(12) United States Patent
Miyamoto et al.

(10) Patent No.: US 8,535,880 B2
(45) Date of Patent: Sep. 17, 2013

(54) ORGAN-SPECIFIC GENE, METHOD FOR IDENTIFYING THE SAME AND USE THEREOF

(75) Inventors: Saku Miyamoto, Osaka (JP); Kenji Takami, Osaka (JP); Akira Horinouchi, Osaka (JP)

(73) Assignee: Takeda Pharmaceutical Company Limited, Osaka (JP)

( * ) Notice: Subject to any disclaimer, the term of this patent is extended or adjusted under 35 U.S.C. 154(b) by 467 days.

(21) Appl. No.: 12/447,446

(22) PCT Filed: Oct. 26, 2007

(86) PCT No.: PCT/JP2007/070944
§ 371 (c)(1),
(2), (4) Date: Apr. 27, 2009

(87) PCT Pub. No.: WO2008/050870
PCT Pub. Date: May 2, 2008

(65) Prior Publication Data
US 2009/0311701 A1    Dec. 17, 2009

(30) Foreign Application Priority Data
Oct. 27, 2006   (JP) ................................ 2006-293324

(51) Int. Cl.
*C12Q 1/68* (2006.01)
(52) U.S. Cl.
USPC ........................................................ 435/6.1
(58) Field of Classification Search
None
See application file for complete search history.

(56) References Cited

U.S. PATENT DOCUMENTS
2009/0048116 A1    2/2009   Miyajima et al.

FOREIGN PATENT DOCUMENTS
JP    2004-135552 A    5/2004
WO    2004/011618 A2   2/2004

OTHER PUBLICATIONS

Deb et al., Reliable classification of two-class cancer data using evolutionary algorithms, BioSystems 72 (2003) 111-129.*
Saito-Hismintao et al. (DNA Res. Apr. 30, 2002;9(2):35-45).*
Miyamoto et al. "Development of custom DNA microarray for cynomolgus monkey and analysis of highly expressing genes in various organs." The Journal of Toxicological Sciences, vol. 31, Supplement, 2006, p. S168 and English-language translation thereof.
"Gene Logic to Idenshi Hatsugen Kaiseki System no Hanbai ni Kanshite Keiyaku Teiketsu." Sep. 9, 2005, [retrieval date: Nov. 7, 2007]   Internet<URL:http://www.gelifesciences.co.jp/company/press/20050909.asp>.

Ringwald et al. "GXD: a Gene Expression Database for the laboratory mouse." Nucleic Acids Research, 1999, vol. 27, No. 1, pp. 106-112. Oxford University Press (1999).
Celis et al. "Gene Expression Profiling: Monitoring Transcription and Translation Products Using DNA Microarrays and Proteomics." FEBS Letter 480 (2000) 23892, pp. 2-16.
Skrabanek et al. "TissueInfo: High-Throughput Identification of Tissue Expression Profiles and Specificity." Nucleic Acids Research, 2001, vol. 29, No. 21, e102, pp. 1-8. Oxford University Press (2001).
Pao et al. "In Silico Identification and Comparative Analysis of Differentially Expressed Genes in Human and Mouse Tissues." BMC Genomics 2006, vol. 7, No. 86, pp. 1-11.
Ferguson et al. "eXPRESSION: An in silico tool to predict patterns of gene expression." Gene Expression Patterns, 2005, vol. 5, pp. 619-628.
International Search Report.
Extended European Search Report issued for European Application No. 07 83 0678, dated Jun. 8, 2010.
Shyamsundar et al., "A DNA Microarray Survey of Gene Expression in Normal Human Tissues", Genome Biology, Biomed Central Ltd., vol. 6, No. 3, Feb. 14, 2005.
Son et al., "Database of mRNA Gene Expression Profiles of Multiple Human Organs", Genome Research, Mar. 2005, pp. 443-450, vol. 15, No. 3, Cold Spring Harbor Laboratory Press.
Giordano et al., "Organ-specific Molecular Classification of Primary Lung, Colon, and Ovarian Adenocarcinomas Using Gene Expression Profiles", The American Journal of Pathology, Oct. 2001, pp. 1231-1238, vol. 159, No. 4.
Higgins et al., "Gene Expression in the Normal Adult Human Kidney Assessed by Complementary DNA Microarray", Molecular Biology of the Cell, Feb. 2004, pp. 649-656, vol. 15, No. 2.
Jeffery et al., "Comparison and Evaluation of Methods for Generating Differentially Expressed Gene Lists from Microarray Data", BMC Bioinformatics, Jul. 26, 2006, vol. 7, No. 1, p. 359.
Wei et al., "Sample Size for Detecting Differentially Expressed Genes in Microarray Experiments", BMC Genomics, Nov. 8, 2004, vol. 5, No. 1, p. 87.
"Gene Logic to Idenshi Hatsugen Kaiseki System no Hanbai ni Kanshite Keiyaku Teiketsu." Sep. 9, 2005, [retrieval date: Nov. 7, 2007],   Internet<URL:http://www.gelifesciences.co.jp/company/press/20050909.asp>?
International Search Report for PCT/JP2007/070944 dated Jan. 15, 2008.

* cited by examiner

*Primary Examiner* — Christopher M. Babic
(74) *Attorney, Agent, or Firm* — Sughrue Mion, PLLC

(57) ABSTRACT

The present invention provides a method of extracting an organ- or tissue-specific highly expressed gene, including:
(1) a step for measuring expression level of a specified gene group for each organ or tissue in 2 or more individuals,
(2) a step for acquiring (a) a minimum value of expression levels in a particular organ or tissue in all individuals, and (b) a maximum value of expression levels in other organs and tissues in all individuals, for each gene, and
(3) a step for extracting the gene as a gene highly expressed specifically in the particular organ or tissue if the above-described (a)/(b) ratio is larger than 1. By the present invention, truly organ- or tissue-specific genes are extracted.

8 Claims, 6 Drawing Sheets

(A)

(B)

ORGAN-SPECIFIC GENE, METHOD FOR IDENTIFYING THE SAME AND USE THEREOF

CROSS-REFERENCE TO RELATED APPLICATION

This application is a 371 of PCT/JP2007/070944, filed Oct. 26, 2007; the entire disclosure of which is incorporated herein by reference.

TECHNICAL FIELD

The present invention relates to a method of identifying organ- or tissue-specific highly expressed genes of various organisms, a set of mouse organ- or tissue-specific highly expressed genes obtained by the method, and a method of identifying an organ or tissue for which no specific highly expressed gene has been obtained, by combining organ- or tissue-specific highly expressed genes identified by the method.

BACKGROUND OF THE INVENTION

In recent years, there has been remarkable progress in regenerative medicine (medical practice). Since a method of establishing human embryonic stem cells (ES cells) was developed, it has been a realistic goal to produce cells/tissues, and even organs themselves, for transplantation from ES cells, as well as from somatic stem cells, including mesenchymal stem cells (MSCs), on an industrial scale using approaches based on cell engineering/embryological engineering. In fact, for the blood, nerves, heart muscle, liver, pancreas and the like, a system for differentiation induction from ES cells is being developed, and a therapeutic technique using ES cells has already been reported.

Meanwhile, an evaluation of the toxicity of a drug to various organs is normally performed by an in vivo toxicity study by compound administration to laboratory animals such as rats; however, such studies are faulty in that (1) several days to several months are taken before onset of the toxicity, (2) a large amount of compound is required, (3) much costs are taken to purchase and maintain laboratory animals, and the like, and, in addition, the radical problem arises that the toxicity in humans is not always reflected.

To quickly predict the presence or absence of toxicity and efficiently optimize a structure in the initial stage of development of a pharmaceutical compound, it is essential to construct an in vitro screening system. In in vitro screening, it is common practice to use a primary culture of a tissue isolated from various organs or a cell line established therefrom; however, primary culture involves the above-described drawback (3) as with in vivo studies; meanwhile, when a cell line is used, problems arise, including the disappearance of the characteristics of the organ or tissue from which the cell line is derived during repeated passage, and the inability to fully reflect the pathology of the organ or tissue as an organic integration thereof on the basis of individual cells. For these reasons, use of a human cell does not always accurately reflect the toxicity in human individuals.

Therefore, there is a major demand for the utilization of tissues/organs that have developed as a result of differentiation induction from stem cells, including ES cells, for toxicity evaluations.

Confirmation of differentiation from stem cells such as ES cells into various cells is usually achieved by, in addition to morphological examination, detecting a product of a gene expressed specifically in the differentiated cell (i.e., differentiation marker gene) at a transcription level (e.g., RT-PCR, microarray analysis and the like) or a translation level (e.g., immunohistological staining and the like). For example, hepatocyte differentiation markers include the albumin gene and the like, and pancreatic β cell differentiation markers include the insulin gene and the like. However, differentiation into albumin-producing cells or insulin-producing cells, if confirmed, does not immediately lead to the conclusion that they are hepatocytes or pancreatic β cells. In fact, a report is available that ES cells were differentiated into insulin-producing cells; however, the resulting cells differed slightly from β cells.

Therefore, to determine whether or not a tissue/organ differentiated from a stem cell such as an ES cell reflects the physiological state of a desired tissue or organ, i.e., whether or not the tissue or organ is exactly the desired tissue or organ, it seems important to comprehensively analyze the expression of a large number of differentiation marker genes, rather than to rely on the expression of a single or several kinds of differentiation marker genes.

Some sets of various tissue/organ-specific genes that can serve as differentiation marker genes have been reported (for example, for human tissue-specific gene sets, see the patent document 1 and the like). However, there are a variety of definitions (criteria) for a specific gene, which have not been unified. For example, the present inventors previously announced that they extracted a crab-eating macaque tissue/organ-specific gene group from results of a comprehensive gene expression analysis in various organs using an independently developed crab-eating macaque DNA microarray (non-patent document 1), wherein a gene whose expression level in a specified tissue (organ) exceeded [the median (50% value) of the expression level in each other tissue/organ]+ [75% value of the expression level in the each other tissue/organ×2] was extracted as a gene highly expressed specifically in the specified tissue (organ). This method of extraction, as a means for comprehensively identifying tissue/organ-specific genes, was better than conventionally known methods; however, even so, the specific highly expressed genes extracted by the method sometimes included those that cannot be said to be truly specific for the tissue (organ).

Patent document 1: JP-A-2004-135552
Non-patent document 1: The Journal of Toxicological Science, Vol. 31 Supplement, page S168, 2006, Title: Development of crab-eating macaque DNA microarray and search for organ-specific highly expressed genes

DISCLOSURE OF THE INVENTION

Problems to Be Solved by the Invention

Accordingly, it is an object of the present invention to provide a method enabling the extraction of a gene group highly expressed truly specifically in a specified tissue or organ, and hence to provide a set of genes highly expressed specifically in the tissue or organ that are useful as differentiation marker genes in regenerative medicine and the like.

Means of Solving the Problems

The present inventors, with the aim of accomplishing the above object, diligently conducted analyses with the use of mouse gene expression data provided by GENE LOGIC™, and found that only a set of genes that are truly specific for a particular organ (tissue) can be acquired by obtaining data on the expression levels of a specified gene group for each organ or tissue in 2 or more individuals, and extracting a certain gene from the gene group as a gene highly expressed specifically in the particular organ (tissue), if the ratio of (a) a minimum value of expression level in the particular organ (tissue) and (b) a maximum value of expression levels in other organs and tissues ((a)/(b)) is larger than 1 in an individual examined for the gene.

Furthermore, the present inventors found that even for an organ or tissue from which no specific highly expressed gene is extracted by the above-described method (referred to as "organ A"), an unidentified organ (tissue) can be identified as the organ A by extracting a gene, if any, wherein the ratio of (a) a minimum value of expression level in the organ A and the expression level in another organ or tissue from which a specific highly expressed gene (referred to as "gene X") has been extracted (referred to as "organ B") and (b) a maximum value of expression levels in organs and tissues other than the organs A and B is larger than 1 in an individual examined, as a gene highly expressed specifically in the organs A and B (referred to as "gene Y"), measuring the expression levels of the genes X and Y in the unidentified organ (tissue), and demonstrating that the expression of the gene X is under the reference value and the expression of the gene Y exceeds the reference value.

The present inventors conducted further investigations based on these findings, demonstrated that in rats, dogs and humans as well, it is possible to extract a set of genes highly expressed specifically in an organ (tissue), and identify an organ (tissue) from which a combination of specific highly expressed genes comprising the set of gene is not extracted, and developed the present invention.

Accordingly, the present invention provides:

[1] a method of extracting an organ- or tissue-specific highly expressed gene, comprising the steps (1) to (3) below;
(1) measuring expression levels of a specified gene group for each organ or tissue in 2 or more individuals,
(2) acquiring, for each gene, (a) a minimum value of expression levels of a particular organ or tissue in all individuals and (b) a maximum value of expression levels in other organs and tissues in all individuals,
(3) extracting the gene as a gene highly expressed specifically in the particular organ or tissue if the above-described (a)/(b) ratio is larger than 1,

[2] the method described in [1] above, wherein the gene is extracted as a gene highly expressed specifically in a particular organ or tissue if the (a)/(b) ratio is 2 or more;

[3] a method of identifying an organ or tissue from which no specific highly expressed gene is extracted by the method described in [1] above, comprising the steps shown below;
(1) acquiring, for each gene, (a) a minimum value of expression levels in the organ or tissue and the expression levels in another particular organ or tissue in which a specific highly expressed gene is present, in all individuals, and (b) a maximum value of expression levels in organs and tissues other than each organ or tissue (a) above, in all individuals,
(2) extracting the gene as a gene highly expressed specifically in each organ or tissue (a) above if the above-described (a)/(b) ratio is larger than 1,
(3) measuring expression levels of (i) a gene highly expressed specifically in the other particular organ or tissue and (ii) the specific highly expressed gene extracted in the above-described (2) in an unidentified organ or tissue,
(4) identifying the unidentified organ or tissue as an organ or tissue from which the specific highly expressed gene is not extracted, with the expression levels of the specific highly expressed genes of the above-described (i) and (ii) as indexes,

[4] the method described in [3] above, wherein the organ or tissue is derived from a mammal;

[5] the method described in [4] above, wherein the organ or tissue is derived from a human or mouse;

[6] an analytical tool for the expression of mouse fat tissue specific genes, comprising 1 or more selected from among 35 kinds of nucleic acids comprising the same or substantially the same base sequence as each base sequence shown by SEQ ID NO:n (n is an integer of 1 to 35) or a partial sequence thereof;

[7] an analytical tool for the expression of mouse urinary bladder specific genes, comprising 1 or more selected from among 36 kinds of nucleic acids comprising the same or substantially the same base sequence as each base sequence shown by SEQ ID NO:n (n is an integer of 36 to 71) or a partial sequence thereof;

[8] an analytical tool for the expression of mouse blood specific genes, comprising 1 or more selected from among 431 kinds of nucleic acids comprising the same or substantially the same base sequence as each base sequence shown by SEQ ID NO:n (n is an integer of 72 to 502) or a partial sequence thereof;

[9] an analytical tool for the expression of mouse bone specific genes, comprising 1 or more selected from among 6 kinds of nucleic acids comprising the same or substantially the same base sequence as each base sequence shown by SEQ ID NO:n (n is an integer of 503 to 508) or a partial sequence thereof;

[10] an analytical tool for the expression of mouse brain specific genes, comprising 1 or more selected from among 246 kinds of nucleic acids comprising the same or substantially the same base sequence as each base sequence shown by SEQ ID NO:n (n is an integer of 509 to 754) or a partial sequence thereof;

[11] an analytical tool for the expression of mouse mammary gland specific genes, comprising 1 or more selected from among 17 kinds of nucleic acids comprising the same or substantially the same base sequence as each base sequence shown by SEQ ID NO:n (n is an integer of 755 to 771) or a partial sequence thereof;

[12] an analytical tool for the expression of mouse colon specific genes, comprising 1 or more selected from among 52 kinds of nucleic acids comprising the same or substantially the same base sequence as each base sequence shown by SEQ ID NO:n (n is an integer of 772 to 823) or a partial sequence thereof;

[13] an analytical tool for the expression of mouse esophagus specific genes, comprising a nucleic acid comprising the same or substantially the same base sequence as the base sequence shown by SEQ ID NO:824 or a partial sequence thereof, and/or a nucleic acid comprising the same or substantially the same base sequence as the base sequence shown by SEQ ID NO:825 or a partial sequence thereof;

[14] an analytical tool for the expression of mouse heart specific genes, comprising 1 or more selected from among 23 kinds of nucleic acids comprising the same or substantially the same base sequence as each base sequence shown by SEQ ID NO:n (n is an integer of 826 to 848) or a partial sequence thereof;

[15] an analytical tool for the expression of mouse liver specific genes, comprising 1 or more selected from among 144 kinds of nucleic acids comprising the same or substantially the same base sequence as each base sequence shown by SEQ ID NO:n (n is an integer of 849 to 992) or a partial sequence thereof;

[16] an analytical tool for the expression of mouse lung specific genes, comprising 1 or more selected from among 143 kinds of nucleic acids comprising the same or substantially the same base sequence as each base sequence shown by SEQ ID NO:n (n is an integer of 993 to 1135) or a partial sequence thereof;

[17] an analytical tool for the expression of mouse pancreas specific genes, comprising 1 or more selected from among 2970 kinds of nucleic acids comprising the same or substantially the same base sequence as each base sequence shown by SEQ ID NO:n (n is an integer of 1136 to 4105) or a partial sequence thereof;

[18] an analytical tool for the expression of mouse spleen specific genes, comprising 1 or more selected from among 195 kinds of nucleic acids comprising the same or substantially the same base sequence as each base sequence shown by SEQ ID NO:n (n is an integer of 4106 to 4300) or a partial sequence thereof;

[19] an analytical tool for the expression of mouse stomach specific genes, comprising 1 or more selected from among 29 kinds of nucleic acids comprising the same or substantially the same base sequence as each base sequence shown by SEQ ID NO:n (n is an integer of 4301 to 4329) or a partial sequence thereof;

[20] an analytical tool for the expression of mouse testis specific genes, comprising 1 or more selected from among 4669 kinds of nucleic acids comprising the same or substantially the same base sequence as each base sequence shown by SEQ ID NO:n (n is an integer of 4330 to 8998) or a partial sequence thereof;

[21] an analytical tool for the expression of mouse thymus specific genes, comprising 1 or more selected from among 141 kinds of nucleic acids comprising the same or substantially the same base sequence as each base sequence shown by SEQ ID NO:n (n is an integer of 8999 to 9139) or a partial sequence thereof;

[22] an analytical tool for the expression of mouse kidney specific genes, comprising 1 or more selected from among 66 kinds of nucleic acids comprising the same or substantially the same base sequence as each base sequence shown by SEQ ID NO:n (n is an integer of 9140 to 9205) or a partial sequence thereof;

[23] an analytical tool for the expression of mouse pancreas and prostate specific genes, comprising a nucleic acid comprising the same or substantially the same base sequence as the base sequence shown by SEQ ID NO:9206 or a partial sequence thereof; and the like.

Effect of the Invention

According to the method of extraction of the present invention, it is possible to extract a set of genes that are highly expressed truly specifically in an organ or tissue. The set of genes highly expressed specifically in an organ (tissue) thus obtained are useful as an organ or tissue differentiation marker. Furthermore, according to the method of identification of the present invention, it is possible to identify an organ or tissue for which no specific highly expressed gene has been obtained.

DETAILED DESCRIPTION OF THE INVENTION

Figure 1:
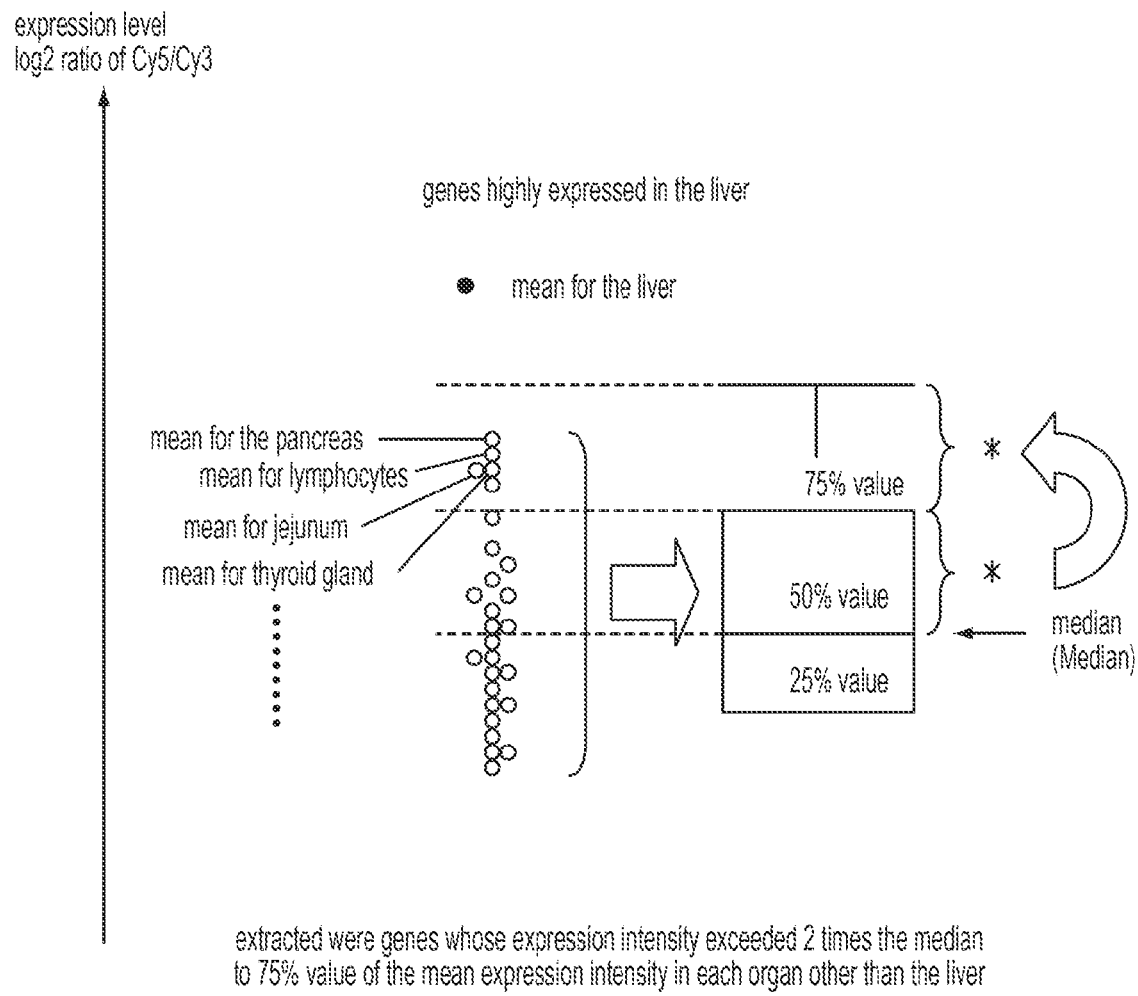
[FIG. 1] A graph showing an outline of a method of extracting organ/tissue-specific genes described in the non-patent document 1.

The present invention provides a novel method of extracting an organ- or tissue-specific highly expressed gene. The method comprises the steps (1) to (3) shown below:

(1) a step for measuring expression levels of a specified gene group for each organ or tissue in 2 or more individuals;

(2) a step for acquiring (a) a minimum value of expression levels in a particular organ or tissue in all individuals, and (b) a maximum value of expression levels in other organs and tissues in all individuals, for each gene; and (3) a step for extracting the gene as a gene highly expressed specifically in the particular organ or tissue if the above-described (a)/(b) ratio is larger than 1.

The subject to which the method of extraction of the present invention is applicable is not particularly limited, as far as it is an organism consisting of 2 or more differentiated tissues, preferably higher animals and plants, more preferably mammals (e.g., humans, monkeys, cattle, horses, pigs, sheep, goats, rabbits, mice, rats, guinea pigs, hamsters and the like), birds such as chickens and domesticated ducks, and the like can be mentioned. Particularly preferred are humans and mice.

The number of organism individuals subjected to the measuring method of the present invention is not particularly limited, as far as it is 2 or more; the expression levels of a gene group are examined for each organ or tissue preferably in 3 or more, more preferably 5 or more, and particularly preferably 10 or more, individuals.

The organ or tissue to be a subject of measurement varies depending on the organism being the subject; in the case of mammals, examples include, but are not limited to, fat tissue, urinary bladder, blood, femoral bone, brain, spinal cord, hypophysis, thyroid, gallbladder, bone marrow, adrenal, skin, blood vessels, mammary gland, colon, esophagus, heart, kidney, liver, lung, pancreas, prostate, skeletal muscle, spleen, stomach, testis, thymus, ovary, placenta, uterus and the like.

Each organ and tissue are obtained by, for example, euthanizing a laboratory animal such as a mouse or a rat by a conventional method, and resecting and isolating the organ and tissue. Meanwhile, for humans, except for some tissues, including blood, no organ or tissue can be collected from a normal living body, so organs and tissues are collected from a deceased individual, patient and the like; in the case of death from disease (illness), a disease-specific change in the expression of a gene is anticipated, so it is desirable, for example, that organs and tissues be collected from a person not suffering from a disease, such as a victim of a traffic accident.

The expression of a specified gene group in an organ or tissue collected can be examined by preparing an RNA (e.g., total RNA, mRNA) fraction from the organ or tissue, and detecting a transcription product of the gene group contained in the fraction. Preparation of an RNA fraction can be performed using a publicly known technique such as the guanidine-CsCl ultracentrifugation method, the AGPC method or the like; a highly pure total RNA can be prepared from a very small amount of sample quickly and conveniently using a commercially available kit for RNA extraction (e.g., RNeasy Mini Kit; manufactured by QIAGEN™, and the like).

As a specified gene group whose expression level is measured in the method of extraction of the present invention, the whole set of genes known to be expressed in the organism being the subject can be mentioned. The number of genes contained in the gene group varies depending on the biological species being the subject, and is, for example, in the case of a mammal such as a human, mouse, rat, or monkey, about 5,000 to about 30,000. For various mammals such as humans, mice, rats, crab-eating macaques, and rhesus monkeys, DNA chips (microarrays) equipped with a probe set for analyzing the expression of such a gene group are commercially available (for example, one manufactured by AFFYMETRIX™ and the like), and they can be utilized.

For example, a cDNA incorporating an appropriate promoter such as the T7 promoter is synthesized from an RNA fraction prepared as described above, by a reverse transcription reaction, and further a cRNA is synthesized using RNA polymerase (in this operation, with the use of a mononucleotide labeled with biotin or the like as the substrate, a labeled cRNA is obtained). By bringing this labeled cRNA into contact with the above-described DNA microarray to cause a hybridization reaction, and measuring the amount of label bound to each probe on the array, the expression level of each gene can be measured.

For example, for humans, mice, rats and the like, analytical data on the expression of gene groups in various organs and tissues acquired using the above-described DNA microarray have been available in databases for restricted access (for example, from GENE LOGIC™ and the like); for such biological species, by accessing the database, and analyzing the data therein, without actually performing a measurement of gene expression as described above, organ- or tissue-specific genes (set) can also be extracted.

As described above, data on the expression level of a specified gene group (for example, the respective genes are given the numbers 1 to n) for each organ or tissue in each individual (number of individuals=m) are obtained.

Next, for a certain gene i out of them, if the ratio of (a) a minimum value of expression levels in a certain organ or tissue A (EXP 1(i/A), ... EXP m(i/A)) (Min[EXP 1–m(i/A)]) and (b) a maximum value of expression levels of the gene i in other organs and tissues (for example, B to Z) (Max[EXP 1–m(i/B–Z)]) ((a)/(b)) is larger than 1 in all individuals examined, the gene i is extracted as a gene highly expressed specifically in the organ or tissue A.

By performing the above-described operation on gene 1 to gene n for each of the organs or tissues A to Z, a set of genes highly expressed specifically in each organ or tissue is extracted.

The (a)/(b) ratio is not particularly limited, as far as it is larger than 1, and it can be set at an optionally chosen level. The higher the value is set, the higher the organ (tissue) specificity is; however, having an excessively high setting is faulty in that no specific highly expressed gene is extracted in many organs (tissues). Preferably, the (a)/(b) ratio can be selected as appropriate in the range of 1.5 or more to 16 or more, more preferably 2 or more to 8 or more.

By the above-described method of extraction (the (a)/(b) ratio was set at 2 or more), (M1) 35 kinds of mouse fat tissue-specific highly expressed genes comprising the base sequences shown by SEQ ID NO:1 to 35, respectively, (M2) 36 kinds of mouse urinary bladder-specific highly expressed genes comprising the base sequences shown by SEQ ID NO:36 to 71, respectively, (M3) 431 kinds of mouse blood-specific highly expressed genes comprising the base sequences shown by SEQ ID NO:72 to 502, respectively, (M4) 6 kinds of mouse bone-specific highly expressed genes comprising the base sequences shown by SEQ ID NO:503 to 508, respectively, (M5) 246 kinds of mouse brain-specific highly expressed genes comprising the base sequences shown by SEQ ID NO:509 to 754, respectively, (M6) 17 kinds of mouse mammary gland-specific highly expressed genes comprising the base sequences shown by SEQ ID NO:775 to 771, respectively, (M7) 52 kinds of mouse colon-specific highly expressed genes comprising the base sequences shown by SEQ ID NO:772 to 823, respectively, (M8) 2 kinds of mouse esophagus-specific highly expressed genes comprising the base sequences shown by SEQ ID NO:824 to 825, respectively, (M9) 23 kinds of mouse heart-specific highly expressed genes comprising the base sequences shown by SEQ ID NO:826 to 848, respectively, (M10) 144 kinds of mouse liver-specific highly expressed genes comprising the base sequences shown by SEQ ID NO:849 to 992, respectively, (M11) 143 kinds of mouse lung-specific highly expressed genes comprising the base sequences shown by SEQ ID NO:993 to 1135, respectively, (M12) 2970 kinds of mouse pancreas-specific highly expressed genes comprising the base sequences shown by SEQ ID NO:1136 to 4105, respectively, (M13) 195 kinds of mouse spleen-specific highly expressed genes comprising the base sequences shown by SEQ ID NO:4106 to 4300, respectively, (M14) 29 kinds of mouse stomach-specific highly expressed genes comprising the base sequences shown by SEQ ID NO:4301 to 4329, respectively, (M15) 4669 kinds of mouse testis-specific highly expressed genes comprising the base sequences shown by SEQ ID NO:4330 to 8998, respectively, (M16) 141 kinds of mouse thymus-specific highly expressed genes comprising the base sequences shown by SEQ ID NO:8999 to 9139, respectively, and (M17) 66 kinds of mouse kidney-specific highly expressed genes comprising the base sequences shown by SEQ ID NO:9140 to 9205, respectively, were obtained.

Likewise, by the above-described method of extraction, (R1) 25 kinds of rat fat-specific highly expressed genes comprising the base sequences shown by SEQ ID NO:9207 to 9231, respectively, (R2) 27 kinds of rat blood-specific highly expressed genes comprising the base sequences shown by SEQ ID NO:9232 to 9258, respectively, (R3) 1 kind of rat duodenum-specific highly expressed gene comprising the base sequence shown by SEQ ID NO:9259, (R4) 4 kinds of rat thymus-specific highly expressed genes comprising the base sequences shown by SEQ ID NO:9260 to 9263, respectively (hereinabove, the (a)/(b) ratio was set at 2 or more), (R5) 3 kinds of rat colon-specific highly expressed genes comprising the base sequences shown by SEQ ID NO:9264 to 9266, respectively, (R6) 4 kinds of rat heart-specific highly expressed genes comprising the base sequences shown by SEQ ID NO:9267 to 9270, respectively (hereinabove, the (a)/(b) ratio was set at 4 or more), (R7) 5 kinds of rat adrenal-specific highly expressed genes comprising the base sequences shown by SEQ ID NO:9271 to 9275, respectively, (R8) 2 kinds of rat urinary bladder-specific highly expressed genes comprising the base sequences shown by SEQ ID NO:9276 to 9277, respectively, (R9) 4 kinds of rat cerebellum-specific highly expressed genes comprising the base sequences shown by SEQ ID NO:9278 to 9281, respectively, (R10) 1 kind of rat esophagus-specific highly expressed gene comprising the base sequence shown by SEQ ID NO:9282, (R11) 10 kinds of rat femoral bone-specific highly expressed genes comprising the base sequences shown by SEQ ID NO:9283 to 9292, respectively, (R12) 2 kinds of rat ileum-specific highly expressed genes comprising the base sequences shown by SEQ ID NO:9293 to 9294, respectively, (R13) 12 kinds of rat kidney-specific highly expressed genes comprising the base sequences shown by SEQ ID NO:9295 to 9306, respectively, (R14) 598 kinds of rat testis-specific highly expressed genes comprising the base sequences shown by SEQ ID NO:9307 to 9904, respectively, (R15) 49 kinds of rat liver-specific highly expressed genes comprising the base sequences shown by SEQ ID NO:9905 to 9953, respectively, (R16) 7 kinds of rat lung-specific highly expressed genes comprising the base sequences shown by SEQ ID NO:9954 to 9960, respectively, (R17) 11 kinds of rat mammary gland-specific highly expressed genes comprising the base sequences shown by SEQ ID NO:9961 to 9971, respectively, (R18) 33 kinds of rat pancreas-specific highly expressed genes comprising the base sequences shown by SEQ ID NO:9972 to 10004, respectively, (R19) 26 kinds of rat prostate-specific highly expressed genes comprising the base sequences shown by SEQ ID NO:10005 to 10030, respectively, (R20) 1 kind of rat skeletal muscle-specific highly expressed gene comprising the base sequence shown by SEQ ID NO:10031, (R21) 1 kind of rat spleen-specific highly expressed genes comprising the base sequence shown by SEQ ID NO:10032, (R22) 10 kinds of rat stomach-specific highly expressed genes comprising the base sequences shown by SEQ ID NO:10033 to 10042, respectively, and (R23) 2 kinds of rat submandibular lymph node-specific highly expressed genes comprising the base sequences shown by SEQ ID NO:10043 to 10044, respectively (hereinabove, the (a)/(b) ratio was set at 8 or more), were obtained.

Likewise, by the above-described method of extraction, (D1) 2 kinds of dog duodenum (mucosa)-specific highly expressed genes comprising the base sequences shown by SEQ ID NO:10056 to 10057, respectively, (D2) 5 kinds of dog stomach (mucosa)-specific highly expressed genes comprising the base sequences shown by SEQ ID NO:10058 to 10062, respectively (hereinabove, the (a)/(b) ratio was set at 2 or more), (D3) 1 kind of dog aorta-specific highly expressed gene comprising the base sequence shown by SEQ ID NO:10063, (D4) 1 kind of dog urinary bladder-specific highly expressed gene comprising the base sequence shown by SEQ ID NO:10064, (D5) 6 kinds of dog kidney (medulla)-specific highly expressed genes comprising the base sequences shown by SEQ ID NO:10065 to 10070, respectively, (D6) 1 kind of dog mesenteric lymph node-specific highly expressed gene comprising the base sequence shown by SEQ ID NO:10071 (hereinabove, the (a)/(b) ratio was set at 4 or more), (D7) 6 kinds of dog fat-specific highly expressed genes comprising the base sequences shown by SEQ ID NO:10072 to 10077, respectively, (D8) 7 kinds of dog adrenal-specific highly expressed genes comprising the base sequences shown by SEQ ID NO:10078 to 10084, respectively, (D9) 10 kinds of dog cerebral cortex-specific highly expressed genes comprising the base sequences shown by SEQ ID NO:10085 to 10094, respectively, (D10) 32 kinds of dog epididymis-specific highly expressed genes comprising the base sequences shown by SEQ ID NO:10095 to 10126, respectively, (D11) 4 kinds of dog heart-specific highly expressed genes comprising the base sequences shown by SEQ ID NO:10127 to 10130, respectively, (D12) 10 kinds of dog kidney (cortex)-specific highly expressed genes comprising the base sequences shown by SEQ ID NO:10131 to 10140, respectively, (D13) 118 kinds of dog liver-specific highly expressed genes comprising the base sequences shown by SEQ ID NO:10141 to 10258, respectively, (D14) 10 kinds of dog lung-specific highly expressed genes comprising the base sequences shown by SEQ ID NO:10259 to 10268, respectively, (D15) 90 kinds of dog pancreas-specific highly expressed genes comprising the base sequences shown by SEQ ID NO:10269 to 10358, respectively, (D16) 3 kinds of dog hypophysis-specific highly expressed genes comprising the base sequences shown by SEQ ID NO:10359 to 10361, respectively, (D17) 24 kinds of dog skeletal muscle-specific highly expressed genes comprising the base sequences shown by SEQ ID NO:10362 to 10385, respectively, (D18) 53 kinds of dog skin-specific highly expressed genes comprising the base sequences shown by SEQ ID NO:10386 to 10438, respectively, (D19) 5 kinds of dog spleen-specific highly expressed genes comprising the base sequences shown by SEQ ID NO:10439 to 10443, respectively, ($D_2O$) 12 kinds of dog stomach (mucosa)-specific highly expressed genes comprising the base sequences shown by SEQ ID NO:10444 to 10455, respectively, (D21) 11 kinds of dog submandibular lymph node-specific highly expressed genes comprising the base sequences shown by SEQ ID NO:10456 to 10466, respectively, (D22) 1303 kinds of dog testis-specific highly expressed genes comprising the base sequences shown by SEQ ID NO:10467 to 11769, respectively, (D23) 2 kinds of dog thymus-specific highly expressed genes comprising the base sequences shown by SEQ ID NO:11770 to 11771, respectively, (D24) 14 kinds of dog thyroid-specific highly expressed genes comprising the base sequences shown by SEQ ID NO:11772 to 11785, respectively, and (D25) 1 kind of dog whole ileum (mucosa+muscle)-specific highly expressed gene comprising the base sequence shown by SEQ ID NO:11786 (hereinabove, the (a)/(b) ratio was set at 8 or more), were obtained.

Likewise, by the above-described method of extraction, (H1) 17 kinds of human aorta-specific highly expressed genes comprising the base sequences shown by SEQ ID NO:11790 to 11806, respectively, (H2) 8 kinds of human hypothalamus-specific highly expressed genes comprising the base sequences shown by SEQ ID NO:11807 to 11814, respectively, (H3) 3 kinds of human right ventricle-specific highly expressed genes comprising the base sequences shown by SEQ ID NO:11815 to 11817, respectively (hereinabove, the (a)/(b) ratio was set at 2 or more), (H4) 1 kind of human urinary bladder-specific highly expressed gene comprising the base sequence shown by SEQ ID NO:11818, (H5) 19 kinds of human cerebrum-specific highly expressed genes comprising the base sequences shown by SEQ ID NO:11819 to 11837, respectively, (H6) 3 kinds of human thalamus-specific highly expressed genes comprising the base sequences shown by SEQ ID NO:11838 to 11840, respectively, (H7) 1 kind of human left ventricle-specific highly expressed gene comprising the base sequence shown by SEQ ID NO:11841 (hereinabove, the (a)/(b) ratio was set at 4 or more), (H8) 8 kinds of human osteous tissue-specific highly expressed genes comprising the base sequences shown by SEQ ID NO:11842 to 11849, respectively, (H9) 3 kinds of human cerebellum-specific highly expressed genes comprising the base sequences shown by SEQ ID NO:11850 to 11852, respectively, (H10) 12 kinds of human kidney-specific highly expressed genes comprising the base sequences shown by SEQ ID NO:11853 to 11864, respectively, (H11) 5 kinds of human liver-specific highly expressed genes comprising the base sequences shown by SEQ ID NO:11865 to 11869, respectively, (H12) 19 kinds of human lung-specific highly expressed genes comprising the base sequences shown by SEQ ID NO:11870 to 11888, respectively, (H13) 45 kinds of human pancreas-specific highly expressed genes comprising the base sequences shown by SEQ ID NO:11889 to 11933, respectively, (H14) 4 kinds of human prostate-specific highly expressed genes comprising the base sequences shown by SEQ ID NO:11934 to 11937, respectively, (H15) 14 kinds of human skeletal muscle-specific highly expressed genes comprising the base sequences shown by SEQ ID NO:11938 to 11951, respectively, (H16) 5 kinds of human skin-specific highly expressed genes comprising the base sequences shown by SEQ ID NO:11952 to 11956, respectively, (H17) 1 kind of human spleen-specific highly expressed gene comprising the base sequence shown by SEQ ID NO:11957, (H18) 10 kinds of human testis-specific highly expressed genes comprising the base sequences shown by SEQ ID NO:11958 to 11967, respectively, (H19) 10 kinds of human thyroid-specific highly expressed genes comprising the base sequences shown by SEQ ID NO:11968 to 11977, respectively, and (H20) 1 kind of human right atrium-specific highly expressed gene comprising the base sequence shown by SEQ ID NO:11978 (hereinabove, the (a)/(b) ratio was set at 8 or more) were obtained.

These organ-(tissue)-specific highly expressed genes, by analyzing the expression thereof, can be utilized for identification of an unidentified organ or tissue (differentiation marker), for evaluation of drug toxicity in a particular organ or tissue (toxicity marker candidate), and for diagnosis of a particular organ disease (disease marker candidate).

Therefore, the present invention also provides an analytical tool for the expression of organ- or tissue-specific genes of mice, rats, dogs or humans, comprising a nucleic acid comprising the same or substantially the same base sequence as the base sequence of one of the above-described organ- or tissue-specific highly expressed genes of the various animals, or a partial sequence thereof.

"Substantially the same base sequence" means a base sequence capable of hybridizing to a nucleic acid consisting of the base sequence shown by each SEQ ID NO under high stringent conditions. Here, "high stringent conditions" means a hybridization reaction at 45° C. in 6×SSC (sodium chloride/sodium citrate) followed by not less than one time of washing at 65° C. in 0.2×SSC/0.1% SDS. For example, as substantially the same base sequence as the base sequence shown by each SEQ ID NO, a base sequence having a homology of 80% or more, preferably 90% or more, more preferably 95% or more, and particularly preferably 98% or more, to the base sequence shown by each SEQ ID NO can be mentioned. Base sequence homology herein can be calculated using the homology calculation algorithm NCBI BLAST (National Center for Biotechnology Information Basic Local Alignment Search Tool) under the following conditions (expectancy=10; gap allowed; filtering=ON; match score=1; mismatch score=−3).

As each nucleic acid that constitutes the analytical tool of the present invention for the expression of organ-(tissue)-specific genes, a nucleic acid (probe) capable of hybridizing specifically to a mouse-, rat-, dog- or human-derived gene transcription product being the subject of detection, a pair of oligonucleotides (primers) capable of functioning as primers that amplify a portion or all of the transcription product and the like can be mentioned. The nucleic acid may be a DNA or an RNA, or a DNA/RNA chimera. Preferably, a DNA can be mentioned.

The nucleic acid used as a probe may be double-stranded or single-stranded. In the case of a double strand, the nucleic acid may be a double-stranded DNA, a double-stranded RNA, or a DNA/RNA hybrid. In the case of a single strand, a sense strand (e.g., in the case of cDNA or CRNA) or an antisense strand (e.g., in the case of mRNA or cDNA) can be selectively used according to the sample supplied. The length of the nucleic acid is not particularly limited, as far as the nucleic acid is capable of hybridizing specifically to a target nucleic acid; for example, the length is about 15 bases or more, preferably about 20 bases or more, and more preferably about 25 bases or more. The nucleic acid is preferably labeled with a labeling agent so as to enable the detection and quantitation of the target nucleic acid. Examples of labeling agents used are radioisotopes, enzymes, fluorescent substances, luminescent substances and the like. Examples of radioisotopes used are [$^{32}$P], [$^{3}$H], [$^{14}$C] and the like. Preferred examples of the enzymes are those that are stable and have a higher specific activity, which include β-galactosidase, β-glucosidase, alkaline phosphatase, peroxidase, malate dehydrogenase and the like. Examples of fluorescent substances used include fluorescamine, fluorescein isothiocyanate and the like. Examples of luminescent substances used are luminol, a luminol derivative, luciferin, lucigenin and the like. Furthermore, a biotin-(strepto)avidin system may be used as well for binding a probe and a labeling agent. Meanwhile, when a nucleic acid to be a probe is immobilized on a solid phase, the nucleic acid in the sample can be labeled using the same labeling agent as that described above.

A set of oligonucleotides used as primers is not particularly limited, as far as they are capable of hybridizing specifically to a sense strand and antisense strand, respectively, of the mouse-derived gene transcription product comprising the base sequence shown by each SEQ ID NO, and capable of amplifying the DNA fragment sandwiched therebetween; for example, a set of oligo-DNAs each having a length of about 15 to about 100 bases, preferably about 15 to about 50 bases, and designed to amplify a DNA fragment about 100 bp to several kbp long, can be mentioned.

A nucleic acid that functions as a probe capable of detecting a mouse-, rat-, dog- or human-derived organ (tissue)-specific gene transcription product can be acquired by amplifying a nucleic acid of desired length by a PCR method using the above-described primer set capable of amplifying a portion or all of the transcription product of the gene, with a cDNA or genomic DNA derived from the organ (tissue) of any of the aforementioned animals as the template, or by cloning the above-described organ-(tissue)-specific highly expressed gene or cDNA from the organ-(tissue)-derived cDNA or genomic DNA library by colony or plaque hybridization and the like, and using as required a restriction endonuclease and the like, to obtain a fragment of appropriate length. The hybridization can be performed according to, for example, a method described in MOLECULAR CLONING, 2nd edition and the like. When a commercially available library is used, hybridization can be performed according to the method described in the instruction manual attached to the library. Alternatively, the nucleic acid can be obtained by chemically synthesizing a portion or all of the base sequence and/or a sequence complementary thereto using a commercially available automated DNA/RNA synthesizer and the like, on the basis of base sequence information on each of the products of mouse-, rat-, dog- or human-derived organ-(tissue)-specific highly expressed genes (for example, in the case of mouse, the base sequences shown by SEQ ID NO:1 to 9205). By directly synthesizing the nucleic acid in situ (on chip) on a solid phase such as silicon or glass and the like, it is also possible to prepare a chip (array) on which the nucleic acid is immobilized.

The analytical tool of the present invention for the expression of genes specific for various mouse, rat, dog or human organs (tissues) comprises a set of nucleic acids capable of detecting a transcription product of at least 1 kind, preferably 2 kinds or more, of genes selected from the group consisting of genes highly expressed specifically in the various organs (tissues) of the aforementioned various animals. The analytical tool may comprise, in addition to the set of nucleic acids, as an internal standard, 1 kind or more of nucleic acids comprising the same or substantially the same base sequence as the base sequence of the transcription product of the mouse housekeeping gene, or a partial sequence thereof. Here, "substantially the same base sequence" is as defined above. Examples of mouse housekeeping genes include, but are not limited to, β-actin, GAPDH, hexokinase, histone and the like.

These nucleic acids may be supplied in a dry state or a state of alcohol precipitate as a solid, and may be supplied in a state dissolved in water or an appropriate buffer solution (e.g., TE buffer solution and the like). When used as a probe, the nucleic acid may be supplied in a state previously labeled with any one of the above-described labeling substances, and may be supplied separately from a labeling substance and labeled before use.

Alternatively, the nucleic acid can be supplied in a state immobilized on an appropriate solid phase. Examples of solid phases include, but are not limited to, glass, silicon, plastics, nitrocellulose, nylon, polyvinylidene difluoride and the like.

Means of immobilization include, but are not limited to, a method wherein a functional group such as an amino group, an aldehyde group, an SH group or biotin is previously introduced into a nucleic acid, meanwhile, a functional group capable of reacting with the nucleic acid (e.g., aldehyde group, amino group, SH group, streptavidin and the like) is introduced onto a solid phase, and bridging the solid phase and the nucleic acid by the covalent bond between the two functional groups, or a solid phase is coated with a polycation to immobilize a polyanionic nucleic acid by means of an electrostatic bond.

As an example of a preferred embodiment wherein a nucleic acid probe is supplied in a state immobilized on a solid phase, a DNA microarray can be mentioned. A DNA microarray can be prepared by either the AFFYMETRIX™ method, wherein a nucleic acid probe is synthesized for each nucleotide on a substrate (glass, silicon and the like), or the Stanford method, wherein a previously prepared nucleic acid probe is spotted onto a substrate.

To quantitatively analyze the expression of a mouse, rat, dog or human organ-(tissue)-specific gene using a very small amount of RNA sample, it is preferable to use competitive RT-PCR or real-time RT-PCR. Competitive RT-PCR refers to a method wherein a known amount of another template nucleic acid that can be amplified by a set of primers capable of amplifying a desired DNA, as a competitor, is allowed to be present in the reaction liquid, to competitively cause an amplification reaction, and comparing the amount of amplification product, whereby the amount of the desired DNA is calculated. Therefore, when competitive RT-PCR is used, the reagent of the present invention can further comprise, in addition to the above-described primer set, a nucleic acid that is amplified by the primer set to produce an amplification product distinguishable from the desired DNA (for example, an amplification product having a size different from that of the desired DNA, and exhibiting a different migration pattern after restriction endonuclease treatment, and the like). This competitor nucleic acid may be a DNA or an RNA. In the case of a DNA, a cDNA is synthesized from an RNA sample by a reverse transcription reaction, and thereafter a competitor is added, and a PCR is performed; in the case of an RNA, the competitor may be added to the RNA sample in advance and RT-PCR can be performed. In the latter case, because the efficiency of the reverse transcription reaction is also taken into account, the absolute amount of the original mRNA can be estimated.

Meanwhile, because real-time RT-PCR enables monitoring of the amount amplified in PCR in real time, it does not require electrophoresis, and makes it possible to more quickly analyze the expression of a mouse organ-(tissue)-specific gene. Usually, monitoring is performed using various fluorescent reagents. These reagents include a reagent that emits fluorescence by binding to a double-stranded DNA (intercalater), such as SYBR Green I and ethidium bromide, as well as a nucleic acid that can be used as the above-described probe (provided that the nucleic acid hybridizes to the target nucleic acid in the amplification region), modified at both ends thereof with a fluorescent substance (e.g., FAM, HEX, TET, FITC and the like) and a quenching substance (e.g., TAMRA, DABCYL and the like), respectively, and the like.

The present invention also provides a method of analyzing gene expression in a mouse, rat, dog or human, comprising measuring a gene transcription product in a sample derived from any one of the animals using 1 kind or more of the above-described gene analytical tools of the present invention.

For example, a gene analytical tool of the present invention can be used preferably to detect and identify a disease marker gene, a pharmacological action marker gene or a drug toxicity marker gene using various organ samples collected from a disease model animal (mouse, rat, dog) or a drug-dosed animal (mouse, rat, dog or human), or a drug-exposed primary culture of an animal tissue or a culture or established cell derived therefrom, and the like, and to analyze disease mechanisms, pharmacological action mechanisms, and toxicological action mechanisms.

Gene expression in an organ (tissue) sample collected from a mouse, rat, dog or human or a drug-exposed mouse, rat, dog or human cell/tissue sample can be examined by preparing an RNA (e.g., total RNA, mRNA) fraction from the sample, and detecting a transcription product of the marker gene contained in the fraction. Preparation of an RNA fraction can be performed using a publicly known technique such as the guanidine-CsCl ultracentrifugation method, the AGPC method or the like; a highly pure total RNA can be prepared quickly and conveniently from a very small amount of sample using a commercially available kit for RNA extraction (e.g., RNeasy Mini Kit; manufactured by QIAGEN™, and the like). As examples of means of detecting a gene transcription product in an RNA fraction, a method using hybridization (Northern blot, dot blot, DNA chip (microarray) analysis and the like), or a method using a PCR (RT-PCR, competitive PCR, real-time PCR and the like) and the like can be mentioned. Preference is given to quantitative PCR methods such as competitive PCR and real-time PCR because of the ability to detect gene expression changes in a very small amount of sample quickly and conveniently with high accuracy, and to DNA chip (microarray) analysis because of the ability to detect expression changes in a plurality of marker genes at one time, and of the possibility of improving the accuracy by choosing appropriate method of detection and the like.

When Northern blot or dot blot hybridization is used, detection of gene expression can be achieved using the above-described gene analytical tool of the present invention comprising a nucleic acid used as a labeled probe. Specifically, when Northern hybridization is used, by separating an RNA fraction prepared as described above by gel electrophoresis, thereafter transferring the fraction to a membrane such as of nitrocellulose, nylon, or polyvinylidene difluoride, and hybridizing the fraction in a hybridization buffer solution containing the reagent of the present invention or each reagent contained in the kit of the present invention under the above-described "high stringent conditions" and thereafter measuring the amount of label bound to the membrane by an appropriate method for each band, the expression level of each gene can be measured. In the case of dot blot as well, by subjecting a membrane with an RNA fraction spotted thereon to a hybridization reaction in the same manner (performed for each gene), and measuring the amount of label in the spot, the expression level of each gene can be measured.

In the case of DNA chip (microarray) analysis, for example, a cDNA incorporating an appropriate promoter such as the T7 promoter is synthesized from an RNA fraction prepared as described above, by a reverse transcription reaction, and a cRNA is synthesized using RNA polymerase (in this operation, with the use of a mononucleotide labeled with biotin or the like as the substrate, a labeled cRNA is obtained). By bringing this labeled cRNA into contact with the above-described immobilized probe to cause a hybridization reaction, and measuring the amount of label bound to each probe on the solid phase, the expression level of each gene can be measured. The method is increasingly advantageous in terms of rapidity and convenience with the increase in the number of genes detected (hence the number of probes immobilized).

Furthermore, the present invention provides a novel method of identification, even for an organ or tissue from which no specific highly expressed gene is extracted by the above-described method of extraction of the present invention (referred to as A), that makes it possible to identify an unidentified organ or tissue as an organ or tissue A from which the specific highly expressed gene is not extracted.

First, for a certain gene i (i=1 to n), if the ratio of (a) a minimum value of expression levels in the organ or tissue A (EXP 1(i/A), ... EXP m(i/A)) and the expression levels in an organ or tissue from which a set X of specific highly expressed genes has been obtained (referred to as B) (EXP 1(i/B), ... EXP m(i/B)) (Min[EXP 1–m(i/A,B)]), and (b) a maximum value of expression levels of the gene i in organs and tissues other than the organs A and B (for example, C to Z) (Max[EXP 1–m(i/C–Z)]) ((a)/(b)) in all individuals examined (number of individuals=m) is larger than 1, the gene i is extracted as a gene highly expressed specifically in the organs or tissues A and B. By performing this operation for the genes 1 to n, a set Y of genes highly expressed specifically in the organs or tissues A and B is obtained. Here, there is absolutely no overlap between the genes contained in the set X and the genes contained in the set Y. The (a)/(b) ratio, as with the above-described method of extraction of the present invention, can be set at any value chosen as appropriate in the range of not less than 1, preferably 1.5 or more to 16 or more, and more preferably 2 or more to 8 or more.

Next, the expression levels of 1 kind or more genes contained in the set X of genes highly expressed specifically in the organ or tissue B (for example, including genes $x_1$, $x_2$, ... $x_p$) and the expression levels of 1 kind or more genes contained in the set Y of genes highly expressed specifically in the organs or tissues A and B (for example, including genes $y_1$, $y_2$, ... $y_q$), in an unidentified organ or tissue, are measured. The unidentified organ or tissue is not particularly limited, as far as it is derived from the biological species from which the gene groups contained in the sets X and Y are derived; an organ or tissue derived preferably from a mammal, more preferably from a human, dog, rat or mouse, can be mentioned.

As a result, if the expression of the genes contained in X is under the reference value, and the expression of the genes contained in Y is not less than the reference value, the unidentified organ (tissue) should be either the organ A or B, and should not be the organ B, so it can be identified as the organ A.

Here, the "reference value" for the expression level of each gene varies depending on the gene; for example, for a gene $x_i$ contained in the gene set X, a minimum value of expression levels in the organ or tissue B in m (m≧2, preferably m≧5, more preferably m≧10) mammal individuals (Min[EXP 1–m ($x_i$/B)]), or a maximum value of expression level of the gene in organs and tissues other than the organ B (for example, A and C to Z) (Max[EXP 1–m($x_i$/A,C–Z)]) and the like can be mentioned, the latter being more preferable. Meanwhile, for a gene $y_i$ contained in the gene set Y, a minimum value of expression level in the organ or tissue A and the expression level in the organ or tissue B (Min[EXP 1–m($y_i$/A,B)]), or a maximum value of expression level of the gene in organs and tissues other than the organs A and B (for example, C to Z) (Max[EXP 1–m($y_i$/C–Z)]), in m (m≧2, preferably m≧5, more preferably m≧10) mouse individuals and the like can be mentioned, the former being more preferable.

For example, as shown in an Example below, even when the above-described method of extraction of the present invention (the (a)/(b) ratio is 2 or more) is performed, no mouse prostate-specific highly expressed gene is obtained. However, as a gene specific for the mouse pancreas and prostate, a gene comprising the base sequence shown by SEQ ID NO:9206 is extracted. Therefore, by examining the expression of 1 kind or more genes selected from among mouse pancreas-specific highly expressed genes (2970 kinds of genes comprising the base sequences shown by SEQ ID NO:1136 to 4105, respectively) and the mouse pancreas- and prostate-specific highly expressed gene in an unidentified mouse organ or tissue, the mouse organ or tissue can be identified as the pancreas, prostate or any other one. Therefore, the present invention also provides an analytical tool for the expression of (M18) a mouse pancreas- and prostate-specific gene comprising a nucleic acid comprising the same or substantially the same base sequence as the base sequence shown by SEQ ID NO:9206 or a partial sequence thereof. Here, "substantially the same base sequence" are as defined above.

Likewise, by the method of extraction of the present invention, for rats, (R24) 1 kind of rat ileum- and jejunum-specific highly expressed gene comprising the base sequence shown by SEQ ID NO:10045, (R25) 3 kinds of rat mesenteric lymph node- and submandibular lymph node-specific highly expressed genes comprising the base sequences shown by SEQ ID NO:10046 to 10048, respectively, (R26) 1 kind of rat mesenteric lymph node-, submandibular lymph node- and thymus-specific highly expressed gene comprising the base sequence shown by SEQ ID NO:10049 (hereinabove, the (a)/(b) ratio is set at 2 or more), (R27) 1 kind of rat whole cerebral cortex (frontal lobe+parietal lobe+temporal lobe)-specific highly expressed gene comprising the base sequence shown by SEQ ID NO:10050 (the (a)/(b) ratio is 4 or more), (R28) 3 kinds of rat ileum-, jejunum- and duodenum-specific highly expressed genes comprising the base sequences shown by SEQ ID NO:10051 to 10053, respectively and (R29) 2 kinds of rat ileum-, jejunum-, duodenum- and colon-specific highly expressed genes comprising the base sequences shown by SEQ ID NO:10054 to 10055, respectively (hereinabove, the (a)/(b) ratio is set at 8 or more), were obtained. For dogs, (D26) 3 kinds of dog whole duodenum (mucosa+muscle)-specific highly expressed genes comprising the base sequences shown by SEQ ID NO:11787 to 11789, respectively, (the (a)/(b) ratio is 8 or more) were obtained. Furthermore, for humans, (H21) 1 kind of human right atrium- and right ventricle-specific highly expressed gene comprising the base sequence shown by SEQ ID NO:11979 (the (a)/(b) ratio is 2 or more), (H22) 2 kinds of human left ventricle- and right ventricle-specific highly expressed genes comprising the base sequences shown by SEQ ID NO:11980 to 11981, respectively, (the (a)/(b) ratio is 4 or more), (H23) 2 kinds of human left atrium- and right atrium-specific highly expressed genes comprising the base sequences shown by SEQ ID NO:11982 to 11983, respectively, and (H24) 3 kinds of human whole heart (left atrium+right atrium+left ventricle+right ventricle)-specific highly expressed genes comprising the base sequences shown by SEQ ID NO:11984 to 11986, respectively, (hereinabove, the (a)/(b) ratio is set at 8 or more) were obtained.

A nucleic acid comprising the same or substantially the same base sequence as each base sequence shown by each SEQ ID NO given above or a partial sequence thereof can be prepared in the same manner as with a nucleic acid that constitutes another analytical tool for the expression of mouse, rat, dog or human organ- or tissue-specific genes.

In the specification, where bases, amino acids, etc. are denoted by their codes, they are based on conventional codes in accordance with the IUPAC-IUB Commission on Biochemical Nomenclature or by the common codes in the art, examples of which are shown below. For amino acids that may have the optical isomer, L form is presented unless otherwise indicated.

DNA: deoxyribonucleic acid
cDNA: complementary deoxyribonucleic acid
A: adenine
T: thymine
G: guanine
C: cytosine
RNA: ribonucleic acid
mRNA: messenger ribonucleic acid
DATP: deoxyadenosine triphosphate
dTTP: deoxythymidine triphosphate
dGTP: deoxyguanosine triphosphate
dCTP: deoxycytidine triphosphate
ATP: adenosine triphosphate
EDTA: ethylenediaminetetraacetic acid
SDS: sodium dodecyl sulfate The present invention is explained in more detail in the following by referring to Examples, which are not to be construed as limitative.

EXAMPLE 1

Materials and Methods

1. Database Used and Method of Data Extraction

Gene expression data on male C57BL/6 mice were extracted from BioExpress of GENE LOGIC™ on Apr. 21, 2006. The parameters used in the extraction are shown in Table 1. Mouse Genome 430 2.0 Array includes 45101 probe sets.

TABLE 1

Parameter settings at time of extraction of C57BL/6 mouse gene expression data

| Parameter setting in BioExpress | Parameter |
|---|---|
| Donor Species | M. musculus |
| Strain | C57BL/6 |
| Gender | Male |
| Chipset | Mouse430_2 (AFFYMETRIX™, Mouse Genome 430 2.0 Array) |
| Algorithm | MAS5.0 (AFFYMETRIX™) |
| Normalization | AFFYMETRIX™ |
| General Pathologic Category | Normal |
| IVT Labeling Protocol-Mouse430_2 | Double Biotin |

2. Method of Calculating Log-Ratio Values of the Gene Expression Data

The gene expression data extracted were subjected to a logarithmic conversion with the base 2 using the Avadis version 3.3 software program (manufactured by STRAND GENOMICS™). The mean of AFFX-GapdhMur/M32599_5_at, AFFX-GapdhMur/M32599_M_at, and AFFX-GapdhMur/M32599_3_at was subtracted from the value of each probe set, and this was used as the Log-ratio value. Fold change was set at $2^{(log\text{-}ratio\ value)}$.

3. Method of Extracting Tissue-Specific Highly Expressed Genes

Genes highly expressed specifically in various tissues were extracted according to the method described below. Using the gene expression data extracted, the highest Log-ratio value in other organs/tissues was subtracted from the lowest Log-ratio value of gene expression in the organ/tissue of interest; a probe set wherein the difference obtained was not less than 1 (Fold change=2 fold or more) was regarded as the desired tissue-specific highly expressed gene. Hence, the sample giving the lowest gene expression value for the tissue of interest exhibits not less than 2 fold higher expression than the sample giving the highest gene expression value for the other tissues. This was performed on each organ/tissue, and a gene highly expressed specifically in each organ/tissue was extracted. For tissues from which no specific highly expressed gene was obtained, they were combined with other tissues, and the same extraction was performed, whereby genes highly expressed specifically in the combination of organs/tissues were extracted.

[Results]

1. Data Used

The data used were extracted from the gene expression database BioExpress, introduced from GENE LOGIC™. A total of 20 organs/tissues had the data extracted therefrom: fat tissue, urinary bladder, blood, femoral bone, brain, mammary gland, colon, esophagus, heart, kidney (left), kidney (right), liver, lung, pancreas, prostate, skeletal muscle, spleen, stomach, testis, and thymus, the total number of samples being 72. The C57BL/6 mice used were at 39 days to 9 weeks of age; regarding the organs/tissues used, the least number of samples was 1 (pancreas) and the largest number of samples was 5 (fat tissue, prostate, skeletal muscle, testis). In the BioExpress of GENE LOGIC™, samples from other mouse strains are included; however, since the largest number of gene expression data sets (samples) was obtained for each organ from intact C57BL/6 mice, the mouse strain C57BL/6 was adopted.

2. Identification of Genes Highly Expressed Specifically in Various Mouse Organs/Tissues Using the above-described method of extracting a tissue-specific highly expressed gene, genes specifically expressed in various mouse organs/tissues were identified. The number of specific expression probe sets was 35 for fat tissue, 36 for urinary bladder, 431 for blood, 6 for femoral bone, 246 for brain, 17 for mammary gland, 52 for colon, 2 for esophagus, 23 for heart, 0 for kidney (left), 0 for kidney (right), 144 for liver, 143 for lung, 2970 for pancreas, 0 for prostate, 0 for skeletal muscle, 195 for spleen, 29 for stomach, 4669 for testis, and 141 for thymus 141 (Table 2). Since no tissue-specific expression probe set was obtained for kidney (left), kidney (right), prostate and skeletal muscle, the following investigation was performed.

TABLE 2

Numbers of genes highly expressed specifically in various organs/tissues

| Name of organ/tissue | Number of probe sets showing at least 2 folds or more higher expression than in other organs |
|---|---|
| Fat tissue | 35 |
| Urinary bladder | 36 |
| Blood | 431 |
| Femoral bone | 6 |
| Brain | 246 |
| Mammary gland | 17 |
| Colon | 52 |
| Esophagus | 2 |
| Heart | 23 |
| Kidney (left) | 0 |
| Kidney (right) | 0 |
| Liver | 144 |

TABLE 2-continued

Numbers of genes highly expressed specifically in various organs/tissues

| Name of organ/tissue | Number of probe sets showing at least 2 folds or more higher expression than in other organs |
|---|---|
| Lung | 143 |
| Pancreas | 2970 |
| Prostate | 0 |
| Skeletal muscle | 0 |
| Spleen | 195 |
| Stomach | 29 |
| Testis | 4669 |
| Thymus | 141 |

EXAMPLE 2

Figure 2:
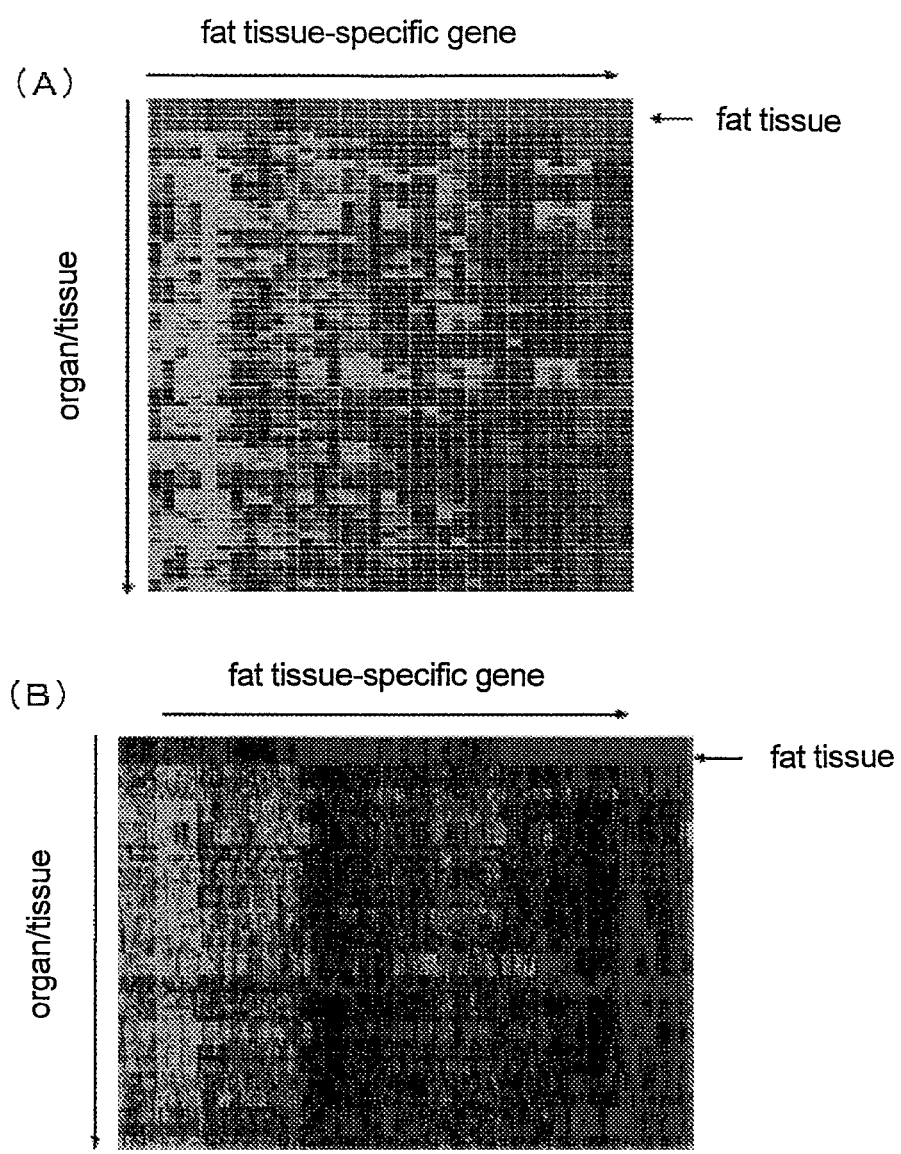
[FIG. 2] A graph showing the expression of the fat tissue specific highly expressed gene groups obtained in Example 1 (A) and Comparative Example (B) in various organs/tissues. Each column indicates a specific highly expressed gene extracted; each line, from the top, indicates each of various organs/tissues: fat tissue (n=5), urinary bladder (n=4), blood (n=2), femoral bone (n=4), brain (n=4), mammary gland (n=3), colon (n=4), esophagus (n=4), heart (n=4), left kidney (n=4), liver (n=4), lung (n=2), pancreas (n=1), prostate (n=5), right kidney (n=4), skeletal muscle (n=5), spleen (n=3), stomach (n=3), testis (n=5), and thymus (n=2).
Figure 3:
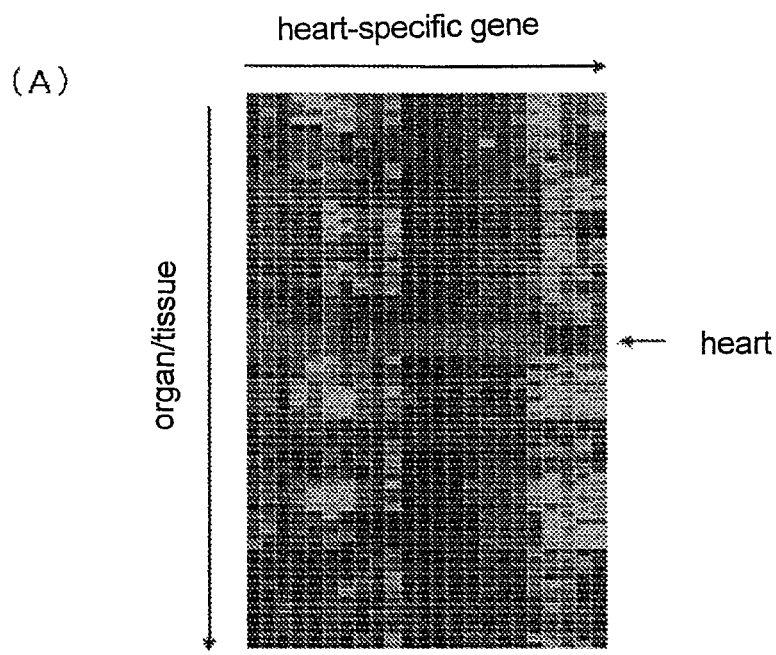
[FIG. 3] A graph showing the expression of the heart fat tissue specific highly expressed gene groups obtained in Example 1 (A) and Comparative Example (B) in various organs/tissues. Each column indicates a specific highly expressed gene extracted; each line, from the top, indicates each of various organs/tissues: fat tissue (n=5), urinary bladder (n=4), blood (n=2), femoral bone (n=4), brain (n=4), mammary gland (n=3), colon (n=4), esophagus (n=4), heart (n=4), left kidney (n=4), liver (n=4), lung (n=2), pancreas (n=1), prostate (n=5), right kidney (n=4), skeletal muscle (n=5), spleen (n=3), stomach (n=3), testis (n=5), and thymus (n=2).
Figure 3:
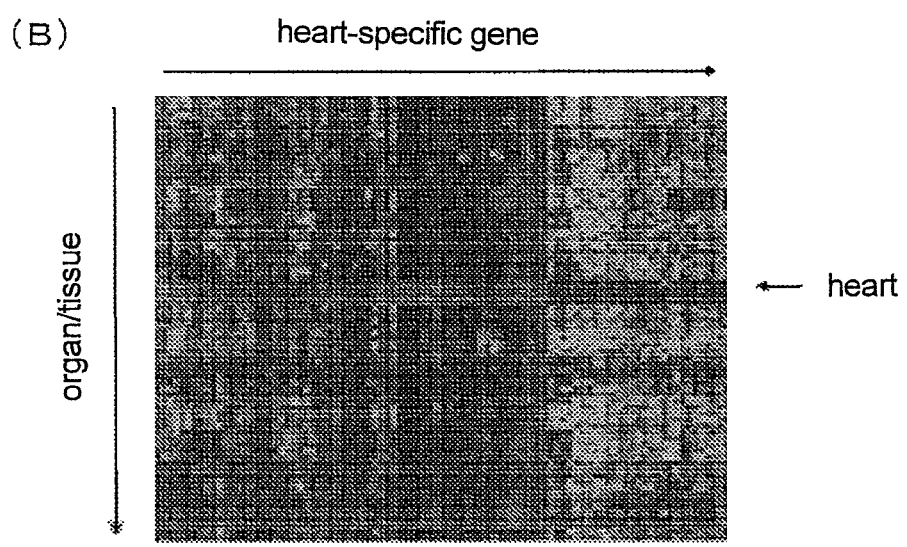
Figure 4:
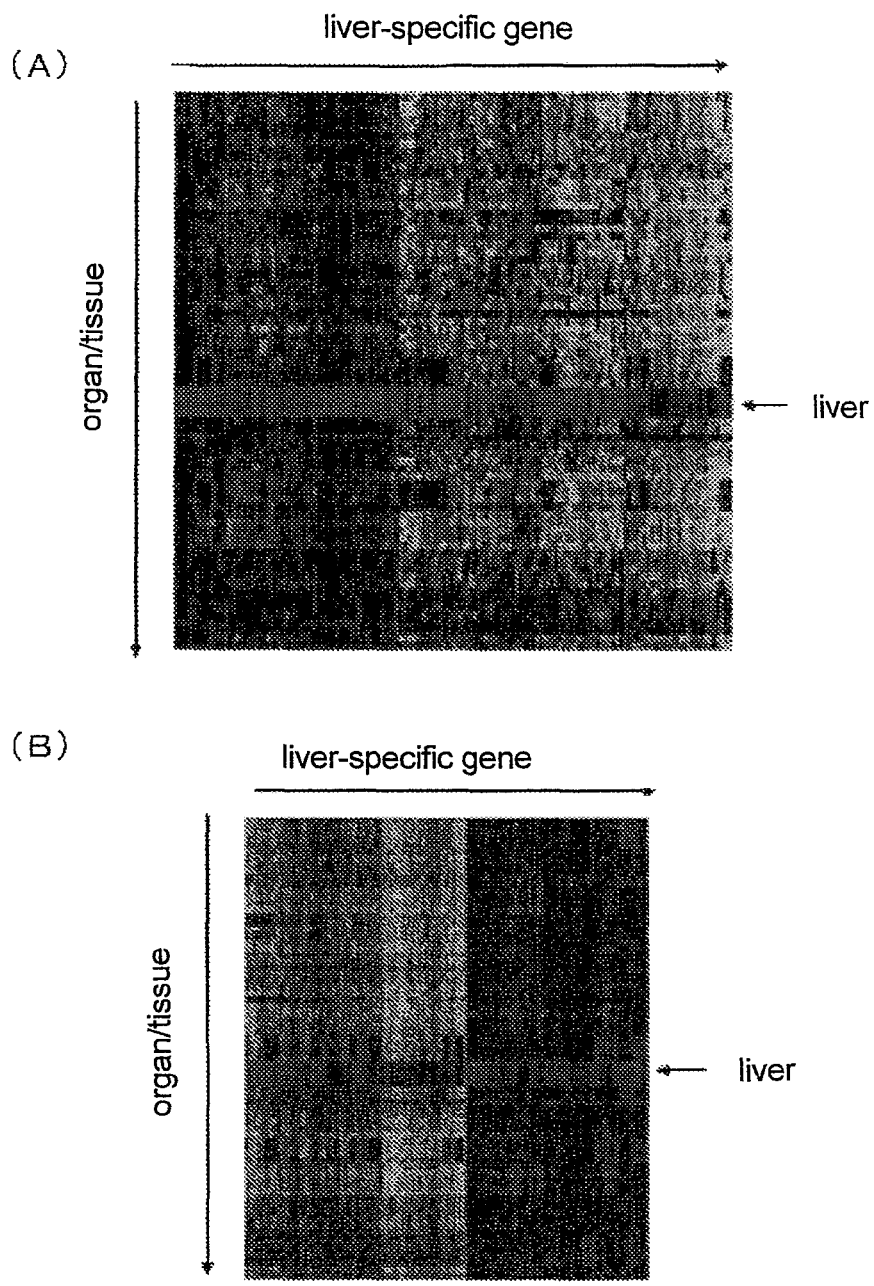
[FIG. 4] A graph showing the expression of the liver specific highly expressed gene groups obtained in Example 1 (A) and Comparative Example (B) in various organs/tissues. Each column indicates a specific highly expressed gene extracted; each line, from the top, indicates each of various organs/tissues: fat tissue (n=5), urinary bladder (n=4), blood (n=2), femoral bone (n=4), brain (n=4), mammary gland (n=3), colon (n=4), esophagus (n=4), heart (n=4), left kidney (n=4), liver (n=4), lung (n=2), pancreas (n=1), prostate (n=5), right kidney (n=4), skeletal muscle (n=5), spleen (n=3), stomach (n=3), testis (n=5), and thymus (n=2).
Figure 5:
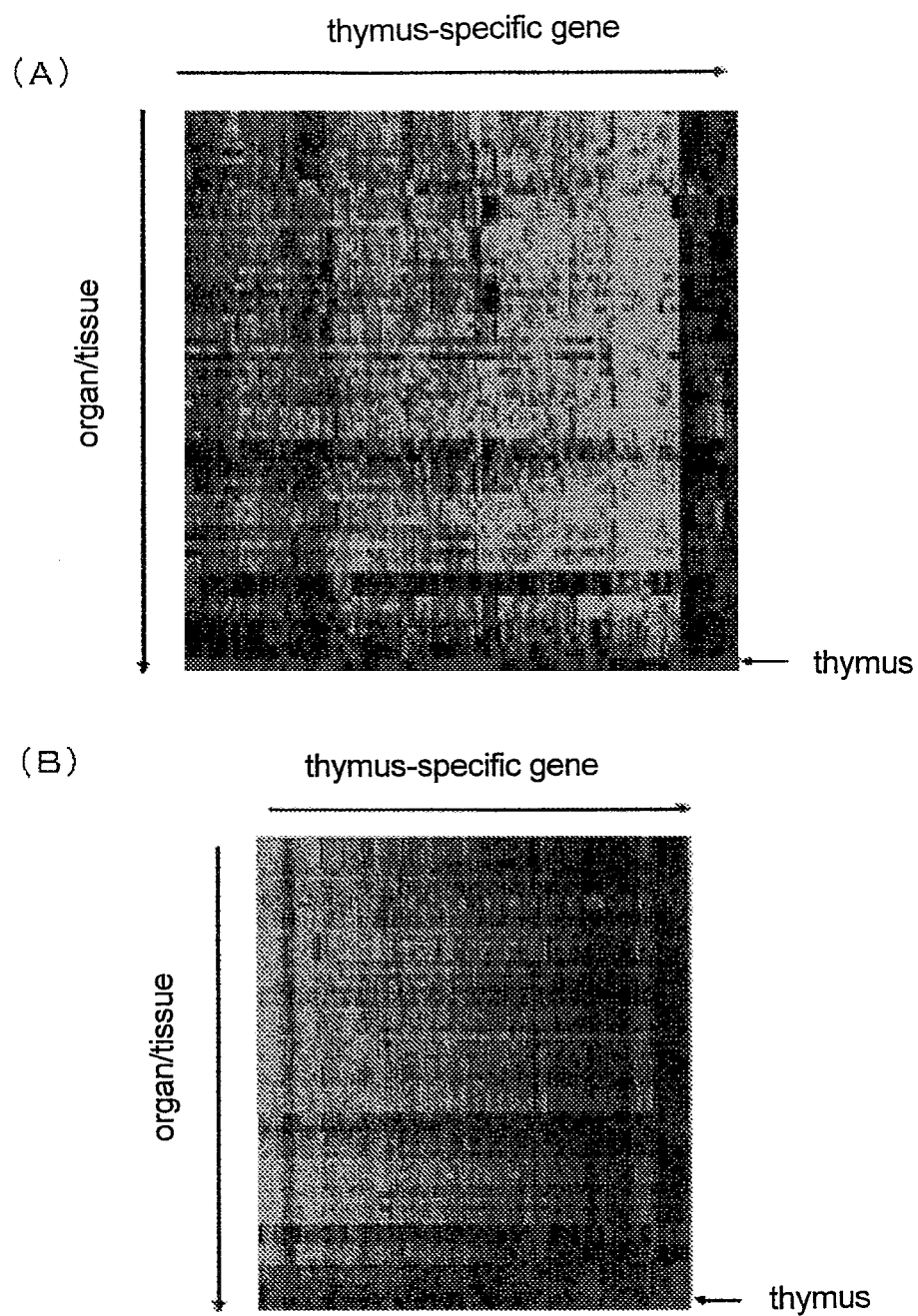
[FIG. 5] A graph showing the expression of the thymus specific highly expressed gene groups obtained in Example 1 (A) and Comparative Example (B) in various organs/tissues. Each column indicates a specific highly expressed gene extracted; each line, from the top, indicates each of various organs/tissues: fat tissue (n=5), urinary bladder (n=4), blood (n=2), femoral bone (n=4), brain (n=4), mammary gland (n=3), colon (n=4), esophagus (n=4), heart (n=4), left kidney (n=4), liver (n=4), lung (n=2), pancreas (n=1), prostate (n=5), right kidney (n=4), skeletal muscle (n=5), spleen (n=3), stomach (n=3), testis (n=5), and thymus (n=2).
Figure 6:
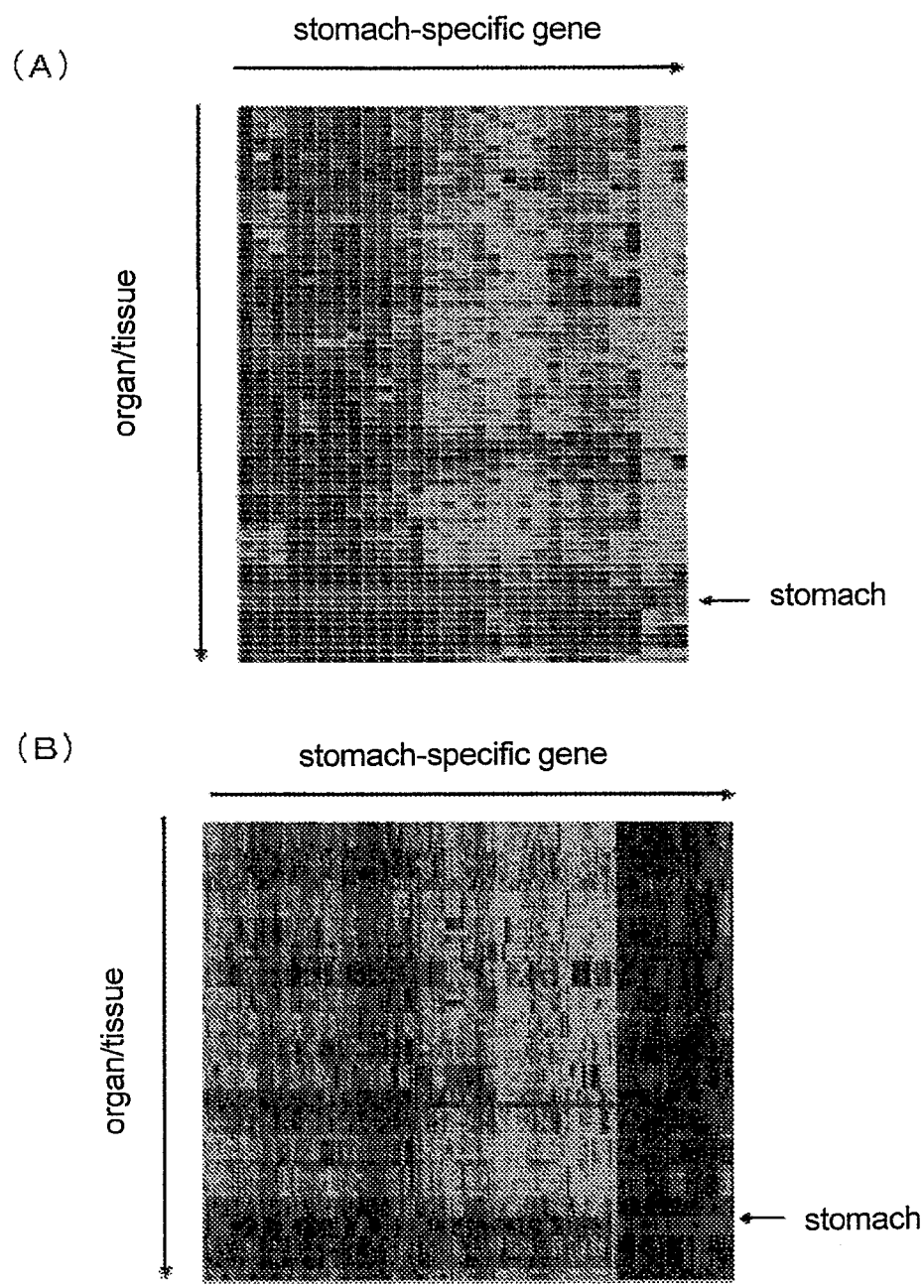
[FIG. 6] A graph showing the expression of the stomach specific highly expressed gene groups obtained in Example 1 (A) and Comparative Example (B) in various organs/tissues. Each column indicates a specific highly expressed gene extracted; each line, from the top, indicates each of various organs/tissues: fat tissue (n=5), urinary bladder (n=4), blood (n=2), femoral bone (n=4), brain (n=4), mammary gland (n=3), colon (n=4), esophagus (n=4), heart (n=4), left kidney (n=4), liver (n=4), lung (n=2), pancreas (n=1), prostate (n=5), right kidney (n=4), skeletal muscle (n=5), spleen (n=3), stomach (n=3), testis (n=5), and thymus (n=2).

Comparison of Organ/Tissue Specificity with Specific Genes Obtained by Other Method of Extraction The expression of the genes specific for various organs/tissues obtained in Example 1 and the expression of the organ/tissue-specific genes obtained by a method previously published by the present inventors (see the non-patent document 1 and FIG. 1) (Comparative Example) in various mouse organs/tissues were compared by generating heat maps. FIG. 2 shows a comparison of both for a fat tissue-specific gene group, FIG. 3 shows a comparison for a heart-specific gene group, FIG. 4 shows a comparison for a liver-specific gene group, FIG. 5 shows a comparison for a thymus-specific gene group, and FIG. 6 shows a comparison for a stomach-specific gene group (in all graphs, A represents the results from the gene groups obtained in Example 1, and B represents the results from the gene groups obtained in Comparative Example). For all organ/tissue-specific gene groups, almost all of the genes obtained in Example 1 had the expression thereof localized in the organs/tissues, whereas the genes obtained in Comparative Example included a considerable number of genes that were also highly expressed in other organs/tissues. This demonstrates that the method of the present invention of extracting organ/tissue-specific genes is better than the conventional method.

EXAMPLE 3

Identification of Genes Highly Expressed Specifically in Combinations of Organs/Tissues For the kidney (left), kidney (right), prostate and skeletal muscle, for which no specific highly expressed gene was identifiable in Example 1, an attempt was made to identify specific highly expressed genes using combinations with other organs/tissues. As a result, it was found that when the kidney (left) and the kidney (right) were combined, 66 probe sets were expressed specifically in the kidneys (left and right). For the prostate, it was found that when it was combined with the pancreas, 1 probe set was highly expressed specifically in the prostate/pancreas (Table 3). For skeletal muscle, an analysis was attempted after it was combined with the heart, which mainly consists of muscular tissue, or with the prostate, from which no specific gene was acquired when examined alone, but no specific highly expressed gene was acquired.

TABLE 3

Numbers of genes highly expressed specifically in combinations of organs/tissues

| Name of organ/tissue | Number of probe sets showing expression at least 2 folds or more higher than in other organs |
|---|---|
| Kidney (left) + kidney (right) | 66 |
| Pancreas + prostate | 1 |
| Skeletal muscle + heart | 0 |
| Skeletal muscle + prostate | 0 |

EXAMPLE 4

Analysis of Wistar Rat Organ-Specific Highly Expressed Genes

[Materials and Methods]

1. Database Used and Method of Data Extraction

Gene expression data on 13 organs (urinary bladder, cerebellum, colon, cerebral cortex frontal lobe, cerebral cortex parietal lobe, cerebral cortex temporal lobe, esophagus, heart, left kidney, left testis, liver, lung, stomach) from 2-month-old male Wistar rats were extracted from BioExpress of Gene Logic on Jul. 24, 2007. The parameters used in the extraction are shown in Table 4. Fourteen tissues not covered in BioExpress of GENE LOGIC™ (spleen, duodenum, jejunum, ileum, mesenteric lymph node, submandibular lymph node, thymus, pancreas, adrenal, skeletal muscle, mammary gland, femoral bone, prostate, fat tissue) and blood were collected from three 2-month-old male Wistar rats, RNAs were extracted using an RNA extraction kit from QIAGEN™, and RAE230 2.0 Array data were obtained according to the protocol of AFFYMETRIX™. The Rat Genome RAE230 2.0 Array includes 31099 probe sets.

TABLE 4

Parameter settings at time of extraction of Wistar rat gene expression data

| Parameter setting in BioExpress | Parameter |
|---|---|
| Donor Species | R. norvegicus |
| Strain | Wistar |
| Gender | Male |
| Chipset | RAE430_2 (AFFYMETRIX™, Rat Genome 230 2.0 Array) |
| Algorithm | MAS5.0 (AFFYMETRIX™) |
| Normalization | AFFYMETRIX™ |

2. Method of Calculating Log-Ratio Values of Gene Expression Data

The gene expression data extracted were subjected to a logarithmic conversion with the base 2 using the Avadis version 3.3 software program (manufactured by STRAND GENOMICS™). The value of 1367557_s_at, which is a probe set for GAPDH, was subtracted from the value of each probe set, and this value was used as the Log-ratio value. Fold change was set at $2^{(Log\text{-}ratio\ value)}$.

3. Method of Extracting Organ/Tissue-Specific Highly Expressed Genes

Organs/tissue-specific highly expressed genes were extracted according to the method described below. Using the gene expression data extracted, the highest Log-ratio value in other organs/tissues was subtracted from the lowest Log-ratio value of gene expression in the organ/tissue of interest; a probe set wherein the value obtained was not less than 1 (2, or 3) (Fold change=2 (4, or 8) fold or more) was regarded as the desired tissue-specific highly expressed gene. Hence, the sample giving the lowest gene expression value for the tissue of interest exhibits not less than 2 (4, or 8) fold higher expression than the sample giving the highest gene expression value for other tissues. This was performed on each organ/tissue, and genes highly expressed specifically in each organ/tissue were extracted. For tissues from which no specific highly expressed gene was obtained, they were combined with other tissues, and the same extraction was performed, whereby genes highly expressed specifically in the combination of organs/tissues were extracted.

[Results]

1. Data Used

The data used were extracted from the gene expression database BioExpress, introduced from GENE LOGIC™, or obtained by performing a microarray analysis on RNAs actually extracted from various rat organs/tissues. A total of 28 organs/tissues had the data extracted therefrom: urinary bladder, cerebellum, colon, cerebral cortex frontal lobe, cerebral cortex parietal lobe, cerebral cortex temporal lobe, esophagus, heart, left kidney, left testis, liver, lung, stomach, spleen, duodenum, jejunum, ileum, mesenteric lymph node, submandibular lymph node, thymus, pancreas, adrenal, skeletal muscle, mammary gland, femoral bone, prostate, fat tissue and blood, the total number of samples being 118. Regarding the organs/tissues used, the least number of samples was 3 and the largest number of samples was 10.

2. Identification of Genes Highly Expressed Specifically in the Various Rat Organs/Tissues Using the above-described method of extracting organ/tissue-specific highly expressed genes, genes specifically expressed in various rat organs/tissues were identified. For Fold changes of larger than 1 fold, 2 folds or more, 4 folds or more and 8 folds or more, the numbers of probe sets expressed specifically in the respective organs/tissues are shown in Table 5(A); the numbers of probe sets expressed specifically in the respective combinations of organs/tissues are shown in Table 5(B).

TABLE 5

| Organ/tissue | Number of samples | Larger than 1 | 2 folds or more | 4 folds or more | 8 folds or more |
|---|---|---|---|---|---|
| | | (A) | | | |
| Fat tissue | 3 | 119 | 25 | 0 | 0 |
| Adrenal | 3 | 145 | 46 | 16 | 5 |
| Urinary bladder | 4 | 88 | 16 | 4 | 2 |
| Blood | 3 | 98 | 27 | 0 | 0 |
| Cerebellum | 10 | 81 | 22 | 12 | 4 |
| Colon | 4 | 38 | 7 | 3 | 0 |
| Cerebral cortex frontal lobe | 7 | 2 | 0 | 0 | 0 |
| Cerebral cortex parietal lobe | 9 | 0 | 0 | 0 | 0 |
| Cerebral cortex temporal lobe | 7 | 0 | 0 | 0 | 0 |
| Duodenum | 3 | 10 | 1 | 0 | 0 |
| Esophagus | 4 | 49 | 16 | 6 | 1 |
| Femoral bone | 3 | 57 | 24 | 18 | 10 |
| Heart | 9 | 35 | 13 | 4 | 0 |
| Ileum | 3 | 174 | 18 | 6 | 2 |
| Jejunum | 3 | 33 | 0 | 0 | 0 |
| Kidney | 3 | 92 | 36 | 21 | 12 |
| Testis | 4 | 3773 | 2028 | 1076 | 598 |
| Liver | 3 | 253 | 162 | 93 | 49 |
| Lung | 4 | 293 | 78 | 26 | 7 |
| Mammary gland | 3 | 265 | 58 | 22 | 11 |

TABLE 5-continued

| Organ/tissue | Number of samples | Fold change | | |
|---|---|---|---|---|
| | | Larger than 1 | 2 folds or more | 4 folds or more | 8 folds or more |
| Mesenteric lymph node | 3 | 256 | 0 | 0 | 0 |
| Pancreas | 3 | 1728 | 333 | 90 | 33 |
| Prostate | 3 | 365 | 107 | 47 | 26 |
| Skeletal muscle | 3 | 102 | 36 | 3 | 1 |
| Spleen | 3 | 102 | 6 | 2 | 1 |
| Stomach | 5 | 40 | 26 | 21 | 10 |
| Submandibular lymph node | 3 | 71 | 6 | 3 | 2 |
| Thymus | 3 | 50 | 4 | 0 | 0 |
| (B) | | | | | |
| Ileum + jejunum | 6 | 48 | 1 | 0 | 0 |
| Mesenteric lymph node + submandibular lymph node | 6 | 185 | 3 | 0 | 0 |
| Ileum + jejunum + skeletal muscle | 9 | 1 | 0 | 0 | 0 |
| Ileum + jejunum + heart | 15 | 0 | 0 | 0 | 0 |
| Ileum + jejunum + skeletal muscle + heart | 18 | 0 | 0 | 0 | 0 |
| Ileum + jejunum + duodenum | 9 | 44 | 12 | 4 | 3 |
| Ileum + jejunum + duodenum + colon | 13 | 50 | 19 | 6 | 2 |
| Ileum + jejunum + duodenum + stomach | 14 | 1 | 0 | 0 | 0 |
| Ileum + jejunum + duodenum + esophagus | 13 | 0 | 0 | 0 | 0 |
| Whole cerebral cortex | 23 | 130 | 21 | 1 | 0 |
| Mesenteric lymph node + submandibular lymph node + thymus | 9 | 44 | 1 | 0 | 0 |

EXAMPLE 5

Analysis of Beagle Dog Organ Specific Highly Expressed Genes

[Materials and Methods]

1. Methods of Data Extraction and Acquisition 12-month-old male beagle dogs were exsanguinated under Nembutal anesthesia, tissues were extirpated, and RNAs were extracted using an RNA extraction kit from QIAGEN™. Using the RNAs extracted, data on Canain ver 2.0Array were obtained according to the protocol of AFFYMETRIX™.

2. Method of Calculating Log-Ratio Values of the Gene Expression Data

The gene expression data extracted were subjected to a logarithmic conversion with the base 2 using the Avadis version 3.3 software program (manufactured by STRAND GENOMICS™). Subtracted from the value of each probe set was a logarithmically converted mean of CfaAffx.23015.1.s1_x_at, CfaAffx.26731.1.s1_x_at and CfaAffx.13010.1.s1_x_at, which are probe sets for GAPDH, and this was used as the Log-ratio value. Fold change was set at $2^{(Log\text{-}ratio\ value)}$.

3. Method of Extracting Organ/Tissue-Specific Highly Expressed Genes

Organ/tissue-specific highly expressed genes were extracted according to the method described below. Using the gene expression data extracted, the highest Log-ratio value in other organs/tissues was subtracted from the lowest Log-ratio value of gene expression in the organ/tissue of interest; a probe set wherein the difference obtained was not less than 1 (2, or 3) (Fold change=2 (4, or 8) fold or more) was regarded as the desired tissue-specific highly expressed gene. Hence, the sample giving the lowest gene expression value for the tissue of interest exhibits not less than 2 (4, or 8) fold higher expression than the sample giving the highest gene expression value for the other tissues. This was performed on each organ/tissue, and a gene highly expressed specifically in each organ/tissue was extracted. For tissues from which no specific highly expressed gene was obtained, they were combined with other tissues, and the same extraction was performed, whereby genes highly expressed specifically in the combination of organs/tissues were extracted.

[Results]

1. Data Used

The data used were obtained by performing a microarray analysis on RNAs extracted from various beagle dog organs/tissues. A total of 35 organs/tissues had the data extracted therefrom: fat, adrenal, aorta, urinary bladder, cecum (mucosa), cecum (muscle), cerebral cortex, colon (mucosa), colon (muscle), duodenum (mucosa), duodenum (muscle), epididymis, heart, ileum (mucosa), ileum (muscle), jejunum (mucosa), jejunum (muscle), kidney (cortex), kidney (medulla), liver, lung, mesenteric lymph node, pancreas, hypophysis, rectum (mucosa), rectum (muscle), skeletal muscle, skin, spleen, stomach (mucosa), stomach (muscle), submandibular lymph node, testis, thymus, and thyroid, the total number of samples being 125. Regarding the organs/tissues used, the least number of samples was 2 and the largest number of is samples was 4.

2. Identification of Genes Highly Expressed Specifically in the Various Organs/Tissues Using the above-described method of extracting organ/tissue-specific highly expressed genes, genes specifically expressed in various beagle dog organs/tissues were identified. When the Fold change was set at larger than 1 fold, 2 folds or more, 4 folds or more and 8 folds or more, the numbers of probe sets expressed specifically in the respective organs/tissues are shown in Table 6(A); the numbers of probe sets expressed specifically in the respective combinations of organs/tissues are shown in Table 6(B).

TABLE 6

| Organ/tissue | Number of samples | Fold change | | |
|---|---|---|---|---|
| | | Larger than 1 | 2 folds or more | 4 folds or more | 8 folds or more |
| (A) | | | | | |
| Fat | 2 | 223 | 52 | 15 | 6 |
| Adrenal | 3 | 112 | 38 | 17 | 7 |
| Aorta | 4 | 180 | 35 | 1 | 0 |
| Urinary bladder | 4 | 5 | 1 | 1 | 0 |
| Cecum (mucosa) | 4 | 0 | 0 | 0 | 0 |
| Cecum (muscle) | 4 | 0 | 0 | 0 | 0 |

TABLE 6-continued

| Organ/tissue | Number of samples | Fold change | | | |
|---|---|---|---|---|---|
| | | Larger than 1 | 2 folds or more | 4 folds or more | 8 folds or more |
| Cerebral cortex | 4 | 437 | 159 | 63 | 10 |
| Colon (mucosa) | 4 | 3 | 0 | 0 | 0 |
| Colon (muscle) | 4 | 0 | 0 | 0 | 0 |
| Duodenum (mucosa) | 2 | 53 | 2 | 0 | 0 |
| Duodenum (muscle) | 3 | 0 | 0 | 0 | 0 |
| Epididymis | 4 | 101 | 65 | 46 | 32 |
| Heart | 4 | 64 | 27 | 15 | 4 |
| Ileum (mucosa) | 4 | 8 | 0 | 0 | 0 |
| Ileum (muscle) | 4 | 0 | 0 | 0 | 0 |
| Jejunum (mucosa) | 3 | 20 | 0 | 0 | 0 |
| Jejunum (muscle) | 4 | 0 | 0 | 0 | 0 |
| Kidney (cortex) | 4 | 140 | 52 | 21 | 10 |
| Kidney (medulla) | 4 | 72 | 16 | 6 | 0 |
| Liver | 4 | 541 | 306 | 181 | 118 |
| Lung | 4 | 313 | 67 | 19 | 10 |
| Mesenteric lymph node | 4 | 77 | 3 | 1 | 0 |
| Pancreas | 2 | 2770 | 824 | 191 | 90 |
| Hypophysis | 4 | 133 | 29 | 8 | 3 |
| Rectum (mucosa) | 3 | 0 | 0 | 0 | 0 |
| Rectum (muscle) | 4 | 2 | 0 | 0 | 0 |
| Skeletal muscle | 4 | 123 | 58 | 38 | 24 |
| Skin | 3 | 412 | 166 | 92 | 53 |
| Spleen | 4 | 461 | 86 | 30 | 5 |
| Stomach (mucosa) | 2 | 194 | 45 | 19 | 12 |
| Stomach (muscle) | 2 | 40 | 5 | 0 | 0 |
| Submandibular lymph node | 4 | 165 | 64 | 28 | 11 |
| Testis | 4 | 6799 | 4070 | 2337 | 1303 |
| Thymus | 4 | 198 | 46 | 14 | 2 |
| Thyroid | 4 | 117 | 33 | 15 | 14 |
| Whole cecum (mucosa + muscle) | 8 | 0 | 0 | 0 | 0 |
| Whole colon (mucosa + muscle) | 8 | 0 | 0 | 0 | 0 |
| Whole duodenum (mucosa + muscle) | 5 | 3 | 3 | 3 | 3 |
| Whole ileum (mucosa + muscle) | 8 | 5 | 2 | 1 | 1 |
| Whole jejunum (mucosa + muscle) | 7 | 0 | 0 | 0 | 0 |
| Whole rectum (mucosa + muscle) | 7 | 0 | 0 | 0 | 0 |
| Stomach (mucosa + muscle) | 4 | 1 | 0 | 0 | 0 |
| Whole mucosa | 22 | 0 | 0 | 0 | 0 |
| Whole muscle | 25 | 0 | 0 | 0 | 0 |
| (B) | | | | | |
| Cecum + rectum (mucosa) | 7 | 0 | 0 | 0 | 0 |
| Cecum + rectum + colon (mucosa) | 11 | 2 | 0 | 0 | 0 |
| Cecum + rectum (muscle) | 8 | 0 | 0 | 0 | 0 |
| Cecum + rectum + colon (muscle) | 12 | 0 | 0 | 0 | 0 |
| Duodenum + ileum + jejunum (mucosa) | 9 | 11 | 0 | 0 | 0 |
| Duodenum + ileum + jejunum (muscle) | 11 | 0 | 0 | 0 | 0 |
| Stomach (mucosa) + submandibular lymph node | 6 | 4 | 0 | 0 | 0 |
| Whole muscle (except ileum) + urinary bladder | 25 | 0 | 0 | 0 | 0 |
| Ileum + jejunum (mucosa) | 7 | 5 | 0 | 0 | 0 |
| Ileum + jejunum (muscle) | 8 | 0 | 0 | 0 | 0 |

EXAMPLE 6

Analysis of Human Organ Specific Highly Expressed Genes

[Materials and Methods]

1. Database Used and Method of Data Extraction

Using GENE LOGIC™ BioExpress, gene expression data on 31 organs or tissues from 35- to 55-year-old men were extracted on Sep. 19, 2007 (fat, aorta, urinary bladder, body of the stomach, osteous tissue, cecum, cerebellum, cerebrum, colon, duodenum, esophagus, heart (left atrium, right atrium, left ventricle, right ventricle), hypothalamus, ileum, jejunum, kidney, liver, lung, pancreas, prostate, rectum, skeletal muscle, skin, spleen, testis, thalamus, thyroid, vein). The organs/tissues used had been confirmed as normal in pathological examination.

2. Method of Calculating Log-Ratio Values of Gene Expression Data

The gene expression data extracted were subjected to a logarithmic conversion with the base 2 using the Avadis version 3.3 software program (manufactured by STRAND GENOMICS)™. Subtracted from the value of each probe set was a logarithmically converted mean of 212581_x_at, 213453_x_at and 217398_x_at, which are probe sets for GAPDH, and this was used as the Log-ratio value. Fold change was set at $2^{(log\text{-}ratio\ value)}$.

3. Method of Extracting Tissue-Specific Highly Expressed Genes

Organ/tissue-specific highly expressed genes were extracted according to the method described below. Using the gene expression data extracted, the highest Log-ratio value in other organs/tissues was subtracted from the lowest Log-ratio value of gene expression in the organ/tissue of interest; a probe set wherein the difference obtained was not less than 1 (2, or 3) (Fold change=2 (4, or 8) fold or more) was regarded as the desired tissue-specific highly expressed gene. Hence, the sample giving the lowest gene expression value for the tissue of interest exhibits not less than 2 (4, or 8) fold higher expression than the sample giving the highest gene expression value for the other tissues. This was performed on each organ/tissue, and a gene highly expressed specifically in each organ/tissue was extracted. For tissues from which no specific highly expressed gene was obtained, they were combined with other tissues, and the same extraction was performed, whereby genes highly expressed specifically in the combination of organs/tissues were extracted.

[Results]

1. Data Used

The data used were extracted from the gene expression database BioExpress, introduced from GENE LOGIC™. A total of 31 organs/tissues had the data extracted therefrom: fat, aorta, urinary bladder, body of the stomach, osteous tissue, cecum, cerebellum, cerebrum, colon, duodenum, esophagus, heart (left atrium, right atrium, left ventricle, right ventricle), hypothalamus, ileum, jejunum, kidney, liver, lung, pancreas, prostate, rectum, skeletal muscle, skin, spleen, testis, thalamus, thyroid, and vein, the total number of samples being 100. Regarding the organs/tissues used, the least number of samples was 1 and the largest number of samples was 9.

2. Identification of Genes Highly Expressed Specifically in Various Organs/Tissues Using the above-described method of extracting organ/tissue-specific highly expressed genes, genes expressed specifically in various human organs/tissues were identified. When the Fold change was set at larger than 1 fold, 2 folds or more, 4 folds or more and 8 folds or more, the numbers of probe sets expressed specifically in the respective organ/tissues are shown in Table 7(A); the numbers of probe sets expressed specifically in the respective combinations of organs/tissues are shown in Table 7(B).

TABLE 7

| Organ/tissue | Number of samples | Larger than 1 | 2 folds or more | 4 folds or more | 8 folds or more |
|---|---|---|---|---|---|
| (A) | | | | | |
| Fat | 2 | 0 | 0 | 0 | 0 |
| Aorta | 1 | 222 | 17 | 0 | 0 |
| Urinary bladder | 1 | 76 | 8 | 1 | 0 |
| Body of the | 3 | 1 | 0 | 0 | 0 |
| Osteous tissue | 1 | 216 | 39 | 16 | 8 |
| Cecum | 3 | 1 | 0 | 0 | 0 |
| Cerebellum | 2 | 442 | 95 | 20 | 3 |
| Cerebrum | 1 | 774 | 108 | 19 | 0 |
| Colon | 6 | 0 | 0 | 0 | 0 |
| Duodenum | 8 | 0 | 0 | 0 | 0 |
| Esophagus | 3 | 0 | 0 | 0 | 0 |
| Hypothalamus | 5 | 49 | 8 | 0 | 0 |
| Ileum | 4 | 0 | 0 | 0 | 0 |
| Jejunum | 5 | 0 | 0 | 0 | 0 |
| Kidney | 7 | 117 | 51 | 29 | 12 |
| Liver | 4 | 113 | 33 | 13 | 5 |
| Lung | 9 | 193 | 45 | 26 | 19 |
| Pancreas | 2 | 864 | 143 | 57 | 45 |
| Prostate | 9 | 17 | 11 | 4 | 4 |
| Rectum | 1 | 18 | 0 | 0 | 0 |
| Skeletal muscle | 8 | 87 | 49 | 23 | 14 |
| Skin | 3 | 55 | 24 | 16 | 5 |
| Spleen | 2 | 419 | 80 | 6 | 1 |
| Testis | 2 | 258 | 79 | 26 | 10 |
| Thalamus | 1 | 245 | 26 | 3 | 0 |
| Thyroid | 1 | 73 | 23 | 11 | 10 |
| Vein | 2 | 8 | 0 | 0 | 0 |
| Left atrium | 1 | 19 | 0 | 0 | 0 |
| Right atrium | 1 | 33 | 1 | 1 | 1 |
| Left ventricle | 1 | 356 | 37 | 1 | 0 |
| Right ventricle | 1 | 64 | 3 | 0 | 0 |
| (B) | | | | | |
| Ileum + jejunum | 9 | 0 | 0 | 0 | 0 |
| Ileum + jejunum + duodenum | 17 | 1 | 0 | 0 | 0 |
| Colon + rectum | 7 | 0 | 0 | 0 | 0 |
| Cecum + colon + rectum | 10 | 0 | 0 | 0 | 0 |
| Stomach + esophagus | 6 | 0 | 0 | 0 | 0 |
| Aorta + vein | 3 | 10 | 0 | 0 | 0 |
| Left atrium + right atrium | 2 | 11 | 7 | 3 | 2 |
| Left ventricle + right ventricle | 2 | 82 | 8 | 2 | 0 |
| Left atrium + left ventricle | 2 | 8 | 0 | 0 | 0 |
| Right atrium + right ventricle | 2 | 16 | 1 | 0 | 0 |
| Whole heart | 4 | 41 | 13 | 5 | 3 |

INDUSTRIAL APPLICABILITY

The method of the present invention for extracting an organ- or tissue-specific gene enables the extraction of a set of truly organ- or tissue-specific highly expressed genes, and is useful as a tool for searching disease markers and toxicity markers in each organ/tissue. The method of the present invention for identifying an unidentified organ or tissue enables the identification of an organ or tissue for which no specific highly expressed gene has been obtained, and is useful in, for example, confirming differentiation in the field of regenerative medicine and the like.

While the present invention has been described with emphasis on preferred embodiments, it is obvious to those skilled in the art that the preferred embodiments can be modified. The present invention intends that the present invention can be embodied by methods other than those described in detail in the present specification. Accordingly, the present invention encompasses all modifications encompassed in the gist and scope of the appended "CLAIMS."

This application is based on patent application No. 2006-293324 filed on Oct. 27, 2006 in Japan, and the contents disclosed therein are hereby entirely incorporated by reference. In addition, the contents disclosed in any publication cited herein, including patents and patent applications, are hereby incorporated in their entireties by reference, to the extent that they have been disclosed herein.

SEQUENCE LISTING (11986 sequences)

SEQ ID NO: 1 - DNA, 327 bp, Mus musculus
gtggtacaaagtgtcacctcagtggctgagaagaccaaggagcaggccaatgccgtgagtgaagctgtggtcagcagcgtcaacacagtggccaacaagaccgtggaggaggctgaaaacatcgtggtcaccaccggggtggtgcgcaaggaggacttggaaccccctgcacaggaccaagaagccaaagagcaagaggagaatgaagaggccaagagtggagaagactagaaggctgccagccaaccacagaggctcaagggacacccctctgccttggaccctgtctcaacctggcacactgaatgccctgcctagagtgccctg

SEQ ID NO: 2 - DNA, 556 bp, Mus musculus
  misc_feature (348)..(348): n is a, c, g, or t
  misc_feature (434)..(434): n is a, c, g, or t
atgtccacaagctttaggcctgggccagctgtggccaaggaatgccatgatagagacggcaaggagcctttccctgaccttctgccatgtcagcatcagggtgacactagacccagccactggcaaacactgggctcagagcctgcagctaagctttccaacagatggcatgagcctcattacatcatgccaagttattggtggctattgaggcaggtggatacaaccaggaggcatgtacccaactcgtgagcccactgggaacacagaagagtggggaagcccctgctgaaagctacagtgagagggggttggggtggtgtggactgcaacactccagcccagagnccgagctgccccagaggcactttgctggtcccacctgggggtccctgcacagctagtgatggatttctgttgggttgtccttagtntctgcttcactcaagctggtagaacaggctactcgctgcactaagagttctgccagcctgtgggtatgagacctgccctgaatcaggtctggctccctatactgctcatggtagccagcacc

SEQ ID NO: 3 - DNA, 398 bp, Mus musculus
  misc_feature (38)..(38): n is a, c, g, or t
  misc_feature (41)..(41): n is a, c, g, or t
  misc_feature (78)..(78): n is a, c, g, or t
  misc_feature (310)..(310): n is a, c, g, or t
ttcactcagccaaaatgagacacttgataaacagtgcntgngcagttgagttttaactaagtaaaccaccatttctangctttagctttccaccatcctccaacccccagggctggagtacaagctgggtccacatgaatcagaaggcagctctctgttctgattttaggttatacccagagtatggaaaaaataaggcatgagaaagcattgacatcttcacttaagaactgaacaaaagagaacaaatattgtcaatgtttggacacttaggatctgaaatcttggaaattttaagacctctttttcnatcagtgtaaaaggaatacaagatagctagttgcaaatgctgaatgcatttcatcattggtcaggtcgataagcgtgtttctgaaata

SEQ ID NO: 4 - DNA, 233 bp, Mus musculus
  misc_feature (56)..(56): n is a, c, g, or t
  misc_feature (77)..(77): n is a, c, g, or t
  misc_feature (93)..(93): n is a, c, g, or t
  misc_feature (100)..(100): n is a, c, g, or t
  misc_feature (106)..(106): n is a, c, g, or t
tgtagttctccacccctgtttttcttaaaattatgtagcccaggctagccttgacnggaactcttatataactaagntttagccatgaactcnggattgntctggncctccacctcctgagttctgggattacaggtgcgcaccaccattcccagtttatatgtggtgctgggatcaaacccaaggccttgtgtatgctaggtaatatccataactaacttaaatcccagctc

SEQ ID NO: 5 - DNA, 434 bp, Mus musculus
  misc_feature (120)..(120): n is a, c, g, or t
  misc_feature (364)..(364): n is a, c, g, or t
agatgtgtgtgcactgttcttgcaaggggcccaaattccgttcccagcatccttattaaggtgctcacaacaatctataactctatctccaggagagccggtgccctcttcaggggcacntaaacttaatgcacataccttcacacagacacatacatataaatacaaaataaaagaactcagcctggcacggtgacacatgactttaatcccagcattggaagtcagaggtagacagatctctgagcatgagtccagcctggtctacagagtgagttccaggacagccatagctatacagagaaaccctgtcttgcaaaacaaaaacaaacaaaccaaaagagagttctttaaagacaaaagnaaagctaaaaatgagtaggcgataagtgtacatttgtttatttctgctgcattccttgagaactgagtaa

SEQ ID NO: 6 - DNA, 443 bp, Mus musculus
tgcacctctaccacatagttcaaagagaaggaggatgggatgcagtcatggactggaaagatgtcctttccggaggggagaagcagagaatgggcatggcgcggatgttttaccataaaccgaagtatgcattgctggatgaatgtaccagtgccgtgagcatcgacgttgaaggaaagatatttcaggctgctattggggctgggatttccctactctccataacacacaggccttctctgtggaaataccacactcatctattacaattcgatggcgaaggaggctggcgctttgaacagttggacactgctatccgtttaacgttgagtgaggaaaagcaaaagttggagtcgcagctcgctggaattcccaaaatgcaacagagactcaacgaactatgcaaaattctgggggaagactcggtgctgaaaacaatccaa

SEQ ID NO: 7 - DNA, 438 bp, Mus musculus
  misc_feature (178)..(178): n is a, c, g, or t
  misc_feature (180)..(180): n is a, c, g, or t
ttaatcaagccttctggagcagagactcaaatgtaaacacagtattctatatggtgtgcagttcttggtttattttcaaactcggtatgtatgttaggctgaactgtgtctttaaacttcaaactcagtgtggacaggcaaaattagcatcaaagagaaaccttgccaatgtgtgtgngngggtggggggaggaactatttcacttgtggagagcatactatgtttgcaacactggagaagatgtgtgtgactgttagacagatgtttaatcataaagcacaggagaacggagtgtgatgctcagttccccaacagcctttggggtattcattgccacacccactgtgtacacaggcgtttgtggcccggctgcctgcgtgtttcgtggctgtagcacggctcttgtccaccctgctgcctttggattgcatttcaag

SEQ ID NO: 8 - DNA, 290 bp, Mus musculus
ccaggcctatcagggtcagagagtctgtcccaacaatagcactggtattcagatccaaaagattccccaggacacgaggcagagtctccccaacatgcaagatacctatgaactgcttggaaactcccagctagctccaaaactgcagggacaaatctcagaagagtataagcaaacagccttgtaaaggaaaggctacgctagtcacagtgagacttacaaaaggctggtttcttgaacatgcgttccagtcccgtgacatgtgaacacataggttcatgcaggtgatg

SEQ ID NO: 9 - DNA, 551 bp, Mus musculus
gaagccgcttatgtgtatcgctcagcgttcagtgtggggctggagacccgcgtcactgttcccaatgtacccattcgctttactaagatcttctacaaccaacagaatcattatgacggcagcactggcaagttctactgcaacattccgggactctactacttctcttaccacatcacggtgtacatgaaagatgtgaaggtgagcctcttcaagaaggacaaggccgttctcttcacctacgaccagtatcaggaaaagaatgtggaccaggcctctggctctgtgctcctccatctggaggtgggagaccaagtctggctccaggtgtatggggatggggaccacaatggactctatgcagataacgtcaacgactctacatttactggctttcttctctaccatgataccaactgactgcaactacccatagcccatacaccaggagaatcatggaacagtcgacacactttcagcttagtttgagagattgattttattgcttagtttgagagtcctgagtattatccacacgtgtactcacttgt

SEQ ID NO: 10 - DNA, 321 bp, Mus musculus
  misc_feature (163)..(163): n is a, c, g, or t
  misc_feature (208)..(208): n is a, c, g, or t
  misc_feature (253)..(253): n is a, c, g, or t
  misc_feature (285)..(285): n is a, c, g, or t
  misc_feature (287)..(287): n is a, c, g, or t
  misc_feature (296)..(296): n is a, c, g, or t
gtatcccaaaagagtctatttaaataactgttatgaggagattctctatattaacatgcaataataagcatgcatacataaatggttcaagacttacattagggaccaatacaatgtatctgcatacattttctatataaatcttaagaaatgaagacagtanaaagattcctagatttacttttgatttcatcatataactaaatgntaaataagacagtactattgattttaaaggaactttgtaattgtncaatgaacaagttttctgacctgactcagttncnataagattnagttaagttattccataaactcatt

SEQ ID NO: 11 - DNA, 316 bp, Mus musculus
  misc_feature (266)..(267): n is a, c, g, or t
ctctctggcatcacagactgatcatcacgggactgtgttgtgtattttgtctcgtggcactcacttaccgtgcagattttctagctccctgaaaggaggacctgaatcttcctggtctttgtaccaccctaaactaccatacttggagatgaatgagcaatataatataagattccagaacacattgtgggttttttgttgttgttgttgttgttgttgttttgttttggtgttgttgttattgttgaatatcatttcatttccannaccgagagtaaaaagttaaatccatgctgttatctctctgattgaccat

SEQ ID NO: 12 - DNA, 450 bp, Mus musculus
  misc_feature (318)..(318): n is a, c, g, or t
  misc_feature (320)..(320): n is a, c, g, or t
  misc_feature (346)..(346): n is a, c, g, or t
  misc_feature (353)..(353): n is a, c, g, or t
  misc_feature (361)..(361): n is a, c, g, or t
  misc_feature (365)..(365): n is a, c, g, or t
  misc_feature (378)..(378): n is a, c, g, or t
gggctccccacagatgaggcacagtccccaaccccagccaatatgttcatggactcacagcttcaacctccctctgtgcctccggagggcctccctgcagacaacagaggagccaggaaggagagctggcactgaccagtggttaacgcagcagagtccttctgcctcagccccggggcccctggctctcccctaggaccaggtccaggatggaggtcccagggcatcagctggcctcacactcaagcagtggtgagcctggagacagagcgtctcaactgtagaacggatgatgccagagagccagtcgggctcaancnaacggtgaactccaaccaacccgggnagctacntctttttnaggnccgtttacaatgnccttgaatatagcaggaaactgaccgggacaaaaccaagtttacaaagaggaccatcacacacattgatagt

SEQ ID NO: 13 - DNA, 517 bp, Mus musculus
ggtgccttggatgccgcagcaaagatgttcagtaaagcctttgacagcggcatcattcccatggagttcgtcaacaagatgaagaaggaggggaagctgatcatgggcatcggccatcgagtaaaatcgataaacaacccagacatgcgagtgcagatcctcaaggacttcgtcaaacagcacttccccgccaccccgctgctcgactatgccctggaagtggagaagattaccacctccaagaagccaaatcttatcctgaatgtggacggcttcatcggcgttgcgtttgtggacatgctcaggaactgtggctccttcacccgggaggaagctgatgaatatgttgacattggagccctcaatggcatctttgtgctaggaaggagtatgggcttcattgggcactaccttgaccagaagaggctgaagcaagggctgtatcgtcacccctgggatgacatttcctatgttcttccagaacacatgagcatgtaactgagccaggagccctact

SEQ ID NO: 14 - DNA, 570 bp, Mus musculus
  misc_feature (369)..(369): n is a, c, g, or t
  misc_feature (396)..(396): n is a, c, g, or t
  misc_feature (415)..(415): n is a, c, g, or t
  misc_feature (440)..(440): n is a, c, g, or t
  misc_feature (442)..(442): n is a, c, g, or t
gagaactaagtcgtaccctctgcatcatttatcctgtggtgtggttgtctctcagttcatccttagttctagctttgggtcaccttttgtcaaagacatagcctttatttaagcatttgtgttgaaggagtcagtgcacccgagacagaaggattctgtgtaacatgccgacagggtgactaaggttctaagttgttcaccctccacagggaagctaaacaaacaaagttcacagcttaagggaccgagatgcagagtgttagtttccaaacttttctatacactgacattctgatttcctgagttcagaagatacttacccagtctgctttacgtttcctgattgttgagaatgcgatcaccattctnaaaggacatgaaatgtgaaacagcatnttcactctacagaaattantcagacaattcatttcatgagggantnatatgggaaagaagcctagaaaattaaatttggcaacaagtgttgtgaaatgtgatttttgttcactcaaaaatagatgaccttttaacacaataactctaagtgaggcctggcctttgacttagatt

SEQ ID NO: 15 - DNA, 295 bp, Mus musculus
aacatggtcaactggagagagttccggtttgttcagtccaaactgggttatctgaccctggtcttgtgcacagcccacactttggtgtatggcggaaagagattcctcagcccgtcgattctaaggtggagcctcccttcggcttatattttggcactcgtcatcccctgcgcagtgctggtgctgaagtgcatcctcatcatgccatgcatagacaagaccctcactcgcatccgccagggcttgggaaagaaactcaaagtacacacaatcagcactgaacggaaaatcggat

SEQ ID NO: 16 - DNA, 456 bp, Mus musculus
  misc_feature (376)..(376): n is a, c, g, or t
  misc_feature (380)..(380): n is a, c, g, or t
  misc_feature (389)..(389): n is a, c, g, or t
  misc_feature (416)..(416): n is a, c, g, or t
tgcccacactcatcatgcagtagacattattatggtggcccccatcataccttggcctgaatcaagacaaccaagcgagcagcatgccacagcaccaactatgtctatgaccatggtgccagagtggttagcactctgtagtagaagaaaaggaggtgggggcttcgggggtctctcacctgggactctgatcactccctcctagcccccagctgcacatgatcatgaggtgtgcgagagagtgttagaggtggagattaactaaagccggcatgccagggatgcagatctggggggtcctcacctgtgccagggatgcagatctggggggtcctcacctgtgccagggagggaccttagggaatgcagatgattntgantcacccagncccctcctgtaagtaacctaaaagctnatagattcaccaagctggacttgggtgaaaccgcggctta

SEQ ID NO: 17 - DNA, 436 bp, Mus musculus
  misc_feature (116)..(116): n is a, c, g, or t
  misc_feature (147)..(147): n is a, c, g, or t
  misc_feature (157)..(157): n is a, c, g, or t
  misc_feature (159)..(159): n is a, c, g, or t
  misc_feature (189)..(189): n is a, c, g, or t
  misc_feature (255)..(255): n is a, c, g, or t
  misc_feature (328)..(328): n is a, c, g, or t
  misc_feature (332)..(332): n is a, c, g, or t
gtgttagtgtttgtgctcagaagtcaccataatcatgaaaataatatactgataataaatctttaacatactacctaaagggaacctgcaataatcttgggggaaaaaaaaaaaangaaagaaaaattcctaatacaggagggaganaaaaaaaaangnaaaaaaaagaaaaaaaagaaaaaaggaagnaacctccagcgtattttatcactacctatagaaagaaatcctgctttgagagtatttgtaatgcgnttttgttgttgtttgttgctgcttctttcactaagaaaaaaaaaaatcccaacaactgagactgcctagcccnccgntcttgtgcgcttttattgtgcttctaaccccagtagagtagaactaaactgcactgaatgtatagttactctgtcttgaattctctgtttatgcaatgtgctcg

SEQ ID NO: 18 - DNA, 484 bp, Mus musculus
  misc_feature (61)..(61): n is a, c, g, or t
  misc_feature (134)..(134): n is a, c, g, or t
  misc_feature (186)..(186): n is a, c, g, or t
  misc_feature (195)..(196): n is a, c, g, or t
  misc_feature (270)..(270): n is a, c, g, or t
  misc_feature (314)..(314): n is a, c, g, or t
  misc_feature (318)..(318): n is a, c, g, or t
  misc_feature (320)..(320): n is a, c, g, or t
  misc_feature (324)..(324): n is a, c, g, or t
  misc_feature (326)..(326): n is a, c, g, or t
  misc_feature (328)..(328): n is a, c, g, or t
  misc_feature (335)..(335): n is a, c, g, or t
  misc_feature (354)..(354): n is a, c, g, or t
  misc_feature (356)..(356): n is a, c, g, or t
  misc_feature (359)..(360): n is a, c, g, or t
  misc_feature (367)..(371): n is a, c, g, or t
  misc_feature (389)..(389): n is a, c, g, or t
  misc_feature (391)..(391): n is a, c, g, or t
  misc_feature (408)..(408): n is a, c, g, or t
  misc_feature (417)..(417): n is a, c, g, or t
  misc_feature (436)..(436): n is a, c, g, or t
  misc_feature (456)..(456): n is a, c, g, or t
  misc_feature (459)..(459): n is a, c, g, or t
tccagaaccgatgactagaccacgaggtgtaagggaaatcttaccaaatgggtttcaccgncctctctctctttccgagagaagttgtctaagacccaccttgaacttcactactacctcagcagctgggacgncaggccacctgtgcttgacggccctgggaggagccctatggccttggaggcntgccagtcnncctgcctatgtttgtgctgtatgcttagggaaaagagagcacccctccctccctttcttcctactgctttcctnaccctgatgatcgacatgttcctccacaaatcactctgtctccnggcntntgtntntntggttantttgagagcaggaatccangnaannaaaaaannnnntttgaggtttcatccctntntcctcactatggctctntaagcaccntcttggaccatctctcacnataggcacaaaacagctctnatntacctcacagttaggacttcaaggt

SEQ ID NO: 19 - DNA, 501 bp, Mus musculus
  misc_feature (26)..(26): n is a, c, g, or t
  misc_feature (44)..(44): n is a, c, g, or t
  misc_feature (71)..(71): n is a, c, g, or t
  misc_feature (85)..(85): n is a, c, g, or t
  misc_feature (166)..(166): n is a, c, g, or t
  misc_feature (170)..(170): n is a, c, g, or t
  misc_feature (172)..(172): n is a, c, g, or t
  misc_feature (290)..(291): n is a, c, g, or t
  misc_feature (344)..(344): n is a, c, g, or t
  misc_feature (373)..(373): n is a, c, g, or t
  misc_feature (394)..(394): n is a, c, g, or t
  misc_feature (415)..(415): n is a, c, g, or t
  misc_feature (434)..(434): n is a, c, g, or t
  misc_feature (462)..(462): n is a, c, g, or t
gattactgggattaaaatactgactnaaaaaacacagagttctnaaaaatacttaagtgcttactaaaatnatttccattaattngaaaaaataatttaatcatggtctgagtcctcagagagcattaaaccagtcaagttattaatgtcaaaagtctgtactttngacntntgggagaacacacgctagcatagcttcagcacttggaaaataaggcaggaagaaagagagttcaaggcaattttaggttaaacaataaaatcctaagaaaaccatcaaaccttacttnnaaataaaaattctattgttaatttatttttacatttaattttcaataatatanatgctaactttataagctgctatataatntctcaccagttgttaattatntcttgtttatataaaattttngtatgtaagaaatgtttgnaaatgactatattatattgatttgaccnaaagaaagtttacagaatcaactgtataacactaaactc

SEQ ID NO: 20 - DNA, 130 bp, Mus musculus
aagaatggccattctggtgatgtcataagaaataatgatagagtgacagacaactcctcccttccaaggtaagaggagagcaaaaacttactacttcctgagctatcgttacatgttaccctttcccagt

SEQ ID NO: 21 - DNA, 294 bp, Mus musculus
cctgcgcagcaagcgtgctgagcaaaaaggaccaccgttgggttgcaaactgccttggagttcggtttgtgtactgctgagaggaccattaaaacgcggagagctacgaagatcctgtagtcccgcccgccctaggccagcgtcaaccccacaactagccaacgatcccagtccgaaatgggggaggttcagaagccctgcgggtcctcccggcccctgagccacagcctggctaacactgacgcctcttagaactgcggcggcgcagtcacacggcaaatcgacacttttcaa

SEQ ID NO: 22 - DNA, 521 bp, Mus musculus
  misc_feature (325)..(325): n is a, c, g, or t
  misc_feature (330)..(330): n is a, c, g, or t
  misc_feature (340)..(340): n is a, c, g, or t
  misc_feature (353)..(353): n is a, c, g, or t
  misc_feature (389)..(389): n is a, c, g, or t
  misc_feature (451)..(451): n is a, c, g, or t
tttctcaggccttggaggaccaggaccggttgctggctggtcagattcatttaagaaccaggatgagtggtgttcattcccacaacacatctcattcagctgcagtggagaaagcactgttagcttttcttgtttgtatgctaaagatttcttttgtcttatgattgttgttttgttttgtttgtttgttttgtaacaaaatgaaattgtccaagggaaggagcctttaaaacaaaagaaccacactttctgcaggatacaagtgtgagctatgcggagcttgcctcctgtccaccctgcccccaacttctctgtagtggtttanccccnaactccccanccttgtcagcagnaaactaaatggtataactaccttttggaaaactganccttaacattttttaaaggggaaacaagagttctctgagtccaatagcatgagctatatttnatagtgatctatttaatactgctgtgagctcttgaggctgttagctccggagcaaccctgtgtagaaagt

SEQ ID NO: 23 - DNA, 557 bp, Mus musculus
accctggtggatggagtagtgttacattaccaagtgcagataaccgatgcctacccgacaggattgctaagtcacggaaattcaagtggcaaagcatcctcagttctcgtgggtaaaaagaagaagaagaaagcagcaggagggggcagcctagtgggggccagtctgcctctgggggactgcagttgaagaagagtggtagaaactatttgcactttctagaaaggcaaggccatttgcttattgcagaaagaacagcttgctgaattcagcttgctctgtgagttactttccataaacttaatctgactgtagtcatttttttctttcatgctttttaattactaagagaaatttggcgacttcaatagctttggtattttgtgtgcaaatcataatagatccagtgtgaaaaaatcaaaatgtcacctgtcactcagtgttagaaaattgcctaaaatgcagtttaataaatgatctttgtaccaaattgtaatgtaaatggggtcattttctgccaggaaaatgtactgtttttatgtttccaactctcctga

SEQ ID NO: 24 - DNA, 172 bp, Mus musculus
  misc_feature (28)..(28): n is a, c, g, or t
  misc_feature (45)..(45): n is a, c, g, or t
  misc_feature (62)..(62): n is a, c, g, or t
  misc_feature (128)..(128): n is a, c, g, or t
  misc_feature (131)..(131): n is a, c, g, or t
ggtcaccttgaaattgattccccagatnctgggaaccagcagtgnccatcttttgcttaatncggtatatcatacatagagcacatatgttcattctaaatcccatttctgggaataccaatacttgntcnatctagaaaattcataatacatacttgtaacgttcaaacac

SEQ ID NO: 25 - DNA, 535 bp, Mus musculus
  misc_feature (52)..(52): n is a, c, g, or t
  misc_feature (347)..(347): n is a, c, g, or t
  misc_feature (493)..(493): n is a, c, g, or t
ctaatttcctgccttgagtggagctatgcaaaaagcaaccactaggcggcancaatagccagcttttggcagaaggtagtctctgcccgctgaggctttggttatttccttttcctgaccatgatggggaacactgtgctcaaggcagcatcaagatggagggggccagggccagtcacaatgctcagataaaatgtcaccatctatgttacagataagtgtgttgaactttctaaaccactaagtcttagcccaactcagaaatccagcagtgaacaagaaaaacatagggtcatgcctatgggccaggggcagcagacagagacatcattggagtcgtttttttnacttctgaattcttgcaatgaacatcttctgttacctgtcgggcaccaagcataatacagggctcttatataatagtttgggtaaaggtgttataaaaacaagagcttatataacattgtagctttgtgtacccaacagtagagtntacgggtcatctcctgagtcttgaccttgtaacttgccatgg

SEQ ID NO: 26 - DNA, 465 bp, Mus musculus
  misc_feature (260)..(260): n is a, c, g, or t
  misc_feature (279)..(279): n is a, c, g, or t
  misc_feature (281)..(282): n is a, c, g, or t
  misc_feature (290)..(290): n is a, c, g, or t
  misc_feature (297)..(297): n is a, c, g, or t
  misc_feature (302)..(302): n is a, c, g, or t
  misc_feature (309)..(309): n is a, c, g, or t
  misc_feature (326)..(326): n is a, c, g, or t
  misc_feature (347)..(347): n is a, c, g, or t
  misc_feature (362)..(362): n is a, c, g, or t
  misc_feature (383)..(383): n is a, c, g, or t
  misc_feature (395)..(396): n is a, c, g, or t
  misc_feature (406)..(406): n is a, c, g, or t
tgataagacatcttactttacttcatgtattcttataattattgaagtttttacctaatcattatttgtataacaatagagaataaatttgatgaaaattgtttccaaaaggaaaagtttctaagtaaaatgcactatatttggtcagtatgtatttattaaggtaaaattttctcatagttactataatgaattaaagtctcattattcaaaatgtcaaaagacatcacccagcagctgttgaaatgcataccatgagnccccacctaagaccagccnanncagtgtantcagctnacatnatccccnagagaaccttgggcttnttacagatacattcctctaanacataaaggatcttnttttatgtttcaatcacttanaaataatttggnnaaacacttanatgttttttaaatataaaagataatgtgtagaaataagcttttcacaatattaactttt

SEQ ID NO: 27 - DNA, 367 bp, Mus musculus
  misc_feature (106)..(107): n is a, c, g, or t
  misc_feature (112)..(113): n is a, c, g, or t
  misc_feature (127)..(127): n is a, c, g, or t
  misc_feature (130)..(130): n is a, c, g, or t
  misc_feature (132)..(132): n is a, c, g, or t
  misc_feature (139)..(139): n is a, c, g, or t
  misc_feature (142)..(142): n is a, c, g, or t
  misc_feature (146)..(146): n is a, c, g, or t
  misc_feature (163)..(163): n is a, c, g, or t
  misc_feature (177)..(177): n is a, c, g, or t
  misc_feature (192)..(192): n is a, c, g, or t
  misc_feature (209)..(209): n is a, c, g, or t
  misc_feature (231)..(231): n is a, c, g, or t
  misc_feature (289)..(289): n is a, c, g, or t
  misc_feature (293)..(293): n is a, c, g, or t
  misc_feature (318)..(318): n is a, c, g, or t
  misc_feature (333)..(333): n is a, c, g, or t
atctgccaaacagcgagatataggaaaagcttatattctgagagcagtgtacgtcagacaacatttaatcattttatggcacttatttctttctctcagtgtcaannttatnnaccttctgtttttnatntngtagatnacnaatnttcgcatcaccaattcnaaaccatttagagnatggtggggagaaanctacatatgtttgatantcatttgcttttagagtggacnatatacttaatgcactttaaccaaggtactattggtttttaaaaggtaaacaacaaancccntgaactgaatgctatacaaatgttntcatatttcatttgnccctatcatgaattgtaacatcaataaacacaag

SEQ ID NO: 28 - DNA, 532 bp, Mus musculus
  misc_feature (28)..(28): n is a, c, g, or t
  misc_feature (109)..(109): n is a, c, g, or t
  misc_feature (116)..(116): n is a, c, g, or t
  misc_feature (126)..(126): n is a, c, g, or t
  misc_feature (145)..(145): n is a, c, g, or t
  misc_feature (166)..(166): n is a, c, g, or t
  misc_feature (185)..(185): n is a, c, g, or t
  misc_feature (195)..(195): n is a, c, g, or t
  misc_feature (251)..(251): n is a, c, g, or t
  misc_feature (289)..(289): n is a, c, g, or t
  misc_feature (328)..(328): n is a, c, g, or t
  misc_feature (330)..(330): n is a, c, g, or t
  misc_feature (346)..(346): n is a, c, g, or t
  misc_feature (358)..(358): n is a, c, g, or t
  misc_feature (365)..(365): n is a, c, g, or t
  misc_feature (408)..(408): n is a, c, g, or t
  misc_feature (417)..(417): n is a, c, g, or t
  misc_feature (452)..(452): n is a, c, g, or t
  misc_feature (462)..(462): n is a, c, g, or t
  misc_feature (472)..(472): n is a, c, g, or t
  misc_feature (477)..(477): n is a, c, g, or t
gaaccaggtactttaagtttgtcatttncgtatttgcccattataaactcaggcagatctaagaattgagtaaagttttcatctttggatcatatgtagattttcctcnttcccanatctgagggnatacatcagcaagtaagcnatgggttattttcccgtaganagaatctataaaaataaantaataaaacngacaaaacaaatgaataaacaaaaaaacacagtttctcacacctgggaaggagctntttttcttatgtttcaatgaggaaagccatctctcctncagatagaggcagttatcacggctgtggtgctaaaatgnantcatcagactgcttanaacattgggagnaaattanagaactttctattttaaaatctccccatgaggtttctgttttntcttgtttntcaaatcacatctaaaatattttgaattgaatgtntctttgatcncaatgatacnatccnagaaatgtgaccacacttaaattcaccttgatggtgtccctgtgatcttgtactt

SEQ ID NO: 29 - DNA, 387 bp, Mus musculus
  misc_feature (26)..(26): n is a, c, g, or t
  misc_feature (227)..(227): n is a, c, g, or t
  misc_feature (235)..(235): n is a, c, g, or t
  misc_feature (251)..(251): n is a, c, g, or t
  misc_feature (267)..(267): n is a, c, g, or t
  misc_feature (303)..(303): n is a, c, g, or t
  misc_feature (314)..(314): n is a, c, g, or t
  misc_feature (329)..(329): n is a, c, g, or t
  misc_feature (334)..(334): n is a, c, g, or t
agtatgtaaaaagatgtcggcttccncaggctcaaatgaatgtacataaggactgtgaaaaaaaaataaattgggttttaaaataagaactgggcgataaattgtatctaaactgcgcagatgggcatcgtcgtgcggctgtgttttcattgttgaaggttgaacagagttctacagagtcgtggatgacattcagatgtttcatgacttttggatctgcgaacatntgcatttnatagtcatgtatactnatattgttaagaaatnatcatattttagaatttagtaagaactcagtgatanccttcataccnaaatgtttaactttnccaanagctagtcataaaaaagtatttattttaaagctttttaatacaattgcataac

SEQ ID NO: 30 - DNA, 570 bp, Mus musculus
  misc_feature (75)..(75): n is a, c, g, or t
  misc_feature (109)..(110): n is a, c, g, or t
  misc_feature (122)..(122): n is a, c, g, or t
  misc_feature (144)..(144): n is a, c, g, or t
  misc_feature (149)..(149): n is a, c, g, or t
  misc_feature (182)..(182): n is a, c, g, or t
  misc_feature (188)..(188): n is a, c, g, or t
  misc_feature (206)..(206): n is a, c, g, or t
  misc_feature (214)..(214): n is a, c, g, or t
  misc_feature (227)..(227): n is a, c, g, or t
  misc_feature (271)..(271): n is a, c, g, or t
  misc_feature (282)..(282): n is a, c, g, or t
  misc_feature (314)..(314): n is a, c, g, or t
  misc_feature (334)..(334): n is a, c, g, or t
  misc_feature (338)..(339): n is a, c, g, or t
  misc_feature (349)..(349): n is a, c, g, or t
  misc_feature (356)..(356): n is a, c, g, or t
  misc_feature (362)..(362): n is a, c, g, or t
  misc_feature (440)..(440): n is a, c, g, or t
  misc_feature (449)..(449): n is a, c, g, or t
  misc_feature (456)..(456): n is a, c, g, or t
  misc_feature (500)..(500): n is a, c, g, or t
  misc_feature (538)..(538): n is a, c, g, or t
attcagtgctttcatcactactgacccttaaatttaactgggatataatgtcaatttaaaaattatgtgagccangcagtggtggcgcacacctttaatcccagcactnnggaggcagaggnaggcggatttctgagttcgagnccagnctggtctacaaagtgagttccaggacagccagngctacncagagaaaccctgtctcnggaaaaanaaaattatgtggnccaggtaaatgtctagaaatggaattgtaggcaaagcagggcanaaggaaaaaantttaagtagatgaataaatatttttaaggcanggaggaatggcagttgcttntctnncaggggtccncgagttnctattnccagcatcacatggtggctcagaactgtgtctaattccagttccagggaatctgacaccctcttctggacttcagganccctgcatncatgaantcctcatacatacatgcagacaaaacattcttaacattaaaaantcaataaatctgaaagatagtaaggatattgaaattgncaatgttgatgttattatcacttattactgtt

SEQ ID NO: 31 - DNA, 262 bp, Mus musculus
  misc_feature (159)..(159): n is a, c, g, or t
  misc_feature (189)..(189): n is a, c, g, or t
  misc_feature (193)..(195): n is a, c, g, or t
  misc_feature (200)..(200): n is a, c, g, or t
  misc_feature (206)..(206): n is a, c, g, or t
  misc_feature (223)..(223): n is a, c, g, or t
  misc_feature (225)..(225): n is a, c, g, or t
aggaccagtctggaaagcaactcaccaggactggctatcaccatggttactgttgcctgcaccagtccagctccatctcatcctgccctggtcaaagacaggctcattattgactggcttgtattccagatatggaaacagacacttagaggcgagatnacagacctccagaccactcttccatccctncttnnngaggntggatncccttcaggagggggantnttcaccccatgttttacaatggagagccagggcttcc

SEQ ID NO: 32 - DNA, 351 bp, Mus musculus
  misc_feature (298)..(298): n is a, c, g, or t
gaagccactgtatgatcggtaccgactagtcaaacagatcctgtcccgggccagcactgtccccatcattggttccccctccagcaaaaggagaagcccttcgctgcagccgattatcgagggtgaaactgcttccttcttcaaggagataaaggaacaagaggagggttcagaagatgacagctccacaaagccagactttgctgtcactttgaaaacagactgcagtgcacattgctttctggaccaacttgaagatgatgctgatggatttatttcaccaatggatgacaaaatnccatcgaaatgcagccaggactcaggcctttcaaacctccactctgcttcaat

SEQ ID NO: 33 - DNA, 518 bp, Mus musculus
  misc_feature (283)..(283): n is a, c, g, or t
  misc_feature (292)..(292): n is a, c, g, or t
  misc_feature (295)..(295): n is a, c, g, or t
  misc_feature (385)..(385): n is a, c, g, or t
  misc_feature (440)..(440): n is a, c, g, or t
  misc_feature (443)..(452): n is a, c, g, or t
  misc_feature (457)..(457): n is a, c, g, or t
  misc_feature (472)..(472): n is a, c, g, or t
aagtgaataactgcagtgccagctccacatcttcattcctcgcacaccagtgacctcgagcttatcttttcagatgtggtcttaaagcagcttgcatcactggcaggcagcagagctccgagagccagtggccatctctccccagagcttccactgaacctctggtactttcttttcattcattgagaccagtcagtgttgaacaggataatcccacttaactcagccacacgacttccaaagcagccaggccactcactaagccagagtgaagcaggccacnggggaaggnggncggcgccctgcagaccaagagtccagcacatcaacaccgaactccacacacgccagagacctccagttttaattacccaatgttacctcnccctgcaccccagcagccatccagagtccagctaaactctaatggcagagcaccngtnnnnnnnnnntgtgnccctcctctgcagancccactttctgagtgtctctcaaccctgtgcggaaactggtattga

SEQ ID NO: 34 - DNA, 254 bp, Mus musculus
  misc_feature (127)..(127): n is a, c, g, or t
ctgtatatatctatgcagttcaattttgtattatgtgtttttgatggaatcttatgtaacacttggtccttgtaaattttgttacgagcaaaaatatcttcttaggttaggtgcaaagtgacaccantgctttgctccttatggatattttggctctgggtataacatagagcttaggaatgctattatgaatttttagtactgtatgcaaaaaatggtggggtttatatacagcatcacttcttgaaatacag

SEQ ID NO: 35 - DNA, 350 bp, Mus musculus
aactaccaatggtggtgctacttaccacacaaagcccaggcttctcagaaaacgtctgtgggagcccagaccagcaagtccgagctgaatgctggccatagttttaggtatattttgtttcaaaacttgggtgtgaatttttgtattcatacttctcaatgagtatgtttatactaatctttagttgctattactagcatatgatatgtctacttattatcaatttactgtatagaaaatacatttggtagtcatgggctggctcagtgggtaaagacacttgccatgtgaacctaaagacctgagcttgatccccagagctcacataactaaccccaccaaattgctgt

SEQ ID NO: 36 - DNA, 332 bp, Mus musculus
ttgctggactggtgccgagccaagacccgcggctacgagcacgtggacatccagaacttctcctccagctggagtgatgggatggccttctgtgccctggtgcacaatttcttccctgaggcttttgactatgggcagctgagcccacaaaaccgacgccagaactttgaaatggccttctcatccgctgagatgctggtggactgtgtacccttggtggaggtggaggacatgatgatcatgggcaaaaagcccgaccccaagtgcgtcttcacctatgtgcaatcgctgtacaaccacctgcggcgccatgagctgcgtttgcgcggcaa

SEQ ID NO: 37 - DNA, 340 bp, Mus musculus
  misc_feature (236)..(238): n is a, c, g, or t
  misc_feature (270)..(270): n is a, c, g, or t
aagctacatggccttcaccaggatgtttttaatagattaagagatgaccaaggtaggccagtcaatccaagccaatatgcacttcagtacagccatgatggaactgttttgattgtacccaaagaactcatctcatcaggccacaaaaaggaagccccaaagggaaagagagagagaagaaactgaatagctccagtgaccagcatcacaaactgtccaactattttaagattttnnnaagtactggtacttgaatcattcagttaattntgatgtttaggaatcaagattatgcttctgtgaagttgggagaatccacatgttcctgcacaattcataa

SEQ ID NO: 38 - DNA, 454 bp, Mus musculus
  misc_feature (146)..(146): n is a, c, g, or t
  misc_feature (150)..(150): n is a, c, g, or t
  misc_feature (152)..(152): n is a, c, g, or t
  misc_feature (160)..(160): n is a, c, g, or t
  misc_feature (171)..(171): n is a, c, g, or t
  misc_feature (178)..(178): n is a, c, g, or t
  misc_feature (192)..(192): n is a, c, g, or t
  misc_feature (195)..(195): n is a, c, g, or t
  misc_feature (212)..(212): n is a, c, g, or t
  misc_feature (243)..(243): n is a, c, g, or t
  misc_feature (349)..(349): n is a, c, g, or t
gcaggacacctctattaaggccagacatgcagtatttaggactgctgctcactacccacagtgcaggcctgatgacctgagtttgatccttggaattcacataaagttaggtgtactctgaccactacatgagtgttggggcatanactntnctcacgcncaaataatggncttaaantacttcagatttgnagnccacatctgcctctatnacacattcatcttcaaacaaaatgcgcaaanccattaaaaacaaaacaaaaagcaaaaaccacttagggcatggtggcccatgtccataatccttgggcttggaaggctgaggcagggctgaccataactccaaggntatctcaccctacccccaacaaccatttaagaaaagtgttcttagcatgaaaaccctacagaagcaggccagggccctttaattctccaactacagtgcttaagg

SEQ ID NO: 39 - DNA, 337 bp, Mus musculus
  misc_feature (58)..(58): n is a, c, g, or t
  misc_feature (83)..(83): n is a, c, g, or t
  misc_feature (230)..(230): n is a, c, g, or t
  misc_feature (259)..(259): n is a, c, g, or t
  misc_feature (268)..(268): n is a, c, g, or t
  misc_feature (281)..(281): n is a, c, g, or t
  misc_feature (284)..(284): n is a, c, g, or t
  misc_feature (288)..(288): n is a, c, g, or t
  misc_feature (294)..(294): n is a, c, g, or t
  misc_feature (297)..(297): n is a, c, g, or t
  misc_feature (299)..(299): n is a, c, g, or t
  misc_feature (302)..(302): n is a, c, g, or t
  misc_feature (305)..(305): n is a, c, g, or t
ctggtcaacatgtccacaggcttggtgcaggaccagacactatggtcagatcccatcnggaccaaccggcccatcccctactnggccatcgacacgtggcccggccggcggagtggaggcatgattgtcatcacgtccattctgggctccctgcccttcttcctgctcgtgggtttcgctggagccatcatcctcagctttgtggacatgggcagttctgatggggaaangacacacgactcacagatcacccaggagnctgttcccnagaccctgggganttntganccttcntantnatntgntgaaccggggcccacccctagacagagcagag

SEQ ID NO: 40 - DNA, 225 bp, Mus musculus
gccaacctaaggcaccagagccttgccaccccaaggcgcctgagccctgccaccctgttgttcccgagccctgcccctcaactgtcactccatcaccataccagcagaagacaaagcagaagtaatattgtccagagccatgcctgaagacctgatcaccagatgctgaggctgctgtctatcctgcttatgagtcccattgccttgtgctaccaatgctgtgac

SEQ ID NO: 41 - DNA, 393 bp, Mus musculus
agtgaagccagtgtgtctgccgaacccaggcatgatgctagacctagaccaggaatgctggatttcggggtggggggccacctatgagaaagggaagacctcggacgtgttgaatgctgccatggtacccttgatcgagccctccaaatgtaatagtaaatacatatacaacaacctaatcacaccagccatgatctgtgccggcttcctccaggggtctgtcgactcttgccagggagacagtggagggccgctggttactttgaagaatgggatctggtggctgattggggacacgagctggggctcgggctgtgccaaggcactcagacctggagtatacgggaacgtgacggtatttacagattggatctaccagcaaatgagggcgaa

SEQ ID NO: 42 - DNA, 143 bp, Mus musculus
tttatttctgtgatattgggttttcactaattgattcatctccctccctcgtgagccttttgtctctccctctagtcattcccagaccgtgagctcaggcccccttcatcatctttgtatgtcattagcagggttcttttaat

SEQ ID NO: 43 - DNA, 308 bp, Mus musculus
aatgcttgactctgttgtgtttctagcactgcacagctagacctcgctggatgataacccatcttgaaaagactgcttccattatcaagcgcatattggcagcacttgaccttataagcagagcccacatatctatttcaggaattcccacagagggcagtccagaaagaagagccacttcgtgctgaagactgggagtccaaaatccagggtgcagacagtgaggcattcctgtcttcatgactaatacagtgagggtatcacatgggcaaaacagaaaatagctaagttccggcatgtggcacatg

SEQ ID NO: 44 - DNA, 433 bp, Mus musculus
taagtcagactttgtggtgcctccatgtcgcgggcgcagggagcttgtgagcgtggtggacagtgggtctggctacaccgtcacaaggctcagcgcatatcaggtgacaaacctaacaccaggaaccaaatactacatatcctaccgagtacagaaggggacgtcgaccgagtccagtccagagactcccatgtccacgcttcctcgaaaaaacatggagtctattgggttaggaatggcccggacaggagggatggtggtcatcacagtgctgctgtctgtggccatgttcctgttggtcgtgggtcttattgttgccctgcactgggatgcccgcaaatgaaaagggctctcctgcatcccaggctcctccaagaagtccagcctgcctcctgccaggctgtagtcactggcttctcagtggcttttcttc

SEQ ID NO: 45 - DNA, 473 bp, Mus musculus
tcacctgagccagaactgcaactgggaaagcagcagcagtcacatgagccggatatggcaggggatcagaaagagaagcagaaacttcataagccagaactgtacctgagaaagcagcagtaccaggagtcacctgacccagagttgtccctgggaaaacagcagcaccaggagtgtcaggaaccagaactgcaattggaagagaagcagcatcagaagccacctgaaccagaactgcacctgggaaagcagcaggagtcacatgagccagatatggcagaggatctggaagagaagcagaaacttggtgagccagaattacacctaggaaagcagcagcagcaacagatagagcgtgaaggttatcaaggaccaaaaagcctgggtcagtcacttaagcaagagaaagcttcaagggaacagcagctagattactcacatctagaacaggagaaggagctctcagaccagcc

SEQ ID NO: 46 - DNA, 517 bp, Mus musculus
  misc_feature (60)..(60): n is a, c, g, or t
  misc_feature (99)..(99): n is a, c, g, or t
  misc_feature (253)..(253): n is a, c, g, or t
  misc_feature (256)..(256): n is a, c, g, or t
  misc_feature (267)..(267): n is a, c, g, or t
  misc_feature (270)..(270): n is a, c, g, or t
  misc_feature (272)..(272): n is a, c, g, or t
  misc_feature (275)..(275): n is a, c, g, or t
  misc_feature (286)..(286): n is a, c, g, or t
  misc_feature (293)..(293): n is a, c, g, or t
  misc_feature (313)..(313): n is a, c, g, or t
  misc_feature (320)..(320): n is a, c, g, or t
  misc_feature (325)..(326): n is a, c, g, or t
  misc_feature (331)..(331): n is a, c, g, or t
  misc_feature (343)..(343): n is a, c, g, or t
  misc_feature (356)..(356): n is a, c, g, or t
  misc_feature (378)..(378): n is a, c, g, or t
  misc_feature (393)..(393): n is a, c, g, or t
  misc_feature (420)..(420): n is a, c, g, or t
  misc_feature (463)..(463): n is a, c, g, or t
  misc_feature (468)..(468): n is a, c, g, or t
ttcccaccggaacgtcgtcaatgtacacatcttcgtctccgagtactggttctgagggcngggttgtggctcagccaggagtgtaccccgccccctggntacgcccttgctgccagtgacagccaggtgcctgtctctacccctcgggcctcccttgatgtttcatattggtttgtatggccacgtgcattaggctgagccgcatcacttaagtccagctggtgtactgtggcgtttaaacatggctcagccnggntggttgaatcnttncnttnttttttttttnaaatgcnaaggccaaatcggaattttnttccctnttctnnacctntgagctaggcanttgctaaggaccnattgaaggagttttcaaagcancactccaccccaaangccgaggtagccatttctcactgagtntgcatgaggattggcattttggtactttttttttttttttttnaaccnacggggctctttgtgtttcaagttgatggctgctgtagagtggcacata

SEQ ID NO: 47 - DNA, 347 bp, Mus musculus
gaagtctgcagctaagagcctgagacttggggagtgagacctggcaactccaacagcccccatcctggaaggccaatgaagaacactaaccgtggatggtgctgcaggaccagctcaggacaaatcccaaacaaaggtcgatgctggcccagacccagatccatggaagtcagaaagagaatggagccagacccagtctggggcctagggttgatctggagcccagtctcggattctaagaacctatgctagcagacccaaggtggcatttgggtcagctgcagacctgggcttagaaacctatttatccctgacttaggacaagtcaggaattgcccaggacccta

SEQ ID NO: 48 - DNA, 574 bp, Mus musculus
  misc_feature (183)..(183): n is a, c, g, or t
  misc_feature (190)..(190): n is a, c, g, or t
  misc_feature (209)..(209): n is a, c, g, or t
  misc_feature (216)..(216): n is a, c, g, or t
  misc_feature (231)..(232): n is a, c, g, or t
gatcaccagcaactcgtctaattgatttgattttagagagaaaatagctaaaagaaatactcacttagaaaaggtcaaacatttcccagtttaacgcaccctgaaaaataaagttgtcatcagccccttccgccccgccccccgcccccccctccccaagcctcctgctgtagctcaacccanatccccnggagatagaatgtccagcnccctccnacccaatccagagannccgccttgtcccatcctgcggtgtctcattctggaagcggttgagccaagctgactcaggagacacattgccttccaactctgcactttcaagctctgcgtttctctccccgctccaactgctgggtttcctggctctaatccttgcctgagttacagcaaggaggacatttatcatgtttcttccatcctgaaaccaagttccccggcttgtggatgactctggctgccttgggggggtgagaggtacaggaaggggggtgtctcctctcctctaaaatccttaggaaactaaacttactcctctgtgcaggagtctggcagctccagacatttgcatgag

SEQ ID NO: 49 - DNA, 147 bp, Mus musculus
gctttgccatcttgatgtggaccctccctgtgatgttgatagccatgtatttctacaccactctctgaggaggaaggggaggccatagatgcaccttggcctgaagctcctgcctcgctgctgcacatgcttggacagcctcaacct

SEQ ID NO: 50 - DNA, 509 bp, Mus musculus
  misc_feature (113)..(113): n is a, c, g, or t
  misc_feature (171)..(171): n is a, c, g, or t
  misc_feature (267)..(267): n is a, c, g, or t
  misc_feature (282)..(282): n is a, c, g, or t
  misc_feature (310)..(310): n is a, c, g, or t
  misc_feature (314)..(314): n is a, c, g, or t
  misc_feature (336)..(336): n is a, c, g, or t
  misc_feature (338)..(338): n is a, c, g, or t
  misc_feature (349)..(350): n is a, c, g, or t
  misc_feature (355)..(355): n is a, c, g, or t
  misc_feature (360)..(360): n is a, c, g, or t
gagggaggacacctcatctcttctccctttccttttcttgtctctgaggcccttcaaaaattgctttgaaacctggagctgaagtgtccggacaagaggagtcctttaagcangtcacagagaagatggcactgcccagagcccatgtagcaggcatgctgccaaaggctntatgatgcagaaaagatgtctcccagggaccacatttggaccccagcctcactgtccccagggccaggattcaggtctctgaggagcccttgggcnaaagttgctgggccnagtggcactctatgggacagtggtaganggcnggaggggatgaaagtccaaagncnaaagtaggagnncagangatantacaaaccctccacctgatatgcctgggcagcaggcatggttggacagtgcctgagagagggtaggctccagatgggagtagaaagacagacagacagcagctggacctgaagggttgatgccaaagcagacattttcttcacatcacc

SEQ ID NO: 51 - DNA, 425 bp, Mus musculus
tgagaaccccgaaaaggccgactgggatttgaagaattctgctcacgtgtggggacctttcctgggactgctgctgccttccctgctgctgttggctggcatggtctgagggggacacccaaaggcctgggagaagaggtcagctgatcaactgctgtgtcctatcctatcgctcaaacaagataccaccgcctggccaaagcccgtctggaagggaaaggctgtgtggtccagcccatcagtaactgcacaccagggccctcccttgccctttacagtggagttctacagaggacatgattctggggatacttgtctgcttcccaggggatggaggggtggggtgggggaggggctgtctgcctgcaggctctagggctccccatctctgagtgcccatgtagcttggacagcagaccctgagg

SEQ ID NO: 52 - DNA, 111 bp, Mus musculus
cagcccctgtgcacacagagagatggttctgcacacttctcggctcactcagcatcatttattgtgcatctggcattctgcaccacatacagtgttagacacggcctcggg

SEQ ID NO: 53 - DNA, 172 bp, Mus musculus
gctgattgtaactttggaggactctaccttgctttgaatcgcagactgacacctgtccagatgtgggatctattactgctggggagatgtcatgctctcaaactatcctcggagtcactctcccaattaccatagtgggctctttgagacccactgtacactcgatcaaagg

SEQ ID NO: 54 - DNA, 347 bp, Mus musculus
tgtggccttgctctgagtttcagtctggtgacttgtggccatgagagagagcttgatatgaaagctaagtcatgtttaatgggacagggtaaggacaggagagaaaagctgttaggctttccctgtgctaaacctatctcctgggagcaggcacttcctcctagctagccaccatcacagcctcaccagcagcagcctcaagactcagtaacatttccaacttaggaaaagctacacagacgcatagaggatatgacattgttcatctgcatgatcctgacagagccttggtattttcacagtgtaagcaaattgcatatctttgctgtctcataaaccatcgctga

SEQ ID NO: 55 - DNA, 431 bp, Mus musculus
  misc_feature (71)..(71): n is a, c, g, or t
  misc_feature (238)..(238): n is a, c, g, or t
  misc_feature (246)..(246): n is a, c, g, or t
  misc_feature (254)..(254): n is a, c, g, or t
  misc_feature (266)..(266): n is a, c, g, or t
  misc_feature (280)..(280): n is a, c, g, or t
  misc_feature (289)..(289): n is a, c, g, or t
  misc_feature (299)..(299): n is a, c, g, or t
  misc_feature (315)..(315): n is a, c, g, or t
  misc_feature (338)..(338): n is a, c, g, or t
tggttcctgcagagctggtagccaccgctgctgcagcagctgggcattcgccgaccttgctttactcagcnccgacgtggatgggcaaactgctcagctcatccgatttcactttttcactctcccagccatcagttacaagccataagcatgagccccctatttccagggacatcccattcccatagtgatggatcagcaagacctctgccagcacacacggagtctttggcttcgngacagccntcactccntgggggttgctncaactccttccccngtgtacacntctgcactcnaacaacggagccacanctgcactcccccctcccccaaancagtgtgggtatttattgatcttgttatctgactcactgacagactccgggacccacgttttagatgcattgagactcgacattcctcggtat

SEQ ID NO: 56 - DNA, 369 bp, Mus musculus
  misc_feature (268)..(268): n is a, c, g, or t
  misc_feature (271)..(271): n is a, c, g, or t
  misc_feature (274)..(274): n is a, c, g, or t
  misc_feature (278)..(278): n is a, c, g, or t
  misc_feature (280)..(280): n is a, c, g, or t
  misc_feature (284)..(286): n is a, c, g, or t
  misc_feature (288)..(288): n is a, c, g, or t
  misc_feature (291)..(306): n is a, c, g, or t
  misc_feature (313)..(313): n is a, c, g, or t
gagacattttcctatcatcaacgtgacattcacaccacactttcaaagacaatcgctgaaaaccaaattgtctttctgaggtaaaaatatgcggaatgcctgcctggaatctttatgcgaactcttattagccagtgaaacacttgcttgccaactggagccagttcgcttcgttaagaggagacacctcgctttgcagttgcagttggccattattgtaaagtcagtatctcagaatgagatttctcaaagctttctttaaatcttnctncanatantntacnnntnaannnnnnnnnnnnnnnnaataccnttaaatattacagaaaggtataaataataatataaaggtccctctatagctaacac

SEQ ID NO: 57 - DNA, 532 bp, Mus musculus
  misc_feature (37)..(37): n is a, c, g, or t
  misc_feature (39)..(39): n is a, c, g, or t
  misc_feature (76)..(76): n is a, c, g, or t
  misc_feature (93)..(93): n is a, c, g, or t
  misc_feature (260)..(281): n is a, c, g, or t
  misc_feature (302)..(302): n is a, c, g, or t
  misc_feature (313)..(313): n is a, c, g, or t
  misc_feature (319)..(319): n is a, c, g, or t
  misc_feature (325)..(325): n is a, c, g, or t
  misc_feature (358)..(358): n is a, c, g, or t
  misc_feature (374)..(378): n is a, c, g, or t
  misc_feature (402)..(402): n is a, c, g, or t
  misc_feature (438)..(438): n is a, c, g, or t
  misc_feature (472)..(472): n is a, c, g, or t
ctgtgttgttttcgaggcctgatactcttacaaggtntngaaaaaaaatgtgtgtatccattcatgggcttggtanccttctggtcacctcantcctgtggctcttaacttattgcccaacaatattcatttcccctcagctacaatgaattgcaagcaaaagatgttgaaaaaaagcactaatttagtttaaaatgtcactttttggtttttattctacaaaaaccatgaagttctctctctctctctctctctctctnnnnnnnnnnnnnnnnnnnnnntatttgttaaatcagattatnttctttttttntttttntttttnagtgattcatgtttatgagcagagtggagtttnacaatcctagctttannnnnaaacctatttaatgtaagatattntacgcatccttcagatattttgtatatcccctatgncctttattctgtacttttaatgtacatatttctntcttgtgtgatttgtatatttcactggttaaaaaaaagaacattgaaaggcttatgccaa

SEQ ID NO: 58 - DNA, 345 bp, Mus musculus
  misc_feature (117)..(117): n is a, c, g, or t
  misc_feature (134)..(134): n is a, c, g, or t
  misc_feature (145)..(145): n is a, c, g, or t
  misc_feature (209)..(209): n is a, c, g, or t
atttcaggtggatctaaagaccttgaagaagccacatctacattgactgaaaacagtgtcatgactgtggagagacggaatatagaatgaaaccaatgtcttcataggccatctacnctagccatttactttcnacctctacatntgacctcaaattcctgtgacaattaggcaaagctcctggaatgtgagcagacctcttgcctccnccaatgcaaagtctaagactgctacagcatctgggacatttagagaagattcacataattttttgtaggccagttacctagtgtcctaccaatatatttcctagtaaaagttcacgtgccttcttccacagtggag

SEQ ID NO: 59 - DNA, 492 bp, Mus musculus
  misc_feature (31)..(31): n is a, c, g, or t
  misc_feature (153)..(153): n is a, c, g, or t
  misc_feature (199)..(199): n is a, c, g, or t
  misc_feature (214)..(214): n is a, c, g, or t
  misc_feature (284)..(284): n is a, c, g, or t
  misc_feature (297)..(297): n is a, c, g, or t
  misc_feature (351)..(351): n is a, c, g, or t
  misc_feature (375)..(377): n is a, c, g, or t
  misc_feature (390)..(390): n is a, c, g, or t
aaaccagagcagctgtctattcagaaagggnctttatctttcttagaacaaatgcagttcaattgcatcccatttccagtcattccactcttaaaaccaaaaaggaggggaacaccagctcactgcagcagttctcccttctttccttccttntgttacgctttagggcacagaatgctctttagtcttttaacaaccncagaccttaagcctngtagccgaagttattgtatcaactggatactgttccatatcgcttttagacgtctttgttttgacacacnaacatttatgccnaattgcagattattctgcagaaatggaattgcatgtttgtgttgtatatttagnatgaactttttttttttttttttnnncaaaacatgtttnttagttatcaaagcagttggaaatgtttgcaagactatgaacatagaattgctgcttttatattttaactgcagattgtgaatttcactgccttatattatt

SEQ ID NO: 60 - DNA, 479 bp, Mus musculus
gcagagctggccttcaattatacacttaactccttcaagccctttttgctttatttcttaggggagactgtgtgaaagagaaacaacctagtccctcctcatcttttggagccatgatgctcacttaggaattacaggaaaagaatggcttggcttggccaggtcatgtgatctgcctaacgtgtttcattccttcaaacacagactgagaaaaaagggagtttcatcatttaaataccatcaatgggaacggtctcattttgcctaagatgggagctaatctagttgggtagtattgcattgtagtaaccttttgagttgtgcttggttactaaaagagtggcagatacatcagcctatgggattacactaccaaaagccatagtgccacagacctcaatcgctcactggcaaactgaattaccctggaccttccttctacttcaagtgatatgtgttccaaactgatatgtgtccca

SEQ ID NO: 61 - DNA, 100 bp, Mus musculus
gggaggagggttgcactgtgaaagaggaggaaatggcagtcatgctttcttctgcctctggttctgctgtgacttctgtctgcagtgttcctcacacttt

SEQ ID NO: 62 - DNA, 393 bp, Mus musculus
  misc_feature (101)..(101): n is a, c, g, or t
  misc_feature (113)..(113): n is a, c, g, or t
  misc_feature (130)..(130): n is a, c, g, or t
  misc_feature (150)..(150): n is a, c, g, or t
  misc_feature (169)..(169): n is a, c, g, or t
  misc_feature (190)..(190): n is a, c, g, or t
  misc_feature (197)..(197): n is a, c, g, or t
  misc_feature (201)..(201): n is a, c, g, or t
  misc_feature (213)..(213): n is a, c, g, or t
  misc_feature (226)..(226): n is a, c, g, or t
  misc_feature (237)..(237): n is a, c, g, or t
  misc_feature (264)..(264): n is a, c, g, or t
  misc_feature (269)..(269): n is a, c, g, or t
  misc_feature (280)..(280): n is a, c, g, or t
  misc_feature (309)..(309): n is a, c, g, or t
  misc_feature (323)..(323): n is a, c, g, or t
gggaggagggttgcactgtgaaagaggaggaaatggcagtcatgctttcttctgcctctggttctgctgtgacttctgtctgcagtgttcctcacactttnggatgcttttantctccagtacaaccctngattttcagatttcctctcntgccctgtggagtgatgtncattgagtgtatggaaacttngggggtntcgnccgtgcccgatntacatcagctcantctttgccctnagaggtttcaaccggaaacacttcccnaaccncgggatccatnccagctattcaaacaagtgatttataggntcttttgtttgctntcaaaatagtttgctcacattaacgatcctgaaggaagtcctgacaagtcaccatttgtttgcctatcca

SEQ ID NO: 63 - DNA, 314 bp, Mus musculus
  misc_feature (285)..(285): n is a, c, g, or t
gagaatgttttctggctgacttccatgtggttccttcgatgctgatgttccattcctgagtttctttccatgttttgatggtagccatgggttactggatgggtcataaatgttccttagttcctcctgagatcagaacttttccctataggttcaaactaggaagcatgcactaactagcttatatccaagtggatagtttggtggtaactgccatcccagcccggaagactgttgtcagcaggatgagacagccatccattctgcccaggatggaggaggganccaaggtacagttattcctgctgaaccca

SEQ ID NO: 64 - DNA, 247 bp, Mus musculus
  misc_feature (69)..(69): n is a, c, g, or t
  misc_feature (161)..(161): n is a, c, g, or t
  misc_feature (172)..(172): n is a, c, g, or t
  misc_feature (177)..(177): n is a, c, g, or t
  misc_feature (206)..(206): n is a, c, g, or t
atgatcacccatgaaaggcgcctgcaagagctgtttagtctgaaatataggtagagagcggggatggcnaggttgcttgtaacttctggtacatgttgaatgcacacacgcatggaggcaagctctaaatcactgcactgttactgtaaagcatactttanaaatatttatngtttngaaaagcattttctagtcttccctctctnggtggagctgtaaacaagatggcatgttgtgaaggttcaag

SEQ ID NO: 65 - DNA, 473 bp, Mus musculus
  misc_feature (56)..(56): n is a, c, g, or t
  misc_feature (67)..(67): n is a, c, g, or t
  misc_feature (313)..(313): n is a, c, g, or t
  misc_feature (377)..(377): n is a, c, g, or t
  misc_feature (415)..(415): n is a, c, g, or t
agattctgcggtttatgggacctccccttccaagcttttctactgtaaactgcttngcttttttttntcattcggtagtagtcagacctgattacaaagtagagaatcgcttcacatttcacacgcctatatttatctgagtgctgtctgaaactgttgtgctagccacagtagtgctaggagatcctttgcagacttaaatctgtgagtggtgttaagtgcactgttattgccatgtgagggggcatcaactctgatcccaccaccatgttcagaccgtttttatacatttcagtggcctttttttaagganaaaaactaagcaaaatgaagtccataatgaaagtggcttttatttggacaaataacttttatanttttcatcaaaccatgcaaaaaatatatatatattacntcttcctggcacataactgtctccttaaccattgaacagttcagccattcgaataaat

SEQ ID NO: 66 - DNA, 408 bp, Mus musculus
  misc_feature (78)..(78): n is a, c, g, or t
  misc_feature (284)..(284): n is a, c, g, or t
  misc_feature (309)..(309): n is a, c, g, or t
  misc_feature (314)..(315): n is a, c, g, or t
  misc_feature (317)..(317): n is a, c, g, or t
  misc_feature (324)..(324): n is a, c, g, or t
  misc_feature (376)..(376): n is a, c, g, or t
tttagctaccaatctggctgcatctctctgaatgtagtcgcttcctgtgcaggtggggaaggattttctagaaaggtntcaaaatgaggaggaagcttgcttgattatgtcacagaagtcaatacatgagtctgtataaatcctcccaggaagaataccagcgcatgatctgatcttgctcacagtaggtggataaaggagaagagaaggggctggagtgtttaaagggacagttgtgggccccatgagacagagaggtggattgtcacaactggctttctttncctgggagggaaagagacctggcanctccnncnaggcacntggacgagggcagagtcctcagccaggctcgggatgtgtttgcttctgtttntctcccttgggaactgcaggttccttaccaca

SEQ ID NO: 67 - DNA, 491 bp, Mus musculus
  misc_feature (257)..(257): n is a, c, g, or t
  misc_feature (276)..(276): n is a, c, g, or t
  misc_feature (293)..(294): n is a, c, g, or t
  misc_feature (301)..(301): n is a, c, g, or t
  misc_feature (303)..(303): n is a, c, g, or t
  misc_feature (308)..(309): n is a, c, g, or t
  misc_feature (311)..(314): n is a, c, g, or t
  misc_feature (316)..(317): n is a, c, g, or t
  misc_feature (319)..(324): n is a, c, g, or t
  misc_feature (337)..(337): n is a, c, g, or t
  misc_feature (371)..(371): n is a, c, g, or t
  misc_feature (373)..(373): n is a, c, g, or t
  misc_feature (437)..(437): n is a, c, g, or t
acatgtatactgaaccctatagttataattaatttccctgtctgtatctgactcgaaagttgttataatgctccatttcttttacttccaatgctattaagactaggaaaactagtcattcattcaatagcactccaattatagcagagatcattttatctaatgaatgttctgtgtcgatagagatttcattacaaaacggccttttatcctgatgtctttatgtatattaagcaggggttcgttataactttgtnaactgggagattattatcnacagtagcattataatnnactccancnttccnngnnnntnntnnnnnnatctcagtacttnaacattattcaagaatattcactaaataagaccntnggctagattatttacaacaagataattgaccttttgtttaaacatctgttagctcagagacttntactaattcacacaagctttaccatttcctagggtaaacctccctgatacttat

SEQ ID NO: 68 - DNA, 402 bp, Mus musculus
  misc_feature (134)..(134): n is a, c, g, or t
  misc_feature (137)..(137): n is a, c, g, or t
  misc_feature (142)..(142): n is a, c, g, or t
  misc_feature (165)..(165): n is a, c, g, or t
  misc_feature (175)..(175): n is a, c, g, or t
  misc_feature (182)..(182): n is a, c, g, or t
  misc_feature (190)..(190): n is a, c, g, or t
  misc_feature (203)..(203): n is a, c, g, or t
  misc_feature (215)..(215): n is a, c, g, or t
  misc_feature (221)..(221): n is a, c, g, or t
  misc_feature (240)..(240): n is a, c, g, or t
  misc_feature (251)..(251): n is a, c, g, or t
  misc_feature (278)..(278): n is a, c, g, or t
  misc_feature (280)..(280): n is a, c, g, or t
  misc_feature (287)..(287): n is a, c, g, or t
  misc_feature (355)..(355): n is a, c, g, or t
  misc_feature (374)..(374): n is a, c, g, or t
gagcaattagtaccaagcactgactaagccagtccaaccagtgaaaggagacgtgctcactacagagaagcagcagcagaaccatgaagtgcagtgaagccaaaactaaagcaaccacaccagtgtcccagagnctntccanccatcccacataagggaagaganccatccacanttccttnaggtcctnagctggcctactnacccataaatcnatctgnccctgaccatcctcttgtntatgacaggcnggatacaggatgctatatggtccggtntnttccccnagaagctcaatcccaaccttaaatatcacaacttcttcctgaggcagggggtgggggaaaaagggagncctgtcagtagttagcaantctgatgtcactcctaatgttgtggcag

SEQ ID NO: 69 - DNA, 308 bp, Mus musculus
atgaactgatctctggaccaatggaccggcatgcctggggagttgcctggtttggatttgccatcctctgctggactttttgggttctcctgggcaccatgttctactggagcagaattgaatattaagcacagacagtgtctccaccatacctccctccctccctgggtgactctgaatttggtgctggaacctgctgtttcgtgacacgccctctgtgtgctctgccccgtgactcgtgcttgtttctctcaaatgccagttccggtggaatgggcttcctttaggctttcaagatgctgcaatcc

SEQ ID NO: 70 - DNA, 519 bp, Mus musculus
  misc_feature (128)..(128): n is a, c, g, or t
  misc_feature (282)..(282): n is a, c, g, or t
  misc_feature (292)..(292): n is a, c, g, or t
  misc_feature (296)..(296): n is a, c, g, or t
  misc_feature (298)..(298): n is a, c, g, or t
  misc_feature (301)..(301): n is a, c, g, or t
  misc_feature (317)..(317): n is a, c, g, or t
  misc_feature (347)..(347): n is a, c, g, or t
  misc_feature (382)..(382): n is a, c, g, or t
  misc_feature (392)..(392): n is a, c, g, or t
  misc_feature (437)..(437): n is a, c, g, or t
tacagtgctgggttcttcttgatgggggaatgacattttgacacactggacaaccctgaatgaagacctgcagtccctatcaggatgtcagttagggacagaagctggggcggccattcacacagttncaaagcttccgaggactagagtgtgggcagaaggtaggaaggacaattagcttattgatagtcgtaaaatatgtgagtgttttacataaactataatgagaatactgagtttacaaaaactttagcccggcatcagctgagtatctttcctacnataccctttngatngnttntccaggtaaaggaggnagcatttttgtgcccattttatggattgtngatggggttccgaggcacaaaggctggagaccttnccctaggttntacactgtgagctagcattctgttaacaactcagtgtgtgctctnccttcctaaccagccacactgcttttactcctgggatttaccgggagagggaaggtggtttgctacttaatggaacacctga

SEQ ID NO: 71 - DNA, 402 bp, Mus musculus
  misc_feature (56)..(56): n is a, c, g, or t
  misc_feature (153)..(153): n is a, c, g, or t
  misc_feature (177)..(177): n is a, c, g, or t
  misc_feature (361)..(361): n is a, c, g, or t
acggtgggaacttcgcaggcctcgaggagggcgtacacagtcgctgggacagccantgtccgctggagttgcaaatcctatgttcggagggaattctcaggcctccaagatctttgtgaggagtggagcgagtaacagttacctccacggcancttgcaggcaggagggattgttcntttccaagaagatctgcaccggctgtacccaaatagaacgtcattttgatatgaaggatttcagcccctgaagattttgatacccacagagttgctggaaacagctctcctggataccaagggatgctcatctcatatttgaatcatcccgaccctcactgagcagacagctcccagagtaacnctgactcagagagaaggaattcgagtcacccgggatattta

SEQ ID NO: 72 - DNA, 498 bp, Mus musculus
  misc_feature (366)..(366): n is a, c, g, or t
  misc_feature (370)..(370): n is a, c, g, or t
  misc_feature (382)..(382): n is a, c, g, or t
  misc_feature (471)..(471): n is a, c, g, or t
atcatctggtcgagtggtgtctctttccactccaatcatttggcggagagggcatgagccccagtccttcattcgcagaaaccaagatctcatttgcagcttcttcacctggttctcggaccacagccttccagaatctgacagaatcgctgagattatcaaagaggatctgtggccaaacccactgcaatactacctgtgtcgtgaaggaatccgtagaccccgacgtcgcccaataagggagccagtggagattcccaggccttttggcttccagtcaggttaatctttgcatttgaaaatgcggccggaactggtcccttctcacctgtgcttgagcaaatgcaacgggtatgcagtgttttngatnttctttcctccntgacttttctgcatcttctatctggatagtctccacctcgagattaagactggacatgcttctgctttcccatggccttcatgctgttntgaattagtatctgctggttcacggcc

SEQ ID NO: 73 - DNA, 464 bp, Mus musculus
  misc_feature (352)..(352): n is a, c, g, or t
actgatgcgttcctgatgctgtattaaccttgttattaggaactctgagccatgcgggagcaccaccctccccatccatggatgctgccctgggccccccagcctcctgcagtgacagataactccagctaaagtctctggtgttcttatctccatcctttctcccattttacttaaccctcatcctcagaaagatgcctcttgctattaaaagtcggatttatgttttaggattcttggtctctatagggagacgacagagaattgagccatttgctctcttgttgagcaatttgcatgagtccaccagaggcctaatatgtgtggccataacttttgtcttccccagccntttgaggcagtgtgtgtggatgtgtgtggatatttatgtgtgtaccctgcactcatgaatgtatgaactggaggaagttactacaggggagggctctcaataacaaggtcta

SEQ ID NO: 74 - DNA, 337 bp, Mus musculus
  misc_feature (125)..(125): n is a, c, g, or t
  misc_feature (132)..(132): n is a, c, g, or t
  misc_feature (165)..(165): n is a, c, g, or t
  misc_feature (172)..(174): n is a, c, g, or t
  misc_feature (176)..(177): n is a, c, g, or t
  misc_feature (179)..(180): n is a, c, g, or t
  misc_feature (182)..(183): n is a, c, g, or t
  misc_feature (197)..(197): n is a, c, g, or t
  misc_feature (206)..(206): n is a, c, g, or t
  misc_feature (211)..(211): n is a, c, g, or t
  misc_feature (214)..(214): n is a, c, g, or t
  misc_feature (216)..(216): n is a, c, g, or t
  misc_feature (218)..(218): n is a, c, g, or t
gtggccactcagcaaaaacttactcccggggcggggaagcaaacagcccctgctgaccctttacggatctcagtttgctccttttatggacctttactggagagagttccctccacagaatgtcngaagtcntgcattctttcccttccatcactgtattgattnttttttnnnannanncnnccaccacccctcanactcccacntcacntcntntntgcagaatgttcacagcaaaacacctttgtctgtttttagattcttgaagaattagtctgttcaagacattgtgtttaaagctgggagcccactgggagtccacaagtgctgcatatat

SEQ ID NO: 75 - DNA, 247 bp, Mus musculus
taatcatttggagagaactagaacaaagtaagtggagctgttcagtaagtggaagacacagcctgaacagctcaagtactgaattgaccggctaactcggctgtgggcctctgccagcgtcacactggctggactcggcctgagaaggtgagccttgttctgaagaccagtgcttgcttgctctcacctcattaccccagttccgggagttacattggatccactaaccagcttcactttctgtctg

SEQ ID NO: 76 - DNA, 486 bp, Mus musculus
  misc_feature (173)..(173): n is a, c, g, or t
  misc_feature (189)..(189): n is a, c, g, or t
  misc_feature (209)..(209): n is a, c, g, or t
tgaccggctaactcggctgtgggccctctgccagcgtcacactggctggactcggccctgagaaggtgagcccttgttctgaagaccagtgcttgcttgctctcacctcattacccccagtttccggggagtttacattgggaatcccacctaaccaggcttccactttctgntctgggttataaaggngtaaatgtaaatttatggtngaaaaaattttaacattattttaaattgccaaatatgttctttctcgactatttatttttgtttctgttctactgctttaattgcatttcagaggagtgaatttaggtggctcatcccacttatgtttgctgctccacacaaagatttaaatgatgagaaattattggctggacacaaattgcagaaaagtcattagaaacaatcatttaaaactttgtttgctttcttcacatattctttctcaaaccattgcttggagtgtgctatgaacttgcc

SEQ ID NO: 77 - DNA, 516 bp, Mus musculus
  misc_feature (222)..(233): n is a, c, g, or t
  misc_feature (235)..(236): n is a, c, g, or t
  misc_feature (238)..(240): n is a, c, g, or t
  misc_feature (248)..(248): n is a, c, g, or t
caatcagttcggacaccaggagaatggcaagaatgaagagattctgaattccctcaagtacgtccgacctggtggcgggttcgagcccaattttacattgtttgagaagtgcgaagtgaatggtgagaaggctcacccgctctttaccttcctgcggaatgccttgccaacacccagtgacgaccccactgcgctcatgaccgaccccaagtacatcatttnnnnnnnnnnnngnngnnnccgcaacngacattgcctggaactttgagaagttcctggtgggccccgacggtgttcccgtgcgcaggtacagccgccgctttcgtaccatcgacatcgaacctgacatagaaaccctgctgtcccagcagtctggcaactcctaaggcggccctggcattggcttggtgattactggctgcactctggggggcggttcttccatgatggtgtttcctctaaatttgcacggagaaacacctgatttccaggaaaatcccctcagatgggcgctgg

SEQ ID NO: 78 - DNA, 500 bp, Mus musculus
  misc_feature (281)..(281): n is a, c, g, or t
  misc_feature (312)..(312): n is a, c, g, or t
  misc_feature (337)..(337): n is a, c, g, or t
  misc_feature (344)..(344): n is a, c, g, or t
  misc_feature (357)..(357): n is a, c, g, or t
  misc_feature (387)..(387): n is a, c, g, or t
  misc_feature (389)..(389): n is a, c, g, or t
aggatctcctaagtgttcccttgactttgctcctgggtttgggggaagcctggcttgggagctgtttccagtaataaattaatcaggctgcagatagacaaaaggcttcccagccatggaaaggagccagcccaggccatgtttgctgtgactcagacaaatcattatatgttctggttggccttgaacttatcaccctggacacacttgccttgttttgactttgtggctgtgtgcttcagcctctgtcactaacaaaggctcctcccgaggcaaccttntcctgtgttgatcccccacttcagcctgggntccaggaaggacattgaccctgtgnccatcgngccaggtaccttnacctacctcaccccttttgctgatgtgccntnggactgtgactttattagtataagccgatgagttgttgagaagtgttataccccatggctgttagggggttgtgtgtgctccctcccccgggctttagtgtgatcccaact

SEQ ID NO: 79 - DNA, 481 bp, Mus musculus
  misc_feature (103)..(103): n is a, c, g, or t
  misc_feature (107)..(107): n is a, c, g, or t
  misc_feature (455)..(455): n is a, c, g, or t
taaaccatctctgcatcaccatgaacccagactagctgtggtgccagaaacctgaacttaaacaacagttctcagtgcaaactgtcctaggaaaatttaaagnatgnacaggcaggggagaagatgcatatcaaaagcttggctttaaagtctaagggagttttagatcaaaaactagctatcacttcctgagtgtctcatgtagccactcaggctcccaggagtttcctgaggtaggttagtagggtcacgtgaatgcctcactatgacatgacttgagtccagtgagatctcattaggattaatatttcagggatccttaatattttgatttgttttccgagattggattttattttatctgctatttcagttcatctaaatcttgtgttctgtacatgtgatgtttgactgtaccatcgactgttatggaagttcagcgttgtatgtctctnctacactgtggtgcacttaacttgtg

SEQ ID NO: 80 - DNA, 396 bp, Mus musculus
  misc_feature (304)..(304): n is a, c, g, or t
  misc_feature (306)..(307): n is a, c, g, or t
  misc_feature (311)..(311): n is a, c, g, or t
  misc_feature (332)..(332): n is a, c, g, or t
  misc_feature (343)..(343): n is a, c, g, or t
  misc_feature (350)..(350): n is a, c, g, or t
aagtcaacgcttgtttcattttaagctgctgatactcattccttattatttgtcgtcagatgaggaagctgcagttctggtacaaactgatgagagtgtatagacttaagtctggcattctaagggcttaccgtataactttaggaacctggaacagtccactgaacggctagaatgaattgcagtatatatgtatgattgattgctttttaagtgactatttttcctcttgtcaaatcatgtaaattctgaaatcttttgcactgatgtgtcaaaccttattcttgtatattcaatcaaggcnanntttnataatttcccatttgttttcnatgaccctganaatgttnaatagcatggtgatattctatgcaactctagttacaccttttggtt

SEQ ID NO: 81 - DNA, 340 bp, Mus musculus
  misc_feature (262)..(262): n is a, c, g, or t
aggacataaaacattaggctcgggttaggcactaagataaagtctagtccagttctcattttaaaagtcaactagctctaaagctagttagtgacaaagttggataccaaaaatagccaacactatgacataaaaactttgtgttcaaaatgtacaattcactttatacattattaatagtagataaatttgtgtaaaatgtatcgctgctgtccagcatgcttttcttctttttatccaaacatgaggccaggaggataanttaacttgaggaatagacaacttacattcactacatatttaatcatgcttaaaatgtttgtatttactgccatgcaat

SEQ ID NO: 82 - DNA, 516 bp, Mus musculus
  misc_feature (163)..(163): n is a, c, g, or t
  misc_feature (354)..(354): n is a, c, g, or t
  misc_feature (447)..(447): n is a, c, g, or t
tactctgccaattttatccatgttcttgctaagtctattgatgatatgaattggaaagggagaattttgaatatggtgagaaattgggaaaaatggacattgataggcatatcatcttgctttgtgtacatatggtattaaaactgaaaacaaatattcttgnacatttgggtttcaaaattgtgttagcacttattttagaaacattaattaagtgtatggctgcctttgaaatacttgatgtgttgttgttgccttacagaggactacaagtataaagcaaatagctgttttaaaattatgtaaataagtcacaggctagttatttgaaaactctaagtcactttaattttntcagaatcttctcttactaggtaggcccaggatgttccatagttagtggaaaacagtacaggaggtggagggaagctaagcaatagacagganccgtcacaggaagtcactggcaatacgggtttaaagcaggtacttagatcacggttttctctgtaagaa

SEQ ID NO: 83 - DNA, 198 bp, Mus musculus
gtggtagagtttgtgtaggtaactaggtaatttatcgtggcccagacgtgaccttcgaatgctgaagagctttgtctgaagcctgaatgaacttttctgctcctcccgtttgaattaactttgcaaagtagtagccagcggggggatttgaccagggtggttttgtgttttggagacaggagagtaacaagtggagat

SEQ ID NO: 84 - DNA, 214 bp, Mus musculus
  misc_feature (141)..(141): n is a, c, g, or t
actgacaggtgctattccagtgagcaggtcaccgttttattcaataatacttctcgagaagactactaggtagcacttgggcagtttagatcagaggcgcatcgaatggcagagtcacaggcgggtccgagggaaggcatntgagcgccacagtagcacaaggccctttgatgtctagcccagtgccatcctgtctgccgtcagtagaaaccaa

SEQ ID NO: 85 - DNA, 446 bp, Mus musculus
  misc_feature (184)..(184): n is a, c, g, or t
tggagagctcctggcgtctgaatgagcgtcactatggagccttgattggcctcaacagggagaaaatggctttgaatcatggtgaagagcaggtaaggctctggaggagaagctacaacgtgaccccacctcctatagaggagtctcatccctacttccacgagatctacagtgaccggaggtnacaaagtgtgcgatgtgcccttggatcaactgccacgttcagaaagcttgaaggatgttctggagagacttcttccctactggaaggaaaggattgctccggaaatcttaaagggcaaaagcattctgatatctgctcacgggaatagcagtagagctctcctgaaacatctggaaggtatctcagacgaggatattatcaacatcactctgcccactggagttccgattctgctggagttggatgagaacctgcgtgccgt

SEQ ID NO: 86 - DNA, 319 bp, Mus musculus
aaggacctgtctctaatacaagcaaacaaacaacaacaaacactacccgctatgctcggtatgatgtactactccaaagctcaagactcctttgctgtcagatgtgtggtgtatatgcagttggacaggatttaggttttggtttttggttttgttttattttgatatttttctcagtgtctaattgaaagcatgcttgctttctcatcacagctttgacagctgtcagaaaagcctctttgtggcttatgctaagattaggattggtttttcttctaaaactgttggcttcctccgttccctctcagcttaagcatga

SEQ ID NO: 87 - DNA, 436 bp, Mus musculus
atgtctgacaaacccgatatggctgagatcgagaaattcgataagtcgaagttgaagaaaacagaaacgcaagagaaaaatcctctgccttcaaaagaaacaattgaacaagagaagcaagctggcgaatcgtaatgaggcgagcgccgccaatatgcactgtacattccacgagcattgccttcttattttacttcttttagctgtttaactttgtaagatgcaaagaggttggatcaagtttaaatgactgtgctgcccctttcacatcaaagaatcagaactactgagcaggaaggcctcccctgcctctcccacccatctgatggtctggctagcagagagggaaaagaacttgcatgttggtgaaggaaaaagctgggtgggagatgatgaaatagagaggaaaattcaagatggtcaaagatgtcctgca

SEQ ID NO: 88 - DNA, 399 bp, Mus musculus
  misc_feature (258)..(258): n is a, c, g, or t
  misc_feature (262)..(262): n is a, c, g, or t
  misc_feature (298)..(298): n is a, c, g, or t
  misc_feature (310)..(311): n is a, c, g, or t
  misc_feature (313)..(313): n is a, c, g, or t
gagtgttgaatgttgcctagatagtgcttctttaaagaagcagtgcaagtttgagttattttcctctctttatatgtgatctgatataagtgaaagtataatattttgcccatcttttaccaatatttagtaaaatgctacttgtttcaacttactgaaaaaatttaaacacttttgtttgcatttatttgaaaccatttggaatattgtaagacaactcactctgtagaccaggctggtcttgaactcagaaatccncctncctttgcctcccaagtgctgggatcaaaggcgtgcnccaccactgccnngnctaacagtagtctttataatactgagactgaatattcgtaacagttttcgatattactccaaattcttagaaacggcttggataat

SEQ ID NO: 89 - DNA, 305 bp, Mus musculus
  misc_feature (142)..(142): n is a, c, g, or t
  misc_feature (244)..(244): n is a, c, g, or t
  misc_feature (249)..(249): n is a, c, g, or t
atctccgaagtgtacgagagtgagagagatgaagacggcttcctgtacatggtttatgcctcgcaggagacattcgggacagcaatggctgtgtaagactccaacaaagccaatggttgttaagcccttaccaaggcaaaanagggatgttaccagcggacgctggacggctcaccacccacagatgagaacgtaggcacccacatagggtattaggaactgttcatcagccagaaactgagcntccantgcaagtgcactcagcttggaaactcgtctaaactaggctattttgtgttcaaact

SEQ ID NO: 90 - DNA, 542 bp, Mus musculus
  misc_feature (362)..(362): n is a, c, g, or t
  misc_feature (401)..(401): n is a, c, g, or t
  misc_feature (403)..(403): n is a, c, g, or t
  misc_feature (405)..(405): n is a, c, g, or t
  misc_feature (414)..(414): n is a, c, g, or t
  misc_feature (452)..(452): n is a, c, g, or t
  misc_feature (470)..(470): n is a, c, g, or t
  misc_feature (472)..(472): n is a, c, g, or t
  misc_feature (493)..(493): n is a, c, g, or t
gggcgagccctacatgtacctgagtccactgcagcaagccgtgagcgacctgcaggaaaatccagaggctacgctgactatgtctttagcacagactgtctactgtaggaatcatggatttgatccccagagtcccctgtgtgttcatataatgatgtcgggaactgtgaccaaggtgaacaagacagaagaggactatgcaagggattcgctgtttgttcgacaccctgagatgaagcactggccttccagccataactggttctttgctaaattaaaaataagccgtatctgggtcttggactactttggtggacctaaagtagtgacacctgaagaatattttaacgtcacgctgcagntgaagcaggatatggtggactgagtcacaccagagaagntntnttcggaggntcatgcacacttgaagggttggccctgcttgggacgtnctccagctgtcagcttantnctgccacctcttgttttaatnttgtttgcttgtgttaacagagagttgtccgtcagaagatgtggttgct

SEQ ID NO: 91 - DNA, 429 bp, Mus musculus
gataaccacggtaccacggcatagaaacaaactacaacaacaacacaacatgcttctggcctagagggttggctcagcacttaagaagattgctctagcagggacccaagttcaggacctggcgctggagtcagacaggcacactggccatcactccagttccaggaaatcatatacctctagtctccaaggtcacctgcactcaagtgcacgtacccacgcagacacacaccgacacataattgtaaaccatgcatcttttcttcagaagaggtactacttagttttactacgtgtattcatgctcttggatgacgtaagagtccttttaattgagtgtgcgtatcagacttcttaaacagcaaaagagttgaacatgagccatcatgttggagaaagagatagaaatccagcaagtgacttctcagt

SEQ ID NO: 92 - DNA, 483 bp, Mus musculus
  misc_feature (333)..(333): n is a, c, g, or t
atggttgctttgagtcacagggcgcttcctttttgaattgtgcagagaagtgtgttctgaacaaggcattttattatgtctgttgatctctagcaaatccaggtgatggtaattgagtgtagaaaggagaattagccaacacaggctatggctgctatttaaaacaagctgatagtgttttgttaagcagtacatcttgtgcatgcaaaaatgaatttgaccctctcacccctcccttcagctaatggaaactgacacagcgacaactcattccttcaccatcagcctttataaactgtttcttgtgagctttcagcagcccttgctgtgccntctttaaattatgatgtgcacacaccttcctttcaatgcaatgcatcagaagtttttgatatgtgtaacttttttttgattgtgattaagaatcatggatttattttttgtaactctttggctattgttcttgtgtaccctgacagcatc

SEQ ID NO: 93 - DNA, 486 bp, Mus musculus
  misc_feature (262)..(262): n is a, c, g, or t
gatgccgctattgaatctgctggagttttacatcccaagatgaagacagcattcagaattgatgtgatttccttgaatggtggcttaggaaatgtggacacttaaaactctcacttgaaattgggcacaggtttgatgtagagataaggacggggtgcggaatggagacccattttgtcattgattcatctgaccgataaggccatagtgcagttaggtgatattcgaaagcttctttgatgctctttatgtatatgttggnaaggaactaccaggcgttgctttaaattcccaatgtgttgtttcgttactactaatttaataccgtaagctctaggtaaagttccatgttgttgaactctgactgttctctttggaattgaacgttttgcatcctcctcctgtggctttaggtctgacattgtatttgacctttactagtaattaacatgtgccaggcaatggtggattggaacccatccccaa

SEQ ID NO: 94 - DNA, 526 bp, Mus musculus
  misc_feature (289)..(289): n is a, c, g, or t
  misc_feature (406)..(406): n is a, c, g, or t
  misc_feature (414)..(414): n is a, c, g, or t
  misc_feature (484)..(484): n is a, c, g, or t
tcatgacagatgacctcccttgccacttcacttctgccttcggggccggcttctgcaccaccgtcatcgcctcccctgttgatgtggtcaagacgagatacatgaactctgccttgggccagtaccacagcgcaggtcactgtgcccttaccatgctccggaaggagggaccccgcgccttctacaaggggttcatgccttcctttctccgcttgggatcctggaacgtagtgatgtttgtcacctatgagcagctcaaaagagccctaatggctgcctaccaatctcngggaggcacctttctgagcctctccatgctgacctggaccctgcttcccagccctgccctgtctttttcttcatcctctgcccagtcccattctcttcccatttcctgcaccccgantttacttncccacctcacctccctgtgcctctgtactgatgactcacagtgaggaggcctgacaccagacccctgagnccctcagccctttctacagctaagcccacatcttcatcttca

SEQ ID NO: 95 - DNA, 148 bp, Mus musculus
cggctgagagcggtcatgactttctgtggattgttttgttttgtctggcttacctcgctatacaagtaatgtaaattatgatctgtaatgtccgagggcgggatgaaacagactgttagactttggatgaaatgcattgttcattcct

SEQ ID NO: 96 - DNA, 307 bp, Mus musculus
  misc_feature (179)..(179): n is a, c, g, or t
acctgccccaagaaacagcttttggaaagtttccaggttaagccctgccctgaagccatcagtgaggtcttcaacaacaagttccacatcattggagcagtgggtatcggcatcgccgtggtgatgatcttcggcatgatcttcagcatgatcctgtgctgcgccatccgcaggagccngagaaatggtctagagtctgcccaaccccgagcaggaacaacggccctgaagactgtccgggccatttgggttttttttgccactaatattagtattcattatgcatttctaaataacagtcattctg

SEQ ID NO: 97 - DNA, 173 bp, Mus musculus
  misc_feature (30)..(30): n is a, c, g, or t
  misc_feature (58)..(58): n is a, c, g, or t
ccaacgaactgccttccttaatattaaagncatggggtagctgccggaacgactagcntgcacagttaagttggactcgggactgagacgattgcttctcgtactttcggtttgtttgccacagcgatggagttgtgggttgaactgcgtcacaaccttttgtcagccatttt

SEQ ID NO: 98 - DNA, 547 bp, Mus musculus
  misc_feature (503)..(503): n is a, c, g, or t
gaggactgaccatagttcttgtgactgagtgtgctggcactggtgagcccagccagcctgtgctgaacagaggcttttcaggaagtgcaccacacacacacacacacacacacacacacacagagcttacccatgaaggaaaaattagagttacttttctcattttgtgcattgatatatttttacaatcctgcaaacttccttgagtcactcacgactccccctgaggtcacttcctggtagtgtcccaatgctctgtgtgcagttacttcaggttgaagttgccttgatcgcctgcccctcatcagggcttttgcttttcttcaaagtactgaggatccaacccagtgccttacacgccaggcaagtgtgaccactgagctaggctcccgccccctttactttttgaagccatacaatggatgtctatatgttgcctttttgaagattaggtggttttgctctttaacatttttgtgactttggtttattttcttcccatntcgcccagagattacttgtgtgtgtgccattctgctcaaaacta

SEQ ID NO: 99 - DNA, 392 bp, Mus musculus
ccgacaactgtcaccaaagcttataaaacacgatagtactgtccctcttttctgaaccatcagaagacacaaaactgttagtgacacaacggtgacaggtagctgggacctaggctatcttattatgaaggttgttttgcttgttgtatatttgtgtatgtagtgtaacgaatttgtaccatagaggactgtccgtaactactgtttagcttctacacattgaaatgtagatgtttcattggctgtctgaaaaggtgtggcttgtccttcctagagagatctacttaaaaactgctttgtggcaaaaaccacacctgaagaaattttaagaatttggcccagttagtcactctgtgtaatcccggaatctagctgctgaagtcttgcgaagt

SEQ ID NO: 100 - DNA, 451 bp, Mus musculus
  misc_feature (269)..(269): n is a, c, g, or t
  misc_feature (317)..(317): n is a, c, g, or t
  misc_feature (329)..(329): n is a, c, g, or t
  misc_feature (353)..(353): n is a, c, g, or t
  misc_feature (377)..(377): n is a, c, g, or t
ttcattgcctgcctatgtaggtttggtgtagttttgaaagccttgtctctgtggggtctctttgagggagttgggggacctctatttgagccctgcttcagtgccgagagattgggagtggaactccctgaaacatgatttcagtttttagagatgaccttctgtggtacggtcatcatggtctccaacatcaccagaccaagtagaaggatgtcaaagacaaattcagggctctttctagggtgaccactctgccgtgtataatattngtcccagtctggccagctttctaggaggccctggctccatcctaagtnctacacaggatntgctgcaaataacagtgtacggantcaacctgacccggaacagaagtntgcatgctggttaagatgcagcctagccattgcctgagctgttcatacaatgatccggaagtgctagccattat

SEQ ID NO: 101 - DNA, 367 bp, Mus musculus
  misc_feature (340)..(340): n is a, c, g, or t
aagacttgtcctcatgattcttaacagaggtttttcatgtcaaggtcctgatagttccgagggagatgacctgcacccttttctgcacaagctgtagcagaatcttagcatgagaaaataagatatcgctcataggaaaagggaggctggaagaccacatttttgttcagtagcctggaaaatctattagtcttattgaaatcttattttatcaaggtaaaaagttttagcttataagagccttgttctgacttttcatgtatttgccatctgtcattcattataatcctaaacgagaaaacctctactctctctacttgttaaataaaagccacagggncaaagggtgtgctttagttgtacaaca

SEQ ID NO: 102 - DNA, 165 bp, Mus musculus
agtaactttagcactgttgaaacttaatgtttattcctgtgctgtgcggtgctgtgctgtgctgtgctgtgcagctaatcagattcttgttttttcccacttggattatgttgatgcttaatacgcagtgatttcacataggatgatttgtacttgcttacattt

SEQ ID NO: 103 - DNA, 512 bp, Mus musculus
tagggcttagcaatcatttaacagaaacatggatctaataggacttctgtttggattattcatttaaatgactacatttaaaatgattacaagaaaggtgttctagccagaaacatgacttgattagacaagataaaaatcttggcgagaatagtgtattctcctattacctcatggtctggtatatatacaatacaacacacataccacacacacacacacatgcaatacacacactacacacacatacacacactcacacacactcatacacacacatgaagagatgataaagatggcccactcagaatttttttttttatttttctaaggtccttataagcaaaaccatacttgcatcatgtcttccaaaagtaactttagcactgttgaaacttaatgtttattcctgtgctgtgcggtgctgtgctgtgctgtgctgtgcagctaatcagattcttgttttttcccacttggattatgttgatgcttaatacgcagtgatttcacat

SEQ ID NO: 104 - DNA, 430 bp, Mus musculus
  misc_feature (92)..(92): n is a, c, g, or t
  misc_feature (94)..(94): n is a, c, g, or t
  misc_feature (166)..(166): n is a, c, g, or t
gtgtattttctaagtgctccttctgagcctcagttctgcccccatgagaaacctgctgtgtccaaccccagctaagctgaatcttggggggnanccaagctttgacccattggagtaggagacagtggcttgctcaaaatatggataaacatctattttttttttnacaaaaagataatatttttaaaaaaagttgaaagaactagaacttgtgagagaaacagaaaatccgagtgagcaggcagcaggaggcttgcagtgggagattctcgggggatttgaaagcacatgcctgccctcctggcacatcaccacagaacgcttgtttccacgttctagaaatgagggcagggatgtacctaccttgtagggagctgggaggattgacccacaaggtctaagaaaagcgtttgccatgttttgggcacac

SEQ ID NO: 105 - DNA, 388 bp, Mus musculus
gtaaccagcatagtcgtgttttattataatttcttctccagttgatttcttaagcaaaaggaattcatcagtgttactgtcactcataaaaaaacatgtggcttaatccaacagattcattcaccttctaatatgtgaccccagttcttatccaagaatagaaggatagatataagcgcaagctctctgtaactccgtcatgaccaggtgctttccattgtagctacttatctaacatactcatttggtgaggaggactagttgtgacttaagctctgtccctcagtgactccttgaagtactcaccacacataatgactgcagagtcagctgctctgttccccaggtgttgtgaaatattttctagaatgtcatgcctgcttgtcaa

SEQ ID NO: 106 - DNA, 458 bp, Mus musculus
  misc_feature (404)..(404): n is a, c, g, or t
  misc_feature (406)..(406): n is a, c, g, or t
gaagaggatccaataccagctagtggacatctcccaggacaacgcccttcgagatgagatgcgaaccttggctggcaaccccaaagctaccccacctcagattgtcaacgggaaccactactgtggggactatgaactcttcgtggaggccgtggagcaggacacactgcaggagttcctgaagctggcctgagtcaggatggccaccgatcctatccagctagctcttcaccaggccttgtaaccaactccttgtcgtcctaatctgcaaacccagacccagaccctttccgcagccgcctcctcttcctccagaggcaacattccttattcaccaactagtctcaaaagattgtcttaagccctgacgatggctgtccccagccacaccttggggcatcctntntgcctggccctgtctgatgagcatttctgttgcttccatcagccagagctct

SEQ ID NO: 107 - DNA, 257 bp, Mus musculus
gaaaccagctataatggctttcctgttataatgtcaaaagaatctcagagattagtgggatttgccctcagaagagacctgactattgcaatagaaagtgccagaaaaaaacaagaagggattgttggcagttctcgggtgtgttttgcacagcatactccatctcttccagcagaaagtccacggccattaaaactgagaagcatccttgacatgagcccttttacagtgacagaccacaccccaatggagattgt

SEQ ID NO: 108 - DNA, 283 bp, Mus musculus
  misc_feature (171)..(171): n is a, c, g, or t
  misc_feature (258)..(258): n is a, c, g, or t
ggcccaggtttcgacagactcttcaaaatgccatcccaaatggagcacgccatggaaaccatgatgcttacgtttcacaggtttgcaggcgacaaagaccacttgacaaaggaggacctgagagtgctcatggaacgggagttccctgggtttttggaaaatcaaaaggancctctggctgtggacaaaataatgaaggacctggaccagtgccgagatggcaaagtgggcttccagagctttctatcactagtggcngggctcaccattgcatgcaatgact

SEQ ID NO: 109 - DNA, 328 bp, Mus musculus
atgcctggtgcctggttcgaagcaaatacaatgaggacatccgcagaggcatcgtgctgctggaggagctgttgcccaaagggagcaaagaggaacagcgggactatgtcttctacctggccgtgggcaactaccggctcaaggaatatgaaaaggctctaaagtatgtgcgagggctgttgcagactgagccccagaacaaccaggccaaggagctggaacgcctgattgataaggccatgaagaaagatggactggtaggcatggccatcgttggtggcatggccctgggcgtggcaggcctggctggactcattggactggctgt

SEQ ID NO: 110 - DNA, 348 bp, Mus musculus
  misc_feature (77)..(77): n is a, c, g, or t
  misc_feature (85)..(85): n is a, c, g, or t
  misc_feature (103)..(103): n is a, c, g, or t
  misc_feature (168)..(168): n is a, c, g, or t
  misc_feature (189)..(189): n is a, c, g, or t
  misc_feature (196)..(196): n is a, c, g, or t
  misc_feature (228)..(228): n is a, c, g, or t
  misc_feature (320)..(320): n is a, c, g, or t
  misc_feature (322)..(322): n is a, c, g, or t
gacaaattgctatggaaactcactgaatagaggagaaatggctcctgatttgcctgaatatgaagatttgggaaagnaacagctntctgacacctggaagggntcagccagagtaacagctgtggcttgactggtaacaatagcataggctagaagtgaagcaagcantctgccattgccttggaagtnttctgtntcctggtatgagaggaatgatgctggagaggntcaacagcaggaggcatcccatcacagcttccagcacctgctttgtgtagtgtaacattgaattcatgtaagattaacactgtggtgtaaantntgaggcacattcatgcaataaaacta

SEQ ID NO: 111 - DNA, 167 bp, Mus musculus
aaattgaggcacacaatgcagactatgagcagggcaagaccagcttctacatgggcctgaatcaatttagtgacttgactccagaagaattcaagacaaattgctatggaaactcactgaatagaggagaaatggctcctgatttgcctgaatatgaagatttggga

SEQ ID NO: 112 - DNA, 86 bp, Mus musculus
tcagaccacacagaaacttttcagcagtgcatgtggccctggagccctgggaatctggccagtgttcatcaaggtgcactgtttct

SEQ ID NO: 113 - DNA, 331 bp, Mus musculus
ataggagctagtctggcttttgcctggtgtattatcatgttaggaatactgagttctcccagtgttaatcttgaggaaatacagtttgaggcttgcatcttctgaagattgattgcatcatcgccatcatgtgtgaagtctaacacaggacccacaccagcccataatccaactgaagcactcaaaagacggtagcatgactctggtgctcttccttgctttgttaaccatcatgactatagtctgcagcacaacttttcttttaacaaagctagaacagttttggcttcttaaacttcatatttgagtaggttaagctgccatacgtgtt

SEQ ID NO: 114 - DNA, 384 bp, Mus musculus
  misc_feature (274)..(274): n is a, c, g, or t
  misc_feature (284)..(284): n is a, c, g, or t
  misc_feature (305)..(305): n is a, c, g, or t
atgaccttcctgtccaataaggcctcttcacaagtcaacgtggaggggcagtctcggctcactgaaaagattctggaagagccacaccctctgatgttccaaaagctccaggaccagatcttcaatctcatgaagtatgacagctacagccgcttcttgaagtctgacttgtttctgaaacccaagcgaactgaggaagaggaagaagagcccccggatgctcagaccgcagctaagcgagcctccagaatttacaacacataagctgagcccnttcaccccangcgaaggagagggatggactnttaggactgtacaggctgtcatttctttgttgtgtttgaggactggagtgtgctagaccttccctctggatatgtgtat

SEQ ID NO: 115 - DNA, 412 bp, Mus musculus
ggaaaacgactgagcacaccttctgccagcacctactgagggagacgaaaagcccctggaaattcgtgtggcctgtgaagtggtgtattgtagtttgaatttgagaccctattgtaagcatgatccctacctacaaccctatttttacatacccaattccagtaactctcaaatccagtattttactcaaactctgttggggcattttactaaccttgttccctttttggcctgtaagacactttagagattcctaacagagtttactgttgtttagaaatttgcaagggctttttttcagcaatgccaccagcagattataatcttgtcaacagttcattgtctcctcttagtaccaccagtcacctgcatcattcatgctagaagctgtgttctagccatgcagttacat

SEQ ID NO: 116 - DNA, 472 bp, Mus musculus
  misc_feature (371)..(371): n is a, c, g, or t
aggcccctgtgattttctcacataggtgtcttctcagttctgtcaaattcctgatgttctgcaatactcagaaaattctttgaatggcagactttcttttgtctgtttctaaaatgtgaagctttaggaccaaattgttagacagcatcaggattgcggattatctcaagtagattttgttagagttcagagcacagcatcactctgaaggagtctgtcttataaatacataattactgtttaagatgtacactttgctatagttacagaaccattgtgaatttcaaagctagcaacctacacggtgcaccaggttgacttgaataaatttggcaaccaggtttgcaagcgtgcagaaactaactcctctntcacaaaggcttataaaattggtgtgtcctatggaaatggaaagaaagatagataagacatttctgtcaattttcaagaacttggctgtttatctttaaga

SEQ ID NO: 117 - DNA, 566 bp, Mus musculus
  misc_feature (258)..(258): n is a, c, g, or t
  misc_feature (273)..(273): n is a, c, g, or t
  misc_feature (401)..(401): n is a, c, g, or t
  misc_feature (408)..(408): n is a, c, g, or t
  misc_feature (413)..(413): n is a, c, g, or t
  misc_feature (443)..(443): n is a, c, g, or t
  misc_feature (490)..(490): n is a, c, g, or t
  misc_feature (523)..(523): n is a, c, g, or t
gcagacatcgttttctctctaaattcagtagcagtttcatcgacagtgccattgaactatgggaacatttatgattttctttcaacattaaaactgaagttagttttgccatttttgaaagtattagtaaaatcatggaatacatcacagaacagctgtccatcagtgagcttgtacagtgctgatttgcagctccaacatgcgggatgttcatcctcctacacagattcttgttgggtgaaacagattgtcctatcncaaagcagaattcancaaagttaaaatttaagataaggtttaaaaagctttattcctgtttacaatttgggatgagaagcaggcttcgttttaagtttattgaaaactggctcagatgtttataagtcaagaggaaagcggcncagagancagcncagtgaagagtgaaatggagaaaactctcncggtgaagcagctgttggaactcctggtattaatggagccagagtgncatgcatccttcgtctgtctcatcagcactggngtcattccttacagtttacagaactcatgtaacttgtagctat

SEQ ID NO: 118 - DNA, 427 bp, Mus musculus
  misc_feature (292)..(292): n is a, c, g, or t
  misc_feature (310)..(310): n is a, c, g, or t
  misc_feature (312)..(315): n is a, c, g, or t
  misc_feature (317)..(318): n is a, c, g, or t
  misc_feature (328)..(328): n is a, c, g, or t
  misc_feature (351)..(351): n is a, c, g, or t
  misc_feature (364)..(364): n is a, c, g, or t
  misc_feature (389)..(389): n is a, c, g, or t
ctggaggaccagtgtaccgagtatatggccaaagtcatagagaagctggtagagcgggaggatttcgtggaggccgtgcgggaagaggcggcagctgtagcggcccggcaggagacagactccatcccgctcgtcgatgacatccgcttccatgtggccagcacggtccagacatacagtgccattgaagaggcacagcagcgactgcgggcactcgaggacctgctcgtgtccattggcttggactgctaagcccttccgtggccagggcagccacggtgacaggcatgcncagtgtgtgcacgcagcnannnngnnattacaatgnggcagaggggacctcacaggatntccttgggatgancctcctcctccagtgcacaaggaanccccaagatttggggcaggcaccactcagggaaaactg

SEQ ID NO: 119 - DNA, 533 bp, Mus musculus
  misc_feature (148)..(148): n is a, c, g, or t
  misc_feature (265)..(265): n is a, c, g, or t
  misc_feature (287)..(287): n is a, c, g, or t
  misc_feature (292)..(295): n is a, c, g, or t
  misc_feature (298)..(298): n is a, c, g, or t
  misc_feature (300)..(302): n is a, c, g, or t
  misc_feature (312)..(312): n is a, c, g, or t
  misc_feature (321)..(321): n is a, c, g, or t
  misc_feature (326)..(326): n is a, c, g, or t
  misc_feature (330)..(330): n is a, c, g, or t
  misc_feature (344)..(344): n is a, c, g, or t
  misc_feature (366)..(366): n is a, c, g, or t
  misc_feature (374)..(374): n is a, c, g, or t
  misc_feature (464)..(464): n is a, c, g, or t
  misc_feature (491)..(491): n is a, c, g, or t
atgtaaggtctttctccatggagtcacagtcctaaagactatggtgcccagactcttgtgggttccaaccacttctttccatgaactctcttggacttactgccacattagctggtgacacggctgagctgacttggatatgtgaggngaggaaggaggggatgaacgccacccagtcatcagctagcttcaggtttagattaggtctgtgaacgtctgtatcatgttctgggtatgatcatattgccctgcatctgtttgcttnctaaagccttcagtgttcatgnatacnnnnaancnnnctaagagaanacagggatntcttnctanccatatatattttntcagtagcatagaactctgtanccggaatntactagaaccctgtaacccacgtgctgctgtgaggttaagaaaggaagacgtaaagacgctacactgaaaactgatatatatgtgtgagntcttgtgtctgtccattgttgtctgtntcccctcaattccaacactccgggcccattacaaactatata

SEQ ID NO: 120 - DNA, 310 bp, Mus musculus
  misc_feature (261)..(261): n is a, c, g, or t
ttcaggcctgctttccaagctctctctgtcttaggccaacctttcaggccaattggcagaaaattgaatgccccagggcccaggcaccaaggggtgagaaaggcaggactctgctcagaaggcagagcctacagaaggtaccaaatttactgttgagtgattgagattgaaagagtagtaaactcagtgctccaaggtatgctaatcataaaacagatagtgacattcctccacccacccacttcctgagttcaaggagtnttcattcaaagaaagtcaccttgactttctttgaatgaatactgcaatg

SEQ ID NO: 121 - DNA, 108 bp, Mus musculus
gaagttggtggtgaggccctgggcaggctgctggttgtctacccttggacccagcggtactttgatagctttggagacctatcctctgcctctgctatcatgggtaat

SEQ ID NO: 122 - DNA, 457 bp, Mus musculus
agtggcgctggataagaactttcatatgaagtgttacaagtgtgaggactgtgggaaacctctgtccattgaggcagatgacaacggctgtttccctctggatggccacgtcctttgtcggaagtgccactccgctagagcccagacctgagttgagatggacctccttccagaccacaggtccgtcccccaccgtggaccacccacactgaggccagtccttgcctctaccctccctgcattccaatcccctcccgagtctcaagtgccctgacccagggcctcagcatggcctacaagtattgaggctccctcctggtgctgaggcccagccctgggctccaacccttgcctcttctgcagggatcacccatcattctgaggtccccaacccaagggtcacatatagtgctgctgctttcactgctgcaccaatgcccttggctggcctgagcag

SEQ ID NO: 123 - DNA, 544 bp, Mus musculus
  misc_feature (358)..(358): n is a, c, g, or t
  misc_feature (406)..(406): n is a, c, g, or t
  misc_feature (418)..(418): n is a, c, g, or t
  misc_feature (452)..(454): n is a, c, g, or t
  misc_feature (510)..(510): n is a, c, g, or t
agcagtaagaacttcagagccccagccggtgatctttcccagtcctgctgagctcccagatcagaagcagctgcactacacagagacgcttctccagcatgtgtctcccggccttcagctggagcttcgaggaccgtcactgtgggccctgcgtatgggcaagtgcaaggtgtactgggaggtaggcagccctatgggcactaccggcccctccaccccaccccagctgctggagcgcaaccgccacacccccatcttcgacttcagcactttcttccgagaactggaggagtttcgggctcggaggcggcaagggtcaccacactacaccatctacctgggttttgggcaagacttntcagcagggaggcccaaggagaagaccctgatcctggtgaagctggangccatgggtatncaaggcatacctggagggcgtgcagcgtgagggnnntgtcctccctggacagcagcagtctcggcttgtgcttgtctagcaccaacagtctntacgaagacatcgaacacttcctcatggacctgg

SEQ ID NO: 124 - DNA, 530 bp, Mus musculus
  misc_feature (155)..(155): n is a, c, g, or t
  misc_feature (158)..(158): n is a, c, g, or t
  misc_feature (399)..(399): n is a, c, g, or t
ggtggctattgtaaaagacccaaagatgagtggatagagctattataacacattaacataggacctgaaagaatagactaaacttatctatagctagatcttcatgagtgctggtgttttcgggggtactctattcaggtcatacaccacacccnacngcagctttaccctgctttccaacatatgatcttctagagcagtggttctcagccttctaatgctgaggtccattagtacagttcctcgtattttggtgacccccaaccataaaattattttgttgctacttcataattataattttgctgttgttatgaatcataatgtaaatatctgatattcaggatatatgatatgtgaccatcaaagggtttcgaaatccatggttgagaactgttnttctagatgcacacaacatataatttcatagcaatgtagttggaaacaatgtatcaaattttttgtctaaattataaattcatgcatttttttgctttataaaagtgtgttcacatttgagaatacatgtt

SEQ ID NO: 125 - DNA, 404 bp, Mus musculus
gagaacagctttctccgagtcacggcaatggcaaggtactcccacaccagcctcagctgctttgcccaggaaaatatggccattggtaaaccggatcttatcatcgagatgccaaagagagcagcacagtatcggcccctcactgtctccgttagaatgcacaactccttagaggcccccatgcagaactgcatcatctccatctttggaaggggactcattcacagagagaagagatatggattgggttctctgtggccaggaagcagcctacatactcagttccagttcaccccaacacatctggggctccaaaggctcactgtggaagtagattgtgacatgttccagaacctgaccggctacagaagtgtccttgtggtggcccctgaagtttctgttta

SEQ ID NO: 126 - DNA, 519 bp, Mus musculus
gaagtggcttcctaggtgacatggaatgggaataccagccaacagatgaaagcaatattgtctatttcaactataagccttttgacaggattctcactgagcaaaaccaagaccaaccagaagacgattttattatatgaatgtgacggtctctgtctccccacctccatgtggaacaatgtattcagtatacttagtgtaccacgtttaaatgaccagtctcaggataaagagttttacagaaaatttaaaatgcctggaaaagactcttgaatcctgttacccctttcctcattaactcgtaaggaattatgctttaatgctgttacctatcttgttgttctggaaaatgcctgcatttatgtgtattgaatcaacatttaagaaattaacacacacccccattattatacaataactttcaaagccatactggttttgaaaattttaatttgatagcaagttgatgaacaatctttcatacctaaagtgttcaggaacccaactcgcattgtgaat

SEQ ID NO: 127 - DNA, 477 bp, Mus musculus
  misc_feature (438)..(438): n is a, c, g, or t
ggctgttgctttcatagcatctcagactacttggaactccaaggactgcctaactaaagtactttcacaaacactaacattcagaaggatgttgagaaagcaagatctaatctgaaatggatgacattaacaagctccttaagcccctgaagttttattgcatctgctagcacttgaatgctgactgacaggcagatcctgatatatccaaattcgaattaataccatttgaaatggcaagtcttggcttaacgcctgtttgtatgcccagcattcagctgttttactcaaagctaggcatgtcatagtaattgtcttttcagatggaaactagagaactctcctaggtgtgatctgcactggccacttggcaggcacaagctgcttccttcccctcaggtcttaacccttcccagacctgcagcgattcctgtcganctcccttacacagtattgatcttctgactgtggaaacca

SEQ ID NO: 128 - DNA, 203 bp, Mus musculus
  misc_feature (94)..(94): n is a, c, g, or t
tgtcatctttcatgaaggttcagtgtcctagttcccttcccccaggcaaaacgacacgggagcaggtcagggttgctctgggtaaaagcctgtnaagcctaagagctaatcctgtacatggctcctttacctacacactggggatttgacctctatctccactctcattaatatgggtggcctatttgctcttattaaaagaa

SEQ ID NO: 129 - DNA, 510 bp, Mus musculus
gattgacaagatgtacacgcccctgttgttcgccagagtgaggagctacactgccttctcggaaaggcctctgtagagccacaccagcatgtcactgctgcatgagcagaagcatagagcgctgggacacctaagttatatgtacatagacacacgcatgtagatagacatgcatatatacatacatggagttggagcttactttaagttgttggaattcctttaagaagagtataaattattttttttatttaaaaggatagttgattcctggggtactttgttttgaaattagaagttgttaaggacacttttgttgtaataaatgttgatgtagagttgaaatcatgttttcaagcaggtttctgagcagatctgtcacatccactgccttgtgcctgagcatcctcaacacacataggtcagggagcacactggagagttcttattcccgcatgacttagtggctttgcatcatactcaaaatgtgaaacctgttctggatttgtt

SEQ ID NO: 130 - DNA, 481 bp, Mus musculus
  misc_feature (107)..(110): n is a, c, g, or t
  misc_feature (418)..(418): n is a, c, g, or t
gacagtgatcacagtctgcatcctagcctctccctagactagtgcggtttgtagtgcctgctgttgtggctctgcctgccatacctcccacccccatccccatcccnnnnagcatccgaggacccaagggctttgactgcaggacttccaaaagaacgaacacttcacgagaggacaaatgccacctctcagctgcatcttgaagctggtcacttctgggtcttgtggcaggcattcgtcaatggcccagtgcagttctctggagaaagctaccttttcccaaggcatctgcatccatcgacattggtaatgtggccagctctccttggtcctgtcctcagccgatgctttttcaataggatttttatgctttgtgtacctcaaccaagtatgaagagctgtactggttttatagatncacccccaattgtatggcttaaaacaagctacatggtcatggtttgctgtgtgaccgacagat

SEQ ID NO: 131 - DNA, 450 bp, Mus musculus
  misc_feature (37)..(37): n is a, c, g, or t
ggagatactcccaggtgcaacaagagctgtgaagctnggctactccccatcctacaaagaggataagcactttgggtacacttcctacagcgtgtctaacagtgtgaaggagatcatggcagaaatctacaaaaatggcccagtggagggtgccttcactgtgttttctgacttcttgacttacaaatcaggagtatacaagcatgaagccggtgatatgatgggtggccacgccatccgcatcctgggctggggagtagagaatggagttccctactggctggcagccaactcttggaaccttgactggggtgataatggcttctttaaaatcctcagaggagagaaccactgtggcattgaatcagaaattgtggctggaatcccacgcactgaccagtactggggaagattctaatctgctttgacttcattgtccagtccttaggg

SEQ ID NO: 132 - DNA, 300 bp, Mus musculus
  misc_feature (191)..(191): n is a, c, g, or t
  misc_feature (203)..(203): n is a, c, g, or t
  misc_feature (258)..(258): n is a, c, g, or t
  misc_feature (268)..(268): n is a, c, g, or t
aggcaagatgtgtccactggtggcatagggacattacttgtaggggtgtaaccaatggctttctcataggatctgaggcctactctctggaagacaattcatgtactattggtcaaatgcctgtgaatagggaggacataagccctgtcaggaatggtatttctattgttttgctaaatattcatgtcctncctatcaaattncccttgaaaagacctctagtttcatgagtcccaaagctaagaatgtcctcagacnaaattcaatncctactttgctgtaatccttataacctatatg

SEQ ID NO: 133 - DNA, 494 bp, Mus musculus
gaacctctttgagatcatcacagcagatgaagttcattattacttgcaggcagccacttccaaggagcgtactgagtggatcaaagccatccaggtggcctcacggactgggaaatgaggacaccgagaatcactgaggagcatctgactggccaagattctacaacccatataacagagatggaattcaaggccagactttgaactttgagtcggcattctgttttgtcttcaccttcctcacatgcttttggggtgcatcattttaatgtgttgtttatttaatattcactgaagcaagagttctcaagctttatgggtctgttccccacacaccagcactcaaatcaaacaatattgtgcttgtataactttctatgggaagtctagagactttacagatagtccagaaagtctcaaggctggaggagcatgaggcctttcatccctttgtattctgagttctccttcctgttttcttctcacctgaataa

SEQ ID NO: 134 - DNA, 588 bp, Mus musculus
gtagcacatctttcaatcccttaatccctcaatcacattatctccttgaagtgctgcctagctcaccagttaccaattcttaattcatgttaagaacatccttcttgtatattcacatttctgtgtttagatcagaaccctaccatttactgtgtagattcatttcaagagcttccaaatagacttccataccccataactatactccaatctactttatatatatttatcactaaactctatatggaatagaggaaccttaaatatataatgttgcttatcttccaaactttagctcatctccaatgtttccattgcttgtaccatagaatctaaagttggtgaactgtaaggttaataatgttaatttgactaaactgggagatgcttaatgtgtagggtatcagtttagcacatatgtaaatatgtctgtaaggagaattttaaaagataattaattcatgatagctctgactcagtgaatggatagttgatccattggtagattcaagactattaggaggtggtggaactttgcaagttggaggaagaaggtgggtgtatccttccggaggtatatctgggctt

SEQ ID NO: 135 - DNA, 426 bp, Mus musculus
  misc_feature (29)..(29): n is a, c, g, or t
  misc_feature (36)..(36): n is a, c, g, or t
aagtgtgaccgcctctctgtagctaagcncagttanggctgggtgatttggatcccgactcgcatctggtattgtagaccttttacctctcatccgttgtgcttactaacaaaatgtgaaaagcaagacccaggtgtctcatgtggtggcagcacagtggcaggccagtggtcaacttagggcatcttttctctgccacggcagcgcaatgcaaagagcagacatggcctcttgcttctcttcacagccataggataatgaatactcaggcctgtttgttaaaatgctatttttaaaaccatatgaaggtaggataattaattacaagtccacatcatgagacaaactgaagtaacttaggcaaaacaggtaaaacagtcatagttttgtgattataaatgagatgaatgttcacccttccaagat

SEQ ID NO: 136 - DNA, 472 bp, Mus musculus
  misc_feature (386)..(386): n is a, c, g, or t
  misc_feature (443)..(443): n is a, c, g, or t
ggcatctttggagtgacatccaaggatggaccatcccacctgtgtacaatgataatactttagctgtgtgtgtgtgtgtgtgtgtgtgtgttcaggccatgtgacagtcaaccatttaatagatgagtgttaatttattatagataaatattgatctttaaaaatgggatgctcttaattcatgactttttaaagaattggattaaatatagctacttttatgtgagctttcccctctgtccccctgccccttctctctgtctcatttctcacaaccatcaccctccagtgtcacccccaaggctatatctccaacatactgctatgccattaaggttttatttaactttatttatggataattatgtctatgaacaacaaatgtnccgttaccggtcacacagtgtgtgggataagagtggcctagtgttgctttccgaatntcttaaaatacctgtggtcaagattgttt

SEQ ID NO: 137 - DNA, 557 bp, Mus musculus
  misc_feature (115)..(115): n is a, c, g, or t
  misc_feature (345)..(345): n is a, c, g, or t
  misc_feature (356)..(356): n is a, c, g, or t
  misc_feature (477)..(477): n is a, c, g, or t
  misc_feature (484)..(484): n is a, c, g, or t
  misc_feature (508)..(508): n is a, c, g, or t
cagggcagcaggacccagttctggtgagctgcgacggctcagcgtcctgtacggtggtggagtgtgagctgcgggagatggtgcgcgggcagcgggccatggttactgtgcaggncatgctggggctgtccagcctccgccagaggccgcaggagcagtttgtgctgcagtcgcacgcctggttcaacgtctcctccctaccttactcggtgccggtggtcagcttgcccagtgggcaagctcgggtgcagacacagctgcttcgggccttggaggagagggccattcctgtctggtgggtgctggtgggcgtgctgggcggtctgctgctgctgaccctgctanttttggccatntggaaggctggcttcttcaagcggaatcgaccgccctctggaggaagatgaagaggaagagtgacagcagagggggcggggttcctggtgggaaagctgggtacctgcttcctgtttccanccagttncctttgctcagaactccatggggntcttccctttccagcagaccgggtgcatcccttttcctaatacctaata

SEQ ID NO: 138 - DNA, 480 bp, Mus musculus
  misc_feature (260)..(260): n is a, c, g, or t
  misc_feature (268)..(268): n is a, c, g, or t
  misc_feature (270)..(270): n is a, c, g, or t
  misc_feature (278)..(278): n is a, c, g, or t
  misc_feature (282)..(283): n is a, c, g, or t
  misc_feature (289)..(289): n is a, c, g, or t
  misc_feature (299)..(299): n is a, c, g, or t
  misc_feature (334)..(334): n is a, c, g, or t
  misc_feature (401)..(401): n is a, c, g, or t
  misc_feature (428)..(428): n is a, c, g, or t
gtaggtaagaaacagtttaggcactgtcaaaaaagatattcctgaaaagcagtgtgcaaaggaggtatgataaaacaggcttttcaagagaaactagtatcggttctgcactaggccctgttggggtgaagacaagacagacattcttccatctaaggaaaatgagcggaccagcctggtaaattagtgctgaaaactcataaacagaaatcagtggatagaggctagcacagtgacttcctcgagagagtgctgttagnatttgtancntaggttcncacnnaggtancagggcagtncatctgagatttgaactaaagatgtaagggggttnggggaaaaattgacagcttagagaatttccacattggtgtttaaggggataggaaaaacttatttcnagtttaatctgtgtacataggttctgnttgggatcctggttgggatggaggtggtcccttcttatgatgaataggttgg

SEQ ID NO: 139 - DNA, 249 bp, Mus musculus
  misc_feature (130)..(130): n is a, c, g, or t
  misc_feature (138)..(138): n is a, c, g, or t
  misc_feature (140)..(140): n is a, c, g, or t
  misc_feature (148)..(148): n is a, c, g, or t
  misc_feature (152)..(153): n is a, c, g, or t
  misc_feature (159)..(159): n is a, c, g, or t
  misc_feature (169)..(169): n is a, c, g, or t
  misc_feature (204)..(204): n is a, c, g, or t
gacaagacagacattcttccatctaaggaaaatgagcggaccagcctggtaaattagtgctgaaaactcataaacagaaatcagtggatagaggctagcacagtgacttcctcgagagagtgctgttagnatttgtancntaggttcncacnnaggtancagggcagtncatctgagatttgaactaaagatgtaagggggttnggggaaaaattgacagcttagagaatttccacattggtgtttaag

SEQ ID NO: 140 - DNA, 456 bp, Mus musculus
  misc_feature (389)..(389): n is a, c, g, or t
  misc_feature (425)..(425): n is a, c, g, or t
ttgatcatcttcgttgtcacgcctgtgtttcgtacgttgggatcagccagttcaacagtgatgttgggttgcccttaacccctttgtaccaaggccgtgcaggctaggagtccagagtgggcgctgtgggagtggacgagagtgcacgtgggcaagtgtactggtcttggggctgcccttgtctccctggtggtctgcagtgggatttgagcgctttcctttcagaagtccagtggggctctcagcttaatccagaaggaagagatgggctctgccctgaaaagtggttatgtcttgacgcccctgggtgaataggccaccagcctgggcactggggcaggaaccatggtgctggagcctggcacagtgcaccggacaagaccgaatcnccggttatgagtgtgggtggaaggtgtgtctgtgtntccgatgggtccggtgtcactgtttacatga

SEQ ID NO: 141 - DNA, 464 bp, Mus musculus
aagcccttgtctaaacccttgagtgctgagagctaaggcagattcagccttgcaaaaggccagcgttactcttgactgaaggacagagggcacccaaatcctttaccttatgtgccaaggctccaacagacaagattattggtacctctttgtagggcagatttatagttataattccccatttaaatgccttgggagtgacttaggtcaggtgactatgaagaaaaaaaagaacaaaaagaaaggaaaggaagaaggaaggaaagaaggaaggaaaggagggagggagggagactgtaagagggaagttatggaagagaagataacagaatgttctagtctgtagctatgctctggtttacttctaagtcattgataggttcctgggaacttagtactaacccccgaggttcagcagattctataagcaaaactccatgaagtcatctctcagcattagcatc

SEQ ID NO: 142 - DNA, 255 bp, Mus musculus
ccgcaaggagagctactcggtgtacgtgtacaaggtcctgaagcaagtgcaccccgacaccggcatctcctccaaggccatgggcatcatgaactcgttcgtgaacgacatcttcgagcgcatcgcgggagaggcgtcccgcctggcgcattacaacaagcgctcgaccatcacgtcccgggagatccagacggccgtgcgcctgctgctgcccggggagctggccaagcacgcggtgtcggagggcaccaaggc

SEQ ID NO: 143 - DNA, 288 bp, Mus musculus
accagctccaagtgatcctgccaagaggagcagacctgacatcgtttgtaccactcaacagtgctggatgctgtaacctcaagacagtgcaaatgggtgatactagcagattaaccaccatagtttcagaactcaaggaacaactgagaagcaccattttaaattctataaaaatgttcactgtagaaatttgtgataagaaagacacacagacgtagaaaatgagaatacttgctgcaaaattaagatgctcctagcaaaagaatgcttttaagtgtttgtcatgta

SEQ ID NO: 144 - DNA, 395 bp, Mus musculus
  misc_feature (342)..(343): n is a, c, g, or t
  misc_feature (362)..(362): n is a, c, g, or t
ggtggacattggatgatgcatacaataatagcccttttgtgttagtataatggaaccatattggaaatgtactgagtgtttagcacttcactgtgtctatatccactgagttcttggacctaaacatgttatgttcagtcagatttcactaaagtgagcgactgggttttaagtcaaactgcactgaaacttttaacctttacttagattaaacgtttgttcttttctgtatgtataaataatacaaggtgattatttcaagagaaacctgaaaaagtacttgaataagggctattgtgaaatttaaaaagaaaaaaaatgtgcacatatacacacacatanncatgcacatacatgtattnttcataatggagggcaatgtttttcattatata

SEQ ID NO: 145 - DNA, 195 bp, Mus musculus
gcagtaattcatgtgtatacgtgtgtgtgtgtgcacatacacacgtgcacatgtgtgtgtgtgttcgtgtgtgtgtgttaatatgctgcgaaggtcaaacccatagaagagttgcctcctctcttgaatcttccagaggtaccacttgttaaagcgtttgtattaatcgcactagcccccagctttttaagtgag

SEQ ID NO: 146 - DNA, 563 bp, Mus musculus
gcaaccagcagcttgtggacattattgagaaagtaaaacccgagattcggctgctgatcgagaaatgtaacacggtcaaaatgtgggttcagctgttgattcccagaatagaagatgggaacaacttcggggtatcaattcaggaggaaacagttgctgaactaagaactgtggagagtgaagcccgcatcttacctggaccagatttctagatattatattacaagagccaaattggtttctaaaatagctaaatatccccatgtggaggactatcgccgcactgtcacagagattgatgagaaagaatacatcagcctccggctcatcatctcagagctgaggaatcagtatgtcactctccatgacatgatcctgaaaaacattgagaagatcaaacggccccggagcagcaatgcagagacactgtactgaggccagggccagggccaggggactttgtgagtctggctcaagaccgacattgccttggtttgttacatgactatcgtgatgggaaaactggctggaaatagtaatcacacctctctgtttttagttag

SEQ ID NO: 147 - DNA, 564 bp, Mus musculus
  misc_feature (404)..(404): n is a, c, g, or t
  misc_feature (475)..(475): n is a, c, g, or t
  misc_feature (477)..(477): n is a, c, g, or t
  misc_feature (479)..(479): n is a, c, g, or t
gggaagcgtcccagttctaggcgcttccagtggctcccttgcacaagtgacttctgggcccagttctggggcaaagatgcctgcccttcacatcgaggatctgccggaaaaggaaaaactgaagatggaggttgagcaacttcgcaaagaagtcaagttgcagagacaacaggtatctaaatgttctgaggaaataaagaactacattgaagaacgttctggagaggatcctctggtaaagggaatcccagaagacaagaatcccttcaaagaaaagggcagctgtgtcatttcataagtaactctgggggagggaaattctgttcttttgtttaattttcccccaaatgaagccaaagtgtgtgttgaagaactgagaaaaaataaaatcgagaaaaagactntcatataagcactctccaagcagttggggtgtgaatcatacctgcttctcaccttggctccccacacactntntntcagaggagagcatctgattgcagttatggaatgaaggcatggctcccccactttcagtatactccttgctgtctccaataaagt

SEQ ID NO: 148 - DNA, 379 bp, Mus musculus
  misc_feature (54)..(54): n is a, c, g, or t
actggctgagcctgctgaaggccaagttctacaatgacccgggaagctgcgtanctgtgcactgtgtggcgggcctgggaagggccccagtgctcgtggctctcgccctcatcgagagcgggatgaagtacgaggacgccatccagttcatccgacagaagcgccgtggggccatcaacagcaagcagctcacctacctggagaagtaccggcctaagcagagactgaggttcaaagacccacacacgcacaagaccagatgctgcgtcatgtagctcaggccctggccctgtacctcattacatctgtgtctaaggagtccaacggctatgtgcgtccctgctctgtccccatctgtacccacggctgtctttctgaa

SEQ ID NO: 149 - DNA, 528 bp, Mus musculus
  misc_feature (68)..(68): n is a, c, g, or t
  misc_feature (70)..(74): n is a, c, g, or t
  misc_feature (76)..(78): n is a, c, g, or t
  misc_feature (80)..(80): n is a, c, g, or t
  misc_feature (82)..(82): n is a, c, g, or t
  misc_feature (85)..(86): n is a, c, g, or t
  misc_feature (89)..(91): n is a, c, g, or t
  misc_feature (93)..(95): n is a, c, g, or t
  misc_feature (99)..(102): n is a, c, g, or t
  misc_feature (105)..(105): n is a, c, g, or t
  misc_feature (109)..(110): n is a, c, g, or t
  misc_feature (114)..(114): n is a, c, g, or t
  misc_feature (160)..(160): n is a, c, g, or t
gataaaacgtgcttgggaagtcccaggagctgctggcctgcacttaagagccctagacccatttcctnannnnnannncntnaanntannncnnnatcnnnnggnccannggcnccctcttgacatgagcgtcgctgcggtgtttcgaggcctccggccnagtcctgagctgctgcttctgggcctgttgtttctgccagcggtggttgctgtcaccagcgctggtcccgaagaaagcgatggagatcttagctgtgtgtgtgtgaagaccatctcctctgggatccatcttaagcacatcaccagcctggaggtgatcaaggcaggacgccactgtgcggttccccagctcatagccaccctgaagaatgggaggaaaatttgcctggaccggcaagcacccctatataagaaagtaatcaagaaaatcctggagagttaggtatcagctgcctaaatgtcaattgtgttacaagactcctggaatcttgtctacttttaatgtaactgcaatcttccgatgtttat

SEQ ID NO: 150 - DNA, 324 bp, Mus musculus
ctcctcgagtttcagaacgatcgcgggggccgtgcactcttccaggatgtgcagaagccatctcaagatgaatggggtaaaacccaggaggccatggaagctgccttggccatggagaagaacctgaatcaggccctcttggatctgcatgccctgggttctgcccgcgcggaccctcatctctgtgacttcctggaaagccactatctggataaggaggtgaaactcatcaagaagatgggcaaccatctgaccaacctccgcagggtggcggggccacaaccagcgcagactggcgcgccccaggggtctctgggcgagtat

SEQ ID NO: 151 - DNA, 315 bp, Mus musculus
  misc_feature (182)..(182): n is a, c, g, or t
  misc_feature (208)..(208): n is a, c, g, or t
agtcttctgaacatatctgtcatgtcttggcatccttaaacaggaccacagcatgcccatgcctagccttctcatgtgtggatatgacttccactcacccctcgcccagcttgcaccaagatgactgagtaggctttgtcagggactcctcctctttacaaaatttacattcattcactctncttcctgcgcctaggtatggcgagtntcttccttggcggggacattctcacagtttagttcttttggagggaacttttgtaatggagcacagctttcttccctgcaagagtggtgaaggctcatggtatttat

SEQ ID NO: 152 - DNA, 472 bp, Mus musculus
aacgtagcagtagctgtctgtctgtatgctagagaaacgagatcagctgtagaggttaaacgacctgcttgtccccctctcagtacaagctgggtcttggacacactgatgttttgaatgttttacagtctagccttttcagtcaggcactttttggaaaaaactttgtcctcatttgagggggcctgttgtgaggttctgtgcttgtttttgtgggtatctgcctcattccatccctgagctttgacaggaagacaggtggattccaaactgaggtgctggttgtactagaggtatctgtcggtttgcagaagtaatgaacccttccccaccgaagaaaagggagggtgcggccacccacgaggcaagcaaaagttaagttgctaaaattccttggcgggaatttcacctttgcattttgttgctctctttcctgaaataacgtgggagatgctctgatctgtcctctgct

SEQ ID NO: 153 - DNA, 418 bp, Mus musculus
  misc_feature (29)..(29): n is a, c, g, or t
  misc_feature (337)..(337): n is a, c, g, or t
  misc_feature (369)..(369): n is a, c, g, or t
ttacaagcatgcgtaccctgatggccgtnagagaggagccacagagacagaaagtgggaacatcaagcagataccgggcccaacgaaggagccacttctgggagctcattgaggagagagagaacaacccctttgacaacgacgaagaggaggttgtcacctttgagctgggcgagatgttgcttatgcttttggctgcaggtggggacgacgagctgacagactctgaggacgagtgggacttgtttcacgatgagctggaggacttttatgacttggatctatagcagcgttgcgtggcgcgggcactggtctgcggagcctcagacagtagctntcccctgtgctgtgtggcagtgcgtgtggctntcctaggcaggcctctcaaactccaggtgctgtgatcacttcccagggc

SEQ ID NO: 154 - DNA, 445 bp, Mus musculus
atgaggcgggctcagcaccattagacttgaagatggccccttttcagagcaataaggatctgatctccacagggataaaggagtttaatgttctgctggatcagcaggtctttgatgatcctctgatctctgaagaagacatggtgattgtggttcatgactgggtgaacttgtacaccaactattacaagaagctcgtgcatggggagcaggaggagcaagacagggccatgacagaattccagcaagagctgagtactctgggcagccagtttctagccaaatacaggacctttctgaagtccaaagagcccccaagcaatacactgccctcctcataacttaaagggtctgggcatcatgtcttagaaccccaaacactcggctctgtgttatatcttcagaccgttctcccaagatgttgctgtactttgacatgccaata

SEQ ID NO: 155 - DNA, 471 bp, Mus musculus
  misc_feature (298)..(298): n is a, c, g, or t
  misc_feature (300)..(300): n is a, c, g, or t
  misc_feature (329)..(329): n is a, c, g, or t
  misc_feature (331)..(331): n is a, c, g, or t
  misc_feature (445)..(445): n is a, c, g, or t
aaattgggatgttctctcgttctgtctcagaaatcacaactgtattctgagaaggcatgataaagaatgtcacaacaaacaaacaaacaatgatgaagacgggcaagccaagttgcaacctgcaatttatggtctatttctgcagttcttggctaagcattctgacatgtcctgcatttctctatttgagcttttcttttcaaatgtactatgtcaagttttcattctgtgtttttaataattatttcttttagttttgagattataattacatcccttcccctttcatttttctccntntgaacccttctatatacccatccttgctntnttcaaatccatggctgcttttttttcccattgagcattgttatatacatatataatgataaatttcgtagtggtcaattgcaacggaaatcgcctggagtcaagcagttttcgntctggtcatgaccatgtttttccaat

SEQ ID NO: 156 - DNA, 223 bp, Mus musculus
taccaagactatgagcctgaagcctaagaaatgtcattggcacccaatctcctaagatctgccggctgctcttccatggcgtacaagtgctcagttccaatgtgcccagtcatgaccttttctcaaagctgtacagtgtgtttcaaagtcttccatcagcagtgatcggcgtcctgtacctgcccctcagcatcccggtgctcccctctcactacagtgaaaa

SEQ ID NO: 157 - DNA, 299 bp, Mus musculus
  misc_feature (100)..(100): n is a, c, g, or t
  misc_feature (207)..(207): n is a, c, g, or t
tgtccttcgccagatcacagtcaatgacctacctgtgggacgctctgtagacgaggctctccgcctagtccaggcctttcagtatacagacgagcatggnggaagtctgccctgctggctggaagcccgggcagtgacaccatcaagcccaatgtggatgacagcaaggaatacttctccaaacacaactgagatgggtaaacatgnggtgagcctgaagcttggatttcacctgtgccccaacctggatgtcctgtgctggcccagaaaatgctagattttcctccactctctgaagg

SEQ ID NO: 158 - DNA, 498 bp, Mus musculus
atgagatcctagcatcggtgctggcagtgtcccaacaggaatacctagacagtatgaagaaaaacaaagtgcacagagagccacccccagacaagagttgatggacacccagggactggacatcattcccgatcccccactcctgccctttgatgccacccaaacttctttggctttcttccctcttggcttccttcttttgtttcctcttttccttttttttttccacttccctctggccggcccacccatgcgctccatccatctcatccctgccaccaccattggtctctgccagctgaagtgccctattgcccccgcacagcaccatctcagcattccacaggggactctggaaagggtgcggaaggtaggcaagaggcccacagagacagaccatctggcagccaggcagccccagaagagagacattcagacaaaggaagtcttctgctcacccttccttaaagatcagataaacttgtcatcccttcccag

SEQ ID NO: 159 - DNA, 442 bp, Mus musculus
gtgcagttgacatggcatgctccgtccttggagttgcacagctggactctgtgatcatggcttcgcctccgattgaagatggagttaatctttccttggagcatttacagccttactgggaggaattagagaacttagttcagagcaagaaaattgttgctataggcacctctgatctagacaagacacagttggagcagctgtatcagtgggcacaggtaaaacccaatagtaaccaagttaacctggcctcctgctgtgtgatgccaccagatttgactgcctttgctaaacaatttgacatacagctactgactcacaatgacccgaaagaactgctctctgaggcaagtttccaggaagctcttcaagaaagcatccctgacattgaagcccaggattgggtgccgctgtggctgctgaggtactcggtcatcgtgaa

SEQ ID NO: 160 - DNA, 485 bp, Mus musculus
  misc_feature (139)..(140): n is a, c, g, or t
gaagtagccaatcgtaagacctgaagacattttgaatgtcccactggactaacctttcttttgatgtgtgtttttagtttagaagtgctatattccacaagggttaagtcaatgaggttggaagacacctatctttttnnttttaattcaaaaagcacaatcagtctttcctttgaaaatccatataaagtacaacttttagcgtgattattttcctaaatacaaagacaaataatttacttattttatgttaattacgggcatgaagcaaaaggtttctttggggaacatgcagttttgtagtgctggggttggttcatgtcctctggcaccctggcttgttgaaaggtggctttagctgtgtgctgtgtacctgcttacgtggcctgctgtcctctgtgtgattaggagggtttctgctggccctgcagcttgcttccctgcggattaggcctttgctcatgctatagccttcatgtgggtgc

SEQ ID NO: 161 - DNA, 570 bp, Mus musculus
  misc_feature (247)..(252): n is a, c, g, or t
  misc_feature (272)..(272): n is a, c, g, or t
  misc_feature (372)..(372): n is a, c, g, or t
  misc_feature (419)..(419): n is a, c, g, or t
  misc_feature (489)..(489): n is a, c, g, or t
gtgccatcctaatcttgactgagtgcttattttataaagttgacctgtgtctgatagccttgaattttctttgtgaataagttcttaatataaaaattacatggttatagactaggccatttgtaaaacacaaagaaataactaatgtaataattatcattttattctaatcttttcctgcatatatgtgtgtatacacacacacatatatacatacatatatatatgtatatatatatatatacannnnnncacacacatacatatatatncatacacatatatatgcacatacacatacatgcatgcatatatagacatatatacacatacatacatatacacatacatatatgcacatacatatatgtntagtctccaacatatttcatcatatcaacctcctttcccctcataantaattcttgcctgaatttgtaatgaaatgttattctaaaaatgtaaaaactatgtcaaagcagaatctgntcttctatatttggatttaaatggatttgaaagtctttgggatccttgaaggatttgtaataatcactttctctaaaactt

SEQ ID NO: 162 - DNA, 279 bp, Mus musculus
caacattgtgttccttggaggatagactcgaaattcttactgagatttctattttcatatacaagtatagtgactgatcctggggtcaatttatcaatatggaatatctagtctactgggacatcccaggaatgagtttcacagttttattttatgagtcgcacacaaattctacacttattgcccaaaacaacttcctacaacattgtggtgtgtctcctcatgtgctaccagtggtgactgagatgtttacagtcttatggatatagctatcactta

SEQ ID NO: 163 - DNA, 324 bp, Mus musculus
aacaacttcctacaacattgtggtgtgtctcctcatgtgctaccagtggtgactgagatgtttacagtcttatggatatagctatcacttaagtgagtattgtgagtttatgaaatgtaatttgtaaaagaattaggctgagcgcacagcttgggatcatgtgctcacctgcatcaaacacaaaacacgatggtacctactcttttcccgagtccatggctacgggagtgtgagtgagttggagcggtcacctggcactgcttctgttgacagtgtagccactgtccactgccactgtggtgactgcaagagtctcatctccct

SEQ ID NO: 164 - DNA, 460 bp, Mus musculus
  misc_feature (108)..(108): n is a, c, g, or t
  misc_feature (289)..(289): n is a, c, g, or t
  misc_feature (296)..(296): n is a, c, g, or t
  misc_feature (298)..(298): n is a, c, g, or t
  misc_feature (316)..(317): n is a, c, g, or t
  misc_feature (329)..(330): n is a, c, g, or t
  misc_feature (360)..(360): n is a, c, g, or t
  misc_feature (377)..(377): n is a, c, g, or t
  misc_feature (396)..(397): n is a, c, g, or t
tgatggctgtgatgcccgatactggggtctgctgctctgtttggtagaactgatggcagagaaacttcctgcctccaggataaagggcttactcatcacctctggcanctgctagacaagttcataacccctttctgctagtccatctgccagctggctcgcaggactcaggcagggcagctgtcccggaggctgctggttggtgagccactgtcagctgagcgccgtgatgttgccccagggtggaagaagccacacttcctacactgtcagggcacttttaaacttntggaggngngtgtgtgtgtgtgtgtgnntgtgtgtgtgtnngtgtgtgtgtgtgtgtgtgtgtgttcattntgcccttccaaatcatntaagtgttatttaaggcanntctgctgtttgtatgagatggttcatagaaattatgacaaagcctttgttatccaggccatgg

SEQ ID NO: 165 - DNA, 500 bp, Mus musculus
ggttcgcctcttcttttggaagcaagtggcagaaaaagtcccactccagccaaagcacttcaggattttgaacccagttatcatcaaagaaactgccttcgacatccttcagtactcagagcctcagtcaagattctggggccatgataagaacatccccacgatcggcgtcattgccgttgtcttggctacacatctgtgtgatgaagtcagcctggcaggctttggctacgacctcagtcaacccaggacccctctgcactactttgacagtcagtgcatgggcgccatgcactggcaggtcatgcacaatgtgaccacagagaccaagttcctcctgaagctcctcaaggagggcgtggtggaggacctcagcggcggcatccactgagaactcggaacacggcaaacctcacccagcaccgcagctgagagcgtggtgagcagcctccacagggacttcaccctgcagctgcttcgatgtgcagctagtgttttca

SEQ ID NO: 166 - DNA, 583 bp, Mus musculus
  misc_feature (338)..(338): n is a, c, g, or t
  misc_feature (379)..(379): n is a, c, g, or t
  misc_feature (488)..(488): n is a, c, g, or t
  misc_feature (543)..(543): n is a, c, g, or t
  misc_feature (558)..(558): n is a, c, g, or t
ttgacccacccattgtggctagatacattaggatacacccaacaaaatcctataatagacccacccttcggctggagctgcagggctgtgaggtgaacggatgttccacaccactgggcctggaagatggacggattcaagacaagcaaattactgcatcttcatttaaaaagtcgtggtggggagactactgggagccctcccttgcccgcctgaacgcccagggccgcgtgaacgcctggcaagccaaggcaaacaacaacaagcagtggttacaagtcgatctgctcaaaatcaagaaggtaacggccatcgtaacgcagggctgtaagtctctntcctctgagatgtacgtgaagagctacagcatccagtacantgaccagggtgtggcatggaaaccttaccgacagaaatcctccatggtggacaagatttttgaaggaaacagcaataccaaggggcacatgaagaactttttcaacccncccattatttccagatttatccgcatcattcctaaaacatggaaccagagcatcncccttcgcctagagntcttcggctgtgacatttattagaa

SEQ ID NO: 167 - DNA, 546 bp, Mus musculus
  misc_feature (193)..(193): n is a, c, g, or t
  misc_feature (239)..(239): n is a, c, g, or t
  misc_feature (315)..(315): n is a, c, g, or t
  misc_feature (405)..(405): n is a, c, g, or t
  misc_feature (437)..(437): n is a, c, g, or t
  misc_feature (442)..(442): n is a, c, g, or t
  misc_feature (506)..(506): n is a, c, g, or t
tccttcatcgctgccactaagtgagatggcagctattatttcttcactgatttgaatataaatggggaaatattaagacctggcaagaatatgactgtttttcactctgattaaagacattgtataatataatagttatataatggaatgatatgattcactgtggctctttgaaatcctgtagacattagcnaaagataatacttttggaaatttttcatggacctagaaagcctttnctttctatatttttcttttaaaagcaaactgtaatttgtaaacaatagaaacaaaagtagttgaggtttttttttnatcatagagaaaaatatatcttgttgtaattaagtgagaacttaaaaatacccagtgttgggctggctcagtgggcaaaagtgcttgctnccaaaacaaaacaacaacagcaacacaacacnaaacnaaccttatggcttgagttcaagtcctggaacccacagtgaaaggagagagcatattccagaaanccgtcccctggtttctgcatgacccacgaccatgtacaag

SEQ ID NO: 168 - DNA, 164 bp, Mus musculus
aaccagtagaggatcacagttccttattgtgacatccttcccttggcctggaaagcttggtggtggcttttgcaacagcttgagggggggggggggattcttgactcagctggaggagcctggaagaatggttccctgtcacagtagtactgttgacacctgcc

SEQ ID NO: 169 - DNA, 436 bp, Mus musculus
  misc_feature (113)..(113): n is a, c, g, or t
  misc_feature (121)..(121): n is a, c, g, or t
  misc_feature (183)..(183): n is a, c, g, or t
gcagagtacgctggacgatgccacggatgactgggggatcaaggtggagcgggtggagattaaggacgtgaagctgccagtgcagctccagagagccatggctgcagaggcangaagccgnccgggaggctagggccaaggtgattgcagctgaaggggaaatgaatgcgtccagagctctgnaaagaagcgtccatggttatcaccgagtctcctgccgcccttcagcttcgataccttcaaaccctgaccactatcgctgcagagaaaaactccaccattgtcttccctctgcccgtcgacatgttgcagggcatcatgggttctaatcactgagctgtccaggtctatggagagctgtgctgaatccttcccagggtaaagtggggacaaagttagcctttaactcacagggagattagccagaaacttgact

SEQ ID NO: 170 - DNA, 588 bp, Mus musculus
  misc_feature (265)..(265): n is a, c, g, or t
  misc_feature (273)..(273): n is a, c, g, or t
  misc_feature (335)..(335): n is a, c, g, or t
taccgtgttcagaacgcaaccctggctgtggccaatatcaccaatgcagattcagcaacccgtcttttggcacaaactaccctcaggaatgcgctgggcaccaagaacctgtctcaaatcctctctgacagagaagagattgcacaccacatgcagagtacgctggacgatgccacggatgactgggggatcaaggtggagcgggtggagattaaggacgtgaagctgccagtgcagctccagagagccatggctgcagaggcangaagccgnccgggaggctagggccaaggtgattgcagctgaaggggaaatgaatgcgtccagagctctgnaaagaagcgtccatggttatcaccgagtctcctgccgcccttcagcttcgataccttcaaaccctgaccactatcgctgcagagaaaaactccaccattgtcttccctctgcccgtcgacatgttgcagggcatcatgggttctaatcactgagctgtccaggtctatggagagctgtgctgaatccttcccagggtaaagtggggacaaagttagcctttaactcacagggagattagccagaaacttgact

SEQ ID NO: 171 - DNA, 374 bp, Mus musculus
ggcgattattgacatccttactcattacgatgcaaaaaagaaagctgcccacgctgcaaaaactgttaaacatggcgctggagctgagatctcgactgtgaacccagagcagtattccaagcgctttttggactttattgggcacatcttgtaaccttctgcacagccccggatgggcatgaactcgggaaggctggtggtggcttcagggtaggaagaaaaggaaaaccgaaccccaggaagcgctcaccttgcaggaagcaagccttgtttacatcttcaagctgacatgactgaagttgggggctactcgctttaacagctacctgatatttcccagcatcgctatttctgactctgtacgtgtgcacaca

SEQ ID NO: 172 - DNA, 315 bp, Mus musculus
  misc_feature (142)..(142): n is a, c, g, or t
ggagcatatctataccttcactgcctcctttacacagaagatctttcccttgtttggactctggggcagagggtccagtttttccctgagctgtcaggaaggtgcagtttccctcctctgagtatgagactggaatcaagcncccttgggagcagaccctcggctgggtcaccaagcacaaagtgaattttttagacattgtttggcatgtgtcagtaagggacaaagtggtaggacctttagtttcttcattgttcaagcctttccccagtgcccatcagatactcgggtatctgggaccttggctgcgctggc

SEQ ID NO: 173 - DNA, 563 bp, Mus musculus
  misc_feature (253)..(253): n is a, c, g, or t
  misc_feature (519)..(519): n is a, c, g, or t
  misc_feature (524)..(524): n is a, c, g, or t
  misc_feature (533)..(533): n is a, c, g, or t
tcacaacctggttccattgtttttttctggtttgtttgtgttttttcttgtaacatttttctaccccaaactgattagtatctgtgattaatgtttctttgaaggaagaaaataatagaaaaggtgtttgtggagtacatgagtaatgccagcattccattggtagagtcaggaagatcagaagctcaaggttatactcagctatatataagtttgtgaccagtctgaactacaggggacattgcatcaaaanaaaagaaaaagaaaaaactgatatatattttttttaatttcttgagacaggtttcactcactatgcagttctagctggcctagaactcaagggtccatcagcttggcttctgcctctttgagagctaggatcaaatgtgtgtcctaccatgcctggcaaagactctgtaagtcaatttatttccttgcctaattaaattaattttggcctggtacttaatagtgaattaaggacctttttagagtcattttgtctatccaataatnaaaantctcgttcnttatttggtctatggttcccaaatgttaat

SEQ ID NO: 174 - DNA, 516 bp, Mus musculus
  misc_feature (119)..(119): n is a, c, g, or t
  misc_feature (407)..(407): n is a, c, g, or t
gaatcattctgctgctcgttgccgggctggtgctcacagtcatcgtggttgttggagccatccttctcatcccaggagaaaagcccgtgaagaatgcttctggacttggcctcattgtnatctctacggggatattaatactacttcagtacaatgtgtttatgacagcttttggaatgacctctttcaccattgccatattgatcactcaagtgctgggctacgtccttgctttggtcgggctgtgtctctgcatcatggcatgtgagccagtgcacggcccccttttgatttcaggtttggggatcatagctctagcagaactacttggattagtttatatgaagtttgtcgcttccaaccagaggactatccaacctcctaggaataggtgaagggaagtgacngactgtaacttggaagtcagaaatggaagaatacagttgtctaagcaccaggtcttcacgactcacagctggaaggaacagacaacagtaactgacttccatccaggaa

SEQ ID NO: 175 - DNA, 499 bp, Mus musculus
agggccacgccatttggtgaagccaggctagagatcctgcagcttctgaaaggcaagctggtggtgggccatgacctgaagcacgacttcaatgccctgaaggaggatatgagcaagtacaccatctatgacacgtccacagacaggctgctgtggcatgaggccaagctgcagtactacagccgagtgtccctgaggctgctgtgtaagcgcctgctacacaagaacatccagaacaactggcggggccactgctctgtggaagatgccagggccacaatggagctctacaaaatctctcagcgactcagagcccagcgagggctgccttgccctgggacgtcagactgaacttcatcctcatccagggttagaagctgccactcctcaagttctccatgaatgagacctgtttctaacaaccactgccaccaaccaccgcaatgtgtaaaaccaagaacactcccccattacagcaactctcttgctttgaggcaaa

SEQ ID NO: 176 - DNA, 218 bp, Mus musculus
taatctcccggaacggtgatggcatccgaatggaaataactgaaccaaattgcactgaagttttgaaatacctttgtagttactcaagcagtcactccccacgctgatgcaaggattacagaaactgatgtcaaggggccgagttcaactgcacgagggctcagagatgactttgcagagggagagagaggtgagcctgaagaaggaagctgcgagaa

SEQ ID NO: 177 - DNA, 491 bp, Mus musculus
caacaatagcctgcgttcagtgccaccaggtgccttcgaccacttgcctcagctgtgggacctggatgtgacacacaacccctggcactgtgactgcagcctcacctacctgcgcctctggctggaggaccacatgcccgaggccctaatgcatgtgtactgtgccagccctgacttggccaccaggcgcccgctgggccagctgacaggttatgagctgggcagctgtggctggaagctgccaccatcctgggcctatccaggggtgtggtgggatgtgtcactagtggctgtggctgtgctgggcctgattctgctggctggtctattgaacacatttacagagtccaggaactgagcctagcccataaaaccagggagagcccaggtccccagaagcatcagccccagtcagcccatgccatcaaaagcccacagggggcaggctgaggccgcctcatgggcaaagacacttgctgtccagtctaaag

SEQ ID NO: 178 - DNA, 462 bp, Mus musculus
  misc_feature (253)..(256): n is a, c, g, or t
  misc_feature (258)..(263): n is a, c, g, or t
  misc_feature (265)..(266): n is a, c, g, or t
  misc_feature (268)..(268): n is a, c, g, or t
  misc_feature (271)..(272): n is a, c, g, or t
  misc_feature (276)..(276): n is a, c, g, or t
  misc_feature (284)..(288): n is a, c, g, or t
  misc_feature (293)..(293): n is a, c, g, or t
  misc_feature (296)..(296): n is a, c, g, or t
  misc_feature (306)..(307): n is a, c, g, or t
  misc_feature (311)..(311): n is a, c, g, or t
  misc_feature (315)..(315): n is a, c, g, or t
  misc_feature (317)..(317): n is a, c, g, or t
  misc_feature (328)..(328): n is a, c, g, or t
  misc_feature (336)..(336): n is a, c, g, or t
  misc_feature (349)..(349): n is a, c, g, or t
  misc_feature (362)..(362): n is a, c, g, or t
  misc_feature (369)..(369): n is a, c, g, or t
  misc_feature (404)..(404): n is a, c, g, or t
  misc_feature (420)..(420): n is a, c, g, or t
tctattacctacaatctcactactccagagataacactgttaaatgtttttctgtatttacttgtagtccttgtgttttttatgagtgtgtatgtgtgtgtgtgtgtgtgtgcaacaacagaattgagattatagtgcccatacatttgcgttatgccctgttatcctaagtatctactacctgtgtctctgaaagcactattttaaaaatgcctgcctaatatgctatactgtatgaaaatagttctctctnnnnannnnnngnngnttnnaatnttcctcannnnnataanggnacggacattnngtgnaaantngacccagtctntaggatanaatcatgaaaatnaaataaatggttnacatganaattttgtaggccctttaaaagtatgccaaattanattttcaatagattgnatcaaattaacagcacccccacatcagcatcgtttcttttaa

SEQ ID NO: 179 - DNA, 580 bp, Mus musculus
  misc_feature (287)..(287): n is a, c, g, or t
acaaaccttaggagacgatcacgatcatttacttacaatgatttccaagatgtaaagtcagatgttgccatttggttatgagtaaaagtcatttgtcttcttttgatagtgtatgtgtatatctaaaatatatactaatactaatgtgtacttctaaaatatagcttgtgtataagaagagatgatttcatttttaaaatacaccatgcaaatacatattaaatgtaagaactttttatattatactaaaataattcatcatctatcttccgaaatattttatgaanatctatctgatattctattctaataaaattctttatttctacaataacagtcagtaagaagaagctttgtaaattgttaaagtaaaatgaaaactttgtagtaatgtcacatctagtttggattatatttctaagcaaagcaatgtatttagataactgtatatacagatgatattttacataatgatggattgaggcttatagaaatgacccattttttatgctgtggaagcatggacatttgttgttgcatactaattctgactacagattatctgtttatcacttcccac

SEQ ID NO: 180 - DNA, 516 bp, Mus musculus
  misc_feature (54)..(54): n is a, c, g, or t
  misc_feature (135)..(135): n is a, c, g, or t
  misc_feature (152)..(152): n is a, c, g, or t
  misc_feature (159)..(159): n is a, c, g, or t
  misc_feature (164)..(164): n is a, c, g, or t
  misc_feature (250)..(250): n is a, c, g, or t
  misc_feature (284)..(284): n is a, c, g, or t
  misc_feature (358)..(358): n is a, c, g, or t
  misc_feature (431)..(431): n is a, c, g, or t
  misc_feature (434)..(434): n is a, c, g, or t
  misc_feature (437)..(437): n is a, c, g, or t
  misc_feature (462)..(462): n is a, c, g, or t
  misc_feature (466)..(466): n is a, c, g, or t
aatcttaacccaggtagatgtctgagacttcactttgccatcatatgtactctnatgaacattccccattagatagagcaacaattttgttcacaggagtgtggtcatgtttcatttctccacatatccatggantagatcatctctcccantaaatgnacgantcattgaaacaacaccaaccagtgcttgaacgatgaagatggcatactttcacacaagcatttatgtctcatatttggaattttanagttggtatagaagttcaaactgagaggtggtgnaaatctatatccacaaatttgacaactttgacatcagcacacccttttctctcattatgttctttcaattcttncctagtactatattatacagtaagattatactaataaatatttatctctatattacagaaatgcttagtttcnatntgntacatggtatataaatataaatgtntgtnttaaagatgacatgctttcagattagtaaatgctcttaatttcatagaag

SEQ ID NO: 181 - DNA, 512 bp, Mus musculus
acaggttttagggtatcacttcaatttaccaagcatgtagttctagcgcactagcatggcaccagccatgtatttacaatgtagttacagagtaattacatggttatttttgcaatgtaaaataaagtgtttctgattattttctatgtaaaggaccccccaccctacccgtgccccctggctttggtataatatatttacttctccatacacagacctctgcagaatgcaacataaaacttgcagtgaatgaacttagcattttatgagagtgctgttggaaagacttgataattcacccctttttgttttgaagagttgaatcttctgttaaaaggtgatttaaaacttgaatgtgatgaattgtggcaagctcactccagttatgtgcaatacttatctcacactttggaagatctttgcagtgtaattctttgtttttaattgcagacattaaaaaatgtcattttctactgttaagagtaatcctctttcttgctggtgtttctaaa

SEQ ID NO: 182 - DNA, 350 bp, Mus musculus
  misc_feature (29)..(29): n is a, c, g, or t
  misc_feature (46)..(46): n is a, c, g, or t
  misc_feature (273)..(273): n is a, c, g, or t
  misc_feature (310)..(310): n is a, c, g, or t
gggacaatattgtattcaactgttttatnttttatatttttaaaantttaaagtataattagtttttataatttcatcagatttttgttatatttttttggaagtgaaacttttagcaagtgggtgtctagtttttactaatccctaatttttccagtgtattgctcatattatcagaagggaacgttatttaagtgcgtcagttaattgtactacttggctgaatttccatatagtttttactgtgtatggggaggttgtagtatttattcnagcattttaaataagggtaattcattttttattaaantcattttcacgttaagttcctatttttgtatgttctactc

SEQ ID NO: 183 - DNA, 482 bp, Mus musculus
  misc_feature (456)..(456): n is a, c, g, or t
gttatctgcagcatttccaccaggaccgtcgtgggggcagcctggacataaacgatggacactgcggccttggaagtgaggtgaacgccacgctgatgcaccggagacacaccgaccccgtacaactccaggcagcagggcgggtgcgttgggccagggcactgtatgactttgaggctctggaagaggacgagctgggattccgaagcggagaagtggttgaagtcctggacagctccaacccatcttggtggaccggccgtctgcacaacaaactgggtctcttccctgccaactatgtggcccccatgatgcgatgagtcgtactgcaaggcttaggggcttttcgtccaaagccgcctgcaagacagagaggggcgagggggtaaagctgaactttataatgacacatacatgcatacatgtgcatgtgtgcccgagtacacaaaacatgtntatgtatgccgatggctacacacgac

SEQ ID NO: 184 - DNA, 203 bp, Mus musculus
  misc_feature (178)..(178): n is a, c, g, or t
gacttggttctgagcatatacccacctgtgtgccacctcactgtgcggatcagttctgcgaaattggtgtctgttttaataaaggctcttgaaattacaaaagcaagtcacgtgagcccccacccaggagatagctggattcctttactcattaatgccgttgaccattgcatgaacngaattaaggcgctcactcagcgtgc

SEQ ID NO: 185 - DNA, 413 bp, Mus musculus
aaggctatggctcctgctagaattgctgattccttccacgtcataaagaatagttccttgtcagagtggcttatggggcctacgtgcaaaggaggccctaaggacgtgcctaatacagaggagagagctggcaaagagatgcttcaaagctccatggccacttcctggtgtccctttaacactgccgactgggttttaccaggaaagaaagtgggaagcctcagccagttcccctctggagaagataagtggctacttcgaaagaaggcacaggaagcatttcttaattcacccctacaagaagaacgtaactttcgccccgactgttacggcctcccagcagtttgtgatctctttgcctgtatgcagcttaaggttgataaagaaaaatggctgtacagaactcctctaca

SEQ ID NO: 186 - DNA, 223 bp, Mus musculus
gcatcctgaacctcctaaagtacagtgcagtgacatcttgattaccaggctgtgctcaacactgtgccttggagtgtctcaccgagacttcacagaactgatatccttgagttctgtattctagaaagcttctctaaggatttatcttttacagttcccaaggataaattagttgctttctattctttgaactattaatattaagcctctgaaatgcctatgc

SEQ ID NO: 187 - DNA, 587 bp, Mus musculus
  misc_feature (416)..(416): n is a, c, g, or t
acgggactctcagccgggaagatttccagaggattccagaacttgccatcaacccactgggggaccggatcatcaatgccttcttctcagagggagaggatcaggtaaacttccgaggattcatgagaacattggctcatttccgacccattgaggataacgaaaagagcaaagatgtgaatggcccggaacccctcaacagccggagcaacaagctgcactttgctttcagactctatgatttggataaagatgacaagatctcccgtgatgagctgttacaggtactgcgaatgatggttggagtgaatatctcggatgagcagctgggcagtattgcggacaggaccatccaggaggctgaccaagatggagatagtgccatatcttttacagaattcgttaaggttttggangaaagtggatgtagaacagaagatgagcatccgatttcttcactaaagggcagagaccaaattattcttgctttctagtatttaagaactgaaacttgtgtcctccagccccaccccatcctgtcatccccttttcccagaatactacagctcttgcatgacaacctgaag

SEQ ID NO: 188 - DNA, 373 bp, Mus musculus
  misc_feature (344)..(344): n is a, c, g, or t
ttcgttgctttggaaggctatccaaggtgtgtaaacaattctttagtaaataaattgctattaacccaaacaaacaaaaacactgcaaagaggatgggtaaaggtgagcaacaggggaatggctgggatagatggctggggctacatgaactggggattctttacgaaatatctgttagactttgtgatcaaatgatgtgataaaagaattgtataaagggaataattgtctgatactgatctgtttgagaagtattgagaagcttctcaatttaaatatttaaactttctaagcttatgcccccttggctgtgtatagcaaactgtttttatccacagttgtnccttattgtcccattaaagttgtattcct

SEQ ID NO: 189 - DNA, 161 bp, Mus musculus
gggccaaggattggtggcaccaactgaggtgacatttagaggtctttgagtgacccagctcaacttctctgccaatgtcagcttgatttagatctcactgaatcaggctgcttctgtcctgtgtccctgtgaatctgctcttggctggctttctctgatgt

SEQ ID NO: 190 - DNA, 279 bp, Mus musculus
gaataggactgaggccccagaagaaactgaagcagagagggagacccccagtgccatcaatggcaacccatcctggcacctggcggatagcccggccgtgaatggagccactggccacagcagcagtttggatgcgcgggaggtgattcccatggcagcagtgaagcaagcgctgagagaggcaggcgatgagtttgaactgcggtaccggagagcgttcagtgatctaacatcccagcttcacataaccccagggaccgcgtatcagagctttgagca

SEQ ID NO: 191 - DNA, 299 bp, Mus musculus
  misc_feature (88)..(88): n is a, c, g, or t
  misc_feature (274)..(274): n is a, c, g, or t
gccaccattgctaccaggagaaccactacatgcaactcacgccccttgccctatcacagggttgggcctagacggagtcccctgcaanttagctttctaggatctaccacacttctgtgaaagccaccttccccccacatctcagttctcttggcctcaaaactcacaaggttttcccctaaaccagctccttggaggctggcaggagcagagaggggtgtgtgagggaggagagcctgtcttgttggtgggaccctaattacccctgagcctnctcgggaatgcttttccagcaggga

SEQ ID NO: 192 - DNA, 402 bp, Mus musculus
  misc_feature (164)..(164): n is a, c, g, or t
  misc_feature (167)..(171): n is a, c, g, or t
  misc_feature (173)..(176): n is a, c, g, or t
tcagaatggcctggctaggagcccttcaggcctctctctcctctgtccacccttggcctgtctcatccctgtgggtcccagctcagctctggccaccccgggctctctgctgtacatattcgagactagtttttattccttgtgaagatgatatactatttttnttnnnnnannnncgtgtctgtatttatgtgtgaggagctgctggcttgctgtgcgcgtgcccgtggagagctggtgcccagagactgacagcctgatgctccctccctgcccttgcctggggaagcccaccaggggttctggcttctgaggggcacctgtccctcctctcccctcaccctacacttgttccagctctttgaaatagtttgtgtgaaggtgaaagtgcagttcagtaat

SEQ ID NO: 193 - DNA, 286 bp, Mus musculus
  misc_feature (158)..(162): n is a, c, g, or t
ttggatccagtttcatattgcacatgcaggaacattatataaatgagtgccttttattctcacacaatgagtcatggcatggtcccattgtaggcctgttaacttcatgaagttgacggtagcctttaaaagatacacacacacacacacacacacannnnntgaaataggagatttcctcaaagttttggggaaacttttacagtgtatcatgtgaattcagatttacctcaatactaagaattatgtttagatatgaaaaaaacttgttttgatctcaggtaga

SEQ ID NO: 194 - DNA, 497 bp, Mus musculus
ggtggctttcaagatcaactctgtcattaatcgcttcaacgtggacgaagacatgaatgaacacatcaaggccctgagccctgtgcgctggaaggttttccagtgcctcctaattgagggtgagaactcaggagaagatgccctgagggaagcagaaagatttcttataagcaatgaagaatttgaaacattcttggagcgtcacaaagaggtgtcctgtttggtgcctgaatctaaccagaagatgaaagactcctaccttatcctagatgaatatatgcgctttctgaactgtaccggtggccggaaggacccttccaagtctattctggatgttggcgtggaagaagcaataaagttcagtggatttgatgagaagatgtttctgaagcgtggcggaaagtatgtgtggagtaaagctgacctgaagctggactggtgaggctgagatgggaaggaaactccgaccagctacagggacattcacgcccagctat

SEQ ID NO: 195 - DNA, 557 bp, Mus musculus
  misc_feature (372)..(372): n is a, c, g, or t
  misc_feature (400)..(400): n is a, c, g, or t
tgttccccttgagaaactgggttattttttgctaactatgccaattttgtcaacaggaaacttcacaaaacacaccctccaattactgctgactattctaatgcttttctgctttggaatattggactttttactcaaaagtgtagaatcaaggcatatctcatagagccttaagttagaatcttactcttatggaaggagttatttcctagaacaggctgtttgttcatggtcccagcctctgatgctgctgcttcaagatggctgctttatactgcagcaattccttcagggttcttgacaaagccaaggtacactttacctcccagggtgtggccatgaggatgccacttctgcagctgcaactgcccnggcattgaggctgcttgagtctctcatnctgaaaggttgtcacacttttctgaaaagctccaaggccatgtggcacgtccagaagagtcgtggggggatagacaggaaggagtctttcaggaatataaaatgtggcagctggcttggtataaatgtgcctgtggttccttagcatatctttcaag

SEQ ID NO: 196 - DNA, 544 bp, Mus musculus
gggatcatgtcggtcacacagcaaaagtatctactggcggagaaggaaaatctctcagcgactctgcaacaattggccaagaaattctgccaagagttgattagacaatcagaaattaagacaaagagcacttttgagcacaagtgcagcccctgcgccacgaagtggagataccatggagatagttgctacgggttcttcaggcgtaacctaacatgggaagagagcaagcagtattgcactgagcagaatgcaacacttgtgaagactgccagccagagcaccctggactacattgcagaaaggattacttcagtccgttggattggattatcacgccagaactctaagaaagactggatgtgggaggatagctcagttcttcgcaagaacgggattaatctttctgggaatacagaagaaaacatgaattgtgcttatcttcataatggaaaaatccatccagcttcctgtaaagagagacattacttaatatgtgagagaaatgctggcatgacaagagtggaccaactgctttaatgca

SEQ ID NO: 197 - DNA, 461 bp, Mus musculus
tcaagtttcttttcctaacagtcaattaagctgaaccctgcttagtccccgacccccaactctaaacactcaactcatactgaatgcagagtgacaccttgagtcacactgagagctgagtcacacctgtgtctcttttcctcaaacatcctttccctcagcctctgttttcatcattctgtgagtcaccgaatctcaaagagcagaccccagactgtcagattccccacctctccagaaacctcttagaatggaaaactaacccaagccagacatttcaccgagactcagcggtcctggacttaacaagcctttcacatcattctgcatgctcctgtttgaaaacaactactatctggcccatgcagcaggccaaatcatcttgtgttcccgccctctcccttcatccatgttagactcccgtggacgtaaatctatctcccttgtctaatcagactcga

SEQ ID NO: 198 - DNA, 517 bp, Mus musculus
ttttctgccatgcaggcaagaccatcagcaccgagaaccccaaacctgttttgtacttagagactggctttggtcagtagttcactgtggagacaatgacagtattctctgtgccagtgtcgctgatggagctccccctccccacagggctgccattaccagaccacggccctgcagggccctgggctcctgtctgctgatgctgcccgcctcacctgcagaggtgcccatcagggcgagttctcaggtgtctgttgctgtgccatgggggccttcttcctggccctgtgcccctcaagcaggctctgcccacccaccctcccgttgtcacctgtgccagtctgacctagctgcacagagagaaggtccagcccacgtctaggaggggaggagtgggtatctctggcagcatgggctgcccgcaggctgggcagtgggtccctccacacctacctcagggagccagtgtgcgggcgggaactccacagcatgcctgttagtcaaggcctggaggaca

SEQ ID NO: 199 - DNA, 396 bp, Mus musculus
acttgacagggcgattgactcacaaagagttccgctcttgcctgagaggactcaattactatctgcctatggtagaggaaggtgaacctgagcccaagtttgagaaattcctgaatgctgtggatccagggaggaaaggatatgtttcactggaagactatacatcattcctgattgacaaggagtcagagaatatcaagaccagcgatgacatagagagtgcattccaagctctggcagaaggcaaggcctatattaccaaggaggacatgaaacaggctctcaccccggaacaagtgtcattctgtaccatacatatgcagcaatatatggatccacggggtcggagccaacctgctggctacgactatgttggcttcaccaattcattctttg

SEQ ID NO: 200 - DNA, 355 bp, Mus musculus
  misc_feature (258)..(258): n is a, c, g, or t
aaatgcttgttttcttcttgtcctgttttgatatttcaccattaaagtgaatgactttggcatgtcagggtcctctcatgttccctaaatctctgaatactctcttacattttaatatgatacaactgatgttttattcatttctatcttctcagaagccagtaaaatgttcataatttaaggaaaaaaccaagaagctatggtggtactatatctaggtgttttcagtacaggtatgtttcttaggtaactttgttngccttttgtgaaatttagcctttcgtacagatagcctattgctcatgaatatcactccttatttactatcttaagtctcagttttttcgcttgagta

SEQ ID NO: 201 - DNA, 467 bp, Mus musculus
aaggcatgctgcagcttataccacacaccctagcactctggtgcatcaggttcctgtcagtgtcgggcccagcctcctcacttctgccagtgtggcccctgctcagtaccaacaccagtttgccactcagtcctacatcgggtcttcccgaggctcaacaatttacactggatacccgctgagtcctaccaagatcagtcagtattcttacttgtagttgatgagcacgaggagggctccgtggctgcctgctagtagccctgagttcttaatgggctctggagagcacctccattatctcctcttgaaagttcctagccagcagcgcgttctgcggggcccactgaagcagaaggcttttccctggggaacagctctcggtgttgactgcattgttgcagtctcccaagtctgccctgtttttttaattctttattcttgtgacagcatttttggacgttggaaga

SEQ ID NO: 202 - DNA, 440 bp, Mus musculus
tgcctctctgagcatactagcagcaaaagagccaactctggagctagaaccaggttctggtcctgtcgttcacacctgctagctgtgcaaacttaggcaaatagcctttgagccttttccctctcatctacgaagtgtggataataacagaaccccatagagcagtgtgaacaattgagaacacactggctgggacagtcaatgcttaaaatgccccaattaatgtcctaagtatttcttctcttcctattctggcctttgttacatgatgaccatcagaaagttcttatctccagcccagacttctatagatagatcccacagtgttttctgtggattttaacatttgtttcttgctcctggatagtgagttgaaaggcaagggttaggatctgtccttaccccccacccccaccccagcatcttcaatactatttcac

SEQ ID NO: 203 - DNA, 498 bp, Mus musculus
  misc_feature (326)..(326): n is a, c, g, or t
  misc_feature (328)..(330): n is a, c, g, or t
  misc_feature (333)..(334): n is a, c, g, or t
  misc_feature (336)..(341): n is a, c, g, or t
  misc_feature (343)..(345): n is a, c, g, or t
  misc_feature (347)..(348): n is a, c, g, or t
  misc_feature (353)..(353): n is a, c, g, or t
  misc_feature (403)..(403): n is a, c, g, or t
  misc_feature (406)..(406): n is a, c, g, or t
  misc_feature (417)..(418): n is a, c, g, or t
  misc_feature (445)..(445): n is a, c, g, or t
aaacgccgtgaattgtacctacaagaacgaggatgactgtgtcgtcagattccagtactacgaagacaccagtgggagggcagtcctctatgtggtggaagagcctgagtgtcccaagggtcctgatatcctggtggtactgctgtcagtgatgggggccatcctgctcattggccttgctactctgctcatctggaagctactcatcaccattcatgaccggaaggaatttgctaaatttgaggaagaacgagccagagctaagtgggacacagcaaacaacccgctgtataaagaggccacctccaccttcaccaatatcaccnannnggnnannnnnngnnncnncttcngatgacgccaggaccgtgggactctctgccattatgtttacagaggacanttntgtgtgtgtgnntgtatgggtgggatttggggcgtgggnttgggctgggctggaagaatgtcagtatgtgggaatgtatctctctgtgtgta

SEQ ID NO: 204 - DNA, 280 bp, Mus musculus
atcactcttagcaaccagcatcaagacagcatctacaactgcaccgcaagcaaccctgtcagcagtatctctaggaccttcaacctatcatcgcaagcatgcaagcaggaatcctcctcagaatcgagtccatggatgcaatatactcttgtaccactgggggtcgttataatcttcatcctggttttcacggcaataataatgatgaaaagacaaggtaaatcaaatcactgccagccaccagtggaagaaaaaagccttactatttatgcccaagtac

SEQ ID NO: 205 - DNA, 356 bp, Mus musculus
tgttgcaagagaaccatccttccgtcatcgtgcagcctgggaagagacctctacctgtggaatccccggatacccaaaggaagcgcaggatacacagatgcgactatgatgggtgcaataaggtctacactaagagctcgcacttgaaagcacacagaagaactcatacaggagaaaagccgtacaaatgcacctgggaaggctgcacgtggaagttcgctcggtctgatgaactgacgagacatttccgaaaacacactgggatcaaacctttccagtgtccagactgtgaccgaagcttctctcgctctgaccaccttgccctacacaggaaacgccacatgctagtctgaaaa

SEQ ID NO: 206 - DNA, 500 bp, Mus musculus
  misc_feature (39)..(39): n is a, c, g, or t
  misc_feature (264)..(264): n is a, c, g, or t
atatccctttccttgtgtgtcttatcttattgttttggntggttaatatggtgataattgaaagtcaagttgaaattcaaatattaatatttctgatttgttgagctttgaattatgccaccatgcttatataaaaacgaaggtggcaccatgatgaaacttaaagaaacagtttctcatctgtaacagttttgattctctttcctgtgacctctttccccactgtctggaaccatagcaaaaggatactgcatctcttgttantgtagtgctgaggttattgaagttacagaaacacatctggtgtgtttcctagaaaagtacctgttcagtcttgctaggtgactgacaggagaggcaaatgtgttatgttttgcacaccaatgcagcagggtttgtataaccacatgacttcatagttgtgatctcaaaggaacttctcctttattttttcttgcaattaatgtaagaatactctaaatctctgcacttctgaagga

SEQ ID NO: 207 - DNA, 379 bp, Mus musculus
tgtatttctgcctaacaagtagcttttataatactctgaacttttcagaaaattgttatttgctttcctacacagtatgagggctattgacatccataacactttgatcccaagtaagtatagtgtgtctacaatgacaatataagggagacttgatcaatgctagagagtactacccattcaaaactgtaagctaaggtaatttttatattatgtaacagttttccaaagcacctccgaacaggaagagtaacataaatataaatctgcattatttgaaaagagttgtaagcttttttattcatgataaaatttacataggacagatataatctctggaaagccattggtactgactgtggtaaaagtacttggtgat

SEQ ID NO: 208 - DNA, 454 bp, Mus musculus
  misc_feature (140)..(140): n is a, c, g, or t
  misc_feature (238)..(238): n is a, c, g, or t
  misc_feature (243)..(243): n is a, c, g, or t
  misc_feature (285)..(285): n is a, c, g, or t
  misc_feature (315)..(315): n is a, c, g, or t
aaaagaaccgacgagctcacctgcgcctgtgtttagaacgcttgaaagttctgatcccgctgggcccagactgcaccaggcacacaacactcggtttgctcaacaaagccaaagcacacatcaagaaacttgaagaagcngagaggaagagccagcaccagctagagaacttggaacgagaacagaggtttttaaagcggcgactggaacagctgcaggggcctcaggagatggagcngatancgaatggacagcattggatcaaccatctcttcagatcgctcngattcagagcgagaggagattgaagtggangtggaaagcacagagttctcccatggagaagcagacagtgtcagtaccaccagcatcagtgaccttgacgaccacagcagcctgcagagtgtcgggagtgacgagggttattccagtgccagtgtcaaactctccttcg

SEQ ID NO: 209 - DNA, 585 bp, Mus musculus
  misc_feature (148)..(148): n is a, c, g, or t
  misc_feature (370)..(370): n is a, c, g, or t
cagcgctggcaatgcaccttctaaaaacaagggctagagaaaccccccacccctgccgggatcgcctttcctcgccttccttgcctctcttcttgcatagtgtggacttgtaaagcctgagacctgcctcaagaaaatgcagttttcnaacccagagtcagcactcggcctttaacgaatgagaatgcatcttccaagaccatgaagagttccttgggtttgcttttgggaaagccaaagcgcctatttacttcccactaggaaggtgcccgctccactctgccttactcacagagccagaacttcttcgaggccacctctgagcagcacacacagaagcattttcaggcatgtcaaagaaaggaaaaantgactcactagaactcaccgccaaacaacctctgacataggtcctgagatgtggggaggcaggagccaaagctctagggagggcatgtacccaagagatgactgtatgaagaaaatgtggaggagctgttcggtactaaatcattttcaggggacagacagacttgctgcatttccgcatgctgctggtgagagctgattgacccaatcttccac

SEQ ID NO: 210 - DNA, 524 bp, Mus musculus
  misc_feature (133)..(140): n is a, c, g, or t
  misc_feature (148)..(148): n is a, c, g, or t
  misc_feature (152)..(152): n is a, c, g, or t
  misc_feature (479)..(480): n is a, c, g, or t
ggagagctagagaaccttaccgtctcagtgagctctagctgcctccgcaggaggggcagtgcgcctttactttatggttagaaaggcacaaaatttctatcaacctaactaaaacattccttttctttctttnnnnnnnnctttcttncttnctttttctctcagttaccatggatttttccaaatctcttttggtttttgtttaacaaatgctttaacaatgtaatatatttattttgttcccctattctggagggttcgtcggaaggattgttactgaaacaggaagcgtgggactatctgaatcatcttcgtagtgagtctttatgactgtaagattgtaaatacagattatttattaaccctgttctacctggaattagactgcatatagcaaatgtttgcaagcaggtagctgaggcggatcagcaaatctctccaaaaccagtgtgtggaaaggcagcagaggcagctgcttnntcatctggggctcacagtgaatgatttggactcctttggcttcc

SEQ ID NO: 211 - DNA, 494 bp, Mus musculus
ctcaccggtccttagggaattgacaattggctccttccctaagcagcacagttggacagaatccagcgtccgtccgtcctaccttcccatccagagtttgtttcccatgagggtgcttagcgccagccaaccattcccatgtgtcgcatatgcacacatgaccacacacaccagagcaggactcctcggatgaggctagacttgaggaccacaggaaacacacccctgcacttagaagggctttgggatcgggggcaacctggtgggggcaagtgggagctctccatctgtactgagtctccaaccttgcccctcactgcacaagaccaccctgaccgtgaggacctcctccctgcaccagatcctaactctgacctttcaccttctctctctcctgaaggaactcttctgagtggacatgggcccaaggccttacctaagcggagagggagggcaggggctgctactcttctctgtaaccttctctgatgggt

SEQ ID NO: 212 - DNA, 469 bp, Mus musculus
gaaaggcaggagctagcacctctctcacgctgggtacacttgtcctggcctgtgtttgcctcaccctggcctttacagtgtaaaaacaccatgggactttagagcagggaaggataaggaacagtgtcacttctagagccttctgctggtagacgctcctactgatagaggaggtaaagactactgacctcccggctaggcctggcttaagccaggcgtgcctgcgtcacaaccttttgcggtgtcttagcaacctgaacctgagatcttattcccgaatcccacagggcccaatgtgcagggctcagcctggggccatctcccttttcacctgggttggtgagcatgtatttggagtggtttcttcctgcatgtattagccaaggaaggacaagggactagagggtctgagttaggtccagacttgtcccctttccccagcccatcacaggatgctgggtgcacaccc

SEQ ID NO: 213 - DNA, 539 bp, Mus musculus
atattcacctgaacacttgtgccaaaagcacctggatggggagttgtgtttcacatgaagtataaatttgacaacatcctgaaaaatctaaaagtgcaatttttttctttaaagaattttctctggcaccacagatcctgtagatacctatttatatttatacatatatatttatgaaataattcttattcacaaaatatatttctgaatagcctaaaaattaagatactaaatctgatgcttaaattttctttaatttggctattactgttttttgtttaaaacttaaaacttgctttttaaattgtgtatagattttaatctaatagttgctggtatagatttggactgtgtgtgtgtgctcttaagaaaacagttttgaatgtctaaacatttgatttaaagttccctgtttatctttttgaccaaaggagcaagagatataatggatatggcattcattaaaatcattaatatataggaaaaataatatttatagcatcagcaaatatttttaagtggtatatgatcttggacaa

SEQ ID NO: 214 - DNA, 509 bp, Mus musculus
  misc_feature (162)..(163): n is a, c, g, or t
aatatcacttactcgttaggcctggcttttgttagcccagaaagggatcttgccctttaagacccccagggctagagggaaggcctgactcaggagcctctgggagccccatcctcactactgtgaaccccagagcctcgctggtcagcacttgctgctggnnaatggaccagtcaccgagctttgctgtttgatccttctctgcccttccctgttttcctttctatatctggcccagaagacctcttgtatgtgtggtttttctgtgttgtactagtgacttgagtctaggccctttgttgcatggtcatggatgcacagtgccttatatacatgtatgcacacaaaccgggtccaagtattttggtaagcatgatggcctatggcaggagtgtgtgtgtgcgcgtgtgaacaaagtcattacacttagtgtttggaaatgttaaagaagcattgttattatggggaggggggagcaacctctgggttcagaatctacatatgctgga

SEQ ID NO: 215 - DNA, 375 bp, Mus musculus
taacagctgggtattgaattcttccaacataaagtgcaaaaaaatatcatggccagtaaactgagcttgggatttggagtccttgagccacctgactatgtgtggctttggctagctaattaaccctgtcaaaccttggattccctattaacaaagtaaggctaatatcaatgttacaggattgttatattagatgaaaatactgtatgtgaaatatctgacagactctggaacatttgtgtttaggtaaaggctagcttcatgttcctggaagagaactgagttatctgggtatattcatgtatatgtatgatatgtatgtgtgcattatatatggtagtgtatgccatataggtgccatagcagatctttgtg

SEQ ID NO: 216 - DNA, 528 bp, Mus musculus
  misc_feature (441)..(441): n is a, c, g, or t
cagcaatggcctgggacctaaaggtgaagatgctgggggtaacaatttcctggtgtctgtgactaactccatgatggtgtcagaactgaagaagcagattgcccagaagattggtgtgccggctttccagcagcgcctggcccaccaaaatgaagtgctccaggacagtcttaccctttccaggctgggtctgggtcccagcaacacagtcatgctagtggtacagaactgcagtgaccctctgagcatcctggtgaggaacaaaaggggccacagcaacatatatgaggtctttctgacacagactgtagacatgcttaagaagaaggtgtcccagcgggaacaagtccatgaagaccaattctggctgagcttcgagtgaaggcccatggaggacaaagagctgctgggggagtatggcctaaagtcccagtgcacagngatcaagcatttgcgcctgaggggtggggaggggaccaatatgcctaaggcccccatccagagccagtgttggttataaaagatgat

SEQ ID NO: 217 - DNA, 439 bp, Mus musculus
tacagcaatggcctgggacctaaaggtgaagatgctgggggtaacaatttcctggtgtctgtgactaactccatgatggtgtcagaactgaagaagcagattgcccagaagattggtgtgccggctttccagcagcgcctggcccaccaaaatgaagtgctccaggacagtcttaccctttccaggctgggtctgggtcccagcaacacagtcatgctagtggtacagaactgcagtgaccctctgagcatcctggtgaggaacaaaaggggccacagcaacatatatgaggtctttctgacacagactgtagacatgcttaagaagaaggtgtcccagcgggaacaagtccatgaagaccaattctggctgagcttcgagtgaaggcccatggaggacaaagagctgctgggggagtatggcctaaagtcccagtgca

SEQ ID NO: 218 - DNA, 561 bp, Mus musculus
  misc_feature (75)..(75): n is a, c, g, or t
  misc_feature (182)..(182): n is a, c, g, or t
  misc_feature (190)..(190): n is a, c, g, or t
gggaagaacctagtggccattctgcatctcctcgtctccctggccatgcacttcagggcccccattcaccttccngagcatgtcaccgtgcaggtggtggtcgttcggaagcgagaaggcttgctgcactccagccacatctcagaggagctgaccacgaccacagagatcatgatgggccnggtttgancgggacgccttcgatactcttttcgaccacgccccggacaagctcaaccttgtgaagaagtctctcatcacgtttgtgaacaaacacctgaataagctaaacttggaggtgactgacctggagacccagtttgcagatggtgtgtacctagttctacttctgggccttcttgaagactactttgtcccccttcacaacttctacctgactcctgacagctttgaccagaaggtgcacaacgtggcctttgcctttgaactgatgctggatggaggcctcaagaagcccaaggcacgccctgaagatgtggtgaacttggacctcaagtccactctgcgggtcctttacacgctgttcaccaagtacaagga

SEQ ID NO: 219 - DNA, 551 bp, Mus musculus
  misc_feature (234)..(234): n is a, c, g, or t
aagttccaggtcattgccattgaaggactggatgccactggtaagaccacactgacgcagtcagtgtcagagtctctcaaggctgtcctcctacagtcgccacccccctgtatcagccagtggaggaagatctttgatgatgaacctactatcattcgaagagccttttattctttgggcaattatctcgtggcttctgaaatagctaaagaatcaaccaactttcctgttatngtagacaggtactggcatagcacagccacctacgccatagctactgaggtgagtggaggcctacagtacctaccccctgcccaccaccctgtgtaccagtggccaggggacctgctgaagcccgacttggtcctgctgctgactgtgaattctgaggagagagtgcggagactgcagggccggggtcaggagaaaactaaagaagaggctgaacttgaggccaataatgtgtttcgtcagaaggtggaaatgacgtaccagcgtatggagaacccaagctgccatctggtggatgccagcccctcgagagagacagt

SEQ ID NO: 220 - DNA, 572 bp, Mus musculus
atacaatctctgtggatcggccagtgccaaggcctggccacacagaccaggaaagtgaggagcagcagcaattccggaacatcttcaggcagatcgcaggcgacgacatggagatctgtgcagatgaactcaagaatgtcctcaacacagtggtgaacaaacacaaggacctgaagacacaagggttcacgctggagtcctgcagaagcatgatagctctcatggatacagatggctctggaagactgaatcttcaagagttccatcacctctggaaaaagatcaaggcctggcagaaaatcttcaagcactatgacacagaccattccggtaccatcaatagctatgagatgcgaaatgcagtcaatgatgcaggcttccatctcaacagccaactctatgacatcatcaccatgcgctatgcggacaaacacatgaacatcgactttgacagcttcatctgctgcttcgtcaggctggaagggatgttcagagcttttaacgcgtttgacaaggatggcgatggtatcatcaaactgaatgtacttgagtggctgcagcttaccatgtat

SEQ ID NO: 221 - DNA, 541 bp, Mus musculus
  misc_feature (289)..(289): n is a, c, g, or t
  misc_feature (321)..(321): n is a, c, g, or t
  misc_feature (330)..(330): n is a, c, g, or t
  misc_feature (333)..(333): n is a, c, g, or t
  misc_feature (364)..(364): n is a, c, g, or t
  misc_feature (385)..(385): n is a, c, g, or t
  misc_feature (398)..(398): n is a, c, g, or t
  misc_feature (400)..(400): n is a, c, g, or t
  misc_feature (403)..(405): n is a, c, g, or t
  misc_feature (415)..(416): n is a, c, g, or t
  misc_feature (453)..(453): n is a, c, g, or t
  misc_feature (455)..(455): n is a, c, g, or t
ggaggtggattctttctccttcagctggcaaaccatactggatacatcaaagttgactggcaaagagtagaaaaagacatgaagaaagccaaagagcagttgaaaattcgtaagaataagcaaataccaactgaggtcaagagcaaagctgaggaggttgtatcatttgtaaagaagaatgttctagtgactggaggattttttggaggctttctgcttggcatggcatcctaagaacttcacttcattgttctatttttatagttgtttgtttcttgccagcagcttntacactccaacataggacaatcggcactcctnttcctcatnttntcctgtgccttcctccctgttgtagcaaatntgaatggctttaataggcttntcctggtgcaagntnttnnntcaggccttnntcaatttaacacgttggaagagacagtaggtgttaantnttccagtaccctccttacttggttggtgtgtagcttaacaagaatgttccttttcccctatgtaagatccttttccaaactcaatt

SEQ ID NO: 222 - DNA, 565 bp, Mus musculus
  misc_feature (34)..(34): n is a, c, g, or t
  misc_feature (124)..(124): n is a, c, g, or t
  misc_feature (187)..(187): n is a, c, g, or t
  misc_feature (239)..(239): n is a, c, g, or t
  misc_feature (280)..(280): n is a, c, g, or t
  misc_feature (296)..(296): n is a, c, g, or t
  misc_feature (305)..(305): n is a, c, g, or t
  misc_feature (356)..(362): n is a, c, g, or t
  misc_feature (364)..(365): n is a, c, g, or t
  misc_feature (367)..(367): n is a, c, g, or t
  misc_feature (370)..(372): n is a, c, g, or t
gaagtatcatcagggcatcaaggcagagatcaantaccagggccaagaacttcagcacctgcctagagcttggggagtccctgctacagaggcaacaccaggcctcggacgagatccgggaganattgcagcaagtgatatccaggaggcaggagatgaatgacaagtgggaggcccgctctgacanggctccacatgcttctggaagtgtgccagttctcgagggatgcctctgtggnccgaggcatggttgattgcccaggagccctacctggccagncgggactttggacatncagtggacnagcgtagaaaagcttatcaagaggcacgaggcgtttgagaagtccacagcnnnnnnngnngngcnnnttgccgccctggagaagcccaccacgcttgagcttaaggaacgccagactccagaaagacccacagaggaacctgggcctcaagaggaggaaggcgagacagctggcgaggccccccaggtccaccatgcggccacagagagaacatctccggtcagtttcatgtcccgcttgtctagttcctgggagtcgct

SEQ ID NO: 223 - DNA, 421 bp, Mus musculus
tcaggacctattgggcacagtgggcattaggtactcaggccatagtctgtgacagtgagtggagatcctacgacttcactggactctactaggatctaactgggatgggaggctgagacaattacaggacatcctagccatttctcctttatctgaagccccctctacatctaggcacccagatccagacctcacaaatcaagaggtagaggtgatggaactgggtggtcacaggatcagcctcccacattgagcctccactcagaacattgtcaggctacatggtcactactaccactttgtgagggaaaaagctagaaaaagcaaacagaaatggagcatggctcccgctcattcatacttggaagaaaacttggaaagccattagccaggatgggagcactatccctaaatatcatga

SEQ ID NO: 224 - DNA, 522 bp, Mus musculus
  misc_feature (325)..(325): n is a, c, g, or t
  misc_feature (339)..(339): n is a, c, g, or t
  misc_feature (341)..(341): n is a, c, g, or t
  misc_feature (368)..(368): n is a, c, g, or t
  misc_feature (389)..(389): n is a, c, g, or t
  misc_feature (474)..(475): n is a, c, g, or t
attgttacacctaaggctcctgttttgcacagccaaatttaagactggtagagtggatttttctttaactgccttaatttaactttccggattgcctttgtttttgacgtggctgacttccacacgctggggcagggcctgcccatctgcactgctgggatgctctcccccaggtcacctgtgctaacagagtggctatcccagcctgctcccacaagcattcttctcataagattgaccttggctcaagactgccaatggatagctgtgcctctggtgaaagttctgtcttaaatgtgcaatagaaggtgatgttaccctttgnccttctttctccantntcctagaagtgaggacccttgctgacnccaaatgcacacaggttcccntctcccttgtcactaaagcacagggtcgacagacttgaatgctagttacatttgtttgtatatgatatttatttttttcttcaannccatcttgctgttgactaataggccaaagatgcttctgggtggttta

SEQ ID NO: 225 - DNA, 510 bp, Mus musculus
aacgaatgtacccttgtgcatgctgacctcagcgagtataacatgttgtggcatgctgggaaggtctggttgattgacgtcagtcagtcggtagagccaacccatcctcatggcctggagttcttattccgtgactgtaggaatgtttcacagttcttccagaaaggaggagtaacggaagccctcaatgaacgggagctgttcaatgctgtttctggcctgaacatctcggcagacaatgaagctgatttcttagctgagatagaagctttggagaagatgaatgaagatcacattcagaagaacgggaggaaagcagcctcgtttctgaaagatgatggaagcccacctgtgctgtctgccgactagtacagcggtgacggacggcagctgccatagccagcgagtggaggtgacctgacataccaaagcaggagtggacagtgctgcttctgggcttctcacttgtgacccacgtgccagatgtgtgcaatttttaactcggcattg

SEQ ID NO: 226 - DNA, 494 bp, Mus musculus
  misc_feature (261)..(264): n is a, c, g, or t
  misc_feature (287)..(288): n is a, c, g, or t
  misc_feature (292)..(292): n is a, c, g, or t
  misc_feature (303)..(303): n is a, c, g, or t
  misc_feature (308)..(308): n is a, c, g, or t
  misc_feature (317)..(317): n is a, c, g, or t
  misc_feature (323)..(323): n is a, c, g, or t
  misc_feature (325)..(325): n is a, c, g, or t
  misc_feature (328)..(328): n is a, c, g, or t
  misc_feature (332)..(333): n is a, c, g, or t
  misc_feature (336)..(336): n is a, c, g, or t
  misc_feature (338)..(338): n is a, c, g, or t
  misc_feature (343)..(343): n is a, c, g, or t
  misc_feature (360)..(360): n is a, c, g, or t
  misc_feature (362)..(362): n is a, c, g, or t
  misc_feature (366)..(366): n is a, c, g, or t
  misc_feature (369)..(369): n is a, c, g, or t
  misc_feature (388)..(388): n is a, c, g, or t
  misc_feature (392)..(392): n is a, c, g, or t
  misc_feature (411)..(411): n is a, c, g, or t
  misc_feature (437)..(437): n is a, c, g, or t
  misc_feature (439)..(439): n is a, c, g, or t
  misc_feature (448)..(448): n is a, c, g, or t
  misc_feature (460)..(460): n is a, c, g, or t
ggtcgctacctgatgtgcagaaggcctgtcttcagatgactatcacatggcacctgggtcgcctgcagccagacatggtacctctaggacaccacacagaaaaatatttctcagacccaaggaccaaagctgtgctcagccaatttcaagcagatttggacaatttggagaaagagattacagcccggaatgagcaacttgacctgccttatgaatacctcaagcccagccgcatagagaacagtatcaccatctgaggcnnnngctgctgggacccagaaggcttnntcanccctaggactnccacnacccacttnattctntnccntctnnatntntgctnctgagactctaattccntntccngantaaacactccacattagtnttcnaactacagggcactaaatntcttgctgttatgaggaacaatttantntttggaggnccacccactttntaccacaattacttagctttctcactataccact

SEQ ID NO: 227 - DNA, 521 bp, Mus musculus
ttaatctcagcacctttaatctctggaggcagatgcagcagatctctgagttcaaggccagcctggcctacagagtgagctccacgacagtcagggatgaagccctgtctcaacaaaacaaaagtgcaaaaccaggcgtggggacacacgcctttagttccagcactctggaggcagagacaggcagatttctcagttcaaggccagcctggtctacaaaatgagttccaggacagccagggctacacagagaaaccctgactcgaaaaacaaaacaaaaacaaacaaaaagtgctttgcatgatttcaggttagatttggtctaacctcatacagacctcaggctccaaacctcattttcaaaatatccaagagccatggtggaggagaggaaaattgtatttctggataaaatcaactacttcagctagttctcctttgccaggaaccagacttcatgcttgacggccaacgtgtaaatttcagactctcttcccctccacgtttccattttgaacaca

SEQ ID NO: 228 - DNA, 509 bp, Mus musculus
  misc_feature (303)..(303): n is a, c, g, or t
  misc_feature (446)..(446): n is a, c, g, or t
tgaaaaacttcttctttgcaccctcttgtattcagctgagccaagaagacagcttttccactgaagcttaaacaggcattaacgcttccttagatctgaagtcgcaggttaagcttgtctggtctacattccagtgtggggggaaaaaaaatcaatctttattctgttaatttcttggaaacaaattcatagtaatagctatttgggaccagacaaaatcagctttcatctataattcattgggggtaataggggatttagataatgtatccagagttaaacataccagtttgacccaccccnttaagcgtttaaaataaaatatgcaacaaaatggatgacttagtggagatggaagcccattaactgggttccccatcaaatcgtttacatacaagtacacagtttttataaggattcctgttaaaagtcttgtaaagttgatntctttcacccagatatatcacatgtgagtggaagaccagtgtgacttcattagatacgtttag

SEQ ID NO: 229 - DNA, 399 bp, Mus musculus
ggatgcacttgaatagctggatcttacaccttgatttcaaggtggaaagaaattgatcatgaatctctaatttcaaatcaaaccagtaggtgcttaatatttttgatttgaatattgcccacttgaatatcatgggttctattaataataactaaggaccccagtccattgtcatctagttgtccttggacttttttccaaggtataatatggggttttatgcaaaattccaagctaccatatgcattgttgtggtccagaaatgccaaaacttaaagggtggcacaacttgagtccttggcttgactgtactggcttggtctttgtggcatatcagttgccatctgcataggagagtggttgtatgtaacacagcccaaaattgctaatctcacatgt

SEQ ID NO: 230 - DNA, 454 bp, Mus musculus
  misc_feature (106)..(106): n is a, c, g, or t
  misc_feature (402)..(402): n is a, c, g, or t
taggtgcacttacaacatgggacgcaccagcacagagcactcttcccacctagtttggaagcgtggtgaaacaatcttttatttccaatttgatcgtagcaactcngtaaaaagaacacataatcatgatctgtcaacccccacttgaaactttgacatcaagattaaagctgccaaattgattccaggatcaaacccccacccctaagaatgaaagacaagccacagaattttctaagagtcagaaagacacaggattccttttgccaggtaagataaagagggagaaaaaggcaatggtgaattttcaagtttcaaaacccaccacaccaggcaacagacatccttctgagtgctgtgggaacacctgcggggtactcatctgcagtcagaaatcatttnttctttattgaattccaacttcatgatggatgaaaacttacagccgctgggc

SEQ ID NO: 231 - DNA, 331 bp, Mus musculus
gctgactgacaagctgggccttcagcacctgcgtagccgcacgtggtacgtccaggccacctgtgccacccaaggcacaggcctgtatgatgggctggactggctgtcccacgagctgtcaaagcgctagccagccaggggcaggcccctgctgcccggaagctcccgcgtgcatcccgggatgaccagactcccggactcctcaggcagtgcccttcctccccactcttcctccccacagacaggcctctgctcctgcgcctgcctgcatgctctctcttgtcgttggagcctggagccttgctctctgggcacagagggctctgctctc

SEQ ID NO: 232 - DNA, 513 bp, Mus musculus
  misc_feature (155)..(155): n is a, c, g, or t
  misc_feature (159)..(159): n is a, c, g, or t
  misc_feature (335)..(335): n is a, c, g, or t
  misc_feature (347)..(347): n is a, c, g, or t
  misc_feature (349)..(349): n is a, c, g, or t
  misc_feature (354)..(354): n is a, c, g, or t
  misc_feature (369)..(370): n is a, c, g, or t
  misc_feature (378)..(378): n is a, c, g, or t
  misc_feature (380)..(380): n is a, c, g, or t
  misc_feature (385)..(385): n is a, c, g, or t
  misc_feature (409)..(409): n is a, c, g, or t
  misc_feature (427)..(427): n is a, c, g, or t
  misc_feature (445)..(445): n is a, c, g, or t
  misc_feature (451)..(451): n is a, c, g, or t
  misc_feature (453)..(453): n is a, c, g, or t
  misc_feature (462)..(462): n is a, c, g, or t
  misc_feature (474)..(474): n is a, c, g, or t
ttctagtagcccaggccatcatagccgcgttcatcgtgtttgccatgattaaaatcggccagctgtttcgaacattaatcagagagaagctcttgttagaggcaatgggaaaatcgtgtaactaatgaaactgaccagagcattgtggacggggncccnaggagaatgcagtcaggatgctggcgtgccattacactatttcccaggccttttctcctctcccgtgctcttagtgtctcttcttctcccctctcttcagaagtagcttttgtaaatcgctactgctttctagcctggcctgggttacctcctctgctgttagtttcaagggggcngagggtgggggntngacgngacttggctcatcanntccaactntncagcnctgggtgcctagtggagagagganccctttcttggtttctgnatttgaggacacatcctnccagtngncaagacctntccgggacccancaagggttgagtaacatttgctgaaggaacaccggctta

SEQ ID NO: 233 - DNA, 537 bp, Mus musculus
gaagagaccagtggccgtgtacaacctttgtcttgagctggaggagggtgacagtcccagccctctcaaggaggacccccccagcagcagtcaggactctctctccaccccatctcccacaacgtcagctgcccatgggcctcctggactagacggaaaccacctagcagcagacggagggagctgtggagatgccaccgccaccacgccaagccagacccggccatccatggtgcagtggctaaatatgcagtctccaaccacaccaagctccaacccagctggaacacctccttcacccagaatgtcaccgttccccctctctcctgctgcctccattgtagacaagctgcctgagtgcgttatcaatcgaaaggctcgggcagtgtacccgtgtgaagcagaacacagctcggaattgtcatttgaaataggagccatttttgaggatgttcagacctcaagggaacccggatggctggaagggaccctgaacggcaagcgagggctgattccacagaattatgtcaagctcct

SEQ ID NO: 234 - DNA, 304 bp, Mus musculus
aggatgcacctctatgtttgagcagtttcttggttatcttttatcctcagcttgatatatcctgggacatctgaaaagagctgcttgcaccacactagcttgcaggcatattgtggcacttttatcctggattcctgactgttgtcgtatgacacagtcaactgtgagtgcttccatccctacgcaggtagtcttggcctatatatgaaatcttgctgtgcatgtgccaatgaatgaaccagcaagcagaattactccatgattcctacccagtttcctgccttgacttttctgccctgagttt

SEQ ID NO: 235 - DNA, 464 bp, Mus musculus
  misc_feature (68)..(68): n is a, c, g, or t
  misc_feature (76)..(76): n is a, c, g, or t
  misc_feature (80)..(80): n is a, c, g, or t
  misc_feature (84)..(84): n is a, c, g, or t
  misc_feature (88)..(88): n is a, c, g, or t
  misc_feature (90)..(90): n is a, c, g, or t
  misc_feature (92)..(92): n is a, c, g, or t
  misc_feature (96)..(96): n is a, c, g, or t
  misc_feature (116)..(116): n is a, c, g, or t
  misc_feature (120)..(120): n is a, c, g, or t
  misc_feature (124)..(124): n is a, c, g, or t
  misc_feature (126)..(126): n is a, c, g, or t
  misc_feature (130)..(130): n is a, c, g, or t
  misc_feature (133)..(134): n is a, c, g, or t
  misc_feature (136)..(139): n is a, c, g, or t
  misc_feature (141)..(144): n is a, c, g, or t
  misc_feature (146)..(147): n is a, c, g, or t
  misc_feature (151)..(155): n is a, c, g, or t
  misc_feature (157)..(158): n is a, c, g, or t
  misc_feature (161)..(161): n is a, c, g, or t
  misc_feature (164)..(168): n is a, c, g, or t
  misc_feature (170)..(172): n is a, c, g, or t
  misc_feature (175)..(175): n is a, c, g, or t
  misc_feature (282)..(282): n is a, c, g, or t
  misc_feature (293)..(293): n is a, c, g, or t
  misc_feature (323)..(323): n is a, c, g, or t
atctggtgtgtatacattatatctcaagatggtacacatttaggtcgtactttgttttattttgaganagaaaganaganaganaganananaganagagagagagagagagaganaganagananaganagnnannnngnnnngnnggannnnngnnagnaannnnnannnctngctttagtctgcatgtccagcattgctagcacatcagaaatatcaaaatgagctgccagattcccctctcccatttctctctgaggctggcaactgtttaggctgtntgttttgactnttgccaaagggtttacagaccccacacttntcctcttgaagggtgtgcattttgatgttgaacatcagcttttatttaaacttaagactcacatgcagtaatataggcaaatgtaattctggaagcaggaatagcagtggtaatgtaacaccatcctgttgagattcagat

SEQ ID NO: 236 - DNA, 527 bp, Mus musculus
  misc_feature (312)..(312): n is a, c, g, or t
  misc_feature (341)..(341): n is a, c, g, or t
  misc_feature (413)..(413): n is a, c, g, or t
  misc_feature (439)..(439): n is a, c, g, or t
  misc_feature (449)..(449): n is a, c, g, or t
agaaagatccggtgaccaccatttattcctcagtgcagctttctgagaagatgaaggaaaccaacatgaaggacagaagtctgcctaaggctttgggtaatgaaattgttgtctaggtgattctctaagaccacgaaggacacaaggacaagtcatctatgaggattgaatcaacggtttcagtcttttggatataacctgggccagccaagggatttaggaatgaagcaagctccgtgggtagaggtctgatccccagtgtgtaatgttaggggccatgtacaggattgactctcaggcccacagatcttnacccagagaaaccctgacctgctcccatnctgtttttcctggggaaaggaccctagggcactcaacctttatgcaatcagacatgcctctcagagactgtntaacagcttccagactaatctctgtncagtacttantcttacaactctcacgggcaacggcttcaagttccaattttacgatgtgtctagcctgggatgactgtttagtttcta

SEQ ID NO: 237 - DNA, 370 bp, Mus musculus
tgctgctccatgctttggccaataagatgggtctgaagtttcagaggtaccgacttgttccctatggaaatcattcctatctggagtctctgacagacaaatctaaggagttgccgttatactgttctgggggtttgcggtttttctgggacaacaagtttgaccatgcaatggtagcttttctggactgtgtgcagcagttcaaagaagaggtggaaaaaggagagactcgattttgtcttccgtacaggatggacgtggagaaaggcaagattgaagacactggaggcagtggcggctcctattccatcaaaacccagtttaactcggaggagcagtggacaaaagcgctcaagttcatgctgaccaa

SEQ ID NO: 238 - DNA, 279 bp, Mus musculus
agtatcaattgcaactccaccaggactccagtcgccaaggagcttaattataatctagacactcatgcgtctacagggaggatcaaggcagttgagaaggaagcctgtaatgcagaaagcaacaaaaaaaaggaaatggaacttcttggctctgttgctaaaagcgaatcagttcctgaagttgaagccctgctggcaagattacgagctttataaatgaaactggttaaaaaaaaaaaatgattaagccaaacaccaagccatgctttcagctgtaac

SEQ ID NO: 239 - DNA, 277 bp, Mus musculus
  misc_feature (195)..(195): n is a, c, g, or t
tttcagctagcatcctgtactccgacgagcggctgaatgtgacagaggagccgacgtctaacgacaagaccagggtcctgagcatccagtccacgctcacggaggccaagcaggtcacctggagggcggtgtggagtggtggtggcctctacatcgagctcccagctggacctctgcctgagggcagtaaggacnagttttgcagctctcctagagttcgcagaggagcaactccaggctgaccacgttttcatctgcttccccaagaaccgtgagg

SEQ ID NO: 240 - DNA, 365 bp, Mus musculus
  misc_feature (65)..(65): n is a, c, g, or t
cagttccagaacatgcggcaagtgattcaacagaacccagcgctcctgcctgctctgctccagcnagctgggtcaggaaaaccctcagctcctgcagcaaattagccgtcaccaggagcagttcatccagatgttgaatgagcctcccggggagctggcggacatctctgatgtagagggggaggttggtgccataggtgaggaggccccacagatgaactatatccaggtgacaccgcaggagaaggaggctatagaaaggctgaaggcactgggcttcccagagagcctggtgatccaggcctacttcgcgtgtgaaaaaaatgagaatttggctgccaacttcctcctgagtcagaactttg

SEQ ID NO: 241 - DNA, 386 bp, Mus musculus
  misc_feature (68)..(69): n is a, c, g, or t
tgctacacgcgctgctattggcacttctactaggtcgcctgcggaggctgcgcgcgcgtgcgcgcgcnncgctccatccaagagttctctctcacagccccgctggtggccgagtcggccagaggtggtgcatcctaagaaaggacaggcactgagcaacaaggacctgcaaactttacaggtccctgcaggaggaccctcaccttcacctggatccgccttggcctctacccttgcccaacctcccagacccgagctctgcaagcctgaatcaacatggtgccaaactgattccagtactaccagagtgaagcaaccttgagtcttcagagcctagagtgatggaacagcccagtctcctgccagactcctcactgaataaaccg

SEQ ID NO: 242 - DNA, 274 bp, Mus musculus
atcattgtcaggatcagattctcttcttcaaataaccactcctgtggtggcttcaactgtaggtaacccaaatcagcattcagcaacaatgtcaacaccagctattcatgtctcaacttatcacacggcccctactgaagtgtctgctgcgtttgaagaacagcctgtctcaccacacattggaggaatgccgtcaccaattcaacacgattttcctgcactagtgatgatactcataattttgggcgtgatggcagggattatcggaactatc

SEQ ID NO: 243 - DNA, 256 bp, Mus musculus
  misc_feature (143)..(143): n is a, c, g, or t
  misc_feature (146)..(146): n is a, c, g, or t
  misc_feature (195)..(195): n is a, c, g, or t
  misc_feature (201)..(202): n is a, c, g, or t
tgcagtttgtggagcccagccggcagtttgtaaaggactcaattcggctggttaaaagatgcaccaaacccgacagaaaagaattccagaagattgccatggctacagctataggatttgctatcatgggattcattggcttnttngtgaaactgatccatatacccattaataacattattgtgggtggctgantccttnnctcatcatgggacgagtgagccagagcgggggaaagggcatgaagtaaagcgtt

SEQ ID NO: 244 - DNA, 339 bp, Mus musculus
agtccttccttctgcgttgggagtctggaagacgactctcccttcctttcctttgcccagatgctgagggttggcaaagcaaaagcagacgggtggcccaaaactgctccaaagaaagatgacaatagcttggttcctcccgcccctgtggacagtgatggggagagtgacaattctgaccgtgttcctgtgcccagtttccaaaattccttcagccaagctatcgaagcagccttcatgaaattggacacaccagctacttcagaccccctctctgaagacagaggagggaagaaaaggaagagacagaagcagaagctgctgttcagcacctcggtc

SEQ ID NO: 245 - DNA, 532 bp, Mus musculus
aaaaccaattctgatctccggctttattttgaatgtacttctgtaagttcagttgagtaactatagacttactggtctggttctgtccagctctgtatttgggccacttgttaatgtgcgtttctcatgtaaactgtaccttttgtgacttcacaattggcacctccaccacgagcagagctgacttcctctgctgtgtggcagcaccttcacaggcttttgattaaaaagaaagtaaaaccatcaccatttaccaaacaccgtgccgcagtattagcaatggccggttgcgctggtttgagcaaggcagagatttggaaggaatcttggtgtaacttgaatatttgcaaactaccttttaatgcagctgcgcgctacctgtttattctggaactgttgagcaccagggcctgccgagttgcttctcacctcctcagttgtatccaagttgtactgcatcttagtttactggatagatttaaaacacagtattgtagaaagctaatacaaagctatcctatgccttcaaata

SEQ ID NO: 246 - DNA, 238 bp, Mus musculus
gtttttatccaaaatgtttcatccaaatgtgtatgctgatggtagcatatgtttagatatcctgcagaatcgatggagtcccacatatgatgtctcttccatcttaacttccattcagtctctgctggatgaaccgaatccaaacagtccagccaacagccaagcagcacagctttatcaggaaaacaaacgggagtatgagaagagagtttcggccattgttgagcaaagctggaat

SEQ ID NO: 247 - DNA, 445 bp, Mus musculus
ttcccgtcgccatgaagtggatgtttaaggaggaccactctctggaacacagatgcgtggaatccgcgaagatcagagcgaagtaccccgaccgagttccggtgatcgtggaaaaagtctcgggctctcagattgttgacatagacaagaggaagtacttggtcccctcggacatcactgtggctcagttcatgtggatcatcaggaaaaggatccagcttccctccgagaaggccatcttcctgtttgtggacaaggacagtcccacagtccagcctaactatgggacagctttacgagaaggaaaaagatgaagatggattcttgtatgtggcctacagcggagagaacacttttggcttctgaggcccttgctgggctaggtgcgcccttcctgcttgtgtctcttgtaaataactggctgttctcagttactctgccagag

SEQ ID NO: 248 - DNA, 556 bp, Mus musculus
  misc_feature (103)..(104): n is a, c, g, or t
gcagccaaaatccaggcgagtttccggggccacatggcgaggaagaagataaagagcggagagtgtggccggaagggaccgggccccgggggaccaggcgganntgggggcgcccggggaggcgcgggcggcggccccagcggagactaggccagagctgaacgttttagaagttccagaggagagtcggatgccgcgtccccttcgcagtgacaagacttccctactgtgtttgtgagcccctccttcccaccaaccagccagcttcaggagccccccccctccccccgccgcgtcccagagactccctctcccaggctggcttcgtcttgggcgtagccaagtccgtgccctttttagctcttcagtctaacgtggtctccttttgccttttctccccaccctcgtcccaaaccccatactcccaaaaatgtccttttgcttcacgcccacctgtccacgcgcccagcatgcagctctgcctccgcagcctcggtgcgcttcgctgcgcgtactgcagagggcgcccaatgcgtcgcccaaatactctcaaaaa

SEQ ID NO: 249 - DNA, 201 bp, Mus musculus
gtcccaggacgtgcgactgcaaagtagcgagactgtgcacactgatgtttacaaggctggaagagtcttcatcaagagcagcggcaaagccttcagatcccaaacaggcgcacgagcgctctcgggatagatgcactttctacagcgtgggtgcacgtcagccgtttctgctgaatgtgccttgtgaagaagagttttcct

SEQ ID NO: 250 - DNA, 528 bp, Mus musculus
  misc_feature (473)..(473): n is a, c, g, or t
ttgagccccagaccctaaagactgttcggacagctgagctttcacctttcattgtgttcatcgcacctactgaccagggcactcagactgaagccctgcagcagctgcagaaggactctgaggccatccgtagtcagtatgctcattactttgacctctctttggtgaataatagtgttgatgaaactcttaagaaattgcaagaagcctttgaccaggcttgcagttctccacagtgggtgcctgtctcctgggtttactaagcttacagaattggcaaacatgtttcagccagcatttggaatgccacctccccgcaccccctcccttgcttaagccaaaagggttgcttcaacttttagctctgctgttttcttactcaggctcctaaaggggtgaagctttcctactatctacatttcaaaatgatctctggaaaattgccataagaataaccaaatgcaatgctactncatagataaaccaactgtccccctgaagcctgagctcctttgctttcaactatag

SEQ ID NO: 251 - DNA, 538 bp, Mus musculus
  misc_feature (398)..(401): n is a, c, g, or t
  misc_feature (431)..(431): n is a, c, g, or t
  misc_feature (449)..(449): n is a, c, g, or t
  misc_feature (511)..(511): n is a, c, g, or t
gaaggagagctttgcccttatgcaccaggcaagatggcctgctttcagcactgggccgcacatctctgttagcgctgactctcagccgggttagaaatgcaggacggctgagttttctgccccgcatttcagctcctttatgtgccctacagtagaggatttcccctgtctgagctttgtggcatttagcttcaagcttttgttattactcttttgcggcaccagagatggaactttggcctcctttacgctgggaaaggatcccaccactgagctacaacccagcccttctagcccccacagctgtctgaagtacttattattttaagagatttcccaggacttttgaacccgacttaagacaacgacggttattttagatgctatgatttatattnnnnatagagatatttctagactattaaagctcnccctttgatactggaatnaggggcatcttgggatttattgttatgtaagaagatagcatagattttgggatagtattatntcagacgttgcttactctgatcttcat

SEQ ID NO: 252 - DNA, 430 bp, Mus musculus
  misc_feature (157)..(157): n is a, c, g, or t
gcatcagtccttactgtgaggctaacactaggttctttaagaagctttagcggagactgcctggaaatacacttgctgggcatccctcttggccagcctgtggttaccttcaccctgcgcactgacatcagtgaaggaacctggaaaggctgctgcngtctccagtgaatcccgagaccatccacatgtattagtgacacttaaaactaactcaaggttctactactttagtctggtgccttttctctataacatgtttatatcatgcttccttttctctataacatgcttcagaaaatttgtaatcttgtagttgctggtcagagactgaatgtaagaaaatcattgcagtttctatataggctaccttgttggaaatttataattctcagtttgattatccaccttgctttctggacttggttctgaa

SEQ ID NO: 253 - DNA, 500 bp, Mus musculus
tataggcttagctgtgtctgagacctggtcagctttctcctagaacaaagcacagtgctagtcatgtgcttcaattctgtggcattcttggactttagtacgtcagcatagtacatttagaatgattgcctttgatagttatttttttaagttttctctgtgtgagtgtgtaaaattccaattaatcaacactgttttcattccacaaaagcattacacagttgtgtgtaggttgcaagagactgtaatgattgtcactaatcttaactaccttcacttaatatgcttcaattgtcgccttaactacagtaagcatttagaataaaagccaaaatagaattattgctgccttctgaaacttgagatgttagctctctattaagctgttctgtgctagccctgagcagctcactggtaaagcagagctgcctacttgtatcaagattttctagtcactgcataaaggaaacgcctaagagttgccgtattgctttctgaga

SEQ ID NO: 254 - DNA, 575 bp, Mus musculus
  misc_feature (37)..(37): n is a, c, g, or t
  misc_feature (488)..(488): n is a, c, g, or t
agttatgcgggtttgccaatccatttcccttttggancttctgcacatttacattggcattgagtcgaatcagcttttcccacggtttttgcagctcacagagagagtgatcattctctttggggtgatcaccagtcaagaggaggtccaagagaaatgtgtagtgtgtgttttattcatcctttggaatctactggatatggtaaggtacacttacagcatgctgtcagtcatagggacatcttatgctgccttgacatggctcagtcaaacactctggatgccaatttaccctctgtgtgttcttgctgaagcattcaccatctatcagtcactgccttattttgagtcatttggtacaaactccaccgtgcttccgttcgacctatctacctgtttcccttatgtgctgaagctgtacctcatgatgctcttcataggtatgtatttcacctacagccatctttatacagaaagaaaagacttcntccgagttttttctgtcaaacagaagaacgtgtgaggtagcctgtcgaacaggtgagaagatggactggtggtctaagctgcagcaa

SEQ ID NO: 255 - DNA, 497 bp, Mus musculus
ctcttcctgggcactaacgacatagcaatcacatgacataatgcaaaggctgagacttcagtgacaaaaaggaccagcccttagagagaatttatggtcacaggctagccatagtaactgacaagattagtggaggaaatatttggggaccagcatgcactgtgccatcctgataggcttccccaggtaactatcgattagatgtgaccttggtgttcatggactagagttgtgcaattaattttttcctggctttggtaactaccctgttctagtcacagtccttcacactaggaaaggaaagagagaagaaatagtcactctttttttctttctttcttttttccttggtcaccttcccgtggccttaagctctggagccaagggaaactgcatggaggtacatttcagttgggaatgaaatccacatctttcaaccagacaaatatttatagcgatgttgatgaatcactgtttttagacaccttcattttgag

SEQ ID NO: 256 - DNA, 483 bp, Mus musculus
  misc_feature (368)..(368): n is a, c, g, or t
ttcccaggattgacccaccagacaggggacatgggtgtccttggtgggacagtgaggctgtgcgtttcccagtgggctgtgggagaggctggccccaatgggcttcctgtttcttcatctctttcacatcagtttgtggtttgtgaacccggggaaattacaggcagtttcaatgaaagaaaacaaggggttttgtgggggttttgcctcaaaagtattggagtacactaggctttaaaatactgcaggcattctgagggactaagtttgctttcccacgactctcagacttcaccctcctgtgccccgtggggaaactgaggcaagccagatgtgaccccaacgcctgcagccctccctcactcctntggtgtttgaaggcttccctgcccctgtgcaggccctgattaggtgtgctagagtctgggcctcggaaggggccacacatgacccacacgggcccctgcactgccagaaaatgtg

SEQ ID NO: 257 - DNA, 325 bp, Mus musculus
  misc_feature (160)..(160): n is a, c, g, or t
agtttcatatgtagccattcctcctgacagtaacaaattttcagtgttattagcaaagatagtatcagctccagttctaaacaccattgcttctgatgctgttctggcttgaccactgtcacatcttaactaattctgatacattaaagtttcatgttcnaagttgaatttaaagctttaaaccctagtaattacatgagatctattgaattctttaaacccaggatctaagttttaatatgatctaacttattatgaaatttacatgccatattatataaaagcttttttcttatttttaatgctacttagataatgcttttag

SEQ ID NO: 258 - DNA, 503 bp, Mus musculus
catccatgcgaggtttttgcagcaaacggtcaacattccacgaacaaacattatacctcttctggcagttttattaagtgtggagaacttgccaattttttagaaacactgcagttttttccaaccttttctgccaatctctaaccctgaactcagtgctgctttgggctgacatccatgactggtgtgggccaccaggagtaagacagtagtgttttgataccatccactttttcagaagacataacttcgctacatgcctttgccccagtttttctccagggtctctctccacagtcggggaggatcctgtccggattatgatagtattattgggttgcccatctgccatgagctttctgaatcatggcgaattgtatttgccactttggtgcccaacggttcaagtcattgtggttaagccacttaactttattgtatgagtttgatattcattttaattgtgggactagacacataaactcacatttctgccttttcct

SEQ ID NO: 259 - DNA, 318 bp, Mus musculus
  misc_feature (26)..(26): n is a, c, g, or t
tgctttgttggttaatctttcttggntgtttaagagaaatgaagtcaccttgcctttagatcagatgctattataacctgtctgtctaggaacaagctgtcagactaaagatatggtttattcattgaaattctggacagctgtacgtttaaaagaaagtttattttgtatgtgtgtctaggctctgatttttggtaaattgtaaaggaacaactgaagaactggttgctggggatgtcttcagtagtcaggagtacccaaggataacaccagccacaccgctgtatatgcatgattctgaacagttagccgcctgtt

SEQ ID NO: 260 - DNA, 429 bp, Mus musculus
tacttgtatctgaagtccatactgaaattagcacagacagaaagttagacttttcaatatatcatttgttaagtacatattactttgcagtgtaattttatgtgtaatttcatgtattggcaaaattaaaaggacttttcactccagaacctttcattctgaagtttgaggtgagtggggtcataggtcagttaggaaagggccagttccccagatgttaaaccgttctcatgcagaggccttaatattttatatataagtgaatttacttttaagatttttctattgttttttggaaagtaacccttaatttaatggtactttctttcatgtagttttgtcccaggccagaattttaaaaagaagaaaagcggcacagacgagatgagtcagatcgatgtattgagcaggtctattgtgaaacgttat

SEQ ID NO: 261 - DNA, 407 bp, Mus musculus
  misc_feature (64)..(65): n is a, c, g, or t
caacagcaacatcattctgctcggggactcccaaggagacctaagaatggccgatggcgtagcnnaatgttgaacacattctgaaaattggttatctgaatgacagagtagacgagcttttagaaaaatacatggactcttatgatattgttttagtaaaagaagaatcattggaggttgtcaactcaattttacagaagacattataaacaagccatcgtgagaagacttcccccaggggtacacctgggtcaggcactgtccattttgaggaaagactctttcttatttataaaacagtcttgctcctggaacttttcccttttcccaacagacgatcttcagacgtgtggaacctgtgaaccacggcccctcttcccacctccgtcactatactcagcagaatt

SEQ ID NO: 262 - DNA, 319 bp, Mus musculus
  misc_feature (162)..(162): n is a, c, g, or t
agttttctcctgcttgagtagaatcaattccttaaagtctaggtagggttctactgttatgttgtcttgtaatggatgtctctacctcctccttcaatctctatcctaccattagtggatttcacagcaaatagagaagaagccagagccctaaggtctttntttttcttaattgtataagagtacaagtatctgctcctggccccattagcaaggtaagactaattcaggggtctgagactctaacgctgttctgtcttgatgatcagagagcaaatcaagaaaattacagtgggaaggaaaaatgccgtgtcactat

SEQ ID NO: 263 - DNA, 403 bp, Mus musculus
  misc_feature (277)..(277): n is a, c, g, or t
  misc_feature (324)..(324): n is a, c, g, or t
  misc_feature (334)..(334): n is a, c, g, or t
agactcttgtgtaaaccctttcgtgtgagttgccatcttgttcgtttagaactttgaaacagtagttacagacatctgcagcccgggattcctctcagcaccgggcctgtggagcggaacatgccattctgacacttgccagtatgcatatgctttctggttcctaaacgaaattgctaaatatttttaaatatttttatcaccagttttttgagccatggttttgctgtatactacaggccagccttgaacgcacaatcctcctgcttcaaccttntgaggcatgtgctaccatgcctggatcccaagtttttccttaagtgntcttgattgnacttgggttggacatcttaagtaacctgtgaattcttttgtggaaggctgagtctcatgcagctgagtt

SEQ ID NO: 264 - DNA, 428 bp, Mus musculus
gagaaaactgcagcccacgcgggcggccctcacactgaccccctctgctgtaaacaagataaaacaacttcttaaagacaaacctgagcatgtgggtctgaaagttggcgtgcgaaccaggggctgtaatggcctctcttacagcctggagtacacaaagacaaaaggagattctgatgaagaagttattcaagatggagtccgagtgttcatcgagaagaaagcacagctaaccctgttaggaacagagatggactatgtggaagacaaactgtccagtgagtttgtgttcaataaccccaacatcaagggaacctgtggctgcggtgagagctttcacgtgtgaaacctcaggactgtgagctccaggtgagccgggtctgcctcggcgcttcctgaagaaatcatgtgatggcacgtgctcaggc

SEQ ID NO: 265 - DNA, 263 bp, Mus musculus
ggagtcttaccatttttctgctttgctaggcatttgatggaacttaaagccttgtcaaacatttcttaagtattatagcaggcattgagagttatcgtttctcctgtctattgaaagggaaccctcgttacaggccctgatgaacttcgtattaatatgtcgcctgtataaattgtacctgttaggttgctgagctgatgttagagtatttaattctccagcctaaggagtgcagcaggtgctcgtgggagtggtctgtgcct

SEQ ID NO: 266 - DNA, 95 bp, Mus musculus
gcacaatgtctgctgtttacaatcaagacgactacatggtccaaacatttcttctctcttctatcacttgtggctttaacttccatttcctccgt

SEQ ID NO: 267 - DNA, 339 bp, Mus musculus
  misc_feature (251)..(251): n is a, c, g, or t
  misc_feature (309)..(309): n is a, c, g, or t
  misc_feature (312)..(312): n is a, c, g, or t
caagaagcacagtcagagctgcccctgggattgcatcagggaacggctgatcaaggcattcagtgtccatgactaaatcttatctttttgatagcaaatccttttaagaaactgaacaattgctaaggctcagcaattttatactccaatgtctgtgtaaggtaaattttgtttgccattgagcccacattggaattccttctgacgtcaacactgacaatgcctatggaaattgcacttctgggtatatntcccagcatccttgttttcttatgtttggtgagtaaggctcaccccttccagcagctntanttctgtgtgctgaggtcctgtagagcc

SEQ ID NO: 268 - DNA, 446 bp, Mus musculus
aactcaggcaaagcatgtcttcaaaactatgtagggagctgatatacatgggtacttattaaaatggacagtaacaagtaaatatccttattatacaactacctgatttatgtgaaatgcatttgacaagccaaaaatctgggatgaagaaatctgaggggaataaaatcataccctgggattcacttcccaaggtatatatattttttaagttaatttgggaaattaacagcatttcactttactgcaagtctttgccacatccgacctatccaagctgttgtttatacatttgaagccactgttgttggctgtgtgacagtgcgtgtgttattgaagcacaactgggtttgcactaaagaatcatcattgtaataacactatttggtagcctaacttcatactcgtattcttaattgcacaggaagtcgctaatttgtcacaac

SEQ ID NO: 269 - DNA, 347 bp, Mus musculus
  misc_feature (316)..(316): n is a, c, g, or t
gggctacaactttgaggacctgacagatagaaacatagtacaggaagatcatcctattatgtcatttactatttccaaaaatggccgattagctttgttaaatgtagcaactcagggagttcatttatgggacttgcaagacagagttttagtaaggaaatatcaaggtgttacccaagggttttatacaatccactcgtgttttggaggccataatgaagacttcattgctagtggcagcgaagatcacaaggtttacatctggcacaaacgtagtgaactgccaattgcggagctcacagggcacacgcgcacnagtaaattgtgttagctggaacccacagatt

SEQ ID NO: 270 - DNA, 264 bp, Mus musculus
gtcattttgaagaccctatatctaacataagcctgattgatgttcatggtgttttcaactccataattgctgggtctaaccagtctcccttgaaatccatgttttccaataggagataaccagggtgaccacagctcttggaaggaaaagtggaattaactccaatgtatcctgatgaacaacaacaacaaaaatctggtacaacttgcccttgaggccaagccaagtccatagcattcaccatgatcatatgcccctcgggat

SEQ ID NO: 271 - DNA, 266 bp, Mus musculus
agttttgtatccagctgcacctagacccgcctgttcactgcttctgaagtacatttaaaaacactgggaggtaagagcgtgccccgaaggtgagggccatgaccagaacataactcctgttagagtggagttacaactatgcaaaggtgttgatagtagctaggtgagttcggtttccaagtctgtcttaactggccgctccctctctagactggtacttgactgtgccaatttgctgtaagcatctgtttcgtatatttgccatg

SEQ ID NO: 272 - DNA, 442 bp, Mus musculus
  misc_feature (188)..(188): n is a, c, g, or t
  misc_feature (230)..(230): n is a, c, g, or t
  misc_feature (233)..(233): n is a, c, g, or t
  misc_feature (235)..(236): n is a, c, g, or t
  misc_feature (239)..(239): n is a, c, g, or t
  misc_feature (241)..(241): n is a, c, g, or t
  misc_feature (243)..(246): n is a, c, g, or t
  misc_feature (248)..(248): n is a, c, g, or t
  misc_feature (250)..(250): n is a, c, g, or t
  misc_feature (252)..(259): n is a, c, g, or t
  misc_feature (284)..(284): n is a, c, g, or t
  misc_feature (287)..(287): n is a, c, g, or t
  misc_feature (406)..(406): n is a, c, g, or t
gaatttgcatttacacttagacactttctaaaaacagggtgaaattaacctaaactttgcagtgttgagttattgttatagtcgctgccctagagttgcaaaaacaagctgtaaaagcccatcccctatctacttaatccagattgcctggatttaatgaagttaaaagagtgtgtgtgtgtgtgttntgtgtgtgtgtgtgtgtgtgtgtgtgtgtgtgtgtgtgtgtntgngnntgngngnnnnananannnnnnnnttcctaaaatattctagaaacaacnttntaggttgtcatttttactgaatgtcttgtgcacatgtaaagtaccctctcttgagtttaaggcttggttaatacttgtctatttttataaaacttaaaactgtgtcccatctttaactntagacatttacattatcaggatcaacatgctagaat

SEQ ID NO: 273 - DNA, 441 bp, Mus musculus
  misc_feature (68)..(68): n is a, c, g, or t
gtattttccatccaacagcagtttgtagagagaattttatgcatatgctggtaattttttccctgtgntttacatcttgagacagaagagtttgcagctacatggtgggctatgtgagggaaaaaaattggggtccttagagtgaaaaggagtgttttgtgtatattttgagtggagaatatgtcaagagcatggtttttaaatttatttgggctttatttaaaattttctttttaacccagttatttcacttaatttgctagcttcaagaagagatccgaatctgtgcccagcgctggaggctcagtgttagcatggcttgtgctggccagtgtgccatattcttgttggagaggaactgtagcaccagaacccattcttccttgtcagtcttgacccacagatgtcaccacccctagttccttgtcaccatggacttgg

SEQ ID NO: 274 - DNA, 158 bp, Mus musculus
  misc_feature (57)..(57): n is a, c, g, or t
aagataaattgtgggcttggtgagcattctgttattttttcctgtcttggattttanagggttttggttgtttttgttttgtttttttctttttttctcgttgcaattttaagtggttttcaataagtaatagtttctactcagatttttggtgcttt

SEQ ID NO: 275 - DNA, 289 bp, Mus musculus
  misc_feature (26)..(26): n is a, c, g, or t
  misc_feature (40)..(40): n is a, c, g, or t
  misc_feature (105)..(105): n is a, c, g, or t
  misc_feature (120)..(120): n is a, c, g, or t
  misc_feature (124)..(124): n is a, c, g, or t
  misc_feature (209)..(209): n is a, c, g, or t
  misc_feature (238)..(238): n is a, c, g, or t
atcttctctttttaagaccatttggnaaagcaaagtgttncagttgtccccagggaaacagaagtgaaattcagcctggatcttttacaatatcagcataattantcattttaggaaaanaaantcatgttttaaatttcaaaatgacactgtctagtaatgtaatgtgatcttggaaaattttaaaagaaaaataatcctactttttnataattgttttcagaaaaaaagtttacantcttaaggaaaaatattcaggtctatcatatggtttgacagattttttaaa

SEQ ID NO: 276 - DNA, 281 bp, Mus musculus
catctccagggtcagagacttggcaggactttccccaaagtgactcaggcacaccacagtaacagtcccaactgcagttttatttttacttcagaagtagatttccttcaaaccacatgagatctctgccacccacccacaatcaagccctatattcccaaggaggctgactccgggggcccttccccccaggccagcaatgtattccggggatgtattctggggtctgagggccctggcccattctgagaaatggagctgtagctatggcctagccagca

SEQ ID NO: 277 - DNA, 328 bp, Mus musculus
  misc_feature (27)..(27): n is a, c, g, or t
aagttctcgctctacttcttagcttangaggataagaacgatatccccaaggacaagtccgagaagacagcatggacgttttccagaaaagccacccttgagctcacgcacaactggggcactgaagatgacgagactcagagttaccacaacggcaactcggaccctcgtggatttggtcacattgggattgccgttcctgatgtctacagtgcctgtaagagatttgaagaactaggtgtcaagtttgtgaagaagcctgatgacgggaaaatgaaaggactggcgttcattcaagaccctgacggctactggattgagattctga

SEQ ID NO: 278 - DNA, 476 bp, Mus musculus
gaatctgtgcgcctactcaagggagaggagggtcaagccctgaggcgggcacaccagcgcaatgtcaaacacatgcgccagctgctaatggacaggggctttcctgttatcccctgtcccagccacatcatccccatcagggtgggtaatgcagcactcaacagcaagatctgtgatcttctgctctccaagcacagcatctatgtgcaggccatcaactacccaactgtgcctcgtggtgaggagctactgcgcttggcccccctccccccaccacagccctcagatgatggaaaactttgtggagaagctgctgctggcctggactgaggtggggctgcccctccaagatgtgtctgtggctgcatgcaacttctgtcatcgtcctgtgcactttgaacttatgagcgagtgggagcgatcctactttgggaacatgggaccccaatatgttaccacctatgcttaaggagcca

SEQ ID NO: 279 - DNA, 436 bp, Mus musculus
  misc_feature (353)..(353): n is a, c, g, or t
aaaacctaggcgaatcctgcgctcagcctggggcagcaacccatacttccggggttcctattcctacacacaggtgggctcaagtggggcggatgtggagaagctagccaagcccctgccctacacagagagctccaagacagcgcccatgcaggtgctcttctccggggaggccacacaccgcaagtactactccaccacccacggtgctctgctctctggccagcgcgaggccgcccggctcatcgagatgtaccgagacctcttccagcaggggccctgaaaggtgtcctcactgccaaatgtgttccttgaagaaccactaactcgtgactgctggtcctcgtcccttngcccccgtgctcttaatttcctaattgtctgtagaatggaattttaccttctgtagtggacaccgggctgacgtcagacctgg

SEQ ID NO: 280 - DNA, 296 bp, Mus musculus
  misc_feature (63)..(63): n is a, c, g, or t
ccgaacaggtgatggcaagatcctgtacagccagtgtggggatgtgatgcgggccctgggccnagaaccctaccaacgccgaggtgctcaaggtcctagggaaccccaagagtgatgagatgaatgtgaaggtgctggactttgagcacttcctgcccatgctgcagaccgtggccaagaacaaggaccagggaacctacgaggattatgttgaaggccttcgtgtgtttgacaaggaaggaaatggcaccgtcatgggtgctgaaatccgtcatgtcctagtcacactgggcgag

SEQ ID NO: 281 - DNA, 422 bp, Mus musculus
  misc_feature (77)..(77): n is a, c, g, or t
tgctgctccttcacagataggacgtgggagctcatgttgagattttacccattcctccagccattttgggaaaaaanaaaattatgaactgggattcttcagaaattatgttttgttttttcttgaagaaaatatcccccccttacccccgtccttactttgtaacctggctgataacgggccatccatttttgtagcacacttttcagaaacaattataacctggtcccatctttctaggacaaacaaagccacgccttgatgtagcccggctaatcatggaagtacgtccaggcttcaaataacttgagtttaaatccttttttttttttttcttggcagagtaatgtaaaattaaaatggggaagatatttaatatttaatactaagctttaaaaagaaacctgctatcactgctatgt

SEQ ID NO: 282 - DNA, 296 bp, Mus musculus
gcaccactgcctagtatagactatgagagtctccagtgttgaggcataccctagaacttagttttagtaacactaccttgttggtgctagagaatcattcagttactgctcgctggagagaaaccagggaaggcggcatgtgattgtgctctcagagctgagggctcaggcaggtagatcactgctccctacgcagcaaacctgcatagttgactagtttcagggaatcggacagtgcttccagaacaattcttgagtgtaacctcccctcctcggcctgaaatctggctgatcag

SEQ ID NO: 283 - DNA, 418 bp, Mus musculus
acattcttctgcagggtgtctcaggtgacccatcccctgcccgccgggaaggtgtgaagaagaaggcagccgagtacctgaagcgggcagagatgcttcacacacacttgccctaaggggtggacccttcctgggatgtcagctccagcactgccagccacccccactgctctctttgggacctggccgtgcttcctgctcgtatgactaccaggggccatatctgtattaactggatcaagtataagaaaagcaaagacttctcagctctgacctgcctgcctccttggaattagacttgaacttctgatcctgcctatctgttctatgtgagtggcatctgggcccctaacctgtcagttcacccatctagaccagagtctgtagccagacctggcccactgccttttttgtaagg

SEQ ID NO: 284 - DNA, 460 bp, Mus musculus
  misc_feature (158)..(158): n is a, c, g, or t
  misc_feature (421)..(421): n is a, c, g, or t
gaagctgtcatcgtgctactgggcactggcaacgacctcagtcccactacagtaatgtccgagggcacccggaacatcgtgacagccatgaaggcacatggagtggacaaggtcgtggcctgcacctcggccttcctactatgggacccgaccaaggntgcccccacgcctgcaggacgtgaccgatgaccacatccggatgcataagattctgcaagagtcagggctgaaatacgtggcagtgatgcccccacacataggagaccaaccactaactggggcctacacagtgaccctggatggacgagggccctcgagggtcatatccaagcatgacctgggccacttcatgctacggtgcctcaccaccaatgagtatgacggacacaccacctacccctcccaccagtatgactagcantctgacctaggtggggagggtcatgcatcctgagaaatg

SEQ ID NO: 285 - DNA, 422 bp, Mus musculus
  misc_feature (370)..(370): n is a, c, g, or t
ccttctcttagaacgtgcatttccagtttctcccttcccaggtgagagaggaactggaagggttgcataggcacacaccaggacacttagtcactccagagtccccagttgcaactaggaggtggttaccctgttaaccccaggaagaagaaccccatttcaaacagttccggccattgagagcctgcttttgtggttgctcatccgtcatcatccgctagaggggcttagccaggccagcacagtactggctgtcctattctgcattagtatgcaggaatttactagttgagatggtttgttttaggataggagatgaaattgcctctcggtgacaggaatggccaagcctgctttgtgtttttttttnaactgatggatggtgcagcatgtctccacgtttccatggttgtttgttgcta

SEQ ID NO: 286 - DNA, 180 bp, Mus musculus
tacttcaccaccaatcacaggcatttggacctgtggccagatggtggcttctggctgtcccagtgcccacctctttgcatcggttccctccattatcaactacagctgaaactggcatcctccacagtgtgcacactggctctgcctttgtccttgcaagttgatattcggcattagcat

SEQ ID NO: 287 - DNA, 369 bp, Mus musculus
  misc_feature (87)..(88): n is a, c, g, or t
  misc_feature (275)..(275): n is a, c, g, or t
  misc_feature (283)..(283): n is a, c, g, or t
  misc_feature (285)..(285): n is a, c, g, or t
  misc_feature (323)..(323): n is a, c, g, or t
gatcataaagtgagactcctccccaatcttcgtttgtgctttctattttcgggaagagtttagtatcttgtgccaacctccaaccannaacgaccacatttaaatgcatgtattttatcatgaacctgggtgttctaattgggatttctttgtacttcagctagccgctaggttagttggtctgtctattttatttgaatgaggaaaccctgtgtatcagtagagtcttcatgctttttgaggagattgtgttaatggattagcatagacagttntaggcttncntgaacaaacatctagctctgaatgtatgtttcttggtntcttacactttccactttcctataccatccattaagctagccaaaa

SEQ ID NO: 288 - DNA, 525 bp, Mus musculus
  misc_feature (85)..(85): n is a, c, g, or t
  misc_feature (107)..(107): n is a, c, g, or t
  misc_feature (154)..(154): n is a, c, g, or t
  misc_feature (242)..(242): n is a, c, g, or t
  misc_feature (426)..(426): n is a, c, g, or t
atttgctggcttttcaaaccctgcccgccctggtttgcctgcggtttaatatgcaatattcagcagacagctgctggcgctacanttagtgaggcgaaaataaccangatccacattaccatcaagcccttgacattcgcagcacttgctgtgnggaaagcaggccaagaacttgtcatgtgccccatccacttcgaggctggatgggatggggctccaagtctgagatttcattgatactnggcaatatggtttgtaaaatacagaaacactgcccaattgtgatgttgtcaatgggctcctgatgcccatattctggggaaccttagatactgccatagaagctaaaagcaccctagctttcttagacaatccacttagctatctgaaacttgaggcattccagacctgacatgtttacaatgnaccactgaacttttttaaattgaattaatcagatgtatatttgtaccactttggggggtggggggaggttgagaggaaaatattgctcgttctaactgt

SEQ ID NO: 289 - DNA, 315 bp, Mus musculus
  misc_feature (108)..(108): n is a, c, g, or t
  misc_feature (117)..(117): n is a, c, g, or t
  misc_feature (225)..(225): n is a, c, g, or t
  misc_feature (246)..(246): n is a, c, g, or t
ggtgtcaccggcacagagaaaaagctaagcagaacacagcagctgaagaaggttttccaagagtacggggccgtgggcgtgtcaatgcacattgggatctccctggtntccttgggnatattttacacagttgtttccagtggcatagacatgtctgcaatcctgcttaaacttggctttaaagagtccctggtgcagtccaaaatggcagcaggcaccagcacnttcgtggtggcctatgccatncataagctgtttgctcccgttcggatcagcatcaccttggtctctgtgccctttgtcgtcagatacttc

SEQ ID NO: 290 - DNA, 505 bp, Mus musculus
acatctgccaagtcattttctggattaattttttaattgtcatcgtttgttatagcctcattaccaaagaactctatcggtcttatgtcagaacaaggggttcagccaaagttcccaagaaaaaggtaaacgtcaaggttttcatcatcattgctgtattctttatttgctttgttcccttccactttgcacggattccctacaccctgagccaaactcgggccgtctttgactgcagtgctgagaacaccctgttctacgtgaaggagagcaccctatggctgacgtcactgaacgcctgccttgatccattcatctacttttttctttgcaagtctttcagaaattccttgacaagcatgctgaggtgctcaaactctacatcaacatctgggacaaacaagaagaaaggacaagaaggtggcgaaccaagcgaagagaccccaatgtagaacattacccaaggggctgcttcagtctttaatatccagactgctccaaggaa

SEQ ID NO: 291 - DNA, 279 bp, Mus musculus
tagccttagtcaataaacctgtaggactttgaacaaaagtgtccctgtgatgtccacagcccagcagtgccgagctgtcaccaacactcgtgtctctattttactgttgcaatattaggtgaatatggaggtaaaggcattccacagactcagcatcttaaatgggattcgggtcctgttttctaaaacagcagtgtagatgttcttaatttgaatctatttattagtgagcatttcacttgtctcccgcagccagtgtggtactcatttcttcttaaa

SEQ ID NO: 292 - DNA, 394 bp, Mus musculus
agcgccagggccgtactctgtacgggttcggcggttaagctgctcagtttcttccaatgctacttaaaggccctttttagggccaccacaaaatcaacaaaagagctaagttgcttttcagtgttctttttgtcctggaactctgtagaccaggctggccttgaactcagaagcctgtctgcctttgcttcccgagtgttgggattaaaggcgtgcgccacaagacctggccagtgttaagcttttgtagaactatttactgcagacttaggggaatcccaatagagccttctgcttgggacagaaggttaattttctcgggggatgaaaatagtgtatgaactcaaactagatgtttggtttggctggattgggctgtatggaggttctgttt

SEQ ID NO: 293 - DNA, 512 bp, Mus musculus
  misc_feature (186)..(186): n is a, c, g, or t
ggtggttcactgactgtatgatcttcacagagtacttgcagttagtggttggctgctaagtgagtaaaacaagcaacaccctgggctatcaggataccttgtttatcccgagtttcttaagttgtacctgatgcttagtattttttttttttatctaactcttacaaaacactcctccaattaaanctcatattaaaaaaaatttttttaatctgttcttatttagaaatctatggtttgtagccaagtgtagtggaacacacatttaatcccagcacttggtagacagaggctggcagatctctgggtttgaggccagcctggtcaacatagcgagttccaggacagcagagctatatggagaaaccctgtctcaaaaagcaaacaaaagaaaaatctatggcttagtacagaccccatccattagagtaataccacacagcctaaggacaccacagcttctaggtgatttcattccttacctctaaaaaggcttcttgacacctctgagc

SEQ ID NO: 294 - DNA, 373 bp, Mus musculus
  misc_feature (50)..(50): n is a, c, g, or t
  misc_feature (290)..(290): n is a, c, g, or t
gaaagtccgcctgaagattcgggaagcagatggctccgaggatccacatncactccttgctggctactggactcttaaaaaaggtggcagaggagacccctgtgtgaaggcctggctggcagggctcagaggtagtagacagaccagagtcagatggcaatgcagctggcatttggaaagatggaggctgcctgacttttcatgcacagctatgatgcttctcaggcccgtagccacagccagcagagcctgctctgtgatcccgtgtgaacatattttcaagggttttnttttgcacattgttgtatatgacaagcacagatggacagatttgagctttggatggagtaggcacctctgtctcattttgaga

SEQ ID NO: 295 - DNA, 91 bp, Mus musculus
gaggagctgggatgccattgctcataggtcaacatgaatcctgggttctgcaggctggcatctgcgggcctgggtctctctggtgtcctca

SEQ ID NO: 296 - DNA, 244 bp, Mus musculus
tccttcagaagttccggctgccagggttcaggagaactaactgagatcactgcctgacagcagctgagccagtccccaatgtgaccactgtaaccactgccatgcctgagcccagaagacagaacgacgcgctggaagacaccagaaggccacacaataaagagctctttccttccacgtgatctgagtgtcggcaccagtgggcaggctcttgctctgcagattaacacgcagtctccgtggg

SEQ ID NO: 297 - DNA, 320 bp, Mus musculus
  misc_feature (73)..(75): n is a, c, g, or t
  misc_feature (77)..(77): n is a, c, g, or t
  misc_feature (79)..(80): n is a, c, g, or t
  misc_feature (82)..(83): n is a, c, g, or t
  misc_feature (272)..(273): n is a, c, g, or t
  misc_feature (293)..(294): n is a, c, g, or t
gcaacacgggcgagatcaaagcactggcgggctgtgacttcctcaccatctccccgaagctcctgggggagcnnncncnngnnataacagcaagctggcgcctgcgctctctgtcaaggcggcccagaccagtgactcggagaagatacatctggacgagaaggccttccgttggctgcacaacgaagaccaaatggccgtggagaagctctccgacggcatccgcaaatttgctgctgatgccataaagttggagcggatgctcacggaanngaatgttcagcgctgagaanngggaagtagtgcaacacccgaggccc

SEQ ID NO: 298 - DNA, 364 bp, Mus musculus
  misc_feature (51)..(51): n is a, c, g, or t
  misc_feature (69)..(69): n is a, c, g, or t
  misc_feature (125)..(125): n is a, c, g, or t
  misc_feature (132)..(132): n is a, c, g, or t
  misc_feature (138)..(138): n is a, c, g, or t
  misc_feature (161)..(161): n is a, c, g, or t
  misc_feature (182)..(182): n is a, c, g, or t
  misc_feature (185)..(190): n is a, c, g, or t
  misc_feature (193)..(195): n is a, c, g, or t
  misc_feature (197)..(201): n is a, c, g, or t
  misc_feature (204)..(212): n is a, c, g, or t
  misc_feature (216)..(219): n is a, c, g, or t
  misc_feature (221)..(224): n is a, c, g, or t
  misc_feature (226)..(229): n is a, c, g, or t
  misc_feature (234)..(235): n is a, c, g, or t
  misc_feature (239)..(239): n is a, c, g, or t
  misc_feature (256)..(257): n is a, c, g, or t
  misc_feature (319)..(319): n is a, c, g, or t
ttgcctagccgcactcccaggtagtcagagtgagctatatcctgctcctcncctcgtctccatggaaancaaggctgcaagggcaaggggtataacagcagccaaattcatcctcacccgctctngtaaaantgtttnggaaccgtggtccctaaattctngcgtgccggactaagccatancannnnnnccnnnannnnnccnnnnnnnnntctnnnncnnnncnnnnccccnnagcnaagtggggttttctttnnaacttggcagaggagtggcaccaccacccacccgcatcccctgcaccagaactcagtgtttntacagtgtaagaatcgggaatctggcagaaatggcaataaaagtt

SEQ ID NO: 299 - DNA, 111 bp, Mus musculus
ctgctgagctaggtggacagagtctgctgccagggagtcctggctgtgcacagatactggcagccctgcaggagtccagttggcacaattccacctccagagaggctggga

SEQ ID NO: 300 - DNA, 563 bp, Mus musculus
  misc_feature (131)..(131): n is a, c, g, or t
  misc_feature (264)..(264): n is a, c, g, or t
  misc_feature (282)..(282): n is a, c, g, or t
  misc_feature (338)..(338): n is a, c, g, or t
  misc_feature (345)..(345): n is a, c, g, or t
  misc_feature (351)..(351): n is a, c, g, or t
  misc_feature (374)..(374): n is a, c, g, or t
  misc_feature (395)..(395): n is a, c, g, or t
  misc_feature (398)..(403): n is a, c, g, or t
  misc_feature (406)..(408): n is a, c, g, or t
  misc_feature (410)..(414): n is a, c, g, or t
  misc_feature (417)..(425): n is a, c, g, or t
  misc_feature (429)..(432): n is a, c, g, or t
  misc_feature (434)..(437): n is a, c, g, or t
  misc_feature (439)..(442): n is a, c, g, or t
  misc_feature (447)..(448): n is a, c, g, or t
  misc_feature (452)..(452): n is a, c, g, or t
  misc_feature (469)..(470): n is a, c, g, or t
  misc_feature (532)..(532): n is a, c, g, or t
ctgctgagctaggtggacagagtctgctgccagggagtcctggctgtgcacagatactggcagccctgcaggagtccagttggcacaattccacctccagagaggctgggagtgcagcgggcagagcagcnggagcctagggaacctaggggtcggatcgggaccgcagggcacatgggggataggagtgaagggggtatgtttaccaaatgcttgcctagccgcactcccaggtagtcagagtgagctatatcctgctcctcncctcgtctccatggaaancaaggctgcaagggcaaggggtataacagcagccaaattcatcctcacccgctctngtaaaantgtttnggaaccgtggtccctaaattctngcgtgccggactaagccatancannnnnnccnnnannnnnccnnnnnnnnntctnnnncnnnncnnnnccccnnagcnaagtggggttttctttnnaacttggcagaggagtggcaccaccacccacccgcatcccctgcaccagaactcagtgtttntacagtgtaagaatcgggaatctggcagaaa

SEQ ID NO: 301 - DNA, 459 bp, Mus musculus
  misc_feature (81)..(81): n is a, c, g, or t
  misc_feature (182)..(182): n is a, c, g, or t
  misc_feature (224)..(224): n is a, c, g, or t
  misc_feature (394)..(394): n is a, c, g, or t
  misc_feature (396)..(396): n is a, c, g, or t
agattttccgccctatgtacagacactgggccatctatgttggtgatggatacgtgatccacctggctcctccaagtgaantcgcaggagctggggcagccagcatcatgtctgctttgactgacaaggccatagtgaagaaagaactgctgtgccatgtggccgggaaggacaagtaccangtcaataacaaacatgacgaggagtacaccccactgcctctngagcaagatcatccagcgggctgagagactggtggggcaggaggtgctctacaggctgaccagcgagaactgtgagcactttgtgaatgaactacgctatggagttcctcggagtgatcaggtcagagatgcggtcaaggcggtaggcatcgctggagtgggcttggcgncnttgggcctcgttggagtcatgctctccagaaacaagaaacagaagcaatgagctgaatgactg

SEQ ID NO: 302 - DNA, 444 bp, Mus musculus
  misc_feature (167)..(167): n is a, c, g, or t
  misc_feature (176)..(177): n is a, c, g, or t
  misc_feature (187)..(188): n is a, c, g, or t
  misc_feature (196)..(196): n is a, c, g, or t
  misc_feature (202)..(202): n is a, c, g, or t
  misc_feature (212)..(212): n is a, c, g, or t
  misc_feature (317)..(317): n is a, c, g, or t
  misc_feature (321)..(321): n is a, c, g, or t
  misc_feature (323)..(324): n is a, c, g, or t
  misc_feature (347)..(347): n is a, c, g, or t
aggttcagtgttcctagttgcccttcccccaggcaaaacgacacgggagcaggtcagggttggctctgggtaaaagcctgtaagcctcaagagctaatcctgtacatggctcctttgacctacacactggggatttgacctctatctccactctcattaatatgggntggccctanntttgctcttnnattaaaangaaaangggggagatnttgggagccgcccccacattcgccgttacaagatggcgctgacatcctgtgttctaagtggtaaacaaataatctgcgcatgtgccaagggtatcttatgactancttntnntctgccttccccgtgacgtcaantcggccgatgggctgcagccaatcaaggagtgacacgtccgaggcgaaggagaatgctccttaagagggacggggtttcgttctctctcctctcttg

SEQ ID NO: 303 - DNA, 554 bp, Mus musculus
  misc_feature (269)..(269): n is a, c, g, or t
  misc_feature (284)..(284): n is a, c, g, or t
  misc_feature (332)..(332): n is a, c, g, or t
  misc_feature (349)..(349): n is a, c, g, or t
  misc_feature (356)..(356): n is a, c, g, or t
  misc_feature (363)..(363): n is a, c, g, or t
  misc_feature (370)..(370): n is a, c, g, or t
  misc_feature (385)..(385): n is a, c, g, or t
tgttgcctgcagtaccattgggatcccatagcaagagagggagagggagatgttagttagcctttgctacgaaccaagctgtccccaagctcaacagctaaacaggtattcatttacccatgattctatgggttagctaagctcctttgagcagctcctctgatgtggcctggtcctgctcatgagcccatagtcaattgtcacctcagctggggctggttgggctggggtcaccttcaccattgtggcaagtgttggctgcattggcnttggttactcttgtngcctctctcaaaggtcagttcaggagaattctcaagatggcctcaggnttccaagagagagtagntagtgangagggcntggagcnggagactcagctgtnaagagcacctacatggtgattcacaacactgtcatccctgttccagatgacctgatgccctcttctaggctctgtgggcacagacaaacacattcgagcaagcacccaaattgctttcttttggctttttgagacaccgggataatactggtgtaacactggctgtcct

SEQ ID NO: 304 - DNA, 214 bp, Mus musculus
tagacaccctaggaaccagacatctctagatcttctagtctgctgttcatctaccatgggctctgccccaacttccacagccccacccaggagtgcctcagccctgccaagaagccatactcctccctggcatctctctgccccttgagcctgtgtatatccctctgcctacagagacccaccagctgaggtccaactatgttcctgtactggc

SEQ ID NO: 305 - DNA, 506 bp, Mus musculus
  misc_feature (347)..(347): n is a, c, g, or t
  misc_feature (356)..(356): n is a, c, g, or t
  misc_feature (366)..(366): n is a, c, g, or t
  misc_feature (379)..(379): n is a, c, g, or t
  misc_feature (399)..(399): n is a, c, g, or t
  misc_feature (414)..(414): n is a, c, g, or t
  misc_feature (417)..(417): n is a, c, g, or t
  misc_feature (420)..(420): n is a, c, g, or t
  misc_feature (437)..(437): n is a, c, g, or t
  misc_feature (441)..(441): n is a, c, g, or t
  misc_feature (470)..(470): n is a, c, g, or t
  misc_feature (473)..(473): n is a, c, g, or t
agcaggcagctggtgtctctctggacaggccatagccttggtactgtcctggatgccatgcaggttgtatatatattttaaatcacaactgaatgaatggacttcgtacactgtggcctggatcagggacatctctatcctgtctcaggtgctgaggacacactatggggatgaatctcctaagactttcctgagagacgtactgagcttcccaaggccttccccccagcactggccaatggtctctgagggacacactgtcctcagacagcctctggttaccacctttagtggtatctgcctttccctttgaactattattcctgttgccttttgctttgtgggtnttgctgggnttttcttgcnatggtttggagcntgaccacttaaccctgggtnccagcaggctcacanccnccncagtgctcggactggantctncaaggatggctcaagctcttggctcaaanccnacgagggagctgtaacaactctccaggtgtgac

SEQ ID NO: 306 - DNA, 535 bp, Mus musculus
attttggctctctggactttattctggaagctgatcctgatcacctcaaggccaagggctccatgcctcagtttctctctcaccctctagatgaagagggaacaaagcataaagagtgaaatccttgttgtctgagatcattctataaacgaactgacattttatttgcaaaactcaagctagtaattcagtagacttgaagatgattttagagcctcttatgcttcaaacaacagaatgaaatccatccaatgttcttcaaagtgtggttctctgattaagtcaaagcaacactgtttggcaatgctgctgtaaagttgcctggaatactcagaggaacttgtcccagggaggtttttttcacttcttcaaagaacttttgaatttaagttctctgtttattcccttgagcaaaactctggaacctcaagagtctctctccgttggttctgaggccattttatagcctaggcctcctgtggatctacatgtgtatcacccacttcctatctcactgcatacctctgtgtagtag

SEQ ID NO: 307 - DNA, 506 bp, Mus musculus
  misc_feature (83)..(83): n is a, c, g, or t
  misc_feature (104)..(104): n is a, c, g, or t
  misc_feature (113)..(113): n is a, c, g, or t
  misc_feature (129)..(129): n is a, c, g, or t
  misc_feature (131)..(131): n is a, c, g, or t
  misc_feature (212)..(212): n is a, c, g, or t
  misc_feature (227)..(227): n is a, c, g, or t
  misc_feature (262)..(262): n is a, c, g, or t
  misc_feature (317)..(317): n is a, c, g, or t
  misc_feature (391)..(396): n is a, c, g, or t
  misc_feature (398)..(398): n is a, c, g, or t
atgaagatctgggttcaaactcccagtgtccatgtaaaaagataagtgtggttgagtgtgccagtaacatagacacagatagntcctgagactttgctccctanccttcccanccaggcataaatgtcnantcccctgagagtgacagaggaagatactccccccacacacacacacatacacgcacagtgatacacatatacatgcatacnaaaaaaaaacttatngtaacaaagaacaccaactgcctggctcaaaactntcatgtcccattactctgtacctttctgtatttagataatttacagtgtgagttntgctgttccatgtatcctatttgtgttactaacttatgtcaaagtatttctaattataatcaacaaaagctaannnnnnantttttatgtaagaaggaacttattgaaactatgtcatttgagtcaaataactactaggatatactgaaaaaccatctttgttaggtagggttctctggagtaacagaa

SEQ ID NO: 308 - DNA, 451 bp, Mus musculus
  misc_feature (267)..(268): n is a, c, g, or t
  misc_feature (292)..(292): n is a, c, g, or t
  misc_feature (296)..(296): n is a, c, g, or t
  misc_feature (314)..(314): n is a, c, g, or t
  misc_feature (317)..(317): n is a, c, g, or t
  misc_feature (336)..(336): n is a, c, g, or t
  misc_feature (343)..(343): n is a, c, g, or t
  misc_feature (358)..(358): n is a, c, g, or t
gtaagtcttcccgtgttcttccttgccaggcaggcagcacacagctctcttactgggaaggatgctttgccaacactcagaaatgccacaaacataaatgtatgtaaggacactcacagccctcattcagtgtgtaagtcaatacaaaaagtatttattattttaaacaggaagttgctttcttgaataattcaaaataatttgacaatggcacattgactccttcagagtatggaccagtgtgtcatgttgaaaagagaagtttcnngaaccactcagagtaccccctaangatnaaatataaaatataaaantanttaaggccctttccttgcngtggaantcagacagtaactantgtaactgcaagtgagaggcatgggtgaaagcgttagtaactgggttttcaacaaactggaacccatccagtggaagcttcccttcttaataa

SEQ ID NO: 309 - DNA, 441 bp, Mus musculus
acactctgtcatgcacacgggaagagacctggaccagagggctactgaagggtcgcacgtgttctgagctccccggcatgacctctgtaaggagtttcctttagtctcctattcgcatgaatgactggctgtagacgcatgacctacagtcttcagtcctgcctctagcgactatggatctctgtgggaatcaggacaaaggcctcgagagaagggagagaagaagggagaggatagcaagccccaaagagcacacgggtgcagacacgaataataagggctttactgtggccgggatggttgatctgtttgtttgctttttgttttgattttttgacttcaacctcatttgtaagaaatacacataatctttctggaccgaggaaaccgggaacggcgtgaaatcagtttagcccattgtcctacatcctcgttgtacct

SEQ ID NO: 310 - DNA, 428 bp, Mus musculus
  misc_feature (98)..(103): n is a, c, g, or t
  misc_feature (107)..(108): n is a, c, g, or t
  misc_feature (363)..(363): n is a, c, g, or t
  misc_feature (367)..(369): n is a, c, g, or t
cacatgttcaggttggtgacatccagatgaggcccacagagcaggtgacctagtgttctgtggggagatcctaccttctccacccttcacggctcgcnnnnnncctnnggattttaggtgttgatttctggactctgcagcttactttctatgtccaccccactaagggatagacagcttgtcagactattcccattacaaatgtgaaaaactgggccgggaagagaagacagaatctcgactgttctatctaacttcttctgagtcctcttggggctccgtaacctttgctctcctgtgcctcttccttttgacctaggaaagggatgtacctagaaggggcattgctctatcctcttacancctnnnccccaccccttagggttggagcagcagagacctcatcttttacctgtgtggttgtccag

SEQ ID NO: 311 - DNA, 226 bp, Mus musculus
ccgagcgctgtaatggcacatctgggggaagagaagctacgccacgtgtttgctccgtaatgtttacaatgtgctcagctgtgttgtttatttaactgcgttagttgtatactgcggcactgtgagtgcacccctcatcgaacttttaaaaagttttagtgttggtaaattcgctcactgaaaccatcgggagccttttatgtaatctctttcctgaataattctt

SEQ ID NO: 312 - DNA, 243 bp, Mus musculus
aggaacatgggcagtccccgaccaaagaccacgtggatgaaggctgatgaagtccaaaagtccagcagcggcatgcccatacggattgaaaacccaaaccaatttgtgcctctctacactgacccccaggaagttctggacatgaggaacaagattcgagagcaaaaccgacaagacataaagtcagccgggcctcagtctcagctcttggccagtgtcatcgcagagaagagccggagtccg

SEQ ID NO: 313 - DNA, 254 bp, Mus musculus
aaacgttggtggttggagccagctatgtggccctagagtgtgctggcttcctcactggaattggactggataccactgtcatgatgcgcagcatccctctccgaggctttgaccagcaaatgtcatctttggtcacagagcacatggagtctcatggcacccagttcctgaaaggctgtgtcccctcccacatcaaaaaactcccaactaaccagctgcaggtcacttgggaggatcatgcttctggcaaggaa

SEQ ID NO: 314 - DNA, 411 bp, Mus musculus
  misc_feature (157)..(162): n is a, c, g, or t
aggctatgtcactaaagatttttactctgcgttttcataatcaaaggtcatgatgtgtatagacatgctttgtagtgaagtatagtagcaataatttctgtatgtgatcaagagtttattgcattatttctttccctgttctctttttttttttttnnnnnnaagggttagcattaacaaatgtcaaggagtagcaaagtcaacaaagattttagaaggaggaggaactaagagcatacacagacttatgattctttggatgtgacacttattggatgtgattctaaagtcttttattgaacattgtcaaattcgtacgcttcataggatggacataatgtttatataatgcccttcttatgtgttaccatagatgtgtgaaaccttatagcgtccttgaaagtgttaaat

SEQ ID NO: 315 - DNA, 225 bp, Mus musculus
tcctcaagggctagcgtccggatgccgcctgcctccgctcacctctggccatctgatggaagtggaggcctgtaggctacgccttccacttcttgtaagccttgcttcagtcatgaagagtcttgcttgccatttctgcactgtactgactcggccagaggtcccttctcacgtgtccccctccttccgcccgagttgcagtttttaatggaggcactttggaga

SEQ ID NO: 316 - DNA, 573 bp, Mus musculus
  misc_feature (135)..(135): n is a, c, g, or t
  misc_feature (451)..(451): n is a, c, g, or t
  misc_feature (537)..(537): n is a, c, g, or t
tgttggcacagtatccgctaacggagagccagctggctctagttcgggacatccgtcgacggggcaagaacaaggtggcagcccaaaactgtcgcaagagaaaactggaaaccattgtgcagctggagcgagagntggagcggctgagcagtgaaagggagcggcttctcagagcccgaggggaggctgaccgcactctggaggtcatgcgccaacagctggcagagctgtaccatgatattttccagcatcttcgggatgaatctggcaacagttactcaccagaggaatatgtactgcaacaggctgctgatggtgccatctttctggtaccccgtggaaccaaaatggaggctacagattgagctggtctagagagtggacactggtgctagagactccctcattcccttctgatgaaggcacttcttaatcccacaagatctcagantcctccagaccaaaaggcagatgtaaccatatcacctgggagtatttggtgaggtttgcctggaggccaggtgttggcttctcagntcctcaaccccacctcttgtccaagctttggttcat

SEQ ID NO: 317 - DNA, 537 bp, Mus musculus
tggctacatcttcggcaagcggatcatcctgttcctgttcctcatgtccttcgccgggatactcaaccattacctcatcttcttcttcggaagcgactttgagaactacatcagaacggtaagcacgacgatctccccgctgcttctcatcccctgattgctggagacagagaaggacgctcaccagatcaatagagacgcatcataacgcaacgccgcgaaggcttctgctcctcttcaagctgtagatgctgtcaatcttgctgccctcggggctctgtggcatccgttaactttgcttttccgggaagaaaaatgtcttgtgctagctccacccctcgaatgcggcggtggcccaggatttattgtctacatccagcctatacttctcctggcttatcctgctttctgaagatgtcttgtaatcagacacgtgttttcctaaaataaagggtatagacaaaatttaagcccatggctcagattggggtgatatttctgtattagctattagtgtttcttcaacctacatgatga

SEQ ID NO: 318 - DNA, 520 bp, Mus musculus
  misc_feature (176)..(176): n is a, c, g, or t
gggacccaattcgatttctgccgtgcatgcacatctatcacctggactgtatagatgactggttgatgagatccttcacgtgcccctcctgcatggagccagtggatgcagcactgctttcatcctatgagactaattgagccagggtctctcgtctgacttcaagtgaaccatcngttttggtggttttgatcttttgtcactgagcccaaagagccagggattaggaattaagatcatgcacaaaagtttcctaaaaattcctggatggctgcagatgttgagggaagtatgtgatattttagaaatttagggggaaagtaggatggatggtatttttatgtaaagccttgacccagtgtttaaaatataattgttattagaccttgttcttgctccagtacataggaattgtgtaaagtgttacagcaactgtacatgtttaaattgtgtgtgttgaagcttaggaaaaagatagttgttatttttcctaaatgaaataagtttcttctcccaccca

SEQ ID NO: 319 - DNA, 205 bp, Mus musculus
  misc_feature (114)..(114): n is a, c, g, or t
  misc_feature (166)..(166): n is a, c, g, or t
gtgataactctttttaaattcttatgttttctaattatacacttgtgtgtcatcaagtattatagtcagacttttttcccaggttctcaaaatttgtaaatgtacttttcccantctttcatggtgcagtctaagaataacaacaataacaaaacccccttctgtnctcagatagtactgaactgagtgctcttgggtgattctt

SEQ ID NO: 320 - DNA, 363 bp, Mus musculus
ggttcactgacaattttcttactggctagagttcttggtggagaagttgcatatggccaagttcttggagttataggatattcattacttcctctcattgtaatagcccctatacttttggtggttggatcttttgaaatggtatctacacttataaaactgtttggtgtgttctgggctgcctacagtgctgcttcattactcgtaggtgaagaattcaagaccaaaaagcccctcctcatttaccccatctttttattgtacatttattttttgtccttatatactggagtgtgatccaagttgtacatgaatcaaaaagatggtgttacatttgtattacgctgggaattcttgctggag

SEQ ID NO: 321 - DNA, 346 bp, Mus musculus
  misc_feature (305)..(305): n is a, c, g, or t
  misc_feature (312)..(312): n is a, c, g, or t
  misc_feature (315)..(316): n is a, c, g, or t
gggactccctgaaatatgtcttgtgtttcagacgctcagaaaggttctacagaacaggtctgtggttatcttacccatgtttatacagtgtcctgcagtgaacttttatttaaaaaaatattgtaatgagatcagatgttagactccacactcgtgcatcacacaccacataatcggatttcattgtgctctgaaatacttctatgccttctgaataagttaaactatttcatttgttttgaatgttttggattgctatacaatataatattctaaatttaggcatgagggtattaggtttgttngtttttnttnntaattttttgtcatcgcactatggaacaca

SEQ ID NO: 322 - DNA, 544 bp, Mus musculus
  misc_feature (38)..(38): n is a, c, g, or t
  misc_feature (158)..(158): n is a, c, g, or t
  misc_feature (196)..(196): n is a, c, g, or t
  misc_feature (277)..(277): n is a, c, g, or t
  misc_feature (302)..(302): n is a, c, g, or t
  misc_feature (309)..(309): n is a, c, g, or t
  misc_feature (317)..(318): n is a, c, g, or t
  misc_feature (329)..(329): n is a, c, g, or t
  misc_feature (337)..(337): n is a, c, g, or t
  misc_feature (354)..(354): n is a, c, g, or t
  misc_feature (358)..(358): n is a, c, g, or t
  misc_feature (363)..(363): n is a, c, g, or t
  misc_feature (370)..(370): n is a, c, g, or t
  misc_feature (382)..(382): n is a, c, g, or t
  misc_feature (419)..(419): n is a, c, g, or t
  misc_feature (442)..(442): n is a, c, g, or t
  misc_feature (445)..(445): n is a, c, g, or t
  misc_feature (453)..(453): n is a, c, g, or t
  misc_feature (457)..(457): n is a, c, g, or t
  misc_feature (461)..(461): n is a, c, g, or t
  misc_feature (463)..(463): n is a, c, g, or t
  misc_feature (467)..(467): n is a, c, g, or t
  misc_feature (476)..(476): n is a, c, g, or t
gggcttgaagagtgtgtccccatcccacccccagcctntgccttcttggccccacatctctgcaaacataaatatatttggatagattgctaggtaggtagacacacagacacacacacagacacacacacacacagacacacgcacgcacgcacatntggagagggcatagttctccagagcgtcaaggtttccntgaagttttcaaaagctgctgtcacaatttcattccgaggccatcttgcccctcccccttcactctgccttcctgagttgnccccactctgcacgggagggagggncccaccnttagactnnctggggagagnccacaggnctgggggccaggtccgnccanctgtncccatcncctgggagaagnccagctcaccaactgagctctggactggggactaccnctgaccaggagggaagcctgganccncacccgantcanccantntgcntcacattcntcctgtacctaggaccggaggaaagacgtgactgctctaaccggacctctgactaccggtggctttta

SEQ ID NO: 323 - DNA, 470 bp, Mus musculus
  misc_feature (283)..(283): n is a, c, g, or t
aggtcttcatgctgtcgctgacatccactgtgagaactgcaagaccactttgggctggaaatatgagcaagcctttgagagcagccagaagtacaaagaggggaaatacatcattgaactcaaccacatgatcaaagacaacggctgggactgacctagctcctgccgcatgtggcttcagcctggcctggccgccagggggagccactggtttcgctcctcctgaagggagctctggaccctcagggcccccacaggggaaggacccagctcctgtacatancattttattgcatgcactgtgaccttggggggagacaaagagggggattgtacccccaccccctgcacctccctgcgatctggctggcttggatctcattttttaaccccttcctgtcttgcctgtcccatagataaggcctgtgtgctgctctcatggccctggtgcaccacctttctgtgaatct

SEQ ID NO: 324 - DNA, 451 bp, Mus musculus
  misc_feature (35)..(35): n is a, c, g, or t
  misc_feature (218)..(218): n is a, c, g, or t
  misc_feature (260)..(260): n is a, c, g, or t
  misc_feature (304)..(305): n is a, c, g, or t
  misc_feature (310)..(311): n is a, c, g, or t
  misc_feature (317)..(317): n is a, c, g, or t
  misc_feature (345)..(345): n is a, c, g, or t
  misc_feature (347)..(347): n is a, c, g, or t
  misc_feature (424)..(424): n is a, c, g, or t
atctcggcaatgaagtgtctgatgaagaatgcctnaagagagtgggcctgagcgctgttcctgccgacgcctgctccggggcccagaaggctgtggggtacatctgcaaatgcagcggtggccggggagccatccgcgagtttgcagagcacattttcctactgatagaaaaagttaataactcatgccaaaaatagaaaatgttgtagtgtgggggnaagggagattgaagccttttccagccattttgcattgttttngatcaagtcccgaagtgtaatctgcaggtgtgtggtctgatccnntgagnntagttnctctattctcaaagctgagttttctccnantcatggttcctgaacccatgacataatcatgtctgttttcctcttgatgcgaggtaattaccgagggattgacctantcttgctccgacctcataaacaatcca

SEQ ID NO: 325 - DNA, 194 bp, Mus musculus
gttccgtgacctgaaatggacctgttgggaccgcctgaaggtgcccgctgtgcagcctgaaaggacactgaagtcactgctggcccatctccaggaagaacatggactgaaggtggagatgcttctccaccaccaggctctgctctattcttcaggatggtcatctgaaaagcaggctcaacacctgtgcctca

SEQ ID NO: 326 - DNA, 334 bp, Mus musculus
  misc_feature (187)..(187): n is a, c, g, or t
  misc_feature (190)..(191): n is a, c, g, or t
  misc_feature (193)..(193): n is a, c, g, or t
aaaatgttgtttaccttctcagagtagtgctttgggggttcctggcggcgtgttggaggtctagcacatacagcttcccttaacagaatattttacgacagtttcatacagggttgccttaacgggaattggtttccaactccagatggttgtaagggctcgtgcagaaatactgatggtggacacnaanncntcagcagggacgtgtagtgtccaggtgtgactaccggagttttgacaagcagtataatatacctgtgattttgttttttacattagggataatgcataagaaattaatctttatatatatcatgacccctaatgtttggga

SEQ ID NO: 327 - DNA, 530 bp, Mus musculus
ctctttgacagttttcctggacaaaaacaagatacgataaaagcagaaaccaggtttgattttgtatgggagtgaaatcattacagttttatgggtataaatctacatttttaaacaagatttttctcttggagaagaaacctgttgtttataagaaggctttggacagtttaatagtcttaaatgttctgctttgctgttctagtccttctcaggaaggcccagctgggcctgtggctagttcagaatgggaggaaacataggctgggacaatgctcaccctgaactgccagcgtgtgggaggccaaggcaggaagagcagatgttcagggccagcttggacatcaagaggctcaaaaccagtaggaaaaaaaacagagcccagtaacaccctcttttatattccttttgtggaatcatgtagcatgtgagactgggttggaagggaactggcatatgtggtatttcagttaaggtgatgtggtggaccctgatgtgtaactggccttcacctttggacatacaggaat

SEQ ID NO: 328 - DNA, 443 bp, Mus musculus
ggacaaattgctgtggaagctcaatgtgtagaggagaaatggctcctgatttgcctgaatatgaagatttgggaaagaacagctatctgacacctggaagggctcagccagagtaacagttgtggcttgactggtaacaatatcatagtctaggagtgaagcaagcactctgcattgtcttgggagtcttctgtctcctggtatgggaggaatgatgctgtagaggctcaacagcaggaagcagcccatcacagtgtccagcatgtgctgtgtgatatgcaaaactgaactcatataagatcaacactgtggtgtgaactctgaggcacagtcatactgagaaatcattgccaatttttagctctgaagttccttaaatgattctcacaaggatctttagttttcactttaataagatgaatatatgccatgatgtcttcaaa

SEQ ID NO: 329 - DNA, 226 bp, Mus musculus
  misc_feature (117)..(117): n is a, c, g, or t
tggggcatccaccagtgactcatttaaaggggcttggtcagggttgctgtgaattgtaggcactgcaaaccttcagtgaagggggtagggtggacaaaatgctaatttttttttttngatgggatgggtttttctctttgtaattattttaattaactttttggttgtttgtgcaatattatatattttaaattataatgcatctccccagagtattttgtagctg

SEQ ID NO: 330 - DNA, 323 bp, Mus musculus
  misc_feature (47)..(47): n is a, c, g, or t
tccccgagaagggagggagccactttcaggccctccggtgtgttgcntggtaggataactgctccaagcagctacctaccttgactcccatagcttaggacacaagccagctctgagctacatgaagtaatgagcagagatgagtactcacagtccatcaccaggccagcttctcctcagccctctgttcttgaaggggtgtgctggggcaagcatcctgagactcctgtctcctgcagaggccctccttcctgaagacagtcagcctggggctcttaccctgagacaatgagggccgcatgaagatctggtgctgcgcggat

SEQ ID NO: 331 - DNA, 426 bp, Mus musculus
  misc_feature (74)..(74): n is a, c, g, or t
  misc_feature (188)..(188): n is a, c, g, or t
  misc_feature (203)..(203): n is a, c, g, or t
  misc_feature (209)..(209): n is a, c, g, or t
agcttcgcttttgctaacatccaaggtgcatactataatccaggttgattcccttataccctaccttccctctncagcccagtccccaatgttttgagacaacccaagactcttctctttgcagggaaacatgttcatagccaatgttaaagaaccacataaaagagtcctcatttctcatttctttngacattgtggttttnttctancaagtaacgaatctggcttgttttattttcatttttctgggtcccaaagagaacagctttaatgtctttttcctgcttatagggaaagtataagtttggttaaaatgtcatgtttgttgtctttccaaaaacctttataattacagagggccttcttcaatactgctggtgttggaagagccaacatctatcacaggcttttattatctagacatca

SEQ ID NO: 332 - DNA, 259 bp, Mus musculus
agcatggctcgctcggtgaccctggtctttctggtgcttgtctcactgaccggcctgtatgctatccagaaaacccctcaaattcaagtatactcacgccacccaccggagaatgggaagccgaacatactgaactgctacgtaacacagttccacccgcctcacattgaaatccaaatgctgaagaacgggaaaaaaattcctaaagtagagatgtcagatatgtccttcagcaaggactggtctttctatatcctgg

SEQ ID NO: 333 - DNA, 222 bp, Mus musculus
gatacagcattctcagcgagtcgcggctgggttttaccagtgacacagaccgtgtcgaaatgaggatggctgtcatcagagaacacctcggcctaagctgggcagagctggcccgggagctgcagttcagcgtggaagacatcaaccggatccgtgtagaaaaccctaactccttgttggaccagagtacagccttgctgaccctctgggtggaccgtgaag

SEQ ID NO: 334 - DNA, 52 bp, Mus musculus
acatttgacttctatgtttgccccgggcatactgtaccaacagggtgtggag

SEQ ID NO: 335 - DNA, 564 bp, Mus musculus
  misc_feature (248)..(248): n is a, c, g, or t
  misc_feature (269)..(270): n is a, c, g, or t
  misc_feature (303)..(303): n is a, c, g, or t
  misc_feature (307)..(307): n is a, c, g, or t
  misc_feature (319)..(319): n is a, c, g, or t
  misc_feature (357)..(357): n is a, c, g, or t
  misc_feature (360)..(360): n is a, c, g, or t
  misc_feature (381)..(381): n is a, c, g, or t
  misc_feature (424)..(424): n is a, c, g, or t
ctgtacttgacttgtgcgatttaataggggacgactgggatgagactggactcgggtgtcgcactcccgggggaagaaaaagggcaagaacatttgacttctatgtttgccccgggcatactgtaccaacagggtgtggaggcccgagagagggctactgtggcaaatggggctgtgagaccactggacaggcatactggaagccatcatcatcatgggaccttatttcccttaagcgaggaaacacncctcggaatcagggccccttnntaatactcttattaatcctactcttcggacccntgtnttctcaaccgcnttggtccagtttgtaaaagacagaatttcggtggtgcnggncctggttctgacccaacagtntcaccaactcaaatcaataggtccagaagaagtggaatcacgngaataaaagattttattcagtttccagaaagaggggggaagtgaaagaccccaccataaggcttagcaagctagctgcagtaacgccatttgcaagggcatgaaaaagtaccagagctgggttctcaaaaagttacaagg

SEQ ID NO: 336 - DNA, 455 bp, Mus musculus
  misc_feature (369)..(369): n is a, c, g, or t
  misc_feature (412)..(412): n is a, c, g, or t
tccagctccttagccacagagtgggtaaaggggaaaacggtggaggaagccctgaccatcaaaaacaccgacatcgccaaggagctctgcctgccgcctgtgaaactgcactgctccatgctggcagaagacgccatcaaggccgccctggctgactacaaactgaagcaagagtccaagaaggaggagccagagaagcagtgagccctggagacactccagccagtcacagcagctgcttcctgccaccctgcacatcaaagaagctacgcaaaacgcacactattcaccacttgcacaaaatgtgccgttgattacacctgatcccgtgttcctttcagctcacgtgtgtccttagtgcagttagtntcttgatttagtttgtggcctgggactgaaatcagcaccgaantcttaagctctggagagtgacaaggacttgtacctgacctgag

SEQ ID NO: 337 - DNA, 471 bp, Mus musculus
  misc_feature (100)..(100): n is a, c, g, or t
  misc_feature (111)..(111): n is a, c, g, or t
  misc_feature (354)..(354): n is a, c, g, or t
  misc_feature (379)..(379): n is a, c, g, or t
  misc_feature (381)..(381): n is a, c, g, or t
  misc_feature (384)..(384): n is a, c, g, or t
  misc_feature (402)..(402): n is a, c, g, or t
  misc_feature (411)..(411): n is a, c, g, or t
  misc_feature (422)..(422): n is a, c, g, or t
tggcccgtcccagagcactggagttccaggaatggaccctccctcagcagcccaccgtagcagtgactcgggactaccctcggacattccacatgtgagnctcgactcacngccttcctttgactctatctacacaggctcctctcttgatccaccatcaagcgaacccccagctccaccctcacagccccctctgcctcctaaggtcctgatgtcctccaagtctgtgacatatgccacagttgtcttcccaggaggggacaaaggtaaaatagcctcctgtgagccagttcaggacccaccaaacagtcaaactccacccagtaaataagagtacactttaatttattactnttgggatcacccctggggaattctntncancccggccaactagctctnccttttatncccagagtatntcagcgcctggtgactcagggctccaatctggtatcttggtttggtgca

SEQ ID NO: 338 - DNA, 559 bp, Mus musculus
  misc_feature (27)..(27): n is a, c, g, or t
  misc_feature (31)..(31): n is a, c, g, or t
  misc_feature (42)..(42): n is a, c, g, or t
  misc_feature (50)..(50): n is a, c, g, or t
  misc_feature (53)..(53): n is a, c, g, or t
  misc_feature (135)..(135): n is a, c, g, or t
  misc_feature (216)..(216): n is a, c, g, or t
  misc_feature (309)..(309): n is a, c, g, or t
  misc_feature (313)..(313): n is a, c, g, or t
  misc_feature (318)..(318): n is a, c, g, or t
  misc_feature (332)..(332): n is a, c, g, or t
  misc_feature (341)..(342): n is a, c, g, or t
  misc_feature (344)..(344): n is a, c, g, or t
  misc_feature (347)..(347): n is a, c, g, or t
  misc_feature (349)..(349): n is a, c, g, or t
  misc_feature (387)..(387): n is a, c, g, or t
  misc_feature (394)..(394): n is a, c, g, or t
  misc_feature (406)..(406): n is a, c, g, or t
  misc_feature (457)..(457): n is a, c, g, or t
  misc_feature (483)..(483): n is a, c, g, or t
gcaggtgcgcttcgtgctgtccttatngttnatccttttccngggagggnacngcagagaggcacaaatgaggtgggaaagtggggtttgtgctgaggttctggttcggaagagcaggggcaagctctcgggctnaagggtgggatccacgcgtggctcgaggacacaagggaaaccggctctttcccctgcggcaccccctccctgcgcccacangccctttatttatggcagaaagtgaccagatcctgtgtatttgttttatatatttaataactgttttaaatgaaagttttagtaaaaaaaaantacnaaacnaaaagattcaactnctaaagctnntngtnancaggagctctttgtatctgaatgtagttgtatttgaancttcttntttgtttttttnaaagggggggacgagggaagatttgacacggatttattgtaattgcttacnaaagaactttatgaatcttttccaantcgatctattcagtgacatggcctggtgggcgtttcttcttgtattaatgtggttttctggcttttaatacagaca

SEQ ID NO: 339 - DNA, 41 bp, Mus musculus
tattcttggttcatcatactccagaccatgtatcctctggt

SEQ ID NO: 340 - DNA, 569 bp, Mus musculus
  misc_feature (72)..(72): n is a, c, g, or t
  misc_feature (75)..(75): n is a, c, g, or t
tattttttctgctcatctttctgcctgtcaccgggtgtgctgtttttctgaaaaaaaaacaggccccaaggnccntgagcctccagcccaaacccttagacctctgggatcacgttgagttctatttatttatttacttatttatttatttgtacccacccttccctcacttctgcccagctgggctccagagagaggaccctgcccatcctccttttgaagccaggacttattcttggttcatcatactccagaccatgtatcctctggtgtcctggctggaagaaggggcgtgtggccatgcagcccgctctcccaagctgtcccagcaaatgggcaggaggggcatggcctcttttatatatatatatctatttattttatatgtgtgtttgtgaggaagaggatatttgtcatttccttaaggctctggagtgttgtgttcgattctgcacagcccagcctccccgagggcctttccaagcacagtggggatttcttagaacaggagagaggaatccatgaagcaggagaagcagtgcctgccagctgtggtggaccttcctaag

SEQ ID NO: 341 - DNA, 323 bp, Mus musculus
  misc_feature (108)..(111): n is a, c, g, or t
  misc_feature (251)..(251): n is a, c, g, or t
  misc_feature (264)..(266): n is a, c, g, or t
  misc_feature (272)..(273): n is a, c, g, or t
agtttactgctgaagcttctttcaaaggaatatgtcctaagtgccggtatttgaagtgaagtttattttcatgcctagttaaaaaacaaacaaacaaacaaacaaacnnnnctgaaatctgagaaaagtgcggctaagaaacagctcagtggtggagcatttacctaacatgcacatggccctaagtgggatacccagacagacagacagacagacacacacacacacacacacacacacacacacacacnctctctctctctnnnctaagnnaagctgatggctgacttgataattagagaattatccttttgtttgatgtg

SEQ ID NO: 342 - DNA, 524 bp, Mus musculus
  misc_feature (144)..(144): n is a, c, g, or t
  misc_feature (293)..(293): n is a, c, g, or t
  misc_feature (436)..(436): n is a, c, g, or t
  misc_feature (438)..(438): n is a, c, g, or t
tgaatccatgttgcagtgtgtgtctgtatatttgtagagaaagggaaatgacaattgaaaggttactttaaaattttcaaattgggcactgcctgtgttgcagcactactgtatctttgttgagcgacctaacagtatttcccntgttgtgaaagttaattctgatgatgtttcacattcaccagctttttttctgtactatttgcatccccaaatacttagtacaagtagaattgtgcatggcttgggcattcaaagataagcgagcgatgagtcagtctgagtttctaaanccatgaaaacttgctttgagactgaatagttctgagttatttacaacagcaccaattgtccaagtttctttccctactgtaaaagaattgatcagtttcttcattaaagcagcaagaaattaattaaatttgtacataccatntntcttagatttctgtgtatgttgtgaaggacattattttgagaagaaatgtacaaaggcatattacaaggctatgcatgcaccgtcc

SEQ ID NO: 343 - DNA, 575 bp, Mus musculus
  misc_feature (97)..(97): n is a, c, g, or t
  misc_feature (118)..(118): n is a, c, g, or t
  misc_feature (317)..(317): n is a, c, g, or t
  misc_feature (334)..(334): n is a, c, g, or t
  misc_feature (355)..(355): n is a, c, g, or t
  misc_feature (456)..(456): n is a, c, g, or t
  misc_feature (467)..(467): n is a, c, g, or t
ctgcctatgacttcagctattctggagatggaagcaggagagtcagctgagcctggggatttggtactagtctggcaaaagagaccctgagagggantggggctgtcccaaagcaatnggccttctagcagtaatgactatctggagtattctcttcccatctcccacgagcaccagacacatgccagtctcactggccagtagaaatggagaactgagacccttagagacaaacccactcaccaaatctagcagtttctaagtatcccagttagagatgcaccactaccaacacaaatgaaagcgggaaccaccanccatctgaagagaagtngttcccagcacccacttacgnccctggacatctagccctctgattgaggttggagttctgggacaccctgagtagctcactgactatcactacattagttgaatgcacttgatacattgtgncctcctttctntcaagagcacactagatagcaccaagcactgcccaagtgtgacatactattcgaggtgaacagagctcataatggaagtgtaaggtgtgccgctgtgtaatatttcta

SEQ ID NO: 344 - DNA, 162 bp, Mus musculus
gttgtcctgttcctcgaattccagctgaagctaaccctttagcagaccacgtctctgctaccagaattttgtgtggagcccttgtctttcctactattgcgacaatagttggtaaactgatgttcagtagtgttaactcaaatttacaaaggacaatcttgg

SEQ ID NO: 345 - DNA, 290 bp, Mus musculus
  misc_feature (239)..(239): n is a, c, g, or t
aatatttacgtcaggcacaccgcaaaatcctaaattatccagagcaagaagaagcataaaactgacttctggttgttctgaggcctctcatcctgacgagtctgttgtgttctgattccatcattaatgcgctagtggagacttgtgacgctgctcctatattctaagagatacaataaagcacgcagggccggggcaagccgcccagtaatcacggacctaaggacacgcgtcagctnctgtcatttgtatgttctacttttatggcagtcggctaaaccattatttta

SEQ ID NO: 346 - DNA, 285 bp, Mus musculus
ttacaacgcacccacagtgaagttcctcacaccctgctaccaccccaacgtggacacccagggcaacatctgcctggacatcctcaaggataagtggtctgcactatatgatgtcaggactatcttgctctctatccagagcctgctaggagaacccaacatcgatagccctttgaacacacacgctgcggaactctggaaaaaccccacagcatttaagaaatacctgcaagaaacctattcaaagcaggtctccagccaagatccctgatgcaagctggccgc

SEQ ID NO: 347 - DNA, 276 bp, Mus musculus
  misc_feature (81)..(81): n is a, c, g, or t
  misc_feature (198)..(198): n is a, c, g, or t
  misc_feature (202)..(202): n is a, c, g, or t
  misc_feature (224)..(224): n is a, c, g, or t
gagagaaagttaccctggtgcccacctcacaaggtcatattgcttgtgtgggtgaccatctactctgtcatgggctatgcntcctacctggtatggaaggaactcggagggggcttccggtggcccctagcactgccccttggtctctactctttccagctggccctcagctggactttcttggtgctcttcctggcnagcngacagccctgggctggccctcnctggacctcttactgctctatggactggtagcaagcctggtgtttatctggc

SEQ ID NO: 348 - DNA, 139 bp, Mus musculus
gtagtttacactctggcttgtgcaactgactctgtagttatgcctcttcaccacaaggtggaggcattacctcattcacgccatggtctgagcatggtgggacacagtgagaccaaataattactaggcctggagggat

SEQ ID NO: 349 - DNA, 523 bp, Mus musculus
  misc_feature (212)..(212): n is a, c, g, or t
  misc_feature (217)..(219): n is a, c, g, or t
  misc_feature (222)..(223): n is a, c, g, or t
  misc_feature (225)..(225): n is a, c, g, or t
gtatgtaagttatccaatcgcattaaataaaagcatgtgtgacctaatagaacatggctacagctcagagactgtctatgcttcagtctatgtcaacttgtgcttacatatctcactgtaaaacaaaacaacacagaataatcactcagacgttgtatcaattagacaacttttactaaatgagaaaactacatttaaaatgtgctttaaanaaaannnaannanaaaaaaaaagacatatgcattttaaagaacttttgcactgtgctgaaaatcaaatgttacttgcagtaatataatgtgtcaatccataaaatgttaacagagttctcaatttaacactttcaaggacgctataaggtttcacacatctatggtaacacataagaagggcattatataaacattatgtccatcctatgaagcgtacgaatttgacaatgttcaataaaagactttagaatcacatccaataagtgtcacatccaaagaatcataagtctgtgtatgctcttagttcctc

SEQ ID NO: 350 - DNA, 296 bp, Mus musculus
ggaccgagaagaactgctccgggctctgctactcaaacgcagccatgctgaggacctagggaatctggaggggtagaagcccgccgtcctgacccgctctgggggcgcctctgagcctctgcttcctcaccagccatcgctggagacccagctgtactgcggacaggcagaggggggctcagaaggaccctcaacatctgggactctgaagatccccccagattcagaaaccacactggtgctagtgggccgggctaattttctggagaagcctgtactgggcttcgtgagactga

SEQ ID NO: 351 - DNA, 229 bp, Mus musculus
gaagccatcaagttctaccgtagggcgatgcagctggtgccagacattgagttcaagatcacttacacccggtctccagacggcgacggcgttgggagcggctacatcgaagagaacgaggacgccagcaagatggccgatctcctgtcgtacttccagcagcagctcacgttgcaggagtctgtgctcaaactctgtcagcctgagcttgagaccagtcagactcaca

SEQ ID NO: 352 - DNA, 40 bp, Mus musculus
gtgacttaaagtctggatcctgttctcacattctacaggg

SEQ ID NO: 353 - DNA, 284 bp, Mus musculus
  misc_feature (56)..(56): n is a, c, g, or t
  misc_feature (98)..(98): n is a, c, g, or t
  misc_feature (126)..(126): n is a, c, g, or t
  misc_feature (134)..(134): n is a, c, g, or t
  misc_feature (140)..(140): n is a, c, g, or t
  misc_feature (143)..(144): n is a, c, g, or t
  misc_feature (156)..(156): n is a, c, g, or t
  misc_feature (174)..(174): n is a, c, g, or t
  misc_feature (184)..(184): n is a, c, g, or t
  misc_feature (187)..(187): n is a, c, g, or t
ggaggaggaactaagagcatacacagacttatgattctttggatgtgacacttatnggatgtgattctaaagtcttttattgaacattgtcaaattcntacgcttcataggatggacataatgttnatataatncccttnttnnatgtgttaccanagatgtgtgaaaccttanagcgtccttnganagtgttaaattgagaactctgttaacattttatggattgacacattatattactgcaagtaacatttgattttcagcacagtgcaaaagttctttaa

SEQ ID NO: 354 - DNA, 427 bp, Mus musculus
  misc_feature (277)..(277): n is a, c, g, or t
  misc_feature (285)..(285): n is a, c, g, or t
  misc_feature (304)..(304): n is a, c, g, or t
  misc_feature (306)..(306): n is a, c, g, or t
  misc_feature (318)..(318): n is a, c, g, or t
  misc_feature (322)..(322): n is a, c, g, or t
  misc_feature (357)..(357): n is a, c, g, or t
  misc_feature (366)..(366): n is a, c, g, or t
  misc_feature (380)..(380): n is a, c, g, or t
  misc_feature (383)..(383): n is a, c, g, or t
actgggtctgtgcttgggtcattatttcacatctttccttagaagttcagctattgcatttgagctggacctgatagcacaccctattggaaagaggccagatttgacttccgacattgatttgacattacaaagtgttagaatatgcttctttatccaagctatttctaggcagactgatacttgcttttggtgaattaggcagggcagtgaagtcagctagtcatacaaataaacagatgggtattgtaggctcagtttccaagtgaaggaaatngcctgagnttgaacaagtgaaactttntntcattgactttnaaantggtttctgattagtaaagcttatgcttagctttncactcccangttaatggcatggnttntcttgagcagagatagtataatactgcatttccagtgggtgaac

SEQ ID NO: 355 - DNA, 519 bp, Mus musculus
  misc_feature (40)..(40): n is a, c, g, or t
agattggcaactgacaattcttgtcattctaaggaaattnggtgattaaatgacagtgtgacatcctcgtaagaagtaaaaatgacctgtgtgtcctatggtttaagagcaaattttaaaacttggaagttgtggttttccagtttgtgtacactcacccccaaattgtagtctttcaagtcgtgtgcattgcacgttggataagccagggaaattgttaacaaataagtattttgtgtgtgtttagtggttgctttgtattgagagaaaagctttgaggtgtgattaaatcgtaagctctgattctatttgggagaaacaggaaaaaaggtgcacttaatctctagctaaaacagcgtaatttttcaacttttacccttaaattataatttcaagatgtttagacatactgtatcttgtgtttgtgtaccccctccccaatattatggtttattctttaatgccttttaatttggatataatagcttgtactttagattttggttgctatcttgccaa

SEQ ID NO: 356 - DNA, 391 bp, Mus musculus
  misc_feature (230)..(230): n is a, c, g, or t
  misc_feature (234)..(234): n is a, c, g, or t
  misc_feature (251)..(251): n is a, c, g, or t
  misc_feature (255)..(255): n is a, c, g, or t
  misc_feature (272)..(272): n is a, c, g, or t
gatgcctccctcctagaggagttgaccagagtggccctcagggccagaacacttgaccaatcagctgttggcaggggaccatgagatttcccaagtggcattttcatctcagttttaccctgactaaagattgtcttaggggaatcccaacccaaagtgaatagtgggaagaggggtctggcattccttcagggggcatgcagcagccccgtactcgccacctgccccangggngcatgagcagctccatncccntctacccaccccaaggnttgggttgaattagaaaaatgcctatttttcttgtatcgatgtagaaactctattttctcccaaagacactatttttgcagctatttgaagtttgtatattttccgtattgcagagctt

SEQ ID NO: 357 - DNA, 361 bp, Mus musculus
  misc_feature (44)..(44): n is a, c, g, or t
  misc_feature (237)..(237): n is a, c, g, or t
  misc_feature (255)..(255): n is a, c, g, or t
  misc_feature (264)..(264): n is a, c, g, or t
  misc_feature (276)..(276): n is a, c, g, or t
  misc_feature (289)..(289): n is a, c, g, or t
  misc_feature (295)..(295): n is a, c, g, or t
  misc_feature (297)..(297): n is a, c, g, or t
  misc_feature (300)..(300): n is a, c, g, or t
  misc_feature (307)..(309): n is a, c, g, or t
  misc_feature (319)..(319): n is a, c, g, or t
  misc_feature (322)..(322): n is a, c, g, or t
  misc_feature (325)..(325): n is a, c, g, or t
  misc_feature (335)..(335): n is a, c, g, or t
gctcattctcacctcatttactttgtctctgctcttaagagggncataatcattagaccccagctctgcacggaggactggagcagaggtgccactcagtgccatgcctgagctccatgatgaatggttggggttagctttgaaataagtgctgttgagatagccgcgatctaaactttctgttcacatttgatagagttgagcagctaatgaacgcttccattttgctgtttggcntttgaacactttctgttnaattctgantctgactttaancccttccagaatntccttntnctntttttannngaattcattnccnaanagatagggtnccctagttaaattccgttgtgtgctt

SEQ ID NO: 358 - DNA, 468 bp, Mus musculus
  misc_feature (91)..(91): n is a, c, g, or t
  misc_feature (197)..(197): n is a, c, g, or t
  misc_feature (213)..(214): n is a, c, g, or t
  misc_feature (356)..(356): n is a, c, g, or t
  misc_feature (358)..(359): n is a, c, g, or t
  misc_feature (361)..(361): n is a, c, g, or t
  misc_feature (366)..(366): n is a, c, g, or t
  misc_feature (368)..(368): n is a, c, g, or t
  misc_feature (371)..(371): n is a, c, g, or t
  misc_feature (378)..(378): n is a, c, g, or t
ctgccagtgcgttatagcccttaggcctattgaacttactctctaagagaggataggacaccaggagaggctgcagccctcacgtgaacgnagttgagaatgtgctgcctggacagaaatggctacaggtgccttgctcttccagtccaagatggcagtgataatggcagtcctgcccagacctgcctgttatctgnctccatccagcctcannttttatccccactgaggtgacaggagcatctgcacaaaccaggccagcgacaagggcctctcccatccggtggctcagcctctccagtcagccttggcttatagactctctgcaagggcagtctgaggggggaggctggccngnnancgggngnctnccccccnaccccacaggcccagaggtttacaagtttctaagcttttgataatgtgaagctccaggtagagaggatgcctgccggtgagcacattaca

SEQ ID NO: 359 - DNA, 496 bp, Mus musculus
  misc_feature (242)..(242): n is a, c, g, or t
  misc_feature (379)..(379): n is a, c, g, or t
  misc_feature (449)..(449): n is a, c, g, or t
aaagtggcctttgtgttacatgtgtggcacaggtggctcatgagtgcaggacacgagtgtcccgtgtgtcctgtctgatgccactagaaacctacgagttttgcatttaacacaccagtgctgtaaaccctcaggacggtagcagggtcaacacagcctttgcattgtggcaaattggggttttgcttcctttgtggttagagacagatgtttgtgcctatcaacgtttatcttgtggttgngtcatataatcacttgctatatattgtgaccctgtgcaatgaagcagaattgtacatacatagtattatttgagtacctgaaattcctaagctcaaagacaatatagataaacttgtaaggtttagagggctggccntcgtgtaagtggttaatagagagtgaaccctggtttgagggtggtgagagctgggtggatgtggtcaccnctgggccagactgttgccaggaaggcattcatgcttgggttccttat

SEQ ID NO: 360 - DNA, 416 bp, Mus musculus
ggcttagttgccttcaatacattgagcattgtactaataccaagtgttgggcaacaaaaggtctctccagcagcaaagtagtgatagaaaaagaaattggcttaacttcatctccattgttcagggaacaacaaatggaagcttgactttgccaagacttgaattccttcgggaatgacactaataaaagaccaagacctcctgattgaactggatgtggagtgctctgtaggctgcacattttttggctttgtagttttcctttctcagttaacatctcacactgaaacattccacattccccagcagtgcggggccaactcaagtttacagtcctgactgaaagtcaccctgcttctagcttatctgaaccctgcccctcactcctatttattaagcatcacactaccagggag

SEQ ID NO: 361 - DNA, 92 bp, Mus musculus
aagcttataaaacacgatagtactgtccctcttttctgaaccatcagagacacaaaactgttagtgacacaacggtgacaggtagctgggac

SEQ ID NO: 362 - DNA, 371 bp, Mus musculus
  misc_feature (88)..(88): n is a, c, g, or t
  misc_feature (113)..(113): n is a, c, g, or t
  misc_feature (233)..(234): n is a, c, g, or t
  misc_feature (236)..(239): n is a, c, g, or t
  misc_feature (241)..(241): n is a, c, g, or t
  misc_feature (243)..(246): n is a, c, g, or t
  misc_feature (248)..(248): n is a, c, g, or t
  misc_feature (262)..(263): n is a, c, g, or t
  misc_feature (265)..(265): n is a, c, g, or t
  misc_feature (268)..(268): n is a, c, g, or t
  misc_feature (274)..(274): n is a, c, g, or t
  misc_feature (277)..(278): n is a, c, g, or t
  misc_feature (282)..(282): n is a, c, g, or t
  misc_feature (284)..(284): n is a, c, g, or t
  misc_feature (288)..(288): n is a, c, g, or t
  misc_feature (298)..(298): n is a, c, g, or t
  misc_feature (301)..(301): n is a, c, g, or t
  misc_feature (304)..(304): n is a, c, g, or t
  misc_feature (307)..(307): n is a, c, g, or t
  misc_feature (313)..(313): n is a, c, g, or t
  misc_feature (318)..(318): n is a, c, g, or t
  misc_feature (328)..(328): n is a, c, g, or t
  misc_feature (334)..(334): n is a, c, g, or t
  misc_feature (343)..(343): n is a, c, g, or t
aaaagtgggctgctcctggaattctgggctctcttctccttcccttcaagaaactcggagagcccagaaaacagactgccaagggggnccggggggagggaatgaatgccagnccttatacaaaacgacaactgttcaccaagcttataaaacacgatagtactgtccctcttttctgaaccatcagagacacaaaactgttagtgacacaacggtgacaggtagctgggacnnannnnancnnnncntgaagaatttttannanttngcccanttnntcantntgtntaatcccggnatntanctnctgaantcttncgaagtaaantccccntgaccgatntcagttaagctggtgatacctggagaag

SEQ ID NO: 363 - DNA, 69 bp, Mus musculus
tggcgcttcagcaacatgcggcaatggaacgtcaactgggacatacggcaggtggccattgagttcgat

SEQ ID NO: 364 - DNA, 319 bp, Mus musculus
agctgtgtgtctgctagctgccgcatcgtgcacgagtacatcgggggttacatcttcctgtccacccgagagcgggcccgaggggaagagctggatgaggatctgttcctgcagcttacaggaggccatgaggccttctgagggcagcccctgctccactcaccacctccagggaccccccaaaggccacacccacctgaacacactgctccatcactcccgggatgtacactgctgggcaacttcacttgttgtcaccaggcaggccagggccctcgctggggtaggtgctaccaccagccagcctagggatgatggg

SEQ ID NO: 365 - DNA, 112 bp, Mus musculus
acactagtggcaccacttgttcttacaaatcgggattttgactgaatgggatgtctggcatgagtcccactttggccattgtctatttgacagtaacagtattcccaatttt

SEQ ID NO: 366 - DNA, 547 bp, Mus musculus
  misc_feature (32)..(32): n is a, c, g, or t
  misc_feature (35)..(35): n is a, c, g, or t
  misc_feature (40)..(40): n is a, c, g, or t
  misc_feature (42)..(48): n is a, c, g, or t
  misc_feature (50)..(55): n is a, c, g, or t
  misc_feature (57)..(62): n is a, c, g, or t
  misc_feature (64)..(75): n is a, c, g, or t
  misc_feature (77)..(77): n is a, c, g, or t
  misc_feature (79)..(79): n is a, c, g, or t
  misc_feature (82)..(82): n is a, c, g, or t
  misc_feature (98)..(98): n is a, c, g, or t
  misc_feature (102)..(102): n is a, c, g, or t
  misc_feature (109)..(110): n is a, c, g, or t
  misc_feature (440)..(440): n is a, c, g, or t
  misc_feature (504)..(504): n is a, c, g, or t
tcggctttctctattccttttccctttcctgnccnttcancnnnnnnncnnnnnncnnnnnntnnnnnnnnnnnntntntgngtgtgtgtgtgtgtgngtgngtgtgtnngtacagctgtgtgcgtgcatacaaacttgggtttgtgtagggtgtgtgtgtgagagagagacagaatgtgcatgtatgtgtaacacaggggtttagccacctcttacctagggctcagactcacttgtccctctcctcctgcctgtgtctccttgctttggtgtcctgactgaggaaggtgtccagggacagagtcaggcctaaggactggggaacctcctctcacctgaccagactctgacccacctacctcagctgggatgaggggtgcccctcattcagtcacatggttcccagttactccactcctcacttaagactctgacccancctcaacccttaactcttggggcttggctgaggggaacaagcatttgctgaaacttgaaaaacnaaacaaacaaacaaaaaaatgggaaaaattgtacctggtacat

SEQ ID NO: 367 - DNA, 499 bp, Mus musculus
  misc_feature (57)..(57): n is a, c, g, or t
  misc_feature (357)..(357): n is a, c, g, or t
  misc_feature (418)..(418): n is a, c, g, or t
  misc_feature (433)..(433): n is a, c, g, or t
  misc_feature (454)..(454): n is a, c, g, or t
gacttggctgtaatgccagcagctttcaggccatagtgtcgacttcctgcctgcttntggacaaaggaagtatgctgctgatgcccagacagtgccatttgaatattaggtgaccgtgaaacaccatactgccaagtgtctgcaaaccagaagacagtttagttcaggaaatattttgccaaattcaggggctttattaaaatcaaagaggagaaagaggaaatattttgtccttagatgctaatatgttttaggctttctttttctgttttataaagttaacccagtatttacatttccatattgtgtgaattgaaccatctaaatatatttttcttttgttattgaaaggtaccnaaggctttttatgttttgtttggtttgtttgattttattgtagggtttgtttttttttttnctagaaatacctttnatatagactagtccccaagtntctgggtctacttcagtctgtgtaattggtttttacctcagttca

SEQ ID NO: 368 - DNA, 527 bp, Mus musculus
  misc_feature (356)..(356): n is a, c, g, or t
  misc_feature (375)..(375): n is a, c, g, or t
aaccaggttctagttggctggcaatgacagctgcttgggaatgtgttctagttactactttattcctggcaagtagactgcactttaaataaaggctacctcagcctctagccgtaacctctcccttcttttctacaaatgaagttaaaaaccctgctttataagctgctgggataacctgtcagatccatccttacttggtttttatggtaccagactttgacacagaccaggaacctctcctgggggcggtcaaagggcagatgagacctgtggctggtcaagtaagccagctagcaggaccaggctcctgaagaacactgctggctagtaaaacatacgttttcaaagtacantgctcactttgaccacagnccatgacagacttaaaactgcttcctccaattaataagtggaccacaactccagggtggtgtttctgtgctgtgacttacaaataaatcactgttggagagctactacttagcttgtgtaggataaaactagactcagctctttgttatgaa

SEQ ID NO: 369 - DNA, 229 bp, Mus musculus
  misc_feature (60)..(60): n is a, c, g, or t
  misc_feature (74)..(74): n is a, c, g, or t
  misc_feature (204)..(204): n is a, c, g, or t
gccttcgtgtgtttgacaaggaaggaaatggcaccgtcatgggtgctgaaatccgtcatntcctagtcacactngggcgagaagatgacagaggaagaagtagagatgctagtggcggggcatgaggacagcaatggttgcatcaactatgaagagcttgtccggatggtgctgaatggctgaggacattctgtatcccgagtntgttccttgcccagtgtgatttctg

SEQ ID NO: 370 - DNA, 184 bp, Mus musculus
  misc_feature (26)..(26): n is a, c, g, or t
  misc_feature (41)..(41): n is a, c, g, or t
  misc_feature (44)..(44): n is a, c, g, or t
  misc_feature (63)..(64): n is a, c, g, or t
  misc_feature (69)..(69): n is a, c, g, or t
  misc_feature (74)..(74): n is a, c, g, or t
  misc_feature (77)..(77): n is a, c, g, or t
  misc_feature (80)..(80): n is a, c, g, or t
  misc_feature (119)..(119): n is a, c, g, or t
  misc_feature (122)..(123): n is a, c, g, or t
  misc_feature (132)..(132): n is a, c, g, or t
  misc_feature (138)..(138): n is a, c, g, or t
  misc_feature (152)..(152): n is a, c, g, or t
agctgggaggattgacccacaaggtntaagaaaagcgtttnccnatgttttgggcacaccccnntcctntcctnccnttncctgctccttgaacattaccaaagagaatggggatcgtnccnncccactctnccaacnctcttcccccaccnccgtgcttgggaataggttttgccaataaacg

SEQ ID NO: 371 - DNA, 331 bp, Mus musculus
aaagagttaaggttgttcaccatgatggcatcttagaattaaacaagacttgctagggctccaagagaaaattgatttaatgtgtttattctgagggtgactgtctggttctaggaaatgttttgtaatacaaatgcttaccctattgggggcggggcgtcggggagtcttccagaggaagggcacactcactcacacacagccagctattgccggcagaggatcatggggttcagtcttcgtgtgggtcaggtctccaagctgattcttttctttccagacagaaccatagggagagtttactttttgccaaatgtcagaacaggtacac

SEQ ID NO: 372 - DNA, 372 bp, Mus musculus
  misc_feature (219)..(220): n is a, c, g, or t
aatgcattgaaagcttaccttacagatatatcattaatccaatcataactttaatttaggaatgcatttctaccaaaagaagcttagagtaaatttctattcacgttacagggattggtcattaaaaggaaaagaatcttgctgttttcagtatttcttgatttcattttttgtaaatataaagaacttcaattatgaaaaaaattaaagatatatgtnnatatatatctttaaaagttttacagacctatattgtttattccctacatggaacattttgagttttggtattgttttcagattgattgattcagatatgatttgttttcaaatgagactccattagcttctttccctgcctcataaattttt

SEQ ID NO: 373 - DNA, 491 bp, Mus musculus
  misc_feature (86)..(86): n is a, c, g, or t
  misc_feature (88)..(93): n is a, c, g, or t
  misc_feature (96)..(96): n is a, c, g, or t
  misc_feature (98)..(98): n is a, c, g, or t
  misc_feature (100)..(103): n is a, c, g, or t
  misc_feature (105)..(105): n is a, c, g, or t
  misc_feature (109)..(109): n is a, c, g, or t
  misc_feature (111)..(121): n is a, c, g, or t
  misc_feature (123)..(124): n is a, c, g, or t
  misc_feature (126)..(126): n is a, c, g, or t
  misc_feature (128)..(132): n is a, c, g, or t
  misc_feature (140)..(147): n is a, c, g, or t
  misc_feature (151)..(154): n is a, c, g, or t
  misc_feature (158)..(158): n is a, c, g, or t
  misc_feature (328)..(328): n is a, c, g, or t
  misc_feature (381)..(381): n is a, c, g, or t
  misc_feature (424)..(424): n is a, c, g, or t
attccaggatggctgtgacagtcatttgtgcagggtcaacgagagaggagagtacatctgggagaagagggtcacgggctgcccancnnnnnntgnanannnntntctngnnnnnnnnnnnannancnnnnnaattccannnnnnnnctgnnnnacangtgaggagcctgattgcaaagacatcacagccaaggtgcagtacatcaaagtgggagattgtaagtcccaagaggaagtggacattcattactgccagggaaagtgtgccagcaaagctgtgtactccattgacatcgaggatgtgcaggagcaatgctcctgctgcctngccctcgaggacggagcccatgcgcgtgcccttgcactgcaccaatggctctntcgtgtaccacgaggtcatcaacgccatgcagtgcaggtgttntccccggaactgcagcaagtgaggcctgtgcagctacagcggattcctactgatacccatgctatga

SEQ ID NO: 374 - DNA, 315 bp, Mus musculus
  misc_feature (221)..(221): n is a, c, g, or t
ctaagagctaatcctgtacatggctcctttacctacacactggggatttgacctctatctccactctcattaatatgggtggcctatttgctcttattaaaagaaaaagggggaactgtgggaagccgcccccacattcgccgtcacaagatggcgctgacatcctgtgttctaagttggtaaacaaataatctgcgcatgagccaagggtatttacgacnacttgtactctgtttttcccgtgaacgtcagctcggccatgggctgcagccaatcagggagtgatgcgccctaggcaatggttgttctctttaa

SEQ ID NO: 375 - DNA, 467 bp, Mus musculus
  misc_feature (30)..(30): n is a, c, g, or t
  misc_feature (35)..(35): n is a, c, g, or t
  misc_feature (43)..(43): n is a, c, g, or t
  misc_feature (119)..(119): n is a, c, g, or t
  misc_feature (124)..(124): n is a, c, g, or t
gcattcttagaatcctctgcaaagtccaanaatanatgttaantgagatcttttatgacctagtgcggcaaattaacagaaaaactccagtgcctgggaaggcccgcaaaaagtcatcngtgtncagctgctttaatgtactgaatgcattgtagctctgagccaggtctgaagaactgttgcccaattcagcagtgccagcattccaactttgttaaacctaccaacatcttaaacggactttcctgtggtggtaccctgagaggcggatgaaagctactctgtcagtttgcacattctaatcactttccagtatcacgagagatttttacttatataatagttctagagtatgcagctggtaaaaccagaggctacatccagtattactgctaagagacattcttcatccaccaatgttgtacatgtatgaaaatggtgtactgtatactttaacacaccccata

SEQ ID NO: 376 - DNA, 550 bp, Mus musculus
aagacgttgcctttaatatctgttgggaaggaaatgtccagacttttcaaatctccttattatatgtttccttttttgtttacatagggaacaatgtttatagttgtgtgtacagtgggggtctacaacaagaagtgtatattttcaaacaattttttaatgatttaacaatttttgtaaatcattttcaggcttctgcagctgtagattctcactgtgactcccttgcttgctcatgcatatgtgtgtctgcaataccaaatatacaggtttagtatctgcctgttagtgattgtttcccatgtgtaacgtttcggttgagatgttaactggtggacgagtactgtggatgtgaatgtgggatgtcattttaatcatgtgtaactggtcacaaggcctaatttgcagtaactattgctgttttatttaacaatgccttgttgttttgtatgcataaatgtttgggtgtaaagattgtgtgtccatccaacagggagccacagtatttaaattgaccaacctgatgttacaacgactttgaggtggccaa

SEQ ID NO: 377 - DNA, 234 bp, Mus musculus
gtactgtgtttatggagaccgctgcagatacgaacacagcaagccactgaaacaggaagaagtgactgctactgatctgagtgcaaaaccatccctcgctgcttcctcaagtctctcttctggtgttggatcacttgctgaaatgaattcaggcgaagctgagtcacgaaacccaagctttccaactgtaggagcaggttcagaggactgggtgaatgccattgagtttgtccc

SEQ ID NO: 378 - DNA, 478 bp, Mus musculus
  misc_feature (92)..(92): n is a, c, g, or t
  misc_feature (203)..(203): n is a, c, g, or t
tgatgccttgtgtcccatgactgattgatgcagagtagtaatgctgtgaagggggttttactcaagaacttcagaggctaggacatctcacnctgattttacagcctttggtgtctctgttataatgtgttcaatgataaaatcatgggctgtgtttttgtaagagggacgcttcatggtgttatttgaaaaaaaaaaaaaanggtcccaggtttcgatctgtttggagtttggagtctaatggttgcatagataaacaggcgaccaatcacacccagcagcagttagctccttaccgcagtaactcagctcatggactgccctcttgatggattgatgttgtttcataagctattattagacaaagaaccatcacgcaggcctcatgtgagtatgtccagatgaggtctaatgctcagggatatatgtatatgtatctctctgtggaattacactgtgttctgaggcatcgctctaa

SEQ ID NO: 379 - DNA, 331 bp, Mus musculus
tagccgcactcccaggtagtcagagtgagctatatcctgctcctccctcgtctccatggaaacaaggctgcaagggcaaggggtataacagcagccaaattcatcctcacccgctctgtaaaatgtttggaaccgtggtccctaaattctgcgtgccggactaagccatacatgcccttgaattcctctctgtctggccttcccgccccagcaagtggggttttctttaacttggcagaggagtggcaccaccacccacccgcatcccctgcaccagaactcagtgtttctacagtgtaagaatcgggaatctggcagaaatggcaataaa

SEQ ID NO: 380 - DNA, 420 bp, Mus musculus
  misc_feature (54)..(54): n is a, c, g, or t
  misc_feature (89)..(89): n is a, c, g, or t
actgaggatctgtaatatgggtgtccctcgtggccccaccacttcccatgcagntcctgcctccttggcaggaagctgaagcaggaaanaggcttgggtcatctttccctagagacccgaggctaggttggtggtgttcttgaagggtggcctgggttgggggactcataaggtggcagttgtccatggcccctggcaggtggggctggtgttgcccttggtgctcctcagctggggctgagcgccgggctgccctcagggctgtcgctcaccaggcattcgttggatttgaagcttgccagggacttgcagctggggatggaggccagggagccgcagaggcccagcatggagggcgtggggtccttccctagggagagagggcgggtaaggccgggccaaccagcctgtgttgtatgt

SEQ ID NO: 381 - DNA, 466 bp, Mus musculus
  misc_feature (55)..(55): n is a, c, g, or t
  misc_feature (57)..(57): n is a, c, g, or t
  misc_feature (62)..(62): n is a, c, g, or t
  misc_feature (72)..(73): n is a, c, g, or t
aaccacttactgtgagctcttggcgaaatcttcgcgcttggatttactttgggcnancgtgnttggaatgtnnctggctcagaactatgaaatgccaaacctggctaaaaaacttgaagagattaagaaggacctggaagccaagaagaagccccctagttcctgatgcctgcctggcactgcaatctggacccaccagttccatcctggggggcctgtctccttcacagccacgtccaaagctgtgttcctctttggtctcagaccctgcgcgttgctgaggctccagcacgggccagaagtggagttagctttccgtttccagcatctccccgttcccgtatcttccgtccacctgcttctgagacctaagcctggaaccatggtgctaggttagcagccgcaaccatgacaggactcactcgcctgtgctctgggattcctaccgcctactgtcaagaaatga

SEQ ID NO: 382 - DNA, 47 bp, Mus musculus
tgcacatgaatactggactgttccttgaaagcacatcatgtttaata

SEQ ID NO: 383 - DNA, 51 bp, Mus musculus
tcctttctgcacatgaatactggactgttccttgaaagcacatcatgttta

SEQ ID NO: 384 - DNA, 503 bp, Mus musculus
  misc_feature (96)..(96): n is a, c, g, or t
  misc_feature (109)..(109): n is a, c, g, or t
  misc_feature (170)..(170): n is a, c, g, or t
  misc_feature (173)..(173): n is a, c, g, or t
  misc_feature (212)..(212): n is a, c, g, or t
  misc_feature (225)..(225): n is a, c, g, or t
  misc_feature (235)..(235): n is a, c, g, or t
  misc_feature (240)..(241): n is a, c, g, or t
  misc_feature (244)..(244): n is a, c, g, or t
  misc_feature (247)..(247): n is a, c, g, or t
  misc_feature (252)..(252): n is a, c, g, or t
  misc_feature (259)..(259): n is a, c, g, or t
  misc_feature (261)..(261): n is a, c, g, or t
  misc_feature (263)..(264): n is a, c, g, or t
  misc_feature (270)..(270): n is a, c, g, or t
  misc_feature (272)..(273): n is a, c, g, or t
  misc_feature (279)..(279): n is a, c, g, or t
  misc_feature (284)..(284): n is a, c, g, or t
  misc_feature (291)..(291): n is a, c, g, or t
  misc_feature (294)..(294): n is a, c, g, or t
  misc_feature (299)..(299): n is a, c, g, or t
  misc_feature (310)..(310): n is a, c, g, or t
  misc_feature (350)..(350): n is a, c, g, or t
  misc_feature (364)..(364): n is a, c, g, or t
  misc_feature (387)..(387): n is a, c, g, or t
  misc_feature (406)..(406): n is a, c, g, or t
  misc_feature (408)..(408): n is a, c, g, or t
  misc_feature (478)..(478): n is a, c, g, or t
tcacccagcaacttacttttactttgctaagccaatgacctggcgatagctgagggcaagcttccgtgttgatagtacagtgttgctgttgtggtncctatttattttntctgttccagtattctatggacaagtgtaacttaagctggtagctcatacctattgatttnccnatgtgtacataatactactatttttcaaaaaactttatnaaaaaaacttttnagatatttgnatacnnaanaantcacnattttgnantnnagggtntnnttgttnttttnagggttnttntggtnttctttaaatncagtgatttttaatgaacatacatacataacatttccctnattggtgtgttcanctattttttgataaactgttatntcttaagtgcattagaatncnaattgtttgtaatggaactgaagtgtttccctggacagtttaatgtgcatatgaatgagatttacaattnggttgtgtgttgctttttaacttat

SEQ ID NO: 385 - DNA, 296 bp, Mus musculus
  misc_feature (84)..(84): n is a, c, g, or t
  misc_feature (88)..(88): n is a, c, g, or t
  misc_feature (105)..(105): n is a, c, g, or t
  misc_feature (111)..(111): n is a, c, g, or t
  misc_feature (146)..(146): n is a, c, g, or t
  misc_feature (148)..(148): n is a, c, g, or t
  misc_feature (159)..(159): n is a, c, g, or t
tgctgtggatattgttgtggcttcacacttaaattgttagaagaaacttaaaacacctaagtgactaccacttatttctaaatnttcntcgttttctttttgttnctgttnttaagaagttgtgatttgctccaagagttttaggntntcctgaatgantctttctgtctaagaatgatgtgttgtgaaatttgttaatatatattttaaaattatgtgagcatgagactatgcacctataaatattaatttatgaattttacagttttgtgatgtgttttattaacttgtgtttg

SEQ ID NO: 386 - DNA, 187 bp, Mus musculus
  misc_feature (41)..(41): n is a, c, g, or t
  misc_feature (65)..(65): n is a, c, g, or t
  misc_feature (79)..(79): n is a, c, g, or t
  misc_feature (142)..(142): n is a, c, g, or t
ccttattttgatcagcatagttgtagattaactttgttttncctcagcttcccgaagcgcttgcntttatacgtgtgtntcgtcactgaagattgaccttgtatgaatactgaggtttcttggtaatgctttgtacaatccnaaatgttaaattggctatctgttgaaagtgtatgcttctaataaa

SEQ ID NO: 387 - DNA, 165 bp, Mus musculus
  misc_feature (31)..(31): n is a, c, g, or t
  misc_feature (64)..(64): n is a, c, g, or t
aaatatgacagatagtttccagagtacgccnatgtatagcaaagaaccctgccatagttttganctcagccccatgcatcctttccctctttcctgaaaacaactaatttaaatttgctttgttttcttttttaagttgaattgacgttaatgtgttttcactgg

SEQ ID NO: 388 - DNA, 71 bp, Mus musculus
  misc_feature (41)..(41): n is a, c, g, or t
aagcacacgacgaatgccagacacggatgaggaaccacaantcctggtttgaagctggactttctttctgt

SEQ ID NO: 389 - DNA, 147 bp, Mus musculus
ggattctgtgaaggaggatttcaaatcaagatggttgatacaaaggcagagaaagattgtgacgtgctggtcggttttaaagctgtgtatcggatcaactttgctgtggccatctttttctttgccttctttttgctcatgttaaaa

SEQ ID NO: 390 - DNA, 151 bp, Mus musculus
  misc_feature (87)..(87): n is a, c, g, or t
atgagaaaggtgttgttccctgtaatatcctggttggctacaaagctgtgtatcgcctgtgctttggtttggccatgttctatcttntcctctctttactaatgatcaaggtaaaaagcagcagtgaccctagagcggcagtccacaatgg

SEQ ID NO: 391 - DNA, 463 bp, Mus musculus
  misc_feature (57)..(57): n is a, c, g, or t
  misc_feature (60)..(60): n is a, c, g, or t
  misc_feature (66)..(66): n is a, c, g, or t
  misc_feature (394)..(394): n is a, c, g, or t
gtgattggtaatttgcttgtttctctcaaactatttagtgtgaagagttttttgttnttntttttntttttaacttgcaagccagttgttgtcttccgaacatcatgtggaaaggaagctctccccaccctagtaccctgagacacacagtgctgcctgagaaatgcagtcatacacctgcacccagtttctcagttgctccccagttcttccatgctctctttgtgtcaaatgagtattctcataatggctggggctgctggggagggaagcggcaggcccaccgtaggacacagcatcctccacaggttttagaataatcatcctataatctagagaaataggtgctatcaacaggaaattaagcaaaatgctggatgctgtgaatcttttntcttaatttttttctattcttaaactacaggctgtagatgtcttagttctcacagaacttctgtctttt

SEQ ID NO: 392 - DNA, 550 bp, Mus musculus
  misc_feature (191)..(191): n is a, c, g, or t
  misc_feature (196)..(196): n is a, c, g, or t
  misc_feature (202)..(202): n is a, c, g, or t
  misc_feature (211)..(211): n is a, c, g, or t
  misc_feature (306)..(306): n is a, c, g, or t
  misc_feature (315)..(315): n is a, c, g, or t
  misc_feature (332)..(332): n is a, c, g, or t
  misc_feature (337)..(337): n is a, c, g, or t
  misc_feature (346)..(346): n is a, c, g, or t
  misc_feature (349)..(349): n is a, c, g, or t
  misc_feature (357)..(357): n is a, c, g, or t
  misc_feature (364)..(364): n is a, c, g, or t
  misc_feature (381)..(381): n is a, c, g, or t
  misc_feature (393)..(393): n is a, c, g, or t
  misc_feature (402)..(402): n is a, c, g, or t
  misc_feature (404)..(404): n is a, c, g, or t
  misc_feature (440)..(440): n is a, c, g, or t
  misc_feature (452)..(452): n is a, c, g, or t
  misc_feature (457)..(457): n is a, c, g, or t
  misc_feature (488)..(488): n is a, c, g, or t
tagttgtctatttcccagaaaacacatttcaaaggaccatttatgtattcttattcagcatgcaacaggttcaccttactttaagtcagaattctctcagagaataaaaattcattaatgttcaaacctaaatcaaacacagagaaacaaaacccctatttttttattttaaactttattacaaaaaattncaaanaaaatnaaaataaanaaggaagaaaagaaaatcacataccaaattaaccagaccaacagactcttttttttttttaatagtaaaaccccatattgcattaaaaatggctnagttagttnggggtgtaaaaatgctnagatnacaggattnatngggatcangacactnttcctcttactaaagcnagataagagttngtagttgcnanatagttgttgattttttaaactcatgacaaattttnttctgatttttntgctnaaatgtgtcaaagtttcactttcctaaactntctgtaattcttccagatattggtgtctccttgtgatttcacagtgaatgcttgttatcaaa

SEQ ID NO: 393 - DNA, 308 bp, Mus musculus
  misc_feature (42)..(42): n is a, c, g, or t
  misc_feature (86)..(86): n is a, c, g, or t
  misc_feature (167)..(168): n is a, c, g, or t
  misc_feature (170)..(176): n is a, c, g, or t
  misc_feature (178)..(179): n is a, c, g, or t
  misc_feature (181)..(182): n is a, c, g, or t
  misc_feature (186)..(188): n is a, c, g, or t
  misc_feature (190)..(190): n is a, c, g, or t
  misc_feature (192)..(192): n is a, c, g, or t
  misc_feature (194)..(199): n is a, c, g, or t
  misc_feature (201)..(201): n is a, c, g, or t
  misc_feature (204)..(205): n is a, c, g, or t
  misc_feature (207)..(209): n is a, c, g, or t
  misc_feature (213)..(214): n is a, c, g, or t
  misc_feature (216)..(216): n is a, c, g, or t
  misc_feature (220)..(222): n is a, c, g, or t
  misc_feature (225)..(225): n is a, c, g, or t
  misc_feature (228)..(228): n is a, c, g, or t
  misc_feature (230)..(233): n is a, c, g, or t
  misc_feature (235)..(240): n is a, c, g, or t
  misc_feature (242)..(242): n is a, c, g, or t
  misc_feature (244)..(244): n is a, c, g, or t
  misc_feature (262)..(262): n is a, c, g, or t
ccatgacagacactctgtccctaagccttgagcccagcaggnttttctagaggtgtatagagcacttccacctggactcaagttgncatttacattttgagtttaaaaagatgtttttttttaatctgtttatagaagtagctcaccttccactgaggaccaggaanncnnnnnnncnngnnaaannncntngnnnnnngnaannannncccnngntttnnnaanttncnnnncnnnnnncnanctggcctttgcttctgtnccttgtgaattagtaatccagtaggctaaaactcagtcacagggag

SEQ ID NO: 394 - DNA, 106 bp, Mus musculus
taaccataggttcccgtctgttgcccttaaccctcctttacctatcagcaatcccggaaggacaactccaattctctacaaatgaaaacgtgtcacttggtcaggt

SEQ ID NO: 395 - DNA, 151 bp, Mus musculus
  misc_feature (114)..(114): n is a, c, g, or t
  misc_feature (118)..(118): n is a, c, g, or t
taaccataggttcccgtctgttgcccttaaccctcctttacctatcagcaatcccggaaggacaactccaattctctacaaatgaaaacgtgtcacttggtcaggtactggatntcanccttcccagcagagttcgacttgaacccagagc

SEQ ID NO: 396 - DNA, 554 bp, Mus musculus
  misc_feature (246)..(246): n is a, c, g, or t
  misc_feature (388)..(388): n is a, c, g, or t
tctgagttgtctgtttctagaagaaatctcttagagaagtcagtaccagtgacatgtcagctcactgtcccagcctccgtccgggcagtacacttcccatgtgcattcccggcagtcacctcggcaaggcaactgctgctccttcacagataggacgtgggagctcatgttgagattttacccattcctccagccattttgggaaaaaaaaaattatgaactgggattcttcagaaattatgtttngttttttcttgaagaaaatatcccccccttacccccgtccttactttgtaacctggctgataacgggccatccatttttgtagcacacttttcagaaacaattataacctggtcccatctttctaggacaaacaaagccacnccttgatgtagcccggctaatcatggaagtacgtccaggcttcaaataacttgagtttaaatccttttttttttttttcttggcagagtaatgtaaaattaaaatggggaagatatttaatatttaatactaagctttaaaaagaaacctgctatcactgctatgt

SEQ ID NO: 397 - DNA, 86 bp, Mus musculus
  misc_feature (29)..(29): n is a, c, g, or t
  misc_feature (32)..(32): n is a, c, g, or t
acttgtagcattgaatgcttcctgtgctnttntagtgggactacagaatgctgtttgatactgtgtgcgacgtggagagatttaat

SEQ ID NO: 398 - DNA, 83 bp, Mus musculus
  misc_feature (56)..(57): n is a, c, g, or t
tgtggtgaatcttttcttgcgtgatcaggttgcggatagacttgtaagggtgtttnnctgcatacagtgtaagcattgtgacc

SEQ ID NO: 399 - DNA, 464 bp, Mus musculus
  misc_feature (34)..(34): n is a, c, g, or t
  misc_feature (132)..(132): n is a, c, g, or t
  misc_feature (153)..(153): n is a, c, g, or t
  misc_feature (187)..(187): n is a, c, g, or t
  misc_feature (222)..(222): n is a, c, g, or t
  misc_feature (303)..(303): n is a, c, g, or t
  misc_feature (347)..(347): n is a, c, g, or t
agctcggcagactagaaaggctgttgtgtggganttctggggtgatgtggagccacatttttgtgagttgggcagctgcagtttggagaggatgcaattgtccagacttatttatgcagtgctggatgggangagtgggacagaaatcgaaanctgaaattggggatgcatcctgtcaccctggccnattacctcagtctgcaggacctggcatcctgacangggaacagtgttcattggtggtttctgggctttggatttctctattacttcttaacgttttatgcagaccttaagtgtttntattatggcattcatgtaggtgtggacattgttacctatatttntcttatggaaataaaaaattaagatatgtgtgtgttacatgcctgcaacccagaaagaactagggaggttaaggcgggagggtggaaggtttgagggcagcctagactacctagcaa

SEQ ID NO: 400 - DNA, 417 bp, Mus musculus
  misc_feature (28)..(28): n is a, c, g, or t
  misc_feature (30)..(30): n is a, c, g, or t
ttggtgcaaattctcatgtgtgtttatntnggaaggtgagctgaccatccactgcagaggatggaggtaattaacatgatctgtgctctttacaaaagagaatccagtgacctggcctgtgtgtgtgtgtgcgcgcgcgtgcacacacgctcgcgagcgctcacattatgcatgaaaacttgattttcctgaagcatccatttccaaattgatagggatgaaaaagtaaaatttccattggattcaattagaagctctgacttctgtatttgcataggcttgaactattccttagcagtgcctagagatgcggggttcctccttggtactggccactcaccttcttacatgacgcagatgagatttcttatcagtgcaaatgtattagaacctgatggaccagagctttcagtgtga

SEQ ID NO: 401 - DNA, 450 bp, Mus musculus
  misc_feature (91)..(91): n is a, c, g, or t
  misc_feature (131)..(131): n is a, c, g, or t
  misc_feature (147)..(147): n is a, c, g, or t
  misc_feature (192)..(192): n is a, c, g, or t
  misc_feature (202)..(202): n is a, c, g, or t
  misc_feature (259)..(259): n is a, c, g, or t
  misc_feature (261)..(261): n is a, c, g, or t
  misc_feature (331)..(331): n is a, c, g, or t
  misc_feature (333)..(333): n is a, c, g, or t
  misc_feature (409)..(409): n is a, c, g, or t
agttgtagagcaaaaacctcttctacatgttcttcctcagttttaggaatgactggaaaggtgtctcagcaggaagtacattggctctgtntttacacttaatatttctgtatagagcagagtttcaggtngccaaatgaagaaatngatagtatcccttgaaaatcattataaaggaaaccttaagatttngtataagatngcatacaatagagaggagtttaatttgatgtgtaaatttgcagtgcgtggaaatggntntaagaaaaatcattaaagggaataaaatatcttaattttttccccttgggacagggtctcattgtgtagntntggtgggcctcaaattctgcatgtcgatgaggtcacctcacaccctgagtttcctctgcttctgcctctcttgttntgggagtaaagggtgcattaccctggcctgcgataataagt

SEQ ID NO: 402 - DNA, 497 bp, Mus musculus
  misc_feature (278)..(278): n is a, c, g, or t
  misc_feature (298)..(298): n is a, c, g, or t
  misc_feature (314)..(314): n is a, c, g, or t
ggcaagttcatagcacactccaagcaatggtttgagaaagaatatgtgaagaaagcaaacaaagttttaaatgattgtttctaatgacttttctgcaatttgtgtccagccaataatttctcatcatttaaatctttgtgtggagcagcaaacataagtgggatgagccacctaaattcactcctctgaaatgcaattaaagcagtagaacagaaacaaaaataaatagtcgagaaagaacatatttggcaatttaaaataatgttaaaattttttcnaccataaatttacatttacncctttataacccagancagaaagtggaagcctggttaggtgggattcccaatgtaaactccccggaaactgggggtaatgaggtgagagcaagcaagcactggtcttcagaacaagggctcaccttctcagggccgagtccagccagtgtgacgctggcagagggcccacagccgagttagccggtcattcagtacttg

SEQ ID NO: 403 - DNA, 178 bp, Mus musculus
gaatatagaaaaacccttactcaatgaaatgataaattttaaaatcgtacttagatgtggagctgcaagaagaatgagataagtggtgtgaagaaaccctttttatatgggaacgctggcttatggcatatttagataattttatgataacattttagcataatctagatgactattt

SEQ ID NO: 404 - DNA, 424 bp, Mus musculus
  misc_feature (154)..(155): n is a, c, g, or t
  misc_feature (159)..(159): n is a, c, g, or t
gcaagtgtacctcaacggcgagtttgtggggggctgtgacatccttctgcagatgcatcagaatggggacctagtggaagaactgaaaaagctgggtatccgctctgccctggtagatgagaaggaccaagactccaagtgagggccccgggcnntcgnccgagcagagcgccctctccatcctcggggccagaaaagccttactgcgtggtggtgccctgttgctgtgatgcttgcgctgggcctcctggcagcaagcgggcaggtgcttttactttagtctctggctcagaattccctctggtgaacgtacaaccactgcactgtaaatcaatgtcgcgatcctgtattgctataaccgtgatctgttcttacgttgtctttattctctgccggccggctttgggagtcacttctgattctt

SEQ ID NO: 405 - DNA, 429 bp, Mus musculus
  misc_feature (174)..(174): n is a, c, g, or t
atggctactttcatctctggaaggctgaaaataccttgtctaagctcctttccaccaaattgccatattgtcgagaaaacgtgtgtctggcctatggtagtgagtggtcagtgtatgcagtgggctctcaagcgcatgtctccttcttggatccacggcagccatcgtacaacngtcaagtctgtctgctccagggaacgaggcagtgggattcgatcagtgagcttctatgaacacattatcactgtgggcacagggcagggctccctgctgttctatgacatccgagctcaaagatttttggaagagaggctctcagcttgttatgggtccaagcccagactcgcaggggagaatctgaaactaactactggcaggggctggctgaatcatgatgaaacctggaggaattacttttcggacattgac

SEQ ID NO: 406 - DNA, 141 bp, Mus musculus
ggttttgctggtattttctaatttgtctgtccaggaaggtgtggtttgtagcgagtgctttgtgtgtgggatctgttctcagtgcagcagggcttagtgttggaagtcactgtcctgctctgttggctcattcctagggta

SEQ ID NO: 407 - DNA, 412 bp, Mus musculus
  misc_feature (363)..(363): n is a, c, g, or t
  misc_feature (368)..(368): n is a, c, g, or t
gatacctccatcagagttagctgcagccaacctgagtgttgatacaacctacagacctcacattccagtcagcaaattggcgatttcggaatcctatgacacctacatcaataggagtttccaggtgacgaaagagataataagtgaatgcaaaagtaaaggaaataacattctgattgtggcccacgcatcttccctcgaagcgtgtacctgtcagctccaaggtctatccccgcagaactcaaaggacttcgtacaaatggtccggaagatcccatacctaggcttctgttcctgcgaagaattgggagaaactggaatatggcaactgacagacccgcccatccttccccttacccatgnccccnactgggggcttcaactggagagagaccctcctgcaagaataagc

SEQ ID NO: 408 - DNA, 488 bp, Mus musculus
  misc_feature (155)..(155): n is a, c, g, or t
  misc_feature (192)..(192): n is a, c, g, or t
  misc_feature (222)..(222): n is a, c, g, or t
  misc_feature (265)..(265): n is a, c, g, or t
  misc_feature (278)..(278): n is a, c, g, or t
  misc_feature (339)..(339): n is a, c, g, or t
ttacctctctcaccttttatatcgtccaccagcttatatatgaatatttttaaagcaccaaatattgaacaagcactcaagttgagctttatattggtcacattttatggatttttcacagataacatttatttaaaatttatctttgtacttcntttcatatgaatatgggtgtaattgtaaactaatctncattcctatgtgtacattaatggccaattngattgactttgcttttggaaattctgtatataaacaacaagancagtttttgctgngtgccattgtttgatgatcctgagtgtatttcatgcctgtctgcacagtccagtttgggtntaactttattttgaacaactgtgtgctgtcattaataaagagaagcgaggaagattggaaacttgtgaagcagctagagatgctaaagtgaggttcttggggatagtaatctaccttactccgagccattcctttctccattaaagcag

SEQ ID NO: 409 - DNA, 133 bp, Mus musculus
  misc_feature (31)..(31): n is a, c, g, or t
  misc_feature (64)..(64): n is a, c, g, or t
cacaactggtgagagagaagcccttgccctntgcaggtcccattgaaaggagaggtttgctctntgccactcatctgtaaccgtgagcttttccacccggcctcctctttgatcccagaataatgactctgag

SEQ ID NO: 410 - DNA, 250 bp, Mus musculus
ggcagcagagctttgatctcttggtgatcggtgggggatccggtggcctagcttgtgccaaggaagctgctcagctgggaaagaaggtggctgtggctgactatgtggaaccttctccccgaggcaccaagtggggccttggtggcacctgtgtcaacgtgggttgcatacccaagaagctgatgcatcaggctgcactgctggggggcatgatcagagatgctcaccactatggctgggaggtggccca

SEQ ID NO: 411 - DNA, 176 bp, Mus musculus
agacgacaaggaaatctgactcttccattgaacaaagacttggtagaaaaagtgacaaacgaatataacgaatcattgctctacagtccagaagaaccaaaaatacttttcagtattcgagagccaatagcaaacagagttttctccagcagccgtcagcgttgtttctcttccaa

SEQ ID NO: 412 - DNA, 431 bp, Mus musculus
  misc_feature (254)..(258): n is a, c, g, or t
  misc_feature (260)..(269): n is a, c, g, or t
  misc_feature (271)..(272): n is a, c, g, or t
  misc_feature (274)..(280): n is a, c, g, or t
  misc_feature (282)..(282): n is a, c, g, or t
  misc_feature (284)..(284): n is a, c, g, or t
  misc_feature (286)..(286): n is a, c, g, or t
  misc_feature (288)..(290): n is a, c, g, or t
  misc_feature (292)..(292): n is a, c, g, or t
  misc_feature (300)..(300): n is a, c, g, or t
  misc_feature (303)..(303): n is a, c, g, or t
  misc_feature (305)..(305): n is a, c, g, or t
  misc_feature (307)..(307): n is a, c, g, or t
  misc_feature (320)..(320): n is a, c, g, or t
  misc_feature (334)..(334): n is a, c, g, or t
  misc_feature (341)..(341): n is a, c, g, or t
  misc_feature (347)..(347): n is a, c, g, or t
  misc_feature (362)..(362): n is a, c, g, or t
  misc_feature (365)..(365): n is a, c, g, or t
  misc_feature (367)..(368): n is a, c, g, or t
  misc_feature (383)..(384): n is a, c, g, or t
  misc_feature (386)..(386): n is a, c, g, or t
  misc_feature (395)..(395): n is a, c, g, or t
  misc_feature (397)..(397): n is a, c, g, or t
  misc_feature (404)..(404): n is a, c, g, or t
  misc_feature (406)..(406): n is a, c, g, or t
ggcagcaatctgaaggtcactctccatcttcataaagtgacatatttcagatctaccctgctgacctgcaccaacatagcttcttcctggctagcctggcagtctttccctggggctcagcgctgtaccagctccaggggctttttgccagggttctccgaggatacatgctggcttacctgttatcatgacaccagttgtcccagcacttactcacctccctgaggtctagatgggagtcctctactgctcannnnncnnnnnnnnnntnntnnnnnnnanancnannncnctggtggncantnancttcctgaagggnaaatgggatttcanggacatnaggcantgaggtgaggccganccntnntcccagagctatgcnntntatgcaaantncttacgntntcagagccttggtttccaccaaaag

SEQ ID NO: 413 - DNA, 318 bp, Mus musculus
  misc_feature (47)..(47): n is a, c, g, or t
  misc_feature (50)..(50): n is a, c, g, or t
  misc_feature (184)..(184): n is a, c, g, or t
  misc_feature (205)..(205): n is a, c, g, or t
tgctcagggagatttggcagactctttcttcattgtagaatctggangangtgaaaattactatgaaaagaaagggtaaatcagaagttgaagagaacggagctgtggaaatcgctcggtgctttcggggccagtactttggagagcttgccctggtcactaacaaaccaagagcagcgtctgnacacgccatcgggactgtcanatgcttagccatggatgtgcaagcatttgaaaggcttttgggaccttgcatggaaattatgaagaggaacatcgccacctatgaagaacaattagttgcgctgtttggaacaa

SEQ ID NO: 414 - DNA, 509 bp, Mus musculus
  misc_feature (155)..(155): n is a, c, g, or t
agatctgcattctgatgacaacgaggaggagtctgatgaggcagaggacaatgacaatgactcggagatggaaagacctgtaaatagaggaggaagccgaagtcgcagggtcagcttgagtgacggcagtgacagtgaaagcagctccgcctctncccctctccatcatgaacccccgccaccattattgaaaactaacaacaaccagatccttgaagtgaaaagtccaataaaacaaagcaaatcagataagcaaataaagaatggtgaatgtgacaaggcatatctagatgagttggtagagctccacagaaggttaatgacactgagggaacgacacattctgcagcagatcgtgaaccttatagaggaaactggacactttcatattacgaatacaacatttgattttgatctttgctcgctggacaaaactacagtccgtaaattacagagttacctggaaacatctggaacatcctgaggatacaacagctggacgcatcaaa

SEQ ID NO: 415 - DNA, 518 bp, Mus musculus
  misc_feature (297)..(297): n is a, c, g, or t
  misc_feature (299)..(300): n is a, c, g, or t
  misc_feature (305)..(306): n is a, c, g, or t
  misc_feature (308)..(308): n is a, c, g, or t
  misc_feature (313)..(313): n is a, c, g, or t
  misc_feature (325)..(325): n is a, c, g, or t
  misc_feature (347)..(347): n is a, c, g, or t
  misc_feature (350)..(350): n is a, c, g, or t
  misc_feature (356)..(356): n is a, c, g, or t
  misc_feature (360)..(360): n is a, c, g, or t
  misc_feature (368)..(369): n is a, c, g, or t
  misc_feature (378)..(378): n is a, c, g, or t
  misc_feature (383)..(383): n is a, c, g, or t
  misc_feature (429)..(429): n is a, c, g, or t
  misc_feature (458)..(458): n is a, c, g, or t
  misc_feature (469)..(469): n is a, c, g, or t
  misc_feature (492)..(493): n is a, c, g, or t
tcagctggtactgcccgcataggaatgccggttgatgctttggcagtcattcaggatggccatctctagtacacctgagtattccacacaggagactgcctgtcagagcctgcagtggtgggggaagcgctaccccggaccctgctgagtgtgttgaatgtttgtggttacaccgtgtcttcagtaacggcgtagagaagccagaactaaggaactgaggtggagaagtcttcgtttcaccatggcagggcatatttgggagctactgatttgaaatgctgtatatggaccaaagcngnntttcnntnttctntattcctcttantaaacataaaaatctcacgctnttnagagtntctntactcagnntcccagggngtttntcttcccctgagtgcgcccatcgtgctaaggagtaagagtggcatntgcatctctcaccaggcaaagctatgccnggctttctctntagctcagttgtgaaagcaattnnggctctcattcagtttttagtaatt

SEQ ID NO: 416 - DNA, 548 bp, Mus musculus
  misc_feature (291)..(291): n is a, c, g, or t
  misc_feature (330)..(330): n is a, c, g, or t
  misc_feature (400)..(400): n is a, c, g, or t
  misc_feature (425)..(425): n is a, c, g, or t
  misc_feature (432)..(432): n is a, c, g, or t
  misc_feature (437)..(439): n is a, c, g, or t
  misc_feature (447)..(447): n is a, c, g, or t
ttccgccgaaaaagagaagacgctttacccgactctttgggccgttatctcacggcgaactttctgaccgagtatacaactacccagaaggcctaggagaagtgctgtatagagagcagttcgacttcaacgctgagccaccttgggaacctagctgatgatagggggttccatctcctaacttgtccattttgttgcatattctaaggacccagacataggcttggtggcccgtctcttgtttttcctggtttatgactttcggctttgtggaatacggctgagatgaanaggatttattgacgatgcgaactactccgttggcctgtnggatgaaggaacaaaccttggaaatgttattgataactatgtttatgaacataccctgacaggaaaaaantgcatttttgtgggggatcttgggnaagatcngtgannnaagcacangtcagtggcagaccgtggtggctcagattaaagccgttttacacggttgaaagtgcaactccactcccaggccgtgcttgagatctttggagtcttggaac

SEQ ID NO: 417 - DNA, 303 bp, Mus musculus
  misc_feature (240)..(240): n is a, c, g, or t
tcagtttccggatgcctacgggaaggagctctttgacaaggccaacaaacaccactttttgcacagcctggccctgttaggggtaccctcttgcagaaaacctgtctgggcaggattactgttagcttctggaactaccttattctgcaccagcttctactaccaggctctgagtggagacaccagcatccagactctggggcctgtgggagggagcctgctaatcttgggctggcttgncttggctttttgaagtctcttgtttaagcgcccagtcctggcctttctgggtaattgggcgca

SEQ ID NO: 418 - DNA, 548 bp, Mus musculus
  misc_feature (200)..(200): n is a, c, g, or t
gctctttctgagagaattgccccagccactgctgagcatggagtatctcaaagccttccaagctgtccagaatcttccaaccagaaaggaacagttgcaggctttgaacctccttgtcattcttctacctgacgcaaacagagacacactgaaggccttgcttgaatttctccaaagagtcatagataacaaagagaagnacaagatgacagctgggaatgtagcaatggtcatggccccaaatctcttcatgtgccacacgctgggcttgaagtccagtgaacagcgagaatttgaaatggcagctgggacagcaaatgtcatgcacttattgattaggtaccagaaaattctatggacaatccctaaatttattgtaatccaagtgaggaaacagaatattgagaatcaaaagaaggaaaggaaagccatgaagaaattgctgaagaaaatggcttatgaccgggaaacaacatgaaaagccagataaactgcaaatggtgctgatgttcctcagggacgtgattccgagtagcaagactccccga

SEQ ID NO: 419 - DNA, 431 bp, Mus musculus
tccagcatgtgttactctgtcaacagtgatgctttcacagaacctttgtcctccacaattccccccctccatttaaaccaggacatttccatctcagtgagccactgctgtatttgggacctaagcgagaagctggataaacagaggcgctattattattgttactgtcaatatagtttccttccctagttataactgattatttccttttttccatttcaaaacatttttgttcaaatgcttctgatggctctcgtcacaagcaatattcttcggaaataatgcacctttttaatttctcaacctaaaatacacagcccgtcatctccatagtaggatgatgctgttagagagatcagctgtgtctagttggagaatttttaggggaataagggattacaggagcgagtgcttcctctattagttcgtgc

SEQ ID NO: 420 - DNA, 424 bp, Mus musculus
gcactcatcaaaaacctggctgacagttccacactagttcttcttctcaggcatatgttcatctcctgggtcttgagaattctaggacattccaggtactttctccttcatcagctccaaacatgaaatcacaatcaagaatacacatcatctgaatgtctgtggtaggcatgacaacaatcttagaagtcttttaagagggtgtaatgtggtattttctggtttagtgtcttccttaaatatatgtccatccacacattcctctgcatggaggccatgatgtctctgtctatcaacacatcactgtcatctcctgatctttcctcagccagaggagtgtctggaatgatgtggaggttccctttcttgtagtcatccaggagctgatagaagtagagagctggattcttcttgtagtaccaaa

SEQ ID NO: 421 - DNA, 568 bp, Mus musculus
  misc_feature (99)..(99): n is a, c, g, or t
  misc_feature (293)..(293): n is a, c, g, or t
  misc_feature (298)..(298): n is a, c, g, or t
  misc_feature (310)..(310): n is a, c, g, or t
  misc_feature (330)..(330): n is a, c, g, or t
  misc_feature (347)..(347): n is a, c, g, or t
  misc_feature (351)..(351): n is a, c, g, or t
  misc_feature (372)..(372): n is a, c, g, or t
  misc_feature (378)..(378): n is a, c, g, or t
  misc_feature (385)..(385): n is a, c, g, or t
  misc_feature (389)..(389): n is a, c, g, or t
  misc_feature (391)..(391): n is a, c, g, or t
  misc_feature (396)..(396): n is a, c, g, or t
  misc_feature (418)..(419): n is a, c, g, or t
  misc_feature (440)..(440): n is a, c, g, or t
  misc_feature (454)..(454): n is a, c, g, or t
  misc_feature (488)..(488): n is a, c, g, or t
  misc_feature (493)..(493): n is a, c, g, or t
  misc_feature (502)..(502): n is a, c, g, or t
  misc_feature (512)..(512): n is a, c, g, or t
  misc_feature (521)..(521): n is a, c, g, or t
tggtgaagaggcacaccctaagtgtggcctgcatgctgccagattgaaagggtccatcagcttccctggtgccctgggtgtgtcaaggcctcagaggcntggggcggatggacagacactgctggcttaggtttgctaggctacagagggggactgggccagccccgcgtgggactggcacatgtcctttgtagggcgtgttcagagatagagggtccaggtgcaatgctgacccagcttcttgggtgctggtcagttactactaggcccaggttttagatgacaaacccccnccccntcccagtttccnggagaggtgaacaggacctncatgttaactccctctntccngcctgggaaagtggctgaagnccaggnccctatntttntnctcantcaccttcactggaagaggggnncctcatagggaaaactaaggntatcggggcactgncacttcctagactgggtggggagggtggaggctntactntccccgaanccgtgaaganccaagtgtncccacctgcatgtgaagggggaagatggctatcaacttctttcaata

SEQ ID NO: 422 - DNA, 549 bp, Mus musculus
  misc_feature (277)..(277): n is a, c, g, or t
  misc_feature (292)..(292): n is a, c, g, or t
  misc_feature (345)..(345): n is a, c, g, or t
  misc_feature (409)..(409): n is a, c, g, or t
  misc_feature (412)..(412): n is a, c, g, or t
  misc_feature (455)..(455): n is a, c, g, or t
gatcagttaaaccactctgttcatggggcgtggatttaccctctctgcccagatcagagcacccgcacgacttcctcgtcagttactgcccagctcagctagtgtccgctcgcccgcccttccgcacatcccccgcttcttttccaccttttaagctgtgactggtactttctggatctcagtgtaacttttgagctagttaattctcttctacattttactgttctctggggaatgaacccttcctcggaggacactgcttccagagcatcttctnttccagattcactancctttttgatcagctattggtagatgaacaggctggtttattctggtataaancccttttttggagaagggaaaatgtttgtactattccttttacatatggcaacatcaaactganccnttgctcacattaaataattcacttgaactataaagagaagatncaatttgcattttaaaggggaaggggctaacaacacttttctacctgtgtaaattatagatcattaattcatgcaccctgtgggagctcaataa

SEQ ID NO: 423 - DNA, 321 bp, Mus musculus
  misc_feature (35)..(35): n is a, c, g, or t
gtcccgatgtctgtagtgctggctcccttcttggncctgggcacgtgatggctacaactggtctatcgattcattgagatccagcagcaatcagaggaagaagatgagtgctttcttcacaaacctgaagagctctttcttggaagttatcttcgcaagcctttcctcaagtctcctcaagtcttaccggcaaggaataggtctgtggtcatttctcgtcaccatccatgagtagcaatgcctacaactgtattcaagcaatactccctggggcagagaggtttagtggagtccacggcactggacacttgctttggatta

SEQ ID NO: 424 - DNA, 249 bp, Mus musculus
  misc_feature (131)..(131): n is a, c, g, or t
  misc_feature (135)..(148): n is a, c, g, or t
gggctctgttgtgacccctgcctgaccctccatgtttcagctctgatgagggtggctggtcctctctctaggactctgcagacctccccaggacactttcttgtgtgtgtgtgtgtgtgtgtgtgtgtgtntgtnnnnnnnnnnnnnnctgtctgtctgtctgtctgtctgtgtgtgtgtgtgtggcgcacatgtatgcacgccatgtgccatgaacctggacaagcattgtctcaagggctcatttta

SEQ ID NO: 425 - DNA, 505 bp, Mus musculus
  misc_feature (131)..(131): n is a, c, g, or t
  misc_feature (135)..(148): n is a, c, g, or t
  misc_feature (250)..(250): n is a, c, g, or t
  misc_feature (260)..(282): n is a, c, g, or t
gggctctgttgtgacccctgcctgaccctccatgtttcagctctgatgagggtggctggtcctctctctaggactctgcagacctccccaggacactttcttgtgtgtgtgtgtgtgtgtgtgtgtgtgtntgtnnnnnnnnnnnnnnctgtctgtctgtctgtctgtctgtgtgtgtgtgtgtggcgcacatgtatgcacgccatgtgccatgaacctggacaagcattgtctcaagggctcattttangctttttttnnnnnnnnnnnnnnnnnnnnnnnttttttttttttggtgatgtgtgtatcttgtccccagctccctaggccctgcctgcctttcagactgtcctctcctcctccttctcccctctccttatgccaggggtccaggacttccagccagaagcctctgaccttgtgttccctgtcccctcccctgtcccctctgctgctcagcatagctgtggtcactgcagaggtcttatatgttcagcaggcctgg

SEQ ID NO: 426 - DNA, 446 bp, Mus musculus
ccatgggccttctgtgtctcaggaaggtggcttctgcatgctcctcagtatgaatgcaagaaagcagaagccttccctagtctgctgaagggaaggctgcagtatcagagtattgctcatccctccagaagcaagtcaggcagggccaagcttggtgaaacagggtgacgtgctccatgctctctgtggtctggagttagggtggggaaaggttggtataattgaagattgtgcagttcctagtgacaggtgccaagaggttatgatacgggtttcttgggtctgttgtacagtgtgaataaatgcttgcagctcttagccctttttgatcaatgaagcacttttttattaatattttctttgtatgtaaaggaggaagcgtaactccatagctgtacatagaaccttttctcctaaagaggagtcagcgctcctatagttttcat

SEQ ID NO: 427 - DNA, 371 bp, Mus musculus
  misc_feature (77)..(77): n is a, c, g, or t
  misc_feature (271)..(272): n is a, c, g, or t
  misc_feature (286)..(286): n is a, c, g, or t
  misc_feature (290)..(290): n is a, c, g, or t
  misc_feature (324)..(324): n is a, c, g, or t
agtctatcgcgaattatttccccagagatttttgaacagaaaatgagcaaaccgtgtttacatgtctgtttatgttngtcatattttcaagtctttcttccattttagcctccttgtaagaaaacactgtccagtggtctccatcaggccgatcactatattcactgccatcccatgctagtttaaaggaatgctatgaaaatttaaatctgtagaccatatatacttttcacccaagttctcccattgaggactcttgcttaaaaatatnncaatttgactttgntctnctcacacacatgagttggcgagatcccaggaatntcgtgtggtgatgatgttcactgtttgtaaccatgctgttaatgaac

SEQ ID NO: 428 - DNA, 278 bp, Mus musculus
  misc_feature (48)..(48): n is a, c, g, or t
  misc_feature (64)..(64): n is a, c, g, or t
  misc_feature (174)..(175): n is a, c, g, or t
  misc_feature (186)..(186): n is a, c, g, or t
  misc_feature (197)..(197): n is a, c, g, or t
  misc_feature (224)..(224): n is a, c, g, or t
gccgtgtgtcaataattttgagagaattatcttggttgcttacacttnggcaatatcacaagtnggttagttacaaatgtataagggttcttgagaataatttgtttttattttgcttatccagaatacataaaacattttatcatgtgagggtattgggaaagatgttttttnncttatgtatantcattgtaatnatccacttaaagaaaaatagaatatanccacattatgatggttgtactactggaaagattttgctgggacatacaatatgt

SEQ ID NO: 429 - DNA, 274 bp, Mus musculus
gaacaatggcaacccagctaatactggctgaggtgggtatgcctgtttggctgaagcagcgctggtgatcaaggtgatgactaagatcttatacccatcttaccctcagattcctgacaggatttaataaaaaattgttaataagtagatgtgcaccctaaggatttataggaaaaatgatttttatatgaaggtttaagtttgtgatactcttaagatttttttataagattacattttaagatgaataataaaataattgccgtgtgtcaat

SEQ ID NO: 430 - DNA, 481 bp, Mus musculus
  misc_feature (129)..(129): n is a, c, g, or t
  misc_feature (285)..(285): n is a, c, g, or t
  misc_feature (342)..(342): n is a, c, g, or t
  misc_feature (388)..(388): n is a, c, g, or t
  misc_feature (400)..(400): n is a, c, g, or t
  misc_feature (441)..(441): n is a, c, g, or t
  misc_feature (447)..(447): n is a, c, g, or t
tggcagaaatatgaccgctcacaaaaccaaatcggccaagagccctgcctgcgtgtgacccagattccaaagggagggcttcctagttctagacatgtgggccagattagcattggctgtcttttctgncagcatgaattaagccctcataaggtgatgggtcctgtctgaggatgaggggagcaaatgagcacagcagggacagccgcagtcagtggcgggccagggaaggtgtcagtgctggtacagctcattatcagaaaggttaaaggttttttcctactnaaaccatcctcactttttatacatgcaacggactgtacgcgtatatacatacatatntactgtagtttaaagagtaataataatagcccccatatgcctccancctgccatgctncctttctccctaggcaccccatgtgcgcttccctgaccttntctttntccctgttgaatatagaaagcctcaccctgtgtg

SEQ ID NO: 431 - DNA, 289 bp, Mus musculus
aactttatagtgtggccatcgtgactaaattaaccacagtttggtatctgagtctcaaactgaagattatttttataaatgaattttaaaagaaaaaccttggctgttttaaaatctcaagaaaatgaacctgctgccatgcataattttttgatgcttttgcactaggtatcttgtaaatgtcactgcatttctgatgaagggcgactgacaggtagaggtagtattgtgtgtctgaaattgttcagctcctatgacgcaccatgggctgccctcatttccatatgct

SEQ ID NO: 432 - DNA, 502 bp, Mus musculus
  misc_feature (123)..(123): n is a, c, g, or t
  misc_feature (275)..(275): n is a, c, g, or t
  misc_feature (292)..(293): n is a, c, g, or t
  misc_feature (298)..(298): n is a, c, g, or t
  misc_feature (308)..(308): n is a, c, g, or t
  misc_feature (311)..(311): n is a, c, g, or t
  misc_feature (322)..(322): n is a, c, g, or t
  misc_feature (326)..(326): n is a, c, g, or t
  misc_feature (329)..(329): n is a, c, g, or t
  misc_feature (350)..(350): n is a, c, g, or t
  misc_feature (365)..(366): n is a, c, g, or t
  misc_feature (388)..(388): n is a, c, g, or t
  misc_feature (392)..(392): n is a, c, g, or t
  misc_feature (418)..(418): n is a, c, g, or t
  misc_feature (420)..(420): n is a, c, g, or t
  misc_feature (453)..(453): n is a, c, g, or t
  misc_feature (466)..(466): n is a, c, g, or t
gtgagctttaccctcctctaatcaacctctgggagtccagcaaagaaaaacgggcaacactggaagtaaaagcaacggctataggagtgccgacaaatatgtcctaaaaacaaccaaccaaancctacttcaaagaaaagctggaaacggcagtactgcttaaaaatcaacaacaaaaaataggcaggggaatgtcactttctgaaaagaaggctcagtgtcgccaatgctgctcctgaccaagggagaggtgaaagttcggcattttaattganctggcttcaaagggtanntgtgncaaccaaatnaanacaattccatnttcnagnaactttcatgtaacttttatntcaggactgcagttnnacgtgaacatttctgtattttntttnaagtatagaagagtagttgaactgancnatacctcctcctgtgttgtattacacatattanccacgagtttttncagtgaccagataaacttgaattgacacgtggtgta

SEQ ID NO: 433 - DNA, 511 bp, Mus musculus
  misc_feature (79)..(88): n is a, c, g, or t
tgcctgacctctgctattttctaggttgagtggctgtctaatgctcactgagtacatgctgtgcttgtgaccttgagcnnnnnnnnnnactctgcctgggcctcatgcagaacttagtaccagagattatttgaagataaagttgtctcagaatggatatgttgtaaggatgtttgacagtaagtgccaatgtcactatggattaaagcaagactaaatgtacttaaaaggtcagaagtgttcagaatctgatagaggctgggttgaatgtagttttagagaattaaacatagttgtaatatagacagctaggtagagctggaggctagggaagctgggtttgatgggttgttggaactactgtcctttaggatcatgtgtcaaagcaaactacaaaggatttgtgaagcagataattgtggcccttaagcttaactgtgtgagacaaatacctgtttttaacagtaggggaaccataaatttcaaagcggatcctattctttgtcttata

SEQ ID NO: 434 - DNA, 331 bp, Mus musculus
  misc_feature (188)..(188): n is a, c, g, or t
  misc_feature (191)..(191): n is a, c, g, or t
  misc_feature (194)..(194): n is a, c, g, or t
  misc_feature (204)..(204): n is a, c, g, or t
  misc_feature (207)..(207): n is a, c, g, or t
  misc_feature (211)..(211): n is a, c, g, or t
  misc_feature (217)..(217): n is a, c, g, or t
  misc_feature (219)..(219): n is a, c, g, or t
  misc_feature (224)..(224): n is a, c, g, or t
  misc_feature (231)..(231): n is a, c, g, or t
aggatgctgggttcgctgtagactaccctgagcgttgtgtgccggggtctcactgactgctgtacagctcctttgacagcagcttctacgtagtggagcagtgagagtgtcagataacagaaggctggagaggcgcctcaccgcacccagcacctatgtatttcaaaagttcagactctgttagcaanacntantattccaaantantacntagtgntncaggntgtgagnctccctccttccatccatcattcccttcctccctcctctctctccccacctctctccctcctacagaaggtgccagcttactccatagctgtataaataa

SEQ ID NO: 435 - DNA, 447 bp, Mus musculus
  misc_feature (297)..(297): n is a, c, g, or t
  misc_feature (333)..(333): n is a, c, g, or t
ctggctgcttctgaggtctagcaatgcttggatttgtcgaaagaatggagctttctctgttgggaaatgggcacaaagacacaaacccggggcttaacccgctagacaatgcatggaatgtgaacacaagttaattatttcaaaatgtgtatcagatgttatttaaatgataatatattcaatgatttttttcataatttatcgaagcctgtgagatgcactggatttcctttgtcacatagttttgatttttgcagccttctgcattgcacacgtgaactggaccttagggcaagnctgcttgagagagttctcgactacatttttaaacantgttctgtgaaggcctgtgagtgtcatgataaaactgtgaatgactacatagggactctgattagactattggttaggctcctgtggtttgtataggtctccaattcctactta

SEQ ID NO: 436 - DNA, 551 bp, Mus musculus
  misc_feature (300)..(300): n is a, c, g, or t
  misc_feature (354)..(354): n is a, c, g, or t
  misc_feature (384)..(384): n is a, c, g, or t
  misc_feature (402)..(402): n is a, c, g, or t
  misc_feature (420)..(420): n is a, c, g, or t
  misc_feature (436)..(436): n is a, c, g, or t
  misc_feature (445)..(445): n is a, c, g, or t
  misc_feature (518)..(518): n is a, c, g, or t
gcagacagcatcttccatcttgctgcaactatgggcagatgagagatggttatactatactactccaccctttcaggtggggctaaatactaagaataaatctgttttcttgttcaaataataaaataaatgaatcagggagaaatactcttgttaaattatctgaatatgcagtttacataattgtaatttttatcaaaatatttgtcaaaatgatgtcaaatatacacttcttagttgtcttccttttggagaaacctgtttgataggtcacaatctccatccttactgatgctttcnttagatgtcaccgtatccttcaatccaaccatgatcacttgaagcagagatcancaaactttttctgtaaagataatattttantctttgtaggctgggtgncctttgttgtaactattntcctctgtaaaagcantcccagacnatatgcatgtgaccgagcatggctgtactctaataaaatttgatgtacaaaagcaagaggaaggctggactgnccttaccaatcgctcacttaaagcattgatttt

SEQ ID NO: 437 - DNA, 431 bp, Mus musculus
  misc_feature (244)..(244): n is a, c, g, or t
  misc_feature (330)..(330): n is a, c, g, or t
  misc_feature (342)..(342): n is a, c, g, or t
  misc_feature (386)..(386): n is a, c, g, or t
tgtgtgtgtcatcttgtatctgcgctcacatataagctatggtgtggatgtggagatcaaaggacagtgtttgggagttggttctcccaagagccgagcctcttatagcctccccgtgcagctgtgtgcacagttcaagtgggaggggctggctcctggatagcttcctatggctggagagaaggttctaaagcaggagtctgtagctgttcagtggatcttggggttgcagggagaaatctantcttttgcccaggattaaactatttagtgttgcttggttcactttgtggctctggttccagaactgaagagagttccttctcacanccttccttcagnaacattgcacagcattctgtggtgtggggacatgagggacactnccatttgtgccccatgtgatatgtgacttattttgccagttgaag

SEQ ID NO: 438 - DNA, 180 bp, Mus musculus
ccttcaagattttctgtgatgatttctcaggtactttcaagtagcctgttacctattcagagagtctccttgagctcagaattaaaattgccctgaatttttgaagatccaaaatcttatgtaaatagccattggtagttaagtgggttttattttttagtcttgtgcttgcccttggtc

SEQ ID NO: 439 - DNA, 231 bp, Mus musculus
  misc_feature (51)..(51): n is a, c, g, or t
  misc_feature (63)..(63): n is a, c, g, or t
  misc_feature (72)..(72): n is a, c, g, or t
  misc_feature (126)..(126): n is a, c, g, or t
  misc_feature (139)..(139): n is a, c, g, or t
  misc_feature (157)..(157): n is a, c, g, or t
  misc_feature (180)..(180): n is a, c, g, or t
  misc_feature (192)..(192): n is a, c, g, or t
  misc_feature (198)..(198): n is a, c, g, or t
tgagtccccaactagactgtgagctccctgagggcaaggggctgtcatttnttcttcaacttntagtgggtntagcccaagaacctctcagaagacaactggatgaaacacatgctggaggtcatntgaggtggagggnttgtgtgcatggggagantccacatggcttagcaagaggtntatgctgttggnctatgncctgaccccttggatcaacaatggatgctcaag

SEQ ID NO: 440 - DNA, 418 bp, Mus musculus
agagatccatcctttagctactgaggcagagtccgtgagagtagagtggggttttctttagagaagactgtttagatgaggaaactagcagggaaggaagaaaatgtattagaagagtgaaaggtgagtaggaatcttgacggtttctggaatgaggcttgtggtgcttgggcggcaacgccggtcaggactcgggcatatctgtagctgttctctccggaggctgaggaacagtctgagtggtttccaggggatgaacatctaaaattgtgctgggaatgaatgcgcagcacagagcggctgggcccgttctcttacaggtggtttcggtccagtctctgtctgaggacaacaggaagagacagagaatgcctggcaggtagctctgttcccgttctttccctcagagacagtcatt

SEQ ID NO: 441 - DNA, 461 bp, Mus musculus
  misc_feature (283)..(283): n is a, c, g, or t
  misc_feature (285)..(285): n is a, c, g, or t
  misc_feature (304)..(304): n is a, c, g, or t
  misc_feature (315)..(315): n is a, c, g, or t
  misc_feature (339)..(339): n is a, c, g, or t
  misc_feature (343)..(343): n is a, c, g, or t
  misc_feature (353)..(353): n is a, c, g, or t
  misc_feature (360)..(360): n is a, c, g, or t
  misc_feature (384)..(384): n is a, c, g, or t
  misc_feature (424)..(424): n is a, c, g, or t
  misc_feature (436)..(436): n is a, c, g, or t
ctaagggtgggtacctccattgcgatgttgtggcatcttaacttttacacacagacctcatgggtgtccactgaggaagtagtatgagcctaaagacactggcagcgtgcagcctggcctgggagtggcggccttcgcatctctctctctctcagcactcagccacgctgacctggccgggtggtccgcgtggacaggacagctggtgaagcaagccggatgctcagaacactgcgcgtctcctgtcctgttttaagcttagctgggtcctttgttttcacancntcctaggttaaatagtttncactatttttncaataaattcatgggaaacctaanggcnacttatgttnttgttcntactgtgtgtataaactaacactnaaggtttgctatagtgttttcttttcacctccttatgtanccccataacatncacagaatgctgtaaacctgattaa

SEQ ID NO: 442 - DNA, 521 bp, Mus musculus
  misc_feature (40)..(40): n is a, c, g, or t
gggagatcccgaaagcatgtatgtgcttataaaccaagcngtagagatcatgtaaagacgctgggtgttgctctggaggtttctgagctatggaaagggatagggcattgtggtgtgatgtagctaacacagagctcttggtatggagtaacagttaactatggactgatgtttccagacgattgtgttcttaatggggtttgcttttttatttgcctctcagattatgtttagtagtttaaatttctttgttttattatttcattaaagtataaaaacttcaggtctcatatttattttcacttgttctactaattatttacaagacactttttggttgacatttattttataaatgtgtggtatattaaatgtctttaattttttttgttttattgaaattacagtaactttgatttgctttactgggatttttaaattttattttaattccactttttccatgtcagtgcacagcacttgcccagtcctttgtatcccctttctgtcgattcaataaa

SEQ ID NO: 443 - DNA, 409 bp, Mus musculus
  misc_feature (153)..(153): n is a, c, g, or t
  misc_feature (301)..(301): n is a, c, g, or t
  misc_feature (330)..(330): n is a, c, g, or t
  misc_feature (340)..(340): n is a, c, g, or t
ccattcccatatcagtccgagaagacctgggccagacagctgtccccgtcctcttaacagcccagcctactcaaaagttgttggcaagaccatgaggcgacagatgggcccctcttggcctctgtcccagctccctgcagccagatggagggncgcctgcctgcttccccatccctgaagcatccccaaggacaaccctccttcctccaccatgatgaggggaagctggagccctaagctttgatcctctattggagtggcccagatctttccatctggagtaagtctatgttagaagccnaaggccttctccccagtctggccttggcntccagcctgnaaaaggggttatcatcagttctgaaggccaaggccaccccttccccaggacagaaccacatctctgata

SEQ ID NO: 444 - DNA, 505 bp, Mus musculus
  misc_feature (199)..(199): n is a, c, g, or t
  misc_feature (207)..(207): n is a, c, g, or t
  misc_feature (212)..(212): n is a, c, g, or t
  misc_feature (234)..(234): n is a, c, g, or t
  misc_feature (236)..(236): n is a, c, g, or t
  misc_feature (267)..(267): n is a, c, g, or t
  misc_feature (274)..(274): n is a, c, g, or t
  misc_feature (285)..(285): n is a, c, g, or t
  misc_feature (310)..(310): n is a, c, g, or t
  misc_feature (327)..(327): n is a, c, g, or t
  misc_feature (368)..(368): n is a, c, g, or t
  misc_feature (374)..(374): n is a, c, g, or t
aatatcaggcaagtgctatgctcctgagctatactccagttcagaatataatttaaagtttaaatattcaacaaattgtcaagatactatacattaaatataaatttaaaaagataaagtaaaataaaagctagaggttcttttttattttaaacatgcaagttttattactttacatatagaactctattaaataatntaatatancaatnttttaaattaggaaaccccacntnatagttagagatcagtttacatagttgaatnttctatnttcaaagcacnaacattgttgtaagatgctgttagnaaatgctttatttgagncaatggataataattatctgattctgatttgttgcttattntctctnataattatacgttctctgactattgtatttagaacaatatttccagttttgttttccatttccagagactgaatttgtaggcatagagcagctcttatccctcagtgtactgtaatctattgttctcaatg

SEQ ID NO: 445 - DNA, 508 bp, Mus musculus
  misc_feature (324)..(324): n is a, c, g, or t
  misc_feature (395)..(395): n is a, c, g, or t
atgtttgccatttctaatctcctagctgctgcatgtatgattttgcacaatacactttataatgtcgtgggaagaagcagacaggggagaggtcactgagagaaaactcttgatattcgttaccacgcatgttttaaagtctaccccaccttcctgcccatctccagcactgagatgcagtgttgtgggcctagtccatgtttagtgaaatgcaatgtcaagaaagtcaatgaggaaattaaatgtaaattctgagcagccatttactgggttacttgagcaaccaatcattatgaatttctgttatttggcagtgacttatcngtctatttcttacccaaaaagcccatcagaaggtgtcccttacattattgctaaccttctgattgctgttnttaaggatagagacatatatgtgtatgtagtcaaggggacatccttcccctcggtatctgtatgattttgcttattgttaatgtactgggtgagctcctttgtgcatcaggaa

SEQ ID NO: 446 - DNA, 395 bp, Mus musculus
aggaaggttgtcctgcctattccataccatttgaataatttctttagagtttttgatggacttcattgtaaaaggttagaaggcattaaaagttatcatgtgtgttatatttataacatattcttgcagccaaaacacaaaagtagactaaccaagttgaatttgatttaaaaaaacaaaaaggcagggagggatcaggggcattaaaaataagaggttagaacctaagaagtcatccttatctacagggccaaaggggctggattcctctgttgtgttatcttacctggttctttacttacactgtcaaagacttcacagtcccagagggtatgccaggagggggcctttctaaatgaatcctgtgaacactgcatttctttgcttctttagtg

SEQ ID NO: 447 - DNA, 370 bp, Mus musculus
  misc_feature (79)..(79): n is a, c, g, or t
gtgaaacatctaactttgccagtgttcagcaagttttcttttggggtgttggagggtggtaatggggaggggtagtgtnggttttaggggttttaactatgtgaaatttgaaatcaggacagttgttggctatggtacttactagttttgtagtaatgttttgctagcctgactttccttactggtttttatgtccatggtccccggtgactgttactcttgtttggggtgtgtgcatagtagtgtctcatctgtgtgtaggcagtcagtgtatgcacacggtgtgacagtggaacggggtgtggctgggagtggggtgctggagctttaagagcatttgtttttattcagaacagtatttcccatcttt

SEQ ID NO: 448 - DNA, 418 bp, Mus musculus
  misc_feature (289)..(289): n is a, c, g, or t
ggaactgccgtagccttaacagacacccaatacccagtgtcaatgatgcatggggatccaaccagatcctgtgcatgtaagacaagcactcgaccactgagctgtatcttctgcctctttatgtcttaggtaaatgaagcaatggaagggtttttgtaaatctcacttgagattgccatttatgaacctaattgtcttggacatgcaatgtcagtgccctgttctctcctgcagtgtctgcatggcgtccactacttctgttggtgttgggcgtgtgtagtgtcccgtncactggggcctgtgtgcttgtgctgaagtcgtgctcactgcagccctctagttcctgtttgaggatgaatgagtgcttgtttgcagtgccctggactgacttgcttttgcccttgtgcctagttaagag

SEQ ID NO: 449 - DNA, 537 bp, Mus musculus
  misc_feature (197)..(197): n is a, c, g, or t
  misc_feature (271)..(271): n is a, c, g, or t
  misc_feature (282)..(282): n is a, c, g, or t
  misc_feature (289)..(289): n is a, c, g, or t
  misc_feature (302)..(302): n is a, c, g, or t
  misc_feature (318)..(318): n is a, c, g, or t
  misc_feature (320)..(320): n is a, c, g, or t
  misc_feature (323)..(323): n is a, c, g, or t
  misc_feature (328)..(328): n is a, c, g, or t
  misc_feature (365)..(365): n is a, c, g, or t
  misc_feature (399)..(399): n is a, c, g, or t
  misc_feature (431)..(431): n is a, c, g, or t
  misc_feature (444)..(444): n is a, c, g, or t
  misc_feature (451)..(451): n is a, c, g, or t
  misc_feature (476)..(476): n is a, c, g, or t
  misc_feature (503)..(503): n is a, c, g, or t
  misc_feature (508)..(508): n is a, c, g, or t
gactccagagcatttagcagaattaaacttgtaaataggcttggagatgcaccattgaagatgtcaggctgagtcccttctctgtgtggctgtgaggagtgggagtttgggggagtttgtaaactatttcagggggtgcagtgtggtttcccctccctgtgaggcctcagcctctcttctgcacagattccgtgttntaaagagtttgctcatgccgccatcggtgtgctatagctttaacgcttctgaaacctctggggttgattagaanccggggcttangtttccntcgtacccagagnccccacctcacccagntngtntcttntcccacaaggctcttcagggaccgtggtggctacagntctggccagcctctggctcctaggaaatatgcantcttgtggggtttgatcattttgaagataccngggggtgggaagntctggantccctgggttgggactccatgtggntcacctacctcctggtttcacccaaantcctnccttgaaccaccagcaagtttcattctgt

SEQ ID NO: 450 - DNA, 311 bp, Mus musculus
  misc_feature (126)..(126): n is a, c, g, or t
  misc_feature (249)..(250): n is a, c, g, or t
aaagccaatgtacaaactggtttcttggtttggatgggttttatttgggttagtttattcatttccccggtttctactgtggattctttggtggctaacttgatagcctgagtggtctttttcatntcttttatgtcccttattcaaggagacagcataattactgcagaacaagacacatttgaagggtgttttctactaaacctcattcagttattcagtttttaaaagggaaaaaaggcgtggcgnntcaccacgcggtgagctgtttatttaaacattgaggaggaagccagcagtgagatgttccc

SEQ ID NO: 451 - DNA, 548 bp, Mus musculus
  misc_feature (30)..(30): n is a, c, g, or t
  misc_feature (50)..(54): n is a, c, g, or t
  misc_feature (56)..(58): n is a, c, g, or t
  misc_feature (60)..(60): n is a, c, g, or t
  misc_feature (169)..(171): n is a, c, g, or t
  misc_feature (260)..(260): n is a, c, g, or t
  misc_feature (306)..(306): n is a, c, g, or t
  misc_feature (314)..(314): n is a, c, g, or t
  misc_feature (318)..(318): n is a, c, g, or t
  misc_feature (321)..(321): n is a, c, g, or t
  misc_feature (364)..(364): n is a, c, g, or t
  misc_feature (368)..(368): n is a, c, g, or t
  misc_feature (383)..(383): n is a, c, g, or t
  misc_feature (396)..(396): n is a, c, g, or t
  misc_feature (410)..(410): n is a, c, g, or t
  misc_feature (422)..(422): n is a, c, g, or t
  misc_feature (427)..(427): n is a, c, g, or t
  misc_feature (439)..(439): n is a, c, g, or t
  misc_feature (522)..(523): n is a, c, g, or t
atctgggaagagctcttggtctctcttgtnctgcccatagactgaccatnnnnngnnncngtggtcaggagacggcaagagtccgcttttcttcctcgcctttccaggcatggagaatgggcttaaccaaggccacgtgtccagagaggtgtacccaggggtgacgggnnntgagaggccttccacctaccctcagggagcctgggtttctcaggggctcagtggggcagcactttttgcttgttgttgttttaagtttntagcattaaattgatttaaaagatgaagttggctatgccaggtagntccgagcnagcnganctgggaatttgaagtttggatgttgagctaatatgtactggtncccnatttgggttaatttntcttatcctcgantcagcttcctggtnccacaaacttantcctntccgaggagtgntcagcgactcacccccccccacacacacttgaaatttgtctatttttacaccgagtgtccaaccttttgacatatgtgacctnntcgtctctaaagttcaccctcagga

SEQ ID NO: 452 - DNA, 207 bp, Mus musculus
  misc_feature (31)..(31): n is a, c, g, or t
  misc_feature (39)..(39): n is a, c, g, or t
  misc_feature (60)..(60): n is a, c, g, or t
  misc_feature (66)..(66): n is a, c, g, or t
  misc_feature (97)..(97): n is a, c, g, or t
  misc_feature (104)..(104): n is a, c, g, or t
cagttgaaggaatgtatgggtgactggcagncagtgctnccttcaataggaaactaaacnctgggncccatctcccacccgactacctgagaaaccnctttgtntcccactgttactaaagcagaaagtatagtgttcttcacttgaactaatcaaatacaatagattataaattgtgtattgtaaataaaagttcactctgtgagt

SEQ ID NO: 453 - DNA, 351 bp, Mus musculus
  misc_feature (31)..(31): n is a, c, g, or t
  misc_feature (39)..(39): n is a, c, g, or t
  misc_feature (60)..(60): n is a, c, g, or t
  misc_feature (66)..(66): n is a, c, g, or t
  misc_feature (97)..(97): n is a, c, g, or t
  misc_feature (104)..(104): n is a, c, g, or t
  misc_feature (208)..(208): n is a, c, g, or t
  misc_feature (246)..(246): n is a, c, g, or t
  misc_feature (264)..(264): n is a, c, g, or t
  misc_feature (271)..(271): n is a, c, g, or t
  misc_feature (274)..(275): n is a, c, g, or t
  misc_feature (284)..(284): n is a, c, g, or t
  misc_feature (299)..(299): n is a, c, g, or t
  misc_feature (312)..(315): n is a, c, g, or t
  misc_feature (318)..(318): n is a, c, g, or t
  misc_feature (326)..(326): n is a, c, g, or t
cagttgaaggaatgtatgggtgactggcagncagtgctnccttcaataggaaactaaacnctgggncccatctcccacccgactacctgagaaaccnctttgtntcccactgttactaaagcagaaagtatagtgttcttcacttgaactaatcaaatacaatagattataaattgtgtattgtaaataaaagttcactctgtgagtncacattttggtaaattatttatttatgttaacattatnaaagaaagggaaaaaatncatttgnccnnggataagtnaggtatgttggtcanggctttgctttannnnctngatattanagctggtttttgatcctggtctttt

SEQ ID NO: 454 - DNA, 405 bp, Mus musculus
  misc_feature (185)..(185): n is a, c, g, or t
  misc_feature (189)..(189): n is a, c, g, or t
  misc_feature (217)..(217): n is a, c, g, or t
  misc_feature (312)..(312): n is a, c, g, or t
  misc_feature (322)..(322): n is a, c, g, or t
tacagaggatttgtttagtaaacgtaaagaaatagaatgagcactggtatcttaaaaatcaagtctttgttctaagtgttatttgtatgtcttgtttagtatttatttaggggattgtttcttattctatttttatcttttgcttggtttgtcaggtagacacttgatagtaaaatggctttcanaaangacattttaatcatttgctgatatgagnactggtttgagagtagtgtttttgttgtgaaacattccaggtgaagcattatatgcaaattatttaattattaatttctgttcattccaaatacnagctgttaancctcatagaatttaaaagatttgtttcatattttttcctgtatttattaagctcttgaaattgtgaggaaactcatttttaga

SEQ ID NO: 455 - DNA, 518 bp, Mus musculus
ggtaacagcttctctctagcctggctggctttggtaggcaaaagtgaacttggaagtcacagtgggatcagaggggtgtaggttgcgatccttgtcgcctgaggagccggtggactgctgagctagtccaggggtagccggtcccctcatgcatctgctgccttagcttctagaacggagcaagcttttacgtacctaggtgacatgtagaaaaatttacagtaaactgaaatgaccatttgtcaatgcattggtgcataggagttactagggctacttctggaagccaaaatagaatagcatctccatgtgcattaaaaacttcgccagcactgccttttgccagcattctaaatttggagttttactgagaaggaaactgtttttatagttttaatcagagctatgcatttcatacagctttttaatttacaatgaaacaaagaaacaaattcctttgaccaaattgcttgtctatagttgtctgcagtactgtatgattttacccatgtgcaatt

SEQ ID NO: 456 - DNA, 553 bp, Mus musculus
  misc_feature (132)..(133): n is a, c, g, or t
  misc_feature (282)..(283): n is a, c, g, or t
  misc_feature (314)..(314): n is a, c, g, or t
  misc_feature (319)..(319): n is a, c, g, or t
  misc_feature (333)..(333): n is a, c, g, or t
  misc_feature (341)..(341): n is a, c, g, or t
  misc_feature (363)..(363): n is a, c, g, or t
  misc_feature (369)..(370): n is a, c, g, or t
  misc_feature (372)..(372): n is a, c, g, or t
  misc_feature (380)..(380): n is a, c, g, or t
  misc_feature (382)..(382): n is a, c, g, or t
  misc_feature (400)..(400): n is a, c, g, or t
  misc_feature (403)..(403): n is a, c, g, or t
  misc_feature (433)..(433): n is a, c, g, or t
  misc_feature (435)..(435): n is a, c, g, or t
  misc_feature (442)..(442): n is a, c, g, or t
  misc_feature (446)..(446): n is a, c, g, or t
  misc_feature (466)..(466): n is a, c, g, or t
gggtcctttctcctaaggagacacagaggcatagaaacccaatgtgaccattacccacaagcatgtgtctgccaccgcgggcatgcctacctgtgctcctttcctgtgagtctttccagtgtagaataaaanntcacagcagatttcccaaagaaacttaaattttgttatattctgtgtttataactctagaaaagaatttcctaagataacaaacttaaataaataattcaaagaaaaaatcccattttttaacttctaaatttgctttactgttgagtnnatcagttttataaaataaatttgcatttgtnttcanaactaagaaaagtnaattatanatatgaagtatgcttaaatatnatcttnncnagattggnanatggagacataactaatnccnatttagacattttacatctaattttgtgtntnctacttntctncctccattagataacatgtncatgaagacaagtacaacacttttctattcatattcttctattatactgttgtgaggaaatttgggtttccttttgtgtattcttgc

SEQ ID NO: 457 - DNA, 583 bp, Mus musculus
  misc_feature (238)..(238): n is a, c, g, or t
  misc_feature (270)..(270): n is a, c, g, or t
  misc_feature (278)..(278): n is a, c, g, or t
  misc_feature (308)..(308): n is a, c, g, or t
  misc_feature (319)..(319): n is a, c, g, or t
  misc_feature (334)..(334): n is a, c, g, or t
  misc_feature (339)..(339): n is a, c, g, or t
  misc_feature (354)..(354): n is a, c, g, or t
  misc_feature (356)..(356): n is a, c, g, or t
  misc_feature (358)..(358): n is a, c, g, or t
  misc_feature (378)..(378): n is a, c, g, or t
  misc_feature (390)..(390): n is a, c, g, or t
  misc_feature (403)..(403): n is a, c, g, or t
  misc_feature (410)..(410): n is a, c, g, or t
  misc_feature (415)..(415): n is a, c, g, or t
  misc_feature (506)..(506): n is a, c, g, or t
  misc_feature (508)..(508): n is a, c, g, or t
  misc_feature (558)..(558): n is a, c, g, or t
tttcttccgacttctcaagcgtactggtccatagttcataccaacaaaatatagaagggcaacgggatatatacaaaagaattatataagaataaactcaaaatacatgttaagcataaaggtaagacctaaatcgatcagagtcttagggaaaaaaaaaacttcacagtgaaggtatggaagggaaaagctatattcaagctagctatatagggatataatgacatttttttttttngcaatagaaggaatgaagtgctaattaacacntacatganccttgtatgtattagggctgaaccttgagnacattacagtnagagaaagaaaccanacatnaaagaccacataagncnanatctccttataccgagtatncagataggcgantctcctgaaacanccacagntcacntgaggaaggtgagctgagagaaaacagggcatggatatttggaatgatgaggacgtttatgtaattgtggaatttgttccacaactatggntntactgagataccgttgaatcacacactataatggtgaattatatggtttntcagtcactgatcaataaagttctt

SEQ ID NO: 458 - DNA, 470 bp, Mus musculus
  misc_feature (307)..(308): n is a, c, g, or t
  misc_feature (344)..(344): n is a, c, g, or t
  misc_feature (348)..(348): n is a, c, g, or t
  misc_feature (354)..(354): n is a, c, g, or t
  misc_feature (361)..(361): n is a, c, g, or t
  misc_feature (368)..(368): n is a, c, g, or t
  misc_feature (372)..(372): n is a, c, g, or t
  misc_feature (374)..(374): n is a, c, g, or t
  misc_feature (378)..(378): n is a, c, g, or t
  misc_feature (388)..(389): n is a, c, g, or t
  misc_feature (395)..(395): n is a, c, g, or t
  misc_feature (398)..(398): n is a, c, g, or t
ttccggtatgaaaaccactcttagttttggagaaaactattttaattcttgattttgttttcatgaaaagcttctccattgctagataatggatggtattttcatgctgggtttttcagacttgtgcattttcagttgttggtgaacttccttttttattgacaatatgaagactcattctgtgccatctaccatataagtatatatctgtatcatgttatagatatatatgatataatgaattgttgcatagacatcgaaatagaccgtttatggaacttgagcttcgtgagctcagaagtaaaannaactaaagctaggatgtatgatgagatcaaatgctnttangctttnccaaacncaacacnctgntntttnacaattaagnnaaatgnatntcactgtgtgaggtaatttagatctgtctgggtttgtgtgtttatttagaacatttcccttgactatagaag

SEQ ID NO: 459 - DNA, 450 bp, Mus musculus
  misc_feature (318)..(318): n is a, c, g, or t
  misc_feature (388)..(388): n is a, c, g, or t
ggaggctgaggatttctaccgagctgatgtggcttggctccagaatgcatatagaatgtttagttgagtgtaacccatcagttacttaaaggacaagggttgcctgttcacatttgtgccattcaaggtgccacaggaaatgcatttgtaccaaattatttgttttctttaagaatgccttgtcaaaggttcagaatgaaaaatagtcttattgtggctgtactagcacagtggaagcagagctccttaaataagaaaatcatcaataaagcctgaaatacagagctcagagcataatttcaaaagtataaaaggggnccaaacagaaagaattcttttcctggcatatgaaaatgtgttcttagtgctgcttccagaatgttctttntcgtttgccagcaagtttccaaggtcaatgcactgctgctctctgggagatgtctgacttca

SEQ ID NO: 460 - DNA, 290 bp, Mus musculus
taactcagacgagacaagtccatttatatggctaaatacttagcttgaatactcttctgtattttactaatcctaattaattccttttccatgtattttactgtacttatccataagagatcagcaggtattatcagacactcactgagtgctcagaaatagtgaggactgtgaggaacctcaagttcagttttgtctgtccgtttgtctgtccgtgaaggtgtcttctccaggaggtttgcagtgttgttttgacttctaaacaaagttgagcagaaggtggcccattt

SEQ ID NO: 461 - DNA, 233 bp, Mus musculus
gttaaattcatctatggctgacatgatcttataagagaatgttcatagtcctctttgtacatgaaatcgtggctagaatgttaaatggataatgtataaacaagaagtatgttatactgctcactatacctttagctgtgttttgaaatatagttttgcaaaatctttctgtaggaaaaggagcactctctacatgaaggtcacatgttttctatttcagagttcagaagctc

SEQ ID NO: 462 - DNA, 500 bp, Mus musculus
gtaaggcaaggctttcttcgtagaaaaaaaagagagaacccccacccagatgacctcaggtgaccagtgcccacccccaaactttcccacagttctctgggtggggggctgggatacaaatacttctctttgagctgttaatttgagggcattctggaaccttctactgcttggatcttcattctctcctgatattgttgagaggtctggccactaaaactcttagaaatgtcatcatctgtcacttccatggggtcttgaggaaggggcaggcaggtctgcaccccctgcccccaggtctgcaggccaggactgggttcctcccttctgccctgccctgattggcacatcccctccagctctccagccttctgtggacctgcaggcagctcttgtgccaccttcacactcagttgtgcaagtcctgagctcaggccccctgcatccttcctcattggctgaccaaggggaatcttatatccaagcagccgaatccgtta

SEQ ID NO: 463 - DNA, 515 bp, Mus musculus
  misc_feature (371)..(371): n is a, c, g, or t
  misc_feature (387)..(387): n is a, c, g, or t
  misc_feature (425)..(425): n is a, c, g, or t
gtggcagaacactaatacagcatctgtttaaggatgagcagtgctagaacgtgaatcagaactagctaatagatagatgttcagtcctgaaaaatggttgtctggacttgtgagtttatgctttcatttggttgtcaatgatgagaacgtctaggatctgaagccccacattaaatttgaactacttgaatttaaacagtataatttgaaaaaaactgaattatttttaaaactatatagagtaaagtaaaaactgaagttattctgtattgcataggcagtacagattttctgtgaaaaccataaagctattttgtctactttgcatgaataattcagacttttctatatcaaggccaagtagtaactanaaattggatcttgctnttcagagataagaattctcagctcatcataattatatntctttatctaagtgtttccttctaggtctcccaccaagtattagatctttgaaatgtaagcaactgatcactgatatatattgtctggca

SEQ ID NO: 464 - DNA, 528 bp, Mus musculus
aagtcaggtccccacattctgttcacttgtgcctagaagagagtgctgttgtggggcaagcacactcttatttgaccagtgcaggttagtgctcccagagagagcatccaagtcctgaaattggcttggggcctgggaggggcgtgaaagaaggaaggatttagggtagtaaagttaggtacagagacctcgctgttcaaggcctgggacagctgtccctgcccttcttccctgttgtggtctgccagggttatgtggaaggctgtgtagcagcaagcagggctgtggagaggaacagggaagggagagcctgacgagtttggctgagggtctgggaaatgagcagggttggggggaatgtggatcaggtttactagcacctgccagagaggccatctggggctcctccaccccagcccccaagcagcccctcccccagcgcctttgcattgtcccctcccccactcctgctgtgggttcccatcatttcctgtgtcagcgcctggcctacccagattgtatcatgtg

SEQ ID NO: 465 - DNA, 196 bp, Mus musculus
  misc_feature (48)..(48): n is a, c, g, or t
  misc_feature (57)..(57): n is a, c, g, or t
  misc_feature (65)..(65): n is a, c, g, or t
  misc_feature (82)..(82): n is a, c, g, or t
  misc_feature (86)..(86): n is a, c, g, or t
  misc_feature (89)..(89): n is a, c, g, or t
  misc_feature (121)..(121): n is a, c, g, or t
  misc_feature (123)..(123): n is a, c, g, or t
  misc_feature (150)..(150): n is a, c, g, or t
  misc_feature (152)..(152): n is a, c, g, or t
  misc_feature (157)..(159): n is a, c, g, or t
aggaatggtggtgccaccttaccctacccttcgatttgtgaagacacngcgacgatntcactggnaccgtggaagcctttanaatnaanccccccagagtggactccacttggctcctttngnaaaatcgggctgaatttggcacagggnanttttnnnagcttcttccccaggaatatcaaggctgcacctcctg

SEQ ID NO: 466 - DNA, 472 bp, Mus musculus
gtttgatcagggtaatccctcaattgagactctcctcaggggactctaggctgtgtcaagtggacagttaaaggtacctgtcaacttccttgctctcctctcctgcttctgtcctcaccacagggatgctggggttctgtgatgatggctggattttcagttgctgtgataaaacaccagtgttgggagccaggtgatccaaggctctccccacagttctaatgtatggagaaggaaggtagtcccttatctaacaccaggaatacccctggcaaagtcagtagtaacccggggccagggccttggggaaactgtgggttttatcaaatgacctttggacccaactcctccccacaaggagctgtggttattagacccaatgccactataaaatctgtctgtgatacacttgataccctgtatcttaggcaatgttgtttgattagcttcctgctgactggatcctattgta

SEQ ID NO: 467 - DNA, 528 bp, Mus musculus
  misc_feature (79)..(79): n is a, c, g, or t
  misc_feature (149)..(149): n is a, c, g, or t
  misc_feature (158)..(158): n is a, c, g, or t
  misc_feature (160)..(161): n is a, c, g, or t
  misc_feature (322)..(322): n is a, c, g, or t
  misc_feature (335)..(336): n is a, c, g, or t
  misc_feature (352)..(352): n is a, c, g, or t
  misc_feature (395)..(395): n is a, c, g, or t
  misc_feature (416)..(416): n is a, c, g, or t
  misc_feature (430)..(430): n is a, c, g, or t
  misc_feature (444)..(444): n is a, c, g, or t
  misc_feature (469)..(469): n is a, c, g, or t
  misc_feature (483)..(483): n is a, c, g, or t
gaagccctgaaaggtgactctgatgcagacagagggtagaataggaaaccacacaggcaggaagcctcgcttggaagancaggctgtccccccgggaccagaccctttgcatcaaactcttacacggaggagacagacgaggaacccanggtgcttgncnnttggacttactgtttcatgatgtagaatcttctgctgacatacaagagtgttgttcagccacgctgatatttccagcttcagatcagtgagctgacaatgtgtgttaccagaccaagcctgtgcctgacaccaggagcacctatggtcgtaactgtaaaantcttactccagtnntcccaaccgcccaccntcctgagctcttcggaaggagcatagcgactcatcatcgactntcaatattctcctggtgtggnccttcaactatctntcctcctgcctcancctcccgaatagcagggatgacagncctttgtcatcagncccagctcatgtaactcactaagtgctaccctgacttaaggagga

SEQ ID NO: 468 - DNA, 342 bp, Mus musculus
tggtgctgcagcttcttgatgcttccaaggactcgggttgattggcagagtgatgccagctgagacaggcgattgtgctgaggcaaggcatgtggaggacacgtgatctatggagggactaaatagaacttgacggacagtggcagaggctgagcttggcttgtttagagagctagctgtgcaacagtttgtcagtctcgcagcattgctgatcactgctgagaggagaggcacaaccaggaacttctcagggcattcctctgggtccttcctgctgactcaagctgaagctatggccaggttatctctgctaggtcatgtctccactgttgattcgtgttt

SEQ ID NO: 469 - DNA, 290 bp, Mus musculus
  misc_feature (79)..(79): n is a, c, g, or t
  misc_feature (116)..(116): n is a, c, g, or t
  misc_feature (121)..(121): n is a, c, g, or t
  misc_feature (131)..(131): n is a, c, g, or t
  misc_feature (225)..(225): n is a, c, g, or t
  misc_feature (254)..(254): n is a, c, g, or t
gggtacaggagcagcttcaaattaggaaagcataaagtactttttataagttcttttttattggctttatcatttgctngcctggaatttctaggtagaccagaaacgtgtgatgntcttnttaactgatnctggttccatggtagtgatgttttattgactatagtatagagttcattgcttgtgctaaacaacatctgtgtgtgttgataagtgtttagtgtnccatacatttgaaatcatatagtaagctncctttcagattggcttttagctagtaatatgcctat

SEQ ID NO: 470 - DNA, 472 bp, Mus musculus
  misc_feature (71)..(71): n is a, c, g, or t
  misc_feature (261)..(261): n is a, c, g, or t
  misc_feature (298)..(298): n is a, c, g, or t
  misc_feature (303)..(303): n is a, c, g, or t
  misc_feature (313)..(313): n is a, c, g, or t
  misc_feature (407)..(407): n is a, c, g, or t
  misc_feature (436)..(436): n is a, c, g, or t
gagactgcagacaagtcagcacccatcactctaacaacaccctgctgcatctgaacatctgtggggtctcntcgaggtcttgtgctggacttgctaatgcttagctgtctgagaaatgatattgctttagtgggtttgctttgctgtacttttttcatagatttttttggggggggtagtgggggtacaggagcagcttcaaattaggaaagcataaagtactttttataagttcttttttattggctttatcatttgctngcctggaatttctaggtagaccagaaacgtgtgatgntcttnttaactgatnctggttccatggtagtgatgttttattgactatagtatagagttcattgcttgtgctaaacaacatctgtgtgtgttgataagtgtttagtgtnccatacatttgaaatcatatagtaagctncctttcagattggcttttagctagtaatatgcctat

SEQ ID NO: 471 - DNA, 478 bp, Mus musculus
  misc_feature (267)..(267): n is a, c, g, or t
  misc_feature (347)..(347): n is a, c, g, or t
  misc_feature (403)..(403): n is a, c, g, or t
  misc_feature (425)..(425): n is a, c, g, or t
agacagcaaacatcacagtcaggtggctgacacagctagggccttggtgtgcactccaggatgactttgaggcaagagaaggaccaaagtcaggggacagaggggagaaggcatcttcctctctgcttccagatgagagcacaagagggaatatcaaactgaacaactgacaaaacaagttctggaaggatggatggacacacacacctctggctagagtgcatctatatagagccaccaccctagttaactagagaggattagctnacactgcctgttctacagtcccacccccatactggccctgaacctccattgtaccttcattgtcccccacagccttgttncatgatggagaggtcaggcataaggaccagtgatgccactgtccctgtgtgacccntgaccaagccacaaaccctgtntagacctcgtttttgtctcctatgaaaggggataataattcctgcctataaag

SEQ ID NO: 472 - DNA, 480 bp, Mus musculus
  misc_feature (144)..(145): n is a, c, g, or t
  misc_feature (148)..(148): n is a, c, g, or t
  misc_feature (313)..(313): n is a, c, g, or t
  misc_feature (315)..(315): n is a, c, g, or t
  misc_feature (317)..(317): n is a, c, g, or t
  misc_feature (319)..(320): n is a, c, g, or t
  misc_feature (323)..(324): n is a, c, g, or t
  misc_feature (328)..(329): n is a, c, g, or t
  misc_feature (331)..(332): n is a, c, g, or t
  misc_feature (340)..(341): n is a, c, g, or t
  misc_feature (346)..(346): n is a, c, g, or t
  misc_feature (351)..(351): n is a, c, g, or t
  misc_feature (353)..(353): n is a, c, g, or t
  misc_feature (361)..(361): n is a, c, g, or t
gcgaccatgagtttgagggctgtttagactgtggtgagaccttgtctgcaaagtaaaaaaacaagggctgccaggaagatgtcagtcagtaaagtgcacgctctacccccccccacatacacacatacacacacacacacacanncgngcgcgcgcgaacatgtatgtacataacatacacacaatcaaagctagcacaaaaacggatcccaagtccaaactgataagaaacgatgggtgcacggtccacagcacttgcctagcaagggcctcgctgtggccctagggctggagagagaaaggaagacccagnangnanntgnncgtnntnntgactcannccttnacccnancactgggnaggcagaagaaagagtaattccagttccggcccagcctggctctgctcagagaggagagagaagggacccaggaaagcaggagaattagggcaggcacaaggttcctggttaatcccca

SEQ ID NO: 473 - DNA, 144 bp, Mus musculus
  misc_feature (45)..(45): n is a, c, g, or t
  misc_feature (81)..(81): n is a, c, g, or t
  misc_feature (83)..(83): n is a, c, g, or t
  misc_feature (86)..(86): n is a, c, g, or t
  misc_feature (115)..(115): n is a, c, g, or t
ttgctaaaattccttggcgggaatttcacctttccattttgttgntttctttcctgaaataacgtgggagatgttctgatntntcntttgctttgcttccgcggaactcacccantcttaaaaacacatcttcattgcagaggc

SEQ ID NO: 474 - DNA, 156 bp, Mus musculus
  misc_feature (28)..(28): n is a, c, g, or t
  misc_feature (33)..(33): n is a, c, g, or t
  misc_feature (48)..(48): n is a, c, g, or t
  misc_feature (61)..(61): n is a, c, g, or t
tgcccaggagctcacagttcctgcaganccttnttgggacagccattntgaggcagggagntaccaggctgggttcccaggggaacttgttgcaggtaagacgctggggaccaaagctgcggacccatcatagctgaccaaccctgttgcccttgg

SEQ ID NO: 475 - DNA, 183 bp, Mus musculus
  misc_feature (125)..(125): n is a, c, g, or t
  misc_feature (132)..(132): n is a, c, g, or t
ctggaggcccacgtcaaaggttgatgtcaaggacagataaagcccaccgcccttagctggatctaacagcccacaactgatgcttcttgcttcctgcagtggacttcacctgctctccctccctncccactnttccaggaaagacccttggagcttgtgcatacagagtttgaatttccacct

SEQ ID NO: 476 - DNA, 113 bp, Mus musculus
  misc_feature (43)..(43): n is a, c, g, or t
tttttacgcttatttttcatggatcaaaaattcccagcatttntggaagaggtggaaaaggaacttaaaaagattacagggttgagaaactaaagccctgcacatgtatgcaa

SEQ ID NO: 477 - DNA, 426 bp, Mus musculus
  misc_feature (37)..(37): n is a, c, g, or t
  misc_feature (77)..(77): n is a, c, g, or t
  misc_feature (85)..(85): n is a, c, g, or t
  misc_feature (95)..(95): n is a, c, g, or t
  misc_feature (99)..(99): n is a, c, g, or t
  misc_feature (105)..(105): n is a, c, g, or t
gagagaagaaagtttgtaccctgtttccacttttgcnacaagtaactgcttgatttacttgttttttctaaagattnatttcctntatgtgtatntgtntgtgcntgagtgtacatgcatgtagatgccggcagagaccagcagagggcatcagagcccctggagctatagttgtgaggggttgtaggctgcccagtaccggtgctggttaccaaacccaggccctctgcaagagcagcaaatgctgcgaacagtgttactttgttgtagtttgagacaaggtctcatgtagccgaggttggctttaaactgatcctgctgcctttagcactcaagtaccaggattacaagcatggatcacatctggtaatcttgctttaaaaaaatctaagtttagttgtctagacaagaggtatgttgcgggct

SEQ ID NO: 478 - DNA, 538 bp, Mus musculus
  misc_feature (370)..(370): n is a, c, g, or t
agaagcggaatttcctccagtattttcatagcaaccttcagatgaaagtgtagaactctcagctcctcctgcatcatgactgcctggggctgccatgttcctgccttgatgataatggactgaacctctaaacctgactggttgttctatttctgagatctctgagacccagcccaccaggaacacacaaatgtggaaccgagataggctgaggacttattaaacagaattctgctgttcctatcccagggttggaccaatgtgtagaaaattgcttatgggattctttgaatgactttttcattgcgggaaatattaaaaatgaacctgccaaccttccacactcctgcttctttcaagccaccaactncaagagatctgtctctgcctcctacgtgctggaatcaaagaaattacttcactgccattagagcctacttcttcaggattctgcttatactgaaaaccatgtgggacatccagccttgtggactgaacaacttctggcttcttggacctttcactgttagtcagccat

SEQ ID NO: 479 - DNA, 343 bp, Mus musculus
agcaagcccatgcagatactgtggtggggagaagggagggttgtgtggggagcatccacgtgagtaaaccttccttatttacgagggtcctgtgtgtgatgggggtgggggtcctagacgaggtaagtcctcatctctcaggcttacattaagtgcaattactctttataatccagggcatctggggtcctactaaagttttaacggagagagatcttcagggttcttattttcctcctttccactctctccaccctgcatcctctgtaccatccccaacttaaagccagtacaccagagggctgacctccaaaccccttaactcaggctggcttaactgggc

SEQ ID NO: 480 - DNA, 418 bp, Mus musculus
  misc_feature (192)..(192): n is a, c, g, or t
tggtgctagcactgaacctgatgcccatatctgcccagagtagagctataggataacgactcacagtctagtttgctaagacacggtgtgtctcgtttcagagggcttattgggcaacttccctgacaatgaatgccttttttgaagaccacaggttgcaaagataagttagggacatctgtctgttttcgngaagtgaggacagtgaccccatatgggaatcagaacatggcattgctccttagagatacattccatccctgtcaaggtcatctctgtatacgagacagaggttggcttctccctagcagtggggagtggggagtggtgtgttcttctgagactctgtaacatctacctcatgagggtttcctgggaaacagtgagatgatgttctgtgctctgttagactgtgctt

SEQ ID NO: 481 - DNA, 432 bp, Mus musculus
  misc_feature (31)..(31): n is a, c, g, or t
  misc_feature (65)..(65): n is a, c, g, or t
  misc_feature (70)..(70): n is a, c, g, or t
  misc_feature (151)..(151): n is a, c, g, or t
  misc_feature (294)..(294): n is a, c, g, or t
  misc_feature (314)..(314): n is a, c, g, or t
  misc_feature (321)..(321): n is a, c, g, or t
  misc_feature (362)..(362): n is a, c, g, or t
  misc_feature (372)..(372): n is a, c, g, or t
tgtttgtcttgctgactctggcttatttggnattttgtttgttgtttgtttttcacagagtctcnttatntggccctgaatgtcctcaaactcactatgtagaccaggctggccttaaattcacaaagatttgcctgtttctgctttctgnagttctggcctgagtctagtttatttcatttagcataccaatttcttctgtcatccattttcctaaaaaaaattgaaacaaaatttaaaaaattaaaaaagtcatgattttctttttcttcatgactgaataaaatcccactntgtgtagtgccacattttcnttatgtntgtctattggtggacatctaggctggatatttttctggctnttgtgaacgntaaagcaacaaacacagacattcaagtatcgctgttcacttagagtgtgtgccccgcggt

SEQ ID NO: 482 - DNA, 488 bp, Mus musculus
agtccccgagatgcgacttgggagagaggttgcagaaggaggcagcccatcttctcctcccctcgatcatcttttccatccagatgcaagtcgtgggagctgagagctcggacgagggtgaaattgccgccttccctccgacccgaacgcgtgcgccccgccggccccccgctgggtgcacactcgcacgcacaccctcgcacccatacccgcacacgcgggagcacacgcacaggtagtcagtcacacaccaagggcagcagcgacggcggacgaaacatgctccggtggcattgcaaccccccccacccccgccatccaaccttgcaattcatttgcagtcagaccccaaaccccacaccttccccggagcccccctccataaaaaagtgccttccccccaaaacacacacgcacacataacacaaagtaggagaatggaccgacagagatatttttggcaaatgctcacatcagagggcgtcctg

SEQ ID NO: 483 - DNA, 450 bp, Mus musculus
gttccctaagtctgcaaattgctttcataaggaacattacttgattagtgtgtttatttgggggggggggggcaaggtttggaatttggcaatcttgaacccttttaaggtgctaacattggccctttgtaattagcttcatgctgtgacaagtttgagtcaatatgtctgacgtacgtggttttcttttaaccatatatggcttgccggttttgtacaccattcccagagtatgtgtaacaaatatgttggattctttagcagccttgccagcctctgtactgttaagacagcctcctttattttatttatttatagataaggactcaaaagtagcccagtgctcaacgttggacttgcttgaatatgtagcacggaaaaccttgtaatcctaatcttgcttcagttataatcgataggattataggtgtgccccaataaattatgctt

SEQ ID NO: 484 - DNA, 223 bp, Mus musculus
gaacacatactgctcgaattgagcttctggtcatgttttcaaaagggcacaccttgaggacattattccttaaatttttcatgtggtagaacacctggaaataagaattctgggcatgaactatatgcagaactgctactgagaatgtaagataagtatgtaaatatataggtgtgtattaattagatagtcatatgctggctaacaagcactatttctaata

SEQ ID NO: 485 - DNA, 197 bp, Mus musculus
  misc_feature (71)..(72): n is a, c, g, or t
  misc_feature (75)..(76): n is a, c, g, or t
  misc_feature (83)..(83): n is a, c, g, or t
  misc_feature (102)..(102): n is a, c, g, or t
  misc_feature (120)..(120): n is a, c, g, or t
  misc_feature (128)..(128): n is a, c, g, or t
  misc_feature (131)..(131): n is a, c, g, or t
  misc_feature (133)..(133): n is a, c, g, or t
  misc_feature (139)..(140): n is a, c, g, or t
  misc_feature (160)..(160): n is a, c, g, or t
tttccaagtccaaatcctggaggcagcctcacctgctctctgccccgggacgcctaggagcctgggggacnntgnnagagggncctgtccatcctcaccatncccttcccttttctcctncacccctntantntacctnnacagtctccatgacccccancctcttaccccctgcacctttcgtttaaccctgtcat

SEQ ID NO: 486 - DNA, 283 bp, Mus musculus
tcaggaccttgggagacaactcagtagttagagggcttgctacacaaacatgaaaatttcccatctctataacctatatagatcagtagtgtgtgtgtttctgtcctctaggaaatcctagtagcaagctggctagctaaactaaccatatgggcaaagctctaagtacagttgagacaccttgccttaatgtataagggggagaagatgagtgaagacaccaacattagcctctggcctctgcatgcacatgcacaggtttgaacaggcatgcacttgcaca

SEQ ID NO: 487 - DNA, 304 bp, Mus musculus
ataacacctttgagatccacgacgacatagaggtactgaagcggatgggaatgtcctttggtctggagtcaggcaaatgctctctggaggatctgaaaatcgcaaaatccctggttccaaaagctttagaaggctatattacagatatctccacaggaccttcttggttaaatcagggactacttttgaactctacccaatcagtttcaaatttagacccgaccaccggtgccactgtaccccaatcaagtgtaaaccaagggttgtgcttggatgctgaagtggccttagcaactgggcagct

SEQ ID NO: 488 - DNA, 498 bp, Mus musculus
  misc_feature (104)..(104): n is a, c, g, or t
  misc_feature (326)..(326): n is a, c, g, or t
  misc_feature (402)..(402): n is a, c, g, or t
  misc_feature (437)..(437): n is a, c, g, or t
  misc_feature (469)..(469): n is a, c, g, or t
aagatctacctactgtacttcccatgtgaggacaacgccaatgaaaacctattgcttgtctcgtgtgagggcagctcagtgaaaatctaccaggctcctcttgntgaggggcagttccagtgtgtccatgtagggttctagctacatcgttctagaagatatgagttaatctctaataaaaggaaaattaagactggggattattcttaaactcaggaagacattttgaggtattgactttgagagcacagatttagcttgaaatgagaaagaaaagacattgatatcttctgtaaaaatcatgtagaaacgagctgggcttgtcnaaataggactataatttgtgttctgaaagaccttttcttcagattgagaattctaagatgacttaaaatttgtgtnccaaattttttgatatataaacaaagagaaagacncaacttcaacttcaagtgcacagcgatatttncagttatgtatcaatctgtctttcctctg

SEQ ID NO: 489 - DNA, 450 bp, Mus musculus
  misc_feature (63)..(63): n is a, c, g, or t
  misc_feature (113)..(113): n is a, c, g, or t
  misc_feature (148)..(148): n is a, c, g, or t
  misc_feature (169)..(169): n is a, c, g, or t
  misc_feature (172)..(173): n is a, c, g, or t
  misc_feature (175)..(176): n is a, c, g, or t
  misc_feature (178)..(178): n is a, c, g, or t
  misc_feature (181)..(181): n is a, c, g, or t
  misc_feature (184)..(185): n is a, c, g, or t
  misc_feature (188)..(188): n is a, c, g, or t
  misc_feature (289)..(289): n is a, c, g, or t
  misc_feature (306)..(306): n is a, c, g, or t
tctgtcaccagctattcccttgggccccagtttataatcatcaataataaagcggcaggtggntggcattctcttcctatgtgcactgtgagaaaatacttaaagttcctatntagaggaaatcaggccctagtgttgacatgacttnccaagccccagtttatataantgnnannancantanntcntttagataccttccactttgctgtggacggagaaacaccggcttaagtgaaatatgcacctcttcatgactagcaggaaaagcttccttaggtaccaacancccacgactctgcggantcagctgcatacttaacctggacacttccactgtaagcttcaaaaggcaactacatagtgcaaaaagcagaccttaattcttttgaaaaaacaattttattttggctttgtaagactgtgaagacttctgtttgttcactagta

SEQ ID NO: 490 - DNA, 349 bp, Mus musculus
  misc_feature (52)..(52): n is a, c, g, or t
  misc_feature (102)..(103): n is a, c, g, or t
  misc_feature (135)..(135): n is a, c, g, or t
  misc_feature (143)..(143): n is a, c, g, or t
atatgtgttagctagtttttctgttaacttgacacacactagagtccttttngaagagggaacttcaactaagaaaatgcccctaccagattggcccgtggnnaagcctgtggtgggtgtacttcttgacttatnattaacgngggagggtccacccagttccttgagagtggtgccatcccagggcaggtggtcctgcgtgctataagaaagcaggttgaccaagccatgaagagcaagtcagtaagtaggcccctctccacggcctctgcttcaagtcttgcctccaggtccctgccctgagtttttggcctaccttcttttcctcagtgatggtaggaaaccttta

SEQ ID NO: 491 - DNA, 384 bp, Mus musculus
  misc_feature (40)..(40): n is a, c, g, or t
  misc_feature (61)..(61): n is a, c, g, or t
  misc_feature (178)..(178): n is a, c, g, or t
  misc_feature (237)..(237): n is a, c, g, or t
  misc_feature (251)..(251): n is a, c, g, or t
  misc_feature (255)..(256): n is a, c, g, or t
  misc_feature (258)..(259): n is a, c, g, or t
  misc_feature (266)..(266): n is a, c, g, or t
  misc_feature (270)..(271): n is a, c, g, or t
  misc_feature (277)..(277): n is a, c, g, or t
  misc_feature (283)..(283): n is a, c, g, or t
  misc_feature (285)..(285): n is a, c, g, or t
  misc_feature (306)..(306): n is a, c, g, or t
  misc_feature (308)..(308): n is a, c, g, or t
  misc_feature (321)..(321): n is a, c, g, or t
  misc_feature (329)..(329): n is a, c, g, or t
  misc_feature (337)..(337): n is a, c, g, or t
gaagaaagaactgctgtgccatgtggccgggaaggacaantaccaggtcataacaaactgnacgaggagtacaccccactgcctctgagcaagatcatccagcgggctgagagactggtggggccaggaggtgctctacaggctgaccagcgagaactgtgagcactttgtgaaatgnaactacgctatggagttcctcggagtgatcaggtcagagatgcggtcaaggcggtaggnatcgctggagtggncttnncnnccttggncctnnttggantcatgntntccagaaacaagaaacagaancnatgagctgaatgnctgcccantttttggnctcttcttttgctagagggtttggagtttgatttatagattctattg

SEQ ID NO: 492 - DNA, 255 bp, Mus musculus
  misc_feature (54)..(54): n is a, c, g, or t
  misc_feature (61)..(61): n is a, c, g, or t
  misc_feature (71)..(71): n is a, c, g, or t
  misc_feature (74)..(74): n is a, c, g, or t
  misc_feature (78)..(78): n is a, c, g, or t
  misc_feature (81)..(81): n is a, c, g, or t
  misc_feature (91)..(91): n is a, c, g, or t
  misc_feature (95)..(95): n is a, c, g, or t
  misc_feature (97)..(97): n is a, c, g, or t
  misc_feature (114)..(115): n is a, c, g, or t
  misc_feature (119)..(119): n is a, c, g, or t
  misc_feature (122)..(122): n is a, c, g, or t
  misc_feature (126)..(126): n is a, c, g, or t
  misc_feature (132)..(132): n is a, c, g, or t
  misc_feature (134)..(134): n is a, c, g, or t
  misc_feature (147)..(147): n is a, c, g, or t
  misc_feature (171)..(171): n is a, c, g, or t
  misc_feature (181)..(181): n is a, c, g, or t
  misc_feature (192)..(192): n is a, c, g, or t
  misc_feature (200)..(200): n is a, c, g, or t
  misc_feature (212)..(212): n is a, c, g, or t
tatctggatttctaaagcactttcttatctttatggcacttctagacaaacaancctgctnagctcatttncanatanganattacttccntaangnattaagttctctgtgtnntcanctntctntccctncnagtttcatacctncagattcaaccaaccacagacccnaaacacttgnaaaaccttgtntgagctgnaaacgaacaganttcattattcattattcagagtattttcattactccctaaata

SEQ ID NO: 493 - DNA, 456 bp, Mus musculus
  misc_feature (29)..(29): n is a, c, g, or t
  misc_feature (68)..(68): n is a, c, g, or t
  misc_feature (72)..(72): n is a, c, g, or t
  misc_feature (75)..(75): n is a, c, g, or t
  misc_feature (82)..(82): n is a, c, g, or t
  misc_feature (377)..(377): n is a, c, g, or t
  misc_feature (383)..(383): n is a, c, g, or t
  misc_feature (390)..(390): n is a, c, g, or t
  misc_feature (393)..(393): n is a, c, g, or t
  misc_feature (401)..(401): n is a, c, g, or t
cagaagaaagcctcaacgggacctaaccnttctcatccattcaagaaattcccagtgttacttgttangcanaanaaaaaanaaaagaaagacctaaaaagtaacttgaagaatgtttacatcatcagcccctagataagtatatctgatactttttaaaacttcaaattcaatcttagagacccataagaggcgtggccacctcttgacagttgttctcagacttcctgtgccttggtacaaacagacccacagaaaaattaatgtaattggagggagggggaaaacatggtttctctatgtatagctcaggcttgcctggaactcacaaagatccacctgcccaagtgctagaatcaaaggcatgcaccagcatntatggntaaattnatntcattttnaaattataaaaacacaaatccaaaacgttttcttaaaccagtttcttccagaagg

SEQ ID NO: 494 - DNA, 463 bp, Mus musculus
  misc_feature (288)..(288): n is a, c, g, or t
agctcatctccatacgtgtggtcagcccggagtgaccctatagtgcttgtggtaactggactctctgccactcccagcgaggtacccacggaagaatcatttcctgtgacagaatcctccaggagaccttccatcttacccacggacaaaatatctacaactgaaaagcctatgaatatcactgcctctccagaggggctgagccctccatttggttttgctcatcagcactatgccaaggggaatctggtccggatatgccttggtgccacgattataataattttnttggggcttctagcagaggattggcacagtcggaagaaatgcctgcaacacaggatgagagctttgcaaaggccactaccacccctcccactggcctagaaataacttggctttcagcagagggattgaccagacatccatgcacaaccatggacatcaccactagagccacaga

SEQ ID NO: 495 - DNA, 345 bp, Mus musculus
ttctagatctctacaaagacccagaaaaacataaaatcattaccataaacaaacaaacaaacaagcgaagaacaacaacaccacactaagtcttaaaaaaataatctcgccaaatacactgagaacaaccttaaaatcattgaaaaactgtaaaaaaacaccaaaacaaaacaaaacaaaaaaatcctaaaataataaaagcaaaacctaaaaccctaaaaaaccctaaaattattaaacaaactctaaatgacccaaaaaagctatttttaaattcttaataaacatttttaaaaccctaaaattctataaataagaaaacacaagaactctaaatagacacta

SEQ ID NO: 496 - DNA, 224 bp, Mus musculus
  misc_feature (190)..(190): n is a, c, g, or t
  misc_feature (195)..(195): n is a, c, g, or t
ctatgagcagctcaaaagagccctaatggctgcctaccaatctcgggaggcacctttttgagcctctccatgctgacctggaccctgcttcccagccctgccctgtcttttttttcatcctctgcccagtcccatttttttcccatttcctgcaccccgatttacttcccccctcacctccctgtgcctntgtantgatgactcacagtgaggaggcctgacac

SEQ ID NO: 497 - DNA, 229 bp, Mus musculus
  misc_feature (177)..(177): n is a, c, g, or t
  misc_feature (182)..(182): n is a, c, g, or t
aaaagagccctaatggctgcctaccaatctcgggaggcacctttttgagcctctccatgctgacctggaccctgcttcccagccctgccctgtcttttttttcatcctctgcccagtcccatttttttcccatttcctgcaccccgatttacttcccccctcacctccctgtgcctntgtantgatgactcacagtgaggaggcctgacaccagaccctgagccctcag

SEQ ID NO: 498 - DNA, 51 bp, Mus musculus
ttgaagcacacctgactgtatttgcatcagtcagtgatcttctgcttgtat

SEQ ID NO: 499 - DNA, 210 bp, Mus musculus
  misc_feature (149)..(149): n is a, c, g, or t
  misc_feature (168)..(168): n is a, c, g, or t
  misc_feature (173)..(173): n is a, c, g, or t
  misc_feature (176)..(176): n is a, c, g, or t
gaggttacttagaaactgttttgagagttaacaattaccaggtattccttgtgacacctgtgaatttgtatttccttgtgaatcttatttggtatttttggtattttccaacaacgcccttcccacctccttgagttgtgttttttttncctttaaatacccccttantcagntantcggggcgccacggtcttttacccctgcgtggtg

SEQ ID NO: 500 - DNA, 167 bp, Mus musculus
  misc_feature (26)..(26): n is a, c, g, or t
  misc_feature (31)..(32): n is a, c, g, or t
  misc_feature (38)..(38): n is a, c, g, or t
  misc_feature (41)..(41): n is a, c, g, or t
  misc_feature (44)..(46): n is a, c, g, or t
  misc_feature (48)..(49): n is a, c, g, or t
  misc_feature (80)..(80): n is a, c, g, or t
  misc_feature (91)..(91): n is a, c, g, or t
  misc_feature (106)..(106): n is a, c, g, or t
agagaattatcctttcgtttgatctnttttnngttaanaanttnnnanntaaggtcagagtaccacataaagcaattgcngtgctgtgttnttggataaattacanaggtaaattacaaagtgaaggttctgtgtttttcccttatagacgcagagatttgcttcct

SEQ ID NO: 501 - DNA, 59 bp, Mus musculus
agctggcttgctttactggcactcttgacttataattttataaagttgcactgcatttc

SEQ ID NO: 502 - DNA, 139 bp, Mus musculus
gaaatgcagtgcaaatttataaaattataaatcaaaaatgccagtaaagcaagccagctaggtgcaaaataacgcaagaagcttgctggaaccttctagtccaaagggggcccttaaaaccagcgctaatgctgctttg

SEQ ID NO: 503 - DNA, 469 bp, Mus musculus
  misc_feature (79)..(79): n is a, c, g, or t
  misc_feature (125)..(125): n is a, c, g, or t
  misc_feature (295)..(295): n is a, c, g, or t
  misc_feature (344)..(344): n is a, c, g, or t
tgctgggccccaggagtctggataagttgggtctaggcccagaggtaacccacgtcagcgggcttctcccgcgtcgtcncgggaaggctctgctgttcagcaaggggcgtgtctggagattcganttgaagtctcagaaggtggatccccagagcgtcattcgcgtggataaggagttctctggtgtgccctggaactcacacgacatcttccagtaccaagacaaagcctatttctgccatggcaaattcttctggcgtgtgagtttccaaaatgaggtgaacaaggtggaccntgaggtgaaccaggtggacgacgtgggctacgtgacctacgacctcctncagtgcccttgaactagggctccttctttgcttcaaccgtgcagtgcaagtctctagagaccaccaccaccaccaccacacacaaaccccatccgagggaaaggtgctagctggccaggtacaga

SEQ ID NO: 504 - DNA, 322 bp, Mus musculus
gttggtcattactcaaggctatgcacactggtagaagatattgagagagaaatggaggagatttctctttttattaaatatttaggcattgaaaagaccatagtgtgaaaagtcaaaattgctataagatacgtaagcaatgccatagctttttcatgaattatttgactattttagaataaaactaatgtttcaaccttgtttatctacccacttgttctaatgacctatagactctttgatacatagtctcttttctagtaacttgtgtgacaggggctaaggcagaaatattatgtagaagtagatccagctaagacac

SEQ ID NO: 505 - DNA, 485 bp, Mus musculus
  misc_feature (104)..(104): n is a, c, g, or t
  misc_feature (231)..(231): n is a, c, g, or t
  misc_feature (308)..(308): n is a, c, g, or t
  misc_feature (335)..(335): n is a, c, g, or t
  misc_feature (347)..(347): n is a, c, g, or t
  misc_feature (352)..(352): n is a, c, g, or t
  misc_feature (378)..(378): n is a, c, g, or t
  misc_feature (380)..(380): n is a, c, g, or t
  misc_feature (394)..(394): n is a, c, g, or t
  misc_feature (430)..(430): n is a, c, g, or t
ataccctgtataagaaggctcctaatgagagatttattaacaacactatatatgatgtgtgacgttcctttatcacaccccctatctaatactgtattaggttnaatttgcatcctcatgtattttatgtaacctgtgcacatgcatttttatcacaaataaatatgcaatctttcacatgtgttataattaagaagaaagagatttagaatgagtgtgggtttaaggagnagggaacaattcagctaaaaagcaacacttatttccatcagggttttaaactcagaggatctggaaggcattctttnttcaatacatctgaatggctaaggttngactaaggaggncacantcactgtatacaggaggaagtaaatntntccccttaaagttnccagatttaacaagcatgaatacatgttataagatncccacttcagtttgaattccagataaacaataagtggcttttaatacaacccctg

SEQ ID NO: 506 - DNA, 451 bp, Mus musculus
  misc_feature (135)..(135): n is a, c, g, or t
  misc_feature (350)..(350): n is a, c, g, or t
cgtgcttcagtaatgccaactaatactaaagatggaaaataagcaattatttataaatttgtgcaatgttaggttaaaacaatgaactgttaaagtggcatagtaataatagtcgcaaatattattttacttgcncaacaaatacagttcctttgttttaaaataattattttcaacatttgaccaacctagtagctaaaaaatacatagggtgagctgtttcaaaagtcatatttgctcaagacaatcaacccttctctttttttccacttaggtattttcttttacataccttgaactagcaatacaattttaaaatcaccaactgaattttgtatctattttaagtnatatatgtaagacttgaaaataaatgttttattataatttcttatatgaagtgttaaattaattgataccagtttccactggaacacttatcagctgataa

SEQ ID NO: 507 - DNA, 104 bp, Mus musculus
  misc_feature (46)..(46): n is a, c, g, or t
ttttttccagattatttatgtgcagtgtaaatactatccctgagtnctttctatgtgttgcacatagaaaaaattctgcacatagggctcaagtattttgttgt

SEQ ID NO: 508 - DNA, 186 bp, Mus musculus
  misc_feature (42)..(42): n is a, c, g, or t
  misc_feature (106)..(106): n is a, c, g, or t
ttccagattatttatgtgcagtgtaaatactatccctgagtnctttctatgtgttgcacatagaaaaaattctgcacatagggctcaagtattttgttgttgtttntttatcttttcttgtttttttgttttttgtttttttggggttttttttgggtcaagtgccattgaagcattacctcatga

SEQ ID NO: 509 - DNA, 248 bp, Mus musculus
  misc_feature (128)..(130): n is a, c, g, or t
tccaagagccctgtgacattttctggaagggactctgccctgggcgcaaagtgactgctgaagcaaggagcagctgagcagcaccccagcggagctgagccggcaggccacgcccctcgggggggggnnncatttctacccaccctgctctgaatagctccaacttcaccttaggagcctcccaggggcgagcttcacccagaagccagtgactcactccttgattggtggaagctcagttggctcct

SEQ ID NO: 510 - DNA, 560 bp, Mus musculus
  misc_feature (40)..(40): n is a, c, g, or t
  misc_feature (49)..(49): n is a, c, g, or t
  misc_feature (214)..(214): n is a, c, g, or t
  misc_feature (259)..(259): n is a, c, g, or t
  misc_feature (289)..(289): n is a, c, g, or t
  misc_feature (306)..(306): n is a, c, g, or t
  misc_feature (313)..(313): n is a, c, g, or t
  misc_feature (319)..(319): n is a, c, g, or t
  misc_feature (325)..(325): n is a, c, g, or t
  misc_feature (330)..(331): n is a, c, g, or t
  misc_feature (340)..(340): n is a, c, g, or t
  misc_feature (343)..(343): n is a, c, g, or t
  misc_feature (359)..(359): n is a, c, g, or t
  misc_feature (363)..(363): n is a, c, g, or t
  misc_feature (370)..(370): n is a, c, g, or t
  misc_feature (381)..(381): n is a, c, g, or t
  misc_feature (391)..(391): n is a, c, g, or t
  misc_feature (399)..(399): n is a, c, g, or t
  misc_feature (414)..(414): n is a, c, g, or t
  misc_feature (441)..(441): n is a, c, g, or t
  misc_feature (445)..(445): n is a, c, g, or t
  misc_feature (447)..(447): n is a, c, g, or t
  misc_feature (517)..(517): n is a, c, g, or t
ttaatccatgtttcttcaggttgggggagataggttttanttaaatccnaagatatttcccaaatgtcctccagtctggtttttttttttttagttaaatacgtcatgtacaaatgattgtcttatatatcaaagtatgctgtaattttcatggtgattatttgatacagtctcatcataagaagggtagcttaggttcatttcataaatacancaaacaagttgagaaattaatttataacaagggctgaattgaagnacactgtggttgatatgagatttttttttngttccatcacatgtgantcatgtnaaattnaacttnacctnnagaaccatngtncttgaattattcactncctntcagaancctcagtgtgncctaagatantcctattnaccattgtgaagttntcagactagtgaaaaaaaataaacctnagcnangcaattcagttaggaatacatttttttaaatataaaaatctatcagtgtacaagtgtattttcaagattntctttccccctcagagtagacatggctacttaagtttttaact

SEQ ID NO: 511 - DNA, 518 bp, Mus musculus
  misc_feature (179)..(179): n is a, c, g, or t
  misc_feature (263)..(263): n is a, c, g, or t
  misc_feature (274)..(274): n is a, c, g, or t
  misc_feature (330)..(330): n is a, c, g, or t
  misc_feature (372)..(372): n is a, c, g, or t
  misc_feature (377)..(377): n is a, c, g, or t
agttctgtttttcaggctcgcccaggtgttttgttgcagtttatgctccttaaaacctaaaacccttacttagtctccacttccctaaaggtagcttaaccaacgtttgagcttgcttgaaaacaaaattccaaccacgttccatgccatcggtgttcggacttactaaaataggtagncaaggcacgtcgtagcgcaggcttataaaattcggtcattaacgttctcattaaagtaagcggagttgggcgaggatcccaaanccgcctacccnccgcgctgcaggcgggaaggcgctggcacttcacaggctggtccttaaccacagcnagtgcggctgaagaactccgtggacgcgtgcgcgcgtgggtnccgcntcttggcttgtgactagcgttaggaaattacccaagattattgcataatcttcaccagcttgctttgattcttttttatgttggaagttttgggttgttgacagtagccgaatttaactggcattttatttgacctctaac

SEQ ID NO: 512 - DNA, 490 bp, Mus musculus
  misc_feature (264)..(264): n is a, c, g, or t
ggagcatcagccagcgatacctggagtctgcagaaacctcgcccgcactttgcaacaaaggcagccagctagtcagcgaggacctctgcaagccaaaaaatgtcgtcccagcaatatcagcagcaacgtagaaaatttgcagctgccttcctggcattgattttcatcttggcagctgtggacactgctgaggccgggaagaaagagaaacctgaaaaaaaggtgaaaaagtctgactgtggagaatggcagtggagtgtgtgngtgcctaccagcggggactgtggattgggcacccgggagggcactcgcactggcgccgagtgcaaacagaccatgaagactcagagatgtaagatcccttgcaactggaagaagcagtttggagctgagtgcaagtaccagttccaggcttggggagaatgtgacctcaataccgccttgaagaccagaactggcagcctgaagcgagctctgcacaatgctgact

SEQ ID NO: 513 - DNA, 499 bp, Mus musculus
  misc_feature (225)..(225): n is a, c, g, or t
  misc_feature (240)..(240): n is a, c, g, or t
  misc_feature (242)..(242): n is a, c, g, or t
  misc_feature (245)..(245): n is a, c, g, or t
  misc_feature (247)..(248): n is a, c, g, or t
  misc_feature (252)..(252): n is a, c, g, or t
  misc_feature (261)..(261): n is a, c, g, or t
  misc_feature (264)..(264): n is a, c, g, or t
  misc_feature (267)..(268): n is a, c, g, or t
  misc_feature (274)..(274): n is a, c, g, or t
  misc_feature (296)..(296): n is a, c, g, or t
  misc_feature (316)..(316): n is a, c, g, or t
  misc_feature (335)..(335): n is a, c, g, or t
  misc_feature (358)..(358): n is a, c, g, or t
  misc_feature (374)..(374): n is a, c, g, or t
  misc_feature (380)..(380): n is a, c, g, or t
  misc_feature (399)..(399): n is a, c, g, or t
  misc_feature (403)..(403): n is a, c, g, or t
  misc_feature (406)..(406): n is a, c, g, or t
  misc_feature (408)..(408): n is a, c, g, or t
  misc_feature (411)..(411): n is a, c, g, or t
  misc_feature (428)..(428): n is a, c, g, or t
  misc_feature (433)..(433): n is a, c, g, or t
acactcacgcaacacacattctaagcacacatcaattggtttcttacccgactggggacgctgttttttggtacctgggggcttgacaaaagaacaacatcaaaaagttgctgtgaatatagtttgagctttttgggagggggtattctgttgggtttttaataatttcttgtgtgtgtaaatataatatcaacgaaatgcgcgatgcgaagctctttgttcacntgactcccccctccntnctnanncccnctgttttcnttntgnntcgttnccctcccacacacacacctttngccaccgttaacacgagggncaaaccccttcatgcgcgntccctggcgcgacctgcattacnacgtgggctttactgncgcctncctcctaaccttccacctncttnccncnctncccctgcagagtgtatnctatncacctgttttatttttgtaaagaaaaagaagtgctaaataatatttattacttgtttggttgcata

SEQ ID NO: 514 - DNA, 540 bp, Mus musculus
  misc_feature (268)..(268): n is a, c, g, or t
  misc_feature (289)..(289): n is a, c, g, or t
  misc_feature (324)..(330): n is a, c, g, or t
  misc_feature (332)..(333): n is a, c, g, or t
  misc_feature (335)..(338): n is a, c, g, or t
  misc_feature (349)..(349): n is a, c, g, or t
  misc_feature (383)..(383): n is a, c, g, or t
  misc_feature (388)..(388): n is a, c, g, or t
  misc_feature (402)..(402): n is a, c, g, or t
  misc_feature (483)..(483): n is a, c, g, or t
  misc_feature (488)..(488): n is a, c, g, or t
ttggtaggactactgcttggagcttttcaaggcacgtgaaatacttgaaaatttctcatttgtgttatttatgatgttttgtacagtgtttttattattgtattgttttataaatggaggtacaggatattacccaaattattaatgaatgcccaagaagtaatttccttctcattcttctaaaagtactgcctttgagagcacacacacattcgtgcaacactgcagtcattgctccagtttaaattacatgtgtgagcaccattgnggctagtaagccaatgtaccnggctgcaaaatgaagacactggaatagtgtgtatnnnnnnntnntnnnntattgaagaanataattttctaagggtactcgtttcgtctctctngacantcttgcttgtaatntccccagagctcccccatcagtgttcctaactcctttttgttatacaccccatccatgatcatgtctgtataactctttgntcttnccctaatagtatcatgactttgagattgtacctgtactcacagactgctgtt

SEQ ID NO: 515 - DNA, 434 bp, Mus musculus
gaaatgtaccacagtcctgatgtgttggtgttaacattgttctgtttgacttttgtgtaaagtaatgcatgcaatcttgtaatgtggcctgaaaacaagctaactgtattagaaactattcaaaaactaggtatttttagtgacctgtaggcagtggcaaatacagacatgtgaaccttgaatacattacatttctctcaaacacaaagaaacaaacaaaaaacttttccagcgtgttctctgctgccctggagatgccgtcaccttccacccgtgtctgtgtgagttgtggtgtcttagtgacttagtatgtagctcactccttattctgagacattgtctgtggtgtccctgaaacatggtgtccatgctgtaacagtggagtgcagtacatgcctgagtacacacagcagcttatagtatctgtcgggtac

SEQ ID NO: 516 - DNA, 427 bp, Mus musculus
  misc_feature (307)..(307): n is a, c, g, or t
  misc_feature (316)..(316): n is a, c, g, or t
  misc_feature (336)..(336): n is a, c, g, or t
  misc_feature (340)..(340): n is a, c, g, or t
  misc_feature (343)..(343): n is a, c, g, or t
  misc_feature (356)..(356): n is a, c, g, or t
  misc_feature (380)..(380): n is a, c, g, or t
  misc_feature (400)..(400): n is a, c, g, or t
  misc_feature (402)..(402): n is a, c, g, or t
tgtttctgtgactacgaacgtgccccaagagacatctgtaacttaaagagaactgcaaatattttttatttcagtgtgggtttacgtacatctgttcagttagtatttctttgtgtgttctatagagtagtgtttctccatccttcaattgagctcaaagtgacttctattgtacctttgtgataggattgaaaccaattcagcgaattgtatcttttaatgtacataatgtattctttgattttcagtttgttgtcatactgtctgtgccgatggcttggctgaagattttgatgcgtacacaagntcactgttnatcagtgttgtttagtggcnttgncanctctttgtaaaancatattgggttggaaaggcatttncctatttttcaaattatttnanagatgtatggtaccctttaaagtgg

SEQ ID NO: 517 - DNA, 500 bp, Mus musculus
  misc_feature (225)..(225): n is a, c, g, or t
  misc_feature (238)..(238): n is a, c, g, or t
  misc_feature (287)..(287): n is a, c, g, or t
  misc_feature (290)..(290): n is a, c, g, or t
  misc_feature (297)..(297): n is a, c, g, or t
  misc_feature (303)..(303): n is a, c, g, or t
  misc_feature (305)..(305): n is a, c, g, or t
  misc_feature (315)..(315): n is a, c, g, or t
  misc_feature (359)..(359): n is a, c, g, or t
  misc_feature (368)..(368): n is a, c, g, or t
  misc_feature (372)..(373): n is a, c, g, or t
  misc_feature (382)..(382): n is a, c, g, or t
  misc_feature (385)..(385): n is a, c, g, or t
  misc_feature (389)..(389): n is a, c, g, or t
  misc_feature (412)..(412): n is a, c, g, or t
  misc_feature (418)..(418): n is a, c, g, or t
  misc_feature (426)..(426): n is a, c, g, or t
  misc_feature (429)..(429): n is a, c, g, or t
  misc_feature (442)..(442): n is a, c, g, or t
  misc_feature (444)..(444): n is a, c, g, or t
  misc_feature (457)..(457): n is a, c, g, or t
  misc_feature (472)..(472): n is a, c, g, or t
actttccatgacagtagcatactgacaagaaaacacacacaacagcaacaataacaaagcaacaactacgcatgctcagtattgggacactgtcaagattaagtcataccagcaaaacctgcagctgtgtcaccttctttctgtcaacctacagacttactgattataatcatcccattttctttttttcacatatacatacacacacacacacacacacaaagntggatttaacacnaccattacatcatttctgaagcaaaattatgtgtttggctgaaactatngtnaaatggnatgtanantatagggttntgtcgaatgcttttgaaagctatgttttggagacaatactcttnctatgtggnaaanngtgaagatnttntacntctggctcttgttaatcaccatntccccngtggtttntcnatcagtacaattntntgttgcgttaatntagagctatgcacanccaaattgctgagatgtttagtagctga

SEQ ID NO: 518 - DNA, 151 bp, Mus musculus
agggagacgcgactggcggctccagcaggaactacctttctgaacccgcggagacccgcataagcctgaccccttgcttcctccccgccccccagtgcgttctgtgatcgccaagttcaaagctgtgcacatgtggacactcaataaatgt

SEQ ID NO: 519 - DNA, 436 bp, Mus musculus
aggctcaggccattgacatcacagttcttccttttaactctagtgacccggggtccgagttgcccctatgcttccagggcaatttggagcagacagaccagtggggggtggggaacctccttccacctgcgcttccttgaggggaccagagagcccttggtcccaggtctcttgagcttttgtgtcatgttgcagcagagtgaagatggggggttgggggttatttattttgcttgtccttatccctgcttggacacctgagcatcagatccctgtgcccctggtgccatctggcctggctggagccaggaacaagaggtcaccccaccctagaatccgcatggtttccctgtgattgcactccactgccaccgtggtgcctggcttcagctcccctcccccaatccctgctaagcctctactctgcagggagacg

SEQ ID NO: 520 - DNA, 211 bp, Mus musculus
  misc_feature (124)..(124): n is a, c, g, or t
  misc_feature (143)..(144): n is a, c, g, or t
  misc_feature (155)..(155): n is a, c, g, or t
tggtgacgctggacccacgcctgtgtcccttgccgcgattgcggcgccacacggagcccagggtagaagttggtccagtgggcacttgtcgtacccgacggttgcatgtgagcttccgtgaggntgggctggcaccgttgggnnatcgcgccgcntggcttcctagccaacttctgccagggcacgtgcgcactacccgaaacgctgaggg

SEQ ID NO: 521 - DNA, 364 bp, Mus musculus
  misc_feature (180)..(180): n is a, c, g, or t
  misc_feature (213)..(213): n is a, c, g, or t
  misc_feature (288)..(288): n is a, c, g, or t
agtgtatgatgatgggccccactggcccagacgtcgaggatgccggcgacgagactcctgacgtggaccctgagctgctgaggtacttgctagggcggatcctcaccggaagttcggagccagaggctgctcctgccccgcgccgcctccgccgatctgtggaccaggatttgggtcccngaggtgccccctgagagaacgtactgggggctntgctacgcgtcaaacgcctggagaacccctcgccccaggcgccggcacgccgcctcctgcctccctgagcgctgntgcatcctgcacgccctggaacccaggagcgccccagcaaccctgactccctgccagcacgtccaaggctgcttac

SEQ ID NO: 522 - DNA, 380 bp, Mus musculus
  misc_feature (199)..(199): n is a, c, g, or t
  misc_feature (226)..(226): n is a, c, g, or t
  misc_feature (235)..(235): n is a, c, g, or t
  misc_feature (241)..(241): n is a, c, g, or t
  misc_feature (259)..(259): n is a, c, g, or t
  misc_feature (269)..(269): n is a, c, g, or t
  misc_feature (278)..(278): n is a, c, g, or t
  misc_feature (348)..(348): n is a, c, g, or t
tgctgccgtccttttgggttcttgatttctggatacatgtagctttgccagatatgtacttagagatatcaaccgtgttaataagcccattaatgtgtaacaacaagtttaacagttaagagagagtagctgttcaccttgaagacaggccttagtgtcacgcaggtttattacagtggcatgatggtgacctgtgcangtcactgagctgtaggagtgaggcatntgctgcacntccctntcgtacttagagacctgnccggtgcccntgcgcgggncctccccaggacacactgacgtagatttgctgtgtagtcttggtgtggaaatttgaattctgcttttctntactaatctgaagtgctccgtgatgtgtgtat

SEQ ID NO: 523 - DNA, 502 bp, Mus musculus
aggtgggccgcagatttcagaagaaaccgccatgtatgtggatgggactgcagcccaaggctccttggctgtccccatcccaccccatccctctctggtccaataactcaaagaagcaaggcgatgactgttggcccctctcacccaagaacaacccactgttaggattgcatggacatttccttaggttgtgcccagcgagatgatgtgatggccattctccccaaccagctcccccagcccccgaggcactcgctcagtgtaggctgcttcagcccacacatatcgcagctgcctttttcttgaccgtgttgttgtctcttagattaactgtgctgagactcccggtagctcatggacctgtgtctagtactttcccgaagcgatggtgggtgtgcgtaggtgaagttgctgtacccacgttgttgaacttgcgtaccctgtagctagatcgtgaggtgtccgtctgttatcccccaaggtggtaactccgtgtgttcaa

SEQ ID NO: 524 - DNA, 88 bp, Mus musculus
ttgtgttttttactcggcctataattcttttgttagcagaatttatcaattgcatgggaagatccgtattacctattgtgaacctaat

SEQ ID NO: 525 - DNA, 409 bp, Mus musculus
  misc_feature (305)..(305): n is a, c, g, or t
gggactttatcaaccaacaagctgacgcttatgtggagaagggcatcctcgacaaggaagaagccaacgccatcaaacgcatctacagcagcctgtgaaaatggcgggcagcttgagccttcctgttgttccagcaaaaacaatatagcttacaaactaattcggcggttaaagggttaccagcccagaagtattaggatgtgctgaatttatagtagttaatcccttagaaatgagtaaaatagagctctcttgccataaataccttatgaaaagcaaagctgtagagaagccgaggtttttcnatatagaatccttatttcctcttgaatttacattttgtaatcagagatgtgctgctctggaaaagactctaatgggttgaacataagtctgaacctactcccca

SEQ ID NO: 526 - DNA, 522 bp, Mus musculus
  misc_feature (217)..(217): n is a, c, g, or t
  misc_feature (285)..(285): n is a, c, g, or t
  misc_feature (307)..(307): n is a, c, g, or t
  misc_feature (316)..(316): n is a, c, g, or t
  misc_feature (324)..(324): n is a, c, g, or t
  misc_feature (335)..(336): n is a, c, g, or t
  misc_feature (349)..(349): n is a, c, g, or t
  misc_feature (390)..(390): n is a, c, g, or t
  misc_feature (399)..(399): n is a, c, g, or t
  misc_feature (433)..(433): n is a, c, g, or t
  misc_feature (453)..(453): n is a, c, g, or t
  misc_feature (455)..(455): n is a, c, g, or t
gattatcagggtgaaccatgccttggacctctacaacactgagatcctcaaacagtctgaccagatgacagccaaactctgctaacccgggaccctttgccatggactttcccttctgttgtgcaaatacaacagaacaaaacaaagcaaaacaaaagagaacatatacatacatacacatacagacagacagacagacacacacacgcatacacanaatttgtaaaatgtaattagtattcaaaggaaaggaggaaaaaacttcatttgttggaagctaacgtnttctagcgactgtataaaaccntggggcatntctcttanttctatattcnntcatgaagaaggntctcagaattgtgtgaagctttgagttggtggcttctttgncctcaggtnctgtgtgatgggggggagaaggggagagcatatncaatgaattgtaaagacctntnctgtgcaggtgctaagattaaacactaaaagagagagaacaagctatatgtaatgtacctctgacac

SEQ ID NO: 527 - DNA, 543 bp, Mus musculus
  misc_feature (305)..(305): n is a, c, g, or t
  misc_feature (330)..(330): n is a, c, g, or t
  misc_feature (433)..(433): n is a, c, g, or t
  misc_feature (471)..(471): n is a, c, g, or t
gaaaagccacaggatgctagcaaaagggatccgattgtggccctgcctttcgaagctggagactactacgtgcctagaggaggtcgcaggcggttccgggttcggcagcccatcgtgcactacagatgggacctgatgcatagggttggggagccccagggaaggatgagagaggagaacgtacagaggtttggggatgatgtgagacagctcatggagaagctgagggaaaggcagctgagccacagcctgcgggcggttagcactgacccgcctcatcatgaccaccatgatgagttttgccnttatgccctgagtcctgagcttttntctgaagatgacatggggacccctgctttcaaaacttacatgtttgtgatgtactgttgtaatatttctggtgtcacttgtttccccatggggctccaacttnctgccagcttctaattgaaacttgtgttttcgactcantcttacatttctttttttgttagcagaatttatctattgcatgggaagatgctcagtatatattgtgaacct

SEQ ID NO: 528 - DNA, 551 bp, Mus musculus
  misc_feature (341)..(341): n is a, c, g, or t
  misc_feature (353)..(353): n is a, c, g, or t
  misc_feature (397)..(397): n is a, c, g, or t
  misc_feature (400)..(400): n is a, c, g, or t
  misc_feature (468)..(468): n is a, c, g, or t
  misc_feature (493)..(493): n is a, c, g, or t
tatggtcccgtgttacctgttttcttggtagtgtttgtttacaaaatcgtaaaaaattaccccaaatgttttaaagtgttaaattaccttatagcattttagaaatataatttacttgaagagatgtagaatgtagcaattctgtaaagcatgtgtatccagtgttgcctagtttgacctttgtgaagtctttttgtcttgtagcttttagcaagtagctgtgaaaaccatcagaactcctcaatgaagctaatgtttggaaaaagtatatacttgaagaacaaacccaagtgtgtacccccaaccccagctcagaaatagaaagggtttaagtttgcttngtattagctgtnccttcattattttgctatgtaaatgtgacttaataaatggtgcnaanattaaattttattgcttgaggacagacgggcataaaggaagggaaaagacatttaatgtaaaggcctntagcttctttgtgggttttgagttntctgtgaaccaatgttctgtaaagaaacacaaacttaaagttgtttaccactgtggtg

SEQ ID NO: 529 - DNA, 204 bp, Mus musculus
  misc_feature (79)..(79): n is a, c, g, or t
gtgaactatagaacatcaactctgcaaatggtggatatttcttccaagaccacagccttgactgggaagaatatcaatntgggggggggggggtcaggaacagaagagcccacaatatcggggaaagctaagtgagccagggtatgaatatgagcacctgaaccaaaacctggagctaaaattcaaaagaataccgaccagaga

SEQ ID NO: 530 - DNA, 346 bp, Mus musculus
  misc_feature (186)..(186): n is a, c, g, or t
  misc_feature (193)..(193): n is a, c, g, or t
  misc_feature (225)..(225): n is a, c, g, or t
  misc_feature (248)..(248): n is a, c, g, or t
  misc_feature (253)..(253): n is a, c, g, or t
  misc_feature (259)..(259): n is a, c, g, or t
  misc_feature (295)..(295): n is a, c, g, or t
  misc_feature (305)..(305): n is a, c, g, or t
gtgtcttttccaaatgtgctacctttgtgtatagttgtaatagcgacactctctctaaacattctcgctgtctatgacttagcaggccaatccccaaagcactctcctggtgtctctagagtgtgatgtctgttctgttgaaatgaccagtgagtgacacttcacatgatcactggtttaaacagncaatcangcctatgaaattctgtatttctgaatattttnatagtaattttgttcttgtgtgnatttnaatgcnatctctatcttaatcttaatattttgaaatcacatnaaatataagnaaatgtagtattctatatttactcctaatttcagattcctg

SEQ ID NO: 531 - DNA, 158 bp, Mus musculus
ttgagtcaatcctgcatcctgttcctagcgcatggggcaccgggcgctgagcttagaatagcccatgtgttacctgtctgtctgtcctcgtgcctgcacctcctgcatgtcagaggcctcacattttctctctgagggaatcacagccaataaacagt

SEQ ID NO: 532 - DNA, 297 bp, Mus musculus
atcttgacagaaaggccagcctggtcttcccataacccttcctgtccacagtaaaactgaattaagtgtccatgagttttgggccaggtgtgtggcttagcattgaccttcatgaccttacatagctctttagagaagccataacaattagactgcaatactattcagaatgccctctgcccaaagagatgaagcatgctcggcccacagtaccttgctcacctgggccattctctgcgcctctggctggttttcatgaattgagaagccagctctgagcagatggccctctcttga

SEQ ID NO: 533 - DNA, 508 bp, Mus musculus
  misc_feature (350)..(350): n is a, c, g, or t
  misc_feature (355)..(355): n is a, c, g, or t
  misc_feature (370)..(370): n is a, c, g, or t
  misc_feature (372)..(372): n is a, c, g, or t
  misc_feature (375)..(375): n is a, c, g, or t
  misc_feature (383)..(383): n is a, c, g, or t
  misc_feature (391)..(391): n is a, c, g, or t
  misc_feature (402)..(402): n is a, c, g, or t
  misc_feature (408)..(408): n is a, c, g, or t
  misc_feature (418)..(418): n is a, c, g, or t
  misc_feature (430)..(430): n is a, c, g, or t
tccttgctggttacacaactgggacaactatttaacctggaagcctcagtgtcctcatctttgtgactggaatgacagcaacaacgctcactttgtaaggtggctgctgtgaattatctgtgagaattcagcatagttccagatgacggagtgcctgtatcatgaccgcactctgcgtgcctgccagaattctaaccccctctcctgacttttttattccttgtgttccagctttgttcagccactgtgacactagtaaccctctaaagaatttgtttctctggctctcccttggcacatcatgcccccgaacagttaaatgataatgttatttagcccctctgtccgantcccnaatatatatcaaatntnctnagcacctntctgtttntcctgagctgntctttntcatggttgncccccctctttntctgttttcccaaatcttgctgcttccgggagctgaagatatctatgacattcacatgcatgcattcctttgtgtgcc

SEQ ID NO: 534 - DNA, 530 bp, Mus musculus
  misc_feature (197)..(197): n is a, c, g, or t
  misc_feature (276)..(276): n is a, c, g, or t
  misc_feature (279)..(280): n is a, c, g, or t
  misc_feature (370)..(370): n is a, c, g, or t
  misc_feature (374)..(374): n is a, c, g, or t
  misc_feature (377)..(377): n is a, c, g, or t
  misc_feature (379)..(379): n is a, c, g, or t
  misc_feature (385)..(385): n is a, c, g, or t
  misc_feature (396)..(396): n is a, c, g, or t
  misc_feature (424)..(424): n is a, c, g, or t
agtcagaggctatgcgtccatcaggacaattaacgatcccactggcctcttagatgccaattagaacaatttccaagtccaagagacttgtgaacttttgacaatcctagcctgactggatcctgggaccagatgctggtagcacagggtgatgaatgccggtatgtatagcactcgggaggttgaagcaagagganttgctgagtctggtgaccgggatggcagagtcagacctcatctcagacagagggtcatccttcaagtcaccccactccnacnnactgctcagtggggcacctctgtggccctggggtagtgtggagaggttcccactcataccttagcaccgtccagtgttgatggctttttnggcnttngngggggnccctccttttntccccacctgcagtcagtgtttgcagtnccaccctcacctgcccattcccagctatttatttatttattgtgtgccagtgaaggtgggggtagggaccttcccaccccctccacctgttgtaaccggtccttga

SEQ ID NO: 535 - DNA, 550 bp, Mus musculus
  misc_feature (492)..(492): n is a, c, g, or t
tgctttacagtcgtccaggcagctgcagcgacataaacgcccacgatggtcagggccaagtgggatcggaacagctctggacattccaaggacttattgcttcagtcttccagtacttacaacttatattccaccagattgtacccgaaggcatgttctgggcagatgacatagcctatgagttaatgaccaaaaaggtggagcacctcagcagactccacccccagtatccatgcaggaaggatatgaaggcagtttcccccacggcaaacgctggggtgaggagcaagcaagaggagaaacttcaactcttatctccccaaaagagtccaacagtcaaggtgaacagggaccgatgctttaccaccaaagtaatcccaaaggccaccaaacaagaggccacccatcctaccaagggtttctttgggccattccccactgtgggcctcaaccttgttgctgactgagatctcgttgcataagatccctttntccgggaacctcctcaatgccctccaatccaaggggcaattcttggatgacccaaata

SEQ ID NO: 536 - DNA, 423 bp, Mus musculus
  misc_feature (375)..(375): n is a, c, g, or t
tagcttttctcatcccctaaaactaaaagcaatggaccacttgtgtcccagcaaacccagctttgcatttatccatgtagtttagttccccctaccaaaaaagttacatatcaatggattaattattttcattgtcatagcaagggggccacgtgatcaggaagtagcatcaagtaagtttcagaccaactgtcttctgtgaaagtttatcctagtaaatgtcacattttgcttttctgtttcaataactgtatatgtaaaaaaaattattgaaatgaaaaccctagactataaatgtatttataataagatatggatatttccttcagtagactgtaaccataacttcaattattttgttccacactgtttttnatatctgtcatgtacattgcactttgatctgtaactgagcgaccctgg

SEQ ID NO: 537 - DNA, 533 bp, Mus musculus
  misc_feature (149)..(149): n is a, c, g, or t
agaggcctccaggtaaagcccagaggccaaggaagtttccaggacagccggacagctcccgtagcaacctggttccagcagcctcggctgctggctgctctcccagcactggggttcggggggaggggggtggccaaggggcgtttccntctgcttttggtgtttgtacatgtaaaagattgaccagtgaagccatcctatttgtttctggggaacaatgatggggtgggagaggggacagtgagcgtgtggaagagggaggtgaagatgagcccaaggacattgtgacactgtccactgactgcagacttgggccaaggcccccgcttttcatggctctgcctggacatccggcctccaggttccgagtggagagaagatgagaactggggtagaagttcagagtgaagggcagagtcctggcggggtggtggctgcagggccagcaggacaagcccgtctggatggagtgagacctgccctgcagcgggtgggataaggtctgtgtgcgtctgttcattgtcatcttttga

SEQ ID NO: 538 - DNA, 501 bp, Mus musculus
tgtggaagctctagtgtcctggccacttgtttgcttgcacactggtgaaaagctaagtacttaggcagtattacaccacctcccttcagtctctcagaggtagaagaaggcaggcatgctccagagaccttccggtgactggaagaggcccacacaagggtccctggcagcaggcaggtggaaggtaaccactgtcaggatcccctgaactgcacgtgtccttccctactttggaagctgttaagagtctaccaggcacacagatggccgcccctgcccgagggagtttgatgagcagtggtgaccctgcctgcccgtccccgtgcctctgccagcctctcttgcacggccaagccctgccctcagcaggcttcccaaagcttagctgagggttcatgccacctctagctccttgaagggcttgatatcacttgtgtctcctgggcccctgatggagcccaggcgttttgcagaatgaattggtcactgcatcctttatgg

SEQ ID NO: 539 - DNA, 492 bp, Mus musculus
  misc_feature (185)..(185): n is a, c, g, or t
  misc_feature (217)..(217): n is a, c, g, or t
  misc_feature (226)..(226): n is a, c, g, or t
  misc_feature (340)..(340): n is a, c, g, or t
  misc_feature (344)..(349): n is a, c, g, or t
tacgttctccagtaggaaggccactgtagacgggcgcaagctgcagtcctggagcagaggaggagttctccaagaacacagctttctcacccacagttcaggcttcctggtgacaggtgactcaggtgcagaggaagtgcaaatgaaggtgctaaatctgctcatccctcactgggagctgaaancggaaacctatgtttatccactggaccccgcncaggccccnagccatagaaccttactgtagatgcctaaaagcatacaatcactgcagaggacaagctagtgctccagacaccgctccccagccccctccgatagagccgagtcaccacacacncacnnnnnngtctctcatgggcacatgccttccactcttcaatcccataattcctttctcgcacccaagaggaaggaacagagtttagtgtagcatccccttctagccacgcatagaacgtatgccctttagctagctcttcttacactctg

SEQ ID NO: 540 - DNA, 313 bp, Mus musculus
  misc_feature (67)..(67): n is a, c, g, or t
  misc_feature (84)..(84): n is a, c, g, or t
cttgcttttttaagtatgctatgtataggacattttatcaccagacacaatgctaccacccaaaagntgaaaaaacacacacanaaaaaagccacatctggtcaatcaacaccaccagcagatattaaagaaagaaagaaaaaagaaacaaacttttcttcagagtctttccccaacagggttacattgcttcagttggtgggtgtccctcccccaaaggaaaggcagaaacattcaggatccaggaggggtatacacacttctcccacctcacggaggcaggctggaaagtcagctctttctgcacccaact

SEQ ID NO: 541 - DNA, 311 bp, Mus musculus
  misc_feature (158)..(158): n is a, c, g, or t
gcaagcctcaccagtgcaacaaagtcacccccaagccccgtgaccctcagcatagctcgtggcatgccaaataacttctctgaaatgcctcgacaaagcacaaccctcaacttacggagggaagaaaccactgcaaatggaaacactcggccaccttntgcggctagtgcttggaaagtaaatgcctcgctccttttaatgctcaatgctgtggtcatgctggcaggctgagggtctgcagtttctgaaacgaaggagaaccttcctccatgatgtacagttgggaaaacgtgcccctatctaaccagtga

SEQ ID NO: 542 - DNA, 397 bp, Mus musculus
  misc_feature (271)..(271): n is a, c, g, or t
  misc_feature (369)..(369): n is a, c, g, or t
taagagggtttcagaaccttacctgctcaagtatccaaatttattttcctgtgtcactgagtctctttcctgaggatcttgtgatggtttcctgttggggtatggtcagaactggactcctggcacctccaactctgctatttttcagtatttacccaaaatacccaaccaagcagattggatgatgccaatgtgtttctatagagacgagtatgctattctcaaataagaaaccccaaggtggtgtcaaccttaaaaagcatttaaatcntcaaacaggaaaaacggagccccagatccctttgttccttgcattttcatttaatctgaaaatgtagattaggcagaggagaagggaaagtctgactntggtattctctcaactgtgctccttaga

SEQ ID NO: 543 - DNA, 379 bp, Mus musculus
  misc_feature (184)..(186): n is a, c, g, or t
  misc_feature (188)..(188): n is a, c, g, or t
gtcacgggcatgagtgtttcagtgcttaccatggtgtgtataagccttgaactatgcatagaactggagtttggggagtgctggatgtgtggtcatgcttggttgaggctttagtgtatgtgtttacatacacaagcacagtttgtttgtttgcttatttatttatttatttatttatttattnnntnatttatttatttctcagctggtcagtcagccatctcctgtaactctccagtctgaaagtgacctaacttgacaggactaggcacccctattccatgtggcttcattccaagatgacccaggatggggattttgctagcatgggaaggggaacagaaaagggccttagcaattgcttcattcggtgcactaa

SEQ ID NO: 544 - DNA, 366 bp, Mus musculus
ttccagcccctggttaggaatctgggcaccccaggtagcccctcacttagccaggacttctcctcttatagcagcaagggagccctgggtcccagggatgggctcctgtctgggctccttgtctcccagcacccgcttttggggaaacaacttttcctcttcgagctgaaccactctgtccatattacacagaagccatatttgtaccaggggggcggggggagagggggctgttgtgctgtgtgtgtctgtctgtgggtgggggtgggagtgggggaagggagcagggaggggaccgtgtatctttataatctttctaactctcctgtgctaatctcagagggaccaccctcaatatatctggat

SEQ ID NO: 545 - DNA, 508 bp, Mus musculus
  misc_feature (283)..(283): n is a, c, g, or t
  misc_feature (327)..(327): n is a, c, g, or t
  misc_feature (339)..(339): n is a, c, g, or t
  misc_feature (379)..(379): n is a, c, g, or t
  misc_feature (442)..(442): n is a, c, g, or t
attgtatggccgtttcttaagacgaaaggagcaaccacccagcagtttcccagtcacgtcactgatttttgtgtggactgaacacagtcagctgacaactttaataaccaggaagacggattgatggtcactagcttggacaacgtctgcaaaatatgagactattttccacctgggaaaaaattataaccacaaaaacagagagaaagaaatatctaagtgattgccaagattatgccaaagcctgttggcagagcactaagagacttttatttttaagtcntgctattttcacagatttatggtgatcatgtgactctagggatnccgatctatgtntccttccaaatacagtgtttacatggagtatcataagagnccacctggggaaccaggacagcagcagggaaattgagtgattagcaatttgactttgaatatnttctaagtatttaaatgaaatatcaaaatatacagcagcaagtagacataactgctgttcctgaaa

SEQ ID NO: 546 - DNA, 493 bp, Mus musculus
  misc_feature (125)..(125): n is a, c, g, or t
ttggtcctcaagttattcagcacccccagtgcaggagggtcctccccccaccccccgaagtccctggagcccggagcagagccccacctgtgattcctggtgttagggcacctcaaaccttgggntggaccacaccccttcccgccatttccagacccctacctgtactccccagtgctccccaggggcctcttgatgctgcacgggaccctgcagggctcggtcagtgatgtgttttgtccccagttaaccgccatccagcgacctggttccaggaggagctcaggtcacccccaccaccgccgccactgcgtctgccgccctaggctttcagacatcattagttccgacacttgtgaaactccgagacgtgccgtggtctcagcaatgcacctgttttatacatgattgtgtaatttaaaggtatataaatacaaatatatatattatatctatatctatcagttgtgaccgtatggctgtcgataaaacc

SEQ ID NO: 547 - DNA, 472 bp, Mus musculus
gagccccacaaacgttcctgaagaaacagatccttttttctatgactatgccactgtgcagactgtggggatgaccctggccactatcatgttcgtgctggggatcatcatcatcctgagcaagaaggtgaagtgcaggaaggcggattccaggtctgagagcccaacatgcaaatcctgtaagtcggaactgccctcctcagcccctggaggtggcggtgtgtaggatcctctgcagatttccactgctgtccctggccagagtgcaggaaccagaggacccagagaaggcggtggggacccagcctggcgccagggagtgtgcccccaatcagccgccagacccaccccaaggccggagccaatgcaccccgctctccctccccaggccttggcaacaacgatcctatttgtaccctagacccagagactcaggcctccagctcctgggatccaggagtccatccccagt

SEQ ID NO: 548 - DNA, 344 bp, Mus musculus
  misc_feature (97)..(97): n is a, c, g, or t
  misc_feature (159)..(159): n is a, c, g, or t
  misc_feature (295)..(295): n is a, c, g, or t
  misc_feature (301)..(301): n is a, c, g, or t
  misc_feature (319)..(319): n is a, c, g, or t
acactcctgttactcggacactgaagccagagaggactccagcagcaaaggtgaccaggagctcccgggatgtccgagctggagaaggccatggttnccctcattgatgtcttccaccagtactccgggcgagagggtgacaagcacaagctgaagaantcagaactgaaggagcttatcaacaacgagctctctcacttcctggaggaaatcaaggagcaggaagtggtggacaaagtgatggagacgctggacgaagatggggatggggagtgtgacttccaggagttcatgnccttcntcgccatggtgaccacgncctgccatgagttctttgaacatga

SEQ ID NO: 549 - DNA, 574 bp, Mus musculus
  misc_feature (63)..(63): n is a, c, g, or t
  misc_feature (73)..(73): n is a, c, g, or t
  misc_feature (126)..(127): n is a, c, g, or t
  misc_feature (130)..(130): n is a, c, g, or t
  misc_feature (186)..(186): n is a, c, g, or t
  misc_feature (189)..(189): n is a, c, g, or t
aagccatgaagagcggcgtatgtctgtgcgtggtgatggcagtcctagctgctggcgccctgncgcagccggntagtccctgcagaagctacggaccccgtggagcagcgggcgcaagaggcgccnnganaggcagctgcgggctgtgctccggacggacggcgagccccgagcgcgcctgggcgncantgctagcgcgatacatccagcaggtccgcaaagctccttctggccgcatgtccgttcttaagaacctgcagagcctggaccccagccatagaataagtgaccgggactacatgggctggatggattttggccggcgcagtgccgaggactacgaatacccatcgtagtgggccagcgtcttggccctgcttggaggaggtggaatgaggaaacaaccacacatacgacccctcgcctctaatgtctgacgttttgagtatctatttattaagtccccaatgtgaaatctgtccagagtgtgcaatgcagccacatctcagcctagctgtgtggtcggaaggcagtgtttccttcagtgactcccagacctaatgttgctatgcta

SEQ ID NO: 550 - DNA, 225 bp, Mus musculus
atggcagtgcccattggtacacactaacctcggtggaaaaataaccattccctgcctcctagaaaggactcattcttagctttaggggggttcctgtcactgaatcgagtcgctgccctggatgcagggctggcctgggcgacgctccagggatgaggagctgagaaccccagtctaataatgtccatcgacacctccttatccctctaacgtactatgtctttt

SEQ ID NO: 551 - DNA, 501 bp, Mus musculus
  misc_feature (124)..(124): n is a, c, g, or t
  misc_feature (151)..(152): n is a, c, g, or t
  misc_feature (299)..(301): n is a, c, g, or t
  misc_feature (303)..(303): n is a, c, g, or t
  misc_feature (357)..(357): n is a, c, g, or t
  misc_feature (397)..(397): n is a, c, g, or t
  misc_feature (404)..(404): n is a, c, g, or t
  misc_feature (444)..(444): n is a, c, g, or t
gtgacatccagtttaaaccctagaattctcttccaccagggttcattgtctgccatatgactatgtttctacagatattctcagcatgaggatggcttcacatggctttctctcagtactcccntttatgcccacgaccctgtgtatacannaaatgatgatttgtctgtccaggtctaccctctgcttgtcccagaacgccattgacattgactttggtttggtttttatcttgaccacactgtacagtaacatccaagagcccttcctacagtgggtgttttttttttttttttttnnngnctttttacaccttttctcggtcagtgatgatgtttgtccctgttcaacatgtanccctgtaacagaagcccatcaaattaattcagagtgtcantctgttntccctattgtaggtgaaatagtgacgtagaaaacctagtnttctgaatgcttttccatgtagactttttctggaatgtgaacacgactcttcagtta

SEQ ID NO: 552 - DNA, 481 bp, Mus musculus
  misc_feature (57)..(57): n is a, c, g, or t
  misc_feature (67)..(67): n is a, c, g, or t
  misc_feature (83)..(83): n is a, c, g, or t
  misc_feature (156)..(156): n is a, c, g, or t
  misc_feature (450)..(450): n is a, c, g, or t
  misc_feature (456)..(456): n is a, c, g, or t
ccactggtctatgaggtttcaaatgcttgcccagcatggtctcaaatgtctagattnatttaataantttttgaaatcacagngtaggtttgcaccaatgaaacccaagaactccacagacactcacgaggttatatccgtttctttgtatctatntcaacgtatacttcttgaagactgtatacgtgcgtatagataagtagatattatatatatatatatatacatatatatacatggatatataaagttcctttgccggcatgttgccttgtttctgcttaaattgctctattttaacttatgtcctaaaagaagaatgtaatttgtttacaaacctgtagataatgtctttggctatttgtgtggtttaaggacactggtggccaagatgcttacaaacagctcgggcccaacagacacatcccctggattgcatccttgaagttntacgantagccatgctctgatttttgcctgc

SEQ ID NO: 553 - DNA, 511 bp, Mus musculus
accctgctgctgtagtcgtgaaacaaagacagtggaagtcacaaaaatgtccccagcccagtccccgcccctccctcccgcagatttgtacgtattactgtgtctcgtgctgtcttcgcaaacgtggtgtacgcctgccgcaggtgtcctgtgcccttctccctccctgactctagagtctctcttctccttagttctcaggcctctcccctgctcctctccagtgaaccttttcccttaggactgaaccacactagcaccggttgatttcttctgtagcgcttctcccatcccttcctccggtcaagcaatgctcatgcttcaggatcttgtttgtcgaacatgtggggtttcctttatgttatttatataaataatttctcaaatggatatttaaaaaaaagctagtctgtcttgaaacttgttaacttgaaactcttgaatctcagtgtttaaagtatggaagcacaaccgtgtaccgctctgtaccgtcctgtactgcagcatttga

SEQ ID NO: 554 - DNA, 171 bp, Mus musculus
ggactggatatggaccctgagacctgcccctgtcctactggtggttcctgcacctgctcggacaaatgcaagtgcaagggctgcaaatgcacgaactgcaagaagagctgctgctcctgctgccctgccggatgtgagaagtgtgccaaggactgtgtgtgcaaaggtgaa

SEQ ID NO: 555 - DNA, 197 bp, Mus musculus
ctgacatgaggctactggacggagatgatggtcccctgcgttgcccaaagggggtacctgcagcccgtgacattgtccagtttgtgcccttcagggacttcaaggacgctgccccctctgcactagctaagtgtgtcctggcagaggtgccacggcaggtggtagagtactatgccagccaaggtatcagtcccggg

SEQ ID NO: 556 - DNA, 396 bp, Mus musculus
  misc_feature (277)..(277): n is a, c, g, or t
gctggccgtgcacatgtttatcgaccgccacaaacagctgcgggccacggcccgcgccaccgactacctccaggcctccgccatcacccgcatccccagctaccgctaccgctaccagcgccgcagccgctccagctcgcgctccaccgagccctctcactccagagacgcctcgcccgtgggcgtgaagggcttcaacaccctgccgtccacggagatctccatgtacaccctcagtagggaccccctgaaggctgccaccacgcccaccgccacntacaactcggacagggataacagctttctccaggtccacaactgtatccagaaggacagcaaggactctctccacgccaacacagccaaccgccggaccacgcccgtatgaagaccgtg

SEQ ID NO: 557 - DNA, 308 bp, Mus musculus
acagggccagctaccagaggccaaaattgttctcaactgtgacctcttggtagtcctggcgtgccaacaccagcccctcagggaggtttctagtccctctctaaaggctcagaattggacagttaagccttctgccctgtcctgggaggtgatgatttaagaatcctaaaaggttcagggactctattccaagctcaggctgggccccactggatggatactcacgctccacaccaaagcaggacaccctacggctctccggcatccctctactctgaggagggagagcccttccttgaagtttatct

SEQ ID NO: 558 - DNA, 510 bp, Mus musculus
ggctgaacctcgaggagttccagcagctctatgtgaagttcttcccctatggagatgcctccaagttcgcgcagcacgccttccgcaccttcgacaagaacggtgatggcaccatcgatttccgagagttcatctgtgccctgtccatcacctccagaggtagctttgagcagaaactgaactgggctttcaacatgtatgatctggacggtgacggcaagatcacccgagtggagatgctggagattatcgaggctatctacaaaatggtgggcaccgtgatcatgatgaaaatgaatgaggatggcctgacgcctgaacagcgggtggacaagattttcagcaagatggataagaacaaagatgaccagattacactggatgaattcaaagaagctgcaaaaagcgacccttccattgtattacttctgcagtgtgacattcagaaatgagctgatgtcgatgctatggactgcacacaagtcttgatgttccattcagtctgcagct

SEQ ID NO: 559 - DNA, 439 bp, Mus musculus
  misc_feature (34)..(34): n is a, c, g, or t
  misc_feature (282)..(282): n is a, c, g, or t
  misc_feature (299)..(299): n is a, c, g, or t
  misc_feature (351)..(351): n is a, c, g, or t
  misc_feature (360)..(360): n is a, c, g, or t
  misc_feature (366)..(366): n is a, c, g, or t
gcccacacacagcttgtattatcagtgaatatanatatactatatttgcatgccttttgggtttgccttaattcttacctcatttgtaacctctcaatctggaaagagctgttttggatgaatgcagtatacaacttaaaaatcctgctcaactactcattaagtataactacatatctatagacacaaaggtattatttattgaaagtaaaaacataataatgggaatgtattgatttctgtttgacgtttcaaaggcttccagaaaggtggcaatagatntcccaaataaatttctnatagtcgatttacttccctaattattaatttatagttttcagctcagtgttnataggggtnagctanccataacttactaatctaccctggaatttgcagaatgactggaagtggggaaagtcactgtccaacttatcat

SEQ ID NO: 560 - DNA, 372 bp, Mus musculus
gctacttttagcacatggctggcttcagcacctgtccggctatacttgtgtgatatttcaagatctcagcctctgtttctacctgggactcagatcttctggtagcttaactatttcagtcgaaagagaaggtctctaaatccgagatgatgtgctactagtaataaggggaccctgtttttaagtgcatgaccaagctctctgcaagtggacatgcttactctctgcaaatggacgcgtattgcgggtgtttgctacctcctgccctcctcatggttttggttctcctgctgtggtaggatgcttggccagcattgtggcttgtcatgccagccccattgcctaccttgtcatgctcagaggtcctactgc

SEQ ID NO: 561 - DNA, 329 bp, Mus musculus
gctatccacaggaacctttcacaacagccattactcgcagggcaacaaagaatcaaatgagagcaagacaagcggagaccagagttctggttgccagaccggcacggatgaaaacccagtgagatgagtcagaaaatggccaaggagggccccaggctctccaagaaccagaagttctccgagcacttcagcatccactgctgcccacccttcaccttcctcaactccaagcgtgagatcgtggaccgcaagtacagcatctgcaagagcggttgcttttaccagaagaaggaggaggactggatctgctgtgcctgccagaagactag

SEQ ID NO: 562 - DNA, 419 bp, Mus musculus
gccaaaatgtctgtccaagggaatgagagaatcaattttgggacgttcacaaataaagtcctaacagcggttaaaagccaatctgtcagatagaccatgtcatgtaggtaaatctagaaagcaaactgagaactataaaaatcaagtaccgggcagtaaatgcagtatgacgttctgggcctgaatattgacatcccacagtcctgtattggttattgcttaataaggagaagccacaagatctcacactttttctataatgcaataggatttaaaaatgacagcagaacacaaagacactagaaattgtcctgtcagaaataaaagtataagaaataattcctggcttgaggaaataacccagactaaaagctacatagaaacggcttaacagtactggcagggcatatatttgtttg

SEQ ID NO: 563 - DNA, 571 bp, Mus musculus
  misc_feature (134)..(134): n is a, c, g, or t
  misc_feature (148)..(148): n is a, c, g, or t
  misc_feature (225)..(225): n is a, c, g, or t
  misc_feature (246)..(246): n is a, c, g, or t
  misc_feature (297)..(297): n is a, c, g, or t
  misc_feature (302)..(302): n is a, c, g, or t
  misc_feature (309)..(309): n is a, c, g, or t
  misc_feature (325)..(325): n is a, c, g, or t
  misc_feature (340)..(341): n is a, c, g, or t
  misc_feature (343)..(343): n is a, c, g, or t
gggaaccctctccatgaagtatagaataagactcattcccaagaatccaaatcaaggtgcccatcccagagcaagattaaactagaaaccaggtgacctgagctgtccgcggtggactgtggaggcaggaggtngagatacaaagtgnggagaagacacctgtgttaagaagctcactctggtgctcatgaccaggagggaaggagcgggttgcttcaatttctnggttcccaagggccacacagnccccagcaggcagaaaggcagtcatggcttgccacactcgctcaggtcaanccagnctgaagnctgaggccttgcaagnagtccagctccaccnngnaggtgggtgtctgaggccagccaacctccagagcacctgtgcctgggtcgggttatagaaaggttgggagctctagtgcccaccccacccccattcaggggccatgccatactggctgtcctggcattgcctacgaaccaagatgggctctcggcttttgtgggggtcctgagtcagaacctagtaaccagaactgatggaccaagaaatctgtccacagctcaggaa

SEQ ID NO: 564 - DNA, 72 bp, Mus musculus
gccggagatgccagacgcttggttctgaggagtgatttgcaacgcaatggagcgaggaagggatcgcttaca

SEQ ID NO: 565 - DNA, 405 bp, Mus musculus
  misc_feature (78)..(78): n is a, c, g, or t
  misc_feature (127)..(127): n is a, c, g, or t
  misc_feature (160)..(160): n is a, c, g, or t
  misc_feature (368)..(368): n is a, c, g, or t
aatgtttgcaaagaccttatccctttcaataattcaggtatctctctctgtatcctgtaactcaaggtgtaagtgccncaggtagacaaggaactccaaaatgcaagcagtgtggcagaaacagtcnctggctgataatttattatactcagaactgtgncttgtttttctggggaagtgactcagagcttttttgatgcatagttgagatacccacatatcaaggcagagaccccgcagggctcagaagagcagcagtgcactcccggggaatctctggataaaaatttgcatggtatagtcataatagcttttgagctttttatatgcatttggcaccaagactgggatccacaactttatagacnctgtaatgaagttaccatagtagctagactctaagta

SEQ ID NO: 566 - DNA, 598 bp, Mus musculus
  misc_feature (149)..(149): n is a, c, g, or t
  misc_feature (153)..(153): n is a, c, g, or t
  misc_feature (157)..(157): n is a, c, g, or t
  misc_feature (184)..(184): n is a, c, g, or t
  misc_feature (186)..(186): n is a, c, g, or t
  misc_feature (196)..(196): n is a, c, g, or t
  misc_feature (215)..(215): n is a, c, g, or t
  misc_feature (271)..(271): n is a, c, g, or t
  misc_feature (273)..(273): n is a, c, g, or t
  misc_feature (292)..(292): n is a, c, g, or t
  misc_feature (304)..(304): n is a, c, g, or t
  misc_feature (330)..(330): n is a, c, g, or t
  misc_feature (332)..(332): n is a, c, g, or t
  misc_feature (336)..(343): n is a, c, g, or t
  misc_feature (345)..(351): n is a, c, g, or t
  misc_feature (426)..(426): n is a, c, g, or t
  misc_feature (428)..(432): n is a, c, g, or t
  misc_feature (434)..(436): n is a, c, g, or t
  misc_feature (546)..(546): n is a, c, g, or t
gccactttctgtacagacctgaatatatagtgcatgcaaggtcctagatatttatctatacatatacacctaacaacacacacacaacacacacacacactcacacgtatatgtatgctacatacatccgtgcagcaggaaagaaatanacantgancccacctccactcaccccagcacaccntntcccaagttntggggcaggagcccagctntgcagtttgcaggaagcactagcgtggggcaaaggggagagatgctgggtgtggtntntgaaagataagtgatggantgcgctagcccntgtggggacattaaagggcatggctntnttannnnnnnnannnnnnntttgagcagccaggagcagtctgtctgggcctgatgccgggggactgacctaagggtgggtgggaagacctgctntnnnnncnnnctttagtgcatctggccccagcttgccccttggtgtggtgacagtgagcagctttccggaaaactgcagtgggctctaaggaaacattgccctcacctggccagtggcgngcggggaccttgggccggagtggagactgagtttgaaataaaccgttacaat

SEQ ID NO: 567 - DNA, 377 bp, Mus musculus
  misc_feature (149)..(149): n is a, c, g, or t
  misc_feature (153)..(153): n is a, c, g, or t
  misc_feature (157)..(157): n is a, c, g, or t
  misc_feature (184)..(184): n is a, c, g, or t
  misc_feature (186)..(186): n is a, c, g, or t
  misc_feature (196)..(196): n is a, c, g, or t
  misc_feature (215)..(215): n is a, c, g, or t
  misc_feature (271)..(271): n is a, c, g, or t
  misc_feature (273)..(273): n is a, c, g, or t
  misc_feature (292)..(292): n is a, c, g, or t
  misc_feature (304)..(304): n is a, c, g, or t
  misc_feature (330)..(330): n is a, c, g, or t
  misc_feature (332)..(332): n is a, c, g, or t
  misc_feature (336)..(343): n is a, c, g, or t
  misc_feature (345)..(351): n is a, c, g, or t
gccactttctgtacagacctgaatatatagtgcatgcaaggtcctagatatttatctatacatatacacctaacaacacacacacaacacacacacacactcacacgtatatgtatgctacatacatccgtgcagcaggaaagaaatanacantgancccacctccactcaccccagcacaccntntcccaagttntggggcaggagcccagctntgcagtttgcaggaagcactagcgtggggcaaaggggagagatgctgggtgtggtntntgaaagataagtgatggantgcgctagcccntgtggggacattaaagggcatggctntnttannnnnnnnannnnnnntttgagcagccaggagcagtctgtct

SEQ ID NO: 568 - DNA, 472 bp, Mus musculus
caaggtcatctacatggctcgcaaccccaaggacttggtggtatcttactatcagttccaccgctcgctgcggaccatgagctaccgaggcaccttccaggagttctgtcggaggttcatgaatgacaaactgggctacggctcctggtttgagcatgttcaggaattctgggaacatcgaatggatgccaacgtgcttttccttaagtatgaagacatgcaccgggacctggtgaccatggtggagcagctggccagattcctgggtgtgtcctgtgataaggcccagctggagtccttgatcgagcactgtcaccagctggtggatcagtgctgcaatgccgaggccctgcctgtgggtcggggaagagttgggctgtggaaggacatcttcaccgtctccatgaacgagaagtttgatctagtgtacaaacagaagatggggaagtgtgacctcacgtttgacttttat

SEQ ID NO: 569 - DNA, 483 bp, Mus musculus
  misc_feature (27)..(27): n is a, c, g, or t
  misc_feature (120)..(120): n is a, c, g, or t
  misc_feature (141)..(141): n is a, c, g, or t
  misc_feature (216)..(216): n is a, c, g, or t
  misc_feature (219)..(219): n is a, c, g, or t
  misc_feature (221)..(221): n is a, c, g, or t
  misc_feature (233)..(235): n is a, c, g, or t
  misc_feature (245)..(245): n is a, c, g, or t
  misc_feature (301)..(301): n is a, c, g, or t
  misc_feature (306)..(306): n is a, c, g, or t
  misc_feature (441)..(441): n is a, c, g, or t
  misc_feature (457)..(457): n is a, c, g, or t
aaaattttcagtatagtacagtacatntactgtgaggcgcgtgctaaagtgaacaagcgagttttcatgctgacccactcaatgctattcagaactcaattggcttagcactttctcatntccttaggtgcatttagattntcagagttaacctgcgttaaaaaaaaataaaataaaatacatgtatatatttaaaaaaaaaaataaggtttcccnttntnggcaaacagcannntacacgcttntttcctgtgctactgtagcaaaccacagcattgatgagaaggcatgcggactgtgnttcanttcacagtgtttacccgagcacttaataaaatgtaaggctggtatttatttgaagttgtacagtatgacttaattcacatctgttggaatagaaaatatattctgttgagtatttaagaggctgtacatgttttnttttgtgtttggattntttgtgctttttcatgttcggtacat

SEQ ID NO: 570 - DNA, 325 bp, Mus musculus
agtcaagggccgaggcgaaacgaatgaaggtggcaaagaatgcacagaatattaacccatcttcctcgcagaattcccagaattttgcaacttataaggaaggttacaacgtatatggcatcgagagtgttaaaatttaggggatgaccttgagcgctgccacgaggaacaaggcaaggctgtcaattacaggaagtactggagaaaatggacgtgttatgactccagaatttcccaaagcagtgcatgctgtcccttacgtgagtcctggcatgggaatgaatgtcagtgtgactgatctctcgtgattgataggaaccttctg

SEQ ID NO: 571 - DNA, 519 bp, Mus musculus
  misc_feature (273)..(273): n is a, c, g, or t
  misc_feature (285)..(285): n is a, c, g, or t
  misc_feature (289)..(289): n is a, c, g, or t
  misc_feature (306)..(306): n is a, c, g, or t
  misc_feature (314)..(314): n is a, c, g, or t
  misc_feature (318)..(319): n is a, c, g, or t
  misc_feature (321)..(321): n is a, c, g, or t
  misc_feature (332)..(332): n is a, c, g, or t
  misc_feature (334)..(336): n is a, c, g, or t
  misc_feature (338)..(338): n is a, c, g, or t
actggacaggaaactgcagtctcagttgtccaggcaaagatcagggtgatcctttccttcacccccacggcctctccccaccttttccaacgtgttgcatgctgggagttgaggaggaaagggctgctgccttcatttaggaggctgagatttgagggcaagatccaacctggtagactaccccgcttgcagcggtggtgtcttctctgtggatggatagaaagagaaagaaaactcttcttatctgggggaggggcgtcctcttccttatcnttagatttcttnttanatcccctcctcacactntaatttanttcnntntttcaggaggntnnntnggtggggagggggctgggcagggaattgtccgaggtgctgagctgggcgggaccggaatcgtcctgggaagagtaccagggactgggtcgggcctggggccttgtccaaggtgccaatgatgcgggccgacggcgcaggccgcactatctgtctgtccgtctgtcctggagcgaactataa

SEQ ID NO: 572 - DNA, 462 bp, Mus musculus
gtgatctgtagtgtctgcagcacataaataaaacactactctccagcagaacaagccaccccctagtcctctccctcagccctcgaatatccattccagcgtactcaacacacctcttcccgaagaggaactcagcgagccctttggagggtggtttgcctaatcagtgggttagaaggaatgcaattaggtcgtcacgtcattcgtggagatgagtcttagggcgcatgccactctccccgctgctgcttcaaacacaaagacagccatcagaagccgcccgggaggcttgctgccagcaggggcacctgggtgatactctgacactgtccccacagtagaaggcaaatcatctcctagtcttgccgtctgtataccttgtttggggttttcatccctggcttattttgtggctttgaaagagtgaattgtgttgtgaaactgtgattcccgtggctagta

SEQ ID NO: 573 - DNA, 176 bp, Mus musculus
  misc_feature (66)..(66): n is a, c, g, or t
  misc_feature (70)..(70): n is a, c, g, or t
cctttcattggttggtatggagagcattaagcataagccttaaaaagagttgcacacatttcaaanctanatagtgtggtgacatgtgagtccagattactgttagactccagaaattgttagcatgaacttgaaatggaaaaatcataatcactgaaggacttaggttgtttatt

SEQ ID NO: 574 - DNA, 454 bp, Mus musculus
  misc_feature (304)..(304): n is a, c, g, or t
  misc_feature (334)..(334): n is a, c, g, or t
  misc_feature (367)..(367): n is a, c, g, or t
  misc_feature (370)..(370): n is a, c, g, or t
  misc_feature (400)..(400): n is a, c, g, or t
gaagctggtctcaactaaaaaggtagaaaaggtcacttcacacgccatagtcaaggaagtcacccagggtgactaagatcggagtccgttgcaaaaggttaagccatacgacaatttcaaaatgcatgtgattgacagcttcaaaacagaatgggttctcccatgggggctccagacattgtattttcctttgtgcaatatgagggaactgcatgcaagctcagggtgcccccctcctcagtccttggggggaattcaaatgcatgatcgtgtatgtacctagggaattcgccagtttcctganctgttggaagaggggcactcgggggggatntcttgagatgtattatgcagagtaccaactganccnaaaataataagtgaaacagaactctcttanccttaagaaagctatatatgaatacttacgtttacctcactggtgcatttaaaa

SEQ ID NO: 575 - DNA, 448 bp, Mus musculus
  misc_feature (134)..(135): n is a, c, g, or t
  misc_feature (143)..(143): n is a, c, g, or t
  misc_feature (175)..(175): n is a, c, g, or t
  misc_feature (177)..(177): n is a, c, g, or t
  misc_feature (179)..(179): n is a, c, g, or t
  misc_feature (245)..(245): n is a, c, g, or t
  misc_feature (257)..(257): n is a, c, g, or t
  misc_feature (261)..(261): n is a, c, g, or t
  misc_feature (264)..(264): n is a, c, g, or t
  misc_feature (273)..(273): n is a, c, g, or t
  misc_feature (298)..(298): n is a, c, g, or t
  misc_feature (301)..(301): n is a, c, g, or t
  misc_feature (321)..(321): n is a, c, g, or t
  misc_feature (328)..(328): n is a, c, g, or t
  misc_feature (351)..(351): n is a, c, g, or t
  misc_feature (362)..(362): n is a, c, g, or t
atcacacttgccaagggacgctgtcatttcattgccttcatcttcatgtgtcgtctgcttccctctctcctcgtgctaagctggatccgtgtccttttctttttaacgagttcaagtgaacgaaaacttatttnncccccttncctctccttttcttgaagcttctgctagatgnananttcactgaaaattcagtcagtcacaaactggaagaattgtaaaagaaaaaaaaagtatatatcacnaagtacacacanggcntcnacacttatnaactaataaattggcacagaaggtntcntttcacccttgtatccacantctgaancaagcacccatttccatcggttntccggacattntctgttcctgtttcttgcatttatttttataccatatttaaatgagaaaacaccttttactccagatgtatcaaagttgacctctt

SEQ ID NO: 576 - DNA, 351 bp, Mus musculus
tgcggtcaccggtgccaagcagggcccgcagctcaccgaccagcaggcgccacctcatcaggattgtgcctgctgagccacttcccttccctgctgccaggggcacgtcccccatccccgactaccctatttattattgtagctatttatttatttattgaggatgtgccccgagcgcacccccttcccaccctgtacatagctccacccagctcggccgtggtgtattgtggtcactgctgctccctctcctttaccccccacccccattttgtttttgtaaaccatcccgtccacagttgtcagttgtgaagaggggaccagatgtcactctgcagcaggctgatggaa

SEQ ID NO: 577 - DNA, 312 bp, Mus musculus
agacgaaatctttgcttgacaagctccaaaagcttgtgtcatcagatggcagatttaagaacctcagagagtctttgagaaattgtgatccaccctgtgtcccttacctggggatgtatctcaccgacttggtgttcatcgaggaggggacacccaattacacagaggacggcctggtcaacttctccaagatgagaatgatctcccatattatccgagagattcgccagtttcagcagactacctacaaaatcgacccccagccaaaggtaattcagtacttactggatgaatctttcatgttggacgaag

SEQ ID NO: 578 - DNA, 235 bp, Mus musculus
atggccttgggcagtgttgcagttaccaaggatgatggctgctaccggggagagccatcctggtttcacaggaaagcccagcagaatcggagaggattttcagaggagcaacttcgccagggacagaatgtcataggcctgcagatgggcagcaacaagggtgcctcccaggcgggcatgacggggtacgggatgcccaggcagatcatgtaagatgctgtatagtgagtgcccc

SEQ ID NO: 579 - DNA, 454 bp, Mus musculus
  misc_feature (215)..(215): n is a, c, g, or t
  misc_feature (373)..(373): n is a, c, g, or t
tagggctggctccaacaagtagcaagcaagttttacagctttaatgctctggctttctttactttctcatgattacagctttgtatgttactcttatttaacaggacctctgttgtattgatttcttctgtatcttccttttgaatcttgtaagacagaagtttaagaccacgagttggaagacaagtcacataatccaaacacaagtaaatggnctgcaaaagatttgagtaactgcttggacttgacggccttaaacctgctgttccagctttaacaagagcatcttacctgggcgatatttgcccgttctggtgtgacttgtgtgactccaatgcttaccagctgtcactgaaactagtgctcttcctcnttctgcagtgtgtggagacagctttctttgttgaagatgtgaatgggtgtgcatgtgcactgactattgcattcacttttg

SEQ ID NO: 580 - DNA, 414 bp, Mus musculus
  misc_feature (339)..(339): n is a, c, g, or t
gcgacttcgttaagcggcactttttctcagactatctgatggggttcattaactctgggatcttaaaagtcgacgtggactgctgcgagaaagatttgtgcaacggggcatcggtcgcaggacgcagcccctgggccctggctggggggctcctgctcagcctggggcctgctcttctctgggctgggccctaagacccctccctccctcctgctgggcctttggagcttgtcccctaagcctgttgctgcccctccccagcctggcctggctggggctgggacagcaagggtttggcatcaaggtctgaggctctcaacctccctagatgtgagtganccttctccgtttctccaccagctccatatcccaagcagctgaatatctccaggagtccagacatcctggcaggaa

SEQ ID NO: 581 - DNA, 473 bp, Mus musculus
  misc_feature (168)..(169): n is a, c, g, or t
  misc_feature (171)..(171): n is a, c, g, or t
  misc_feature (175)..(176): n is a, c, g, or t
  misc_feature (188)..(188): n is a, c, g, or t
  misc_feature (192)..(193): n is a, c, g, or t
  misc_feature (195)..(195): n is a, c, g, or t
  misc_feature (208)..(208): n is a, c, g, or t
  misc_feature (216)..(218): n is a, c, g, or t
  misc_feature (245)..(245): n is a, c, g, or t
  misc_feature (284)..(284): n is a, c, g, or t
  misc_feature (374)..(374): n is a, c, g, or t
  misc_feature (383)..(383): n is a, c, g, or t
  misc_feature (387)..(387): n is a, c, g, or t
  misc_feature (406)..(406): n is a, c, g, or t
  misc_feature (431)..(431): n is a, c, g, or t
tcacgggcagcctcacaggcgccggcctctgcttcctgctgcccagcctcttccacttgcgccttctctggcgcaagctgctgtggcaccaggtcttcttcgatgtggccatcttcgtcatcggcggcatctgcagcgtgtccggcttcgtgcattcactcgaggganngntcgnnggcttggaaacnttgnncnttgagggtggggntggggccnnntttcacagccattcagtgcttggaatntacagcgtccagccatttccagcaagagcgctccccatnccctggacatttcaaccttgcggcctgaaaggttgaccgggaaatccatttcgggcgggcgacttcactctggagaagccgcggcagggnccccgtttncctngccggttttcaggaacccnaactcatcttgtgcaatgtatccgntcgtggaactgtatactgtgcgtgtggtgtgctcgtggtgaa

SEQ ID NO: 582 - DNA, 423 bp, Mus musculus
  misc_feature (354)..(354): n is a, c, g, or t
  misc_feature (369)..(369): n is a, c, g, or t
ctcctagtgtgtctttgaaacagttactaatattcctgagacgtgaatattaacaattctattaacacctgcctgttgtcactttatgcttctagagcaaatgtatagtgaaacttctttgatggcacttattaaaaactcttttaaagtaagtacaatcaggaacatttaccatcttttgattcccaataagaaattctattttcatgttcctaataggacataaaacaacatagacttggcttatttgggttgatacttattattcctgctttggtttgtcgtttatcacaaattattaatttcttcagattttcagaagtgaaattttaaaaataatcttttggatgtttnaggtgatttaaaatntactgtgttggtggtgaatgacttttgatgacggtgttaagtgcaactgtactg

SEQ ID NO: 583 - DNA, 362 bp, Mus musculus
  misc_feature (184)..(184): n is a, c, g, or t
  misc_feature (334)..(335): n is a, c, g, or t
gggctgcatactatagggttaactatgtatattcatgttaagagttaacttgtggtttggctgtttcctggattttaaaacatatacatgtgcagagatgtattcaaatgaaaggaagcatatctttatcaagatgctagtaaaactgaacatcaactataatatttcatttggattttttttncttttggataatgccgagaaacgcctaattggattccttttaattgggagacgctctcttctgtgtagaacagttgttccaagatagcttagtgttttgttttcctgttgcatgacagaattattgtttccagcagtggaggtgctgttnnagagtccagtgttctagaagaggcggt

SEQ ID NO: 584 - DNA, 400 bp, Mus musculus
cagtgaggatcaaggctacccagaccctccaaatccctgtcctcttgggaaaactgctgatgatggatgtctagaaaacgcccccgacactgcagagttcagccgagaattccagttagaccagcacctttttgatccagaacatgactacccaggtttgggcaagtggaacaagaaactcctttatgagaaaatgaagggaggacagaggcggaagcggaggagtgtcaatccctatctacaaggaaagaggttggacaatgttgtggcaaagaaatctgtcccccacttctcagaagaggagaaggaagcagaataaagagaagacagtatgtagaaacccatccaatgcttatgtgcatgttcatagagcccgtgagtgacagcatgcattttacat

SEQ ID NO: 585 - DNA, 501 bp, Mus musculus
  misc_feature (98)..(98): n is a, c, g, or t
  misc_feature (136)..(136): n is a, c, g, or t
  misc_feature (213)..(213): n is a, c, g, or t
  misc_feature (229)..(229): n is a, c, g, or t
  misc_feature (239)..(239): n is a, c, g, or t
  misc_feature (312)..(312): n is a, c, g, or t
  misc_feature (317)..(319): n is a, c, g, or t
  misc_feature (343)..(343): n is a, c, g, or t
  misc_feature (364)..(364): n is a, c, g, or t
  misc_feature (426)..(426): n is a, c, g, or t
  misc_feature (470)..(470): n is a, c, g, or t
aagcttactcccttcaaatgtcccgcagacacagagcaatgcattctctcaagatgtccaggctttaggctttcatggtctctagaatattgtgaccnaaacgcaacgattgttatagttctcatatttgagtgcnatctggagataattcatagttatggcagttaatatttcttacagaaaagttttccttttgtggcaacatttttatangcttgtgtgaattccntttttttttntttaatgacataaaacagtatttttgcacagttgtaaccatgtgtgatggtgtcactataaccaaagtatatncaccnnncccttgtgcatttattgttccctntggtattgtgcacttaaaatntccaaattcaaacctctgtaactgtggagaatctggcagcagcacagcatgcccgtgacctncctgctacagtgtgagctgtgaccagtaagcaggcactgtaaantcctaagttgctctcaggcaagggagtccat

SEQ ID NO: 586 - DNA, 536 bp, Mus musculus
  misc_feature (107)..(107): n is a, c, g, or t
  misc_feature (410)..(410): n is a, c, g, or t
  misc_feature (427)..(427): n is a, c, g, or t
atggctctaagtcagttccagcagaagagcatctgaacactggccagcctctgttctctgcctcccagttcagtcttctgatgcgaccatttaaagtgagacccacnatggttgtcttacggggcactgtggtttacctttcatcatggctccctaacacacctccatgaagaagtgttgggttgttaaagtagtgtttggattactttgctgcttgtaaagaaacttactcacttatttgcttttcctgaagttaaatgctgggccaggcatcatgaacacttgtaatcccgcagtatctacaaggtgaagggaggaggattgctgtgaggttgaggccagcctggactccctagtgaattccaggccagcctaagttacaatgtgagactccatctatctcaaaaaanccaaccaaccaaccaanccaaaaaaaaaaaaggactgaaaggctgaggtgagtccctgttgagtttattttgtctcagcacttgggaggctgaggcaagaggaacgtgattccagactaagctaag

SEQ ID NO: 587 - DNA, 373 bp, Mus musculus
  misc_feature (78)..(78): n is a, c, g, or t
gagacagctggatcatcttacacccacccacagtcaggaggatcttccacaacacgggggcaggggggcgggtaggtnccctttgggtggtcctcagcctggagggaggtggggagtcatgccaaggtgaagagtctttttgtttggtggggagccacggatgatttctgggctgtggggctttgaagaagttccctgatctacttccctgcagaagaacacttcttgtcccagctcttgctggctggaggccatggtaaaacaaaacaaaactcccaggattccaactgggggtccccaaactcaacctgcctctttgcacttagataaccacagatttaccccgtctgtactctgtatttcacctctctct

SEQ ID NO: 588 - DNA, 528 bp, Mus musculus
tagaaacccaccattgcctaatgacctagatgactccgtaatctctgagcgtgaccaagaccacacctagatcgtgggtactgtgtgtccatgtgaacctccacatttgctcgtaatctgcttcctgcctagaagcggcaaagccaggctaagggaatctaccagtcatagcacttatgtctgctcctcatggattacgcgctacacatgtgtttgggttttagaaacaggtgcatgtgaagacaaatctgagctcagtcagggtagaagcgaaaggctgaaccttccaacgtgctgatcacaaacgcaaagccagagggttcaagcagccatgggattgttcttcatgaagtgggcttatttctctcattttagttattatgatgggatgaattaattgacatgtcgggtggcttatctgtgggtgccatgggtgatgatgttcattttaagcttttgcctgtagtacaagcacataatgctactgaacgtttttccacttggagactgtgagctggttgctgcatt

SEQ ID NO: 589 - DNA, 487 bp, Mus musculus
  misc_feature (113)..(113): n is a, c, g, or t
tcgccttttccgggttgcgaggttgaggcgggcggagaagcaagagacttggaagctgcaaggagaggccagggcacaaggccttcttcgcagagccatttctgcgctgtctnccgcagcaggctccctttgcctttcctgtgtcccctgctttggtggaaagtgagatataagacctaaatcctgctaggcgtgaccgagggcctggaagcagtttcttgctcaccctcaattccaaatgcatcaggaattattcccaatcctagtactcgaacccgcctgccccgcgtgactgtcttcacgcctactttccttggatgtctccagctctatccgctccgcggcgcccgaagcacactgacactttgtaccagcgcctctgaacccgaggtccacccgccaaacaaacccgggcggccggactcgcgattgcgctcattcgcaggactttcaaggggttcgtccagaagttttgattgtaccgaaa

SEQ ID NO: 590 - DNA, 459 bp, Mus musculus
  misc_feature (56)..(56): n is a, c, g, or t
  misc_feature (61)..(61): n is a, c, g, or t
  misc_feature (137)..(137): n is a, c, g, or t
  misc_feature (322)..(322): n is a, c, g, or t
aaaaccctgaccactagatgtcgctgttcacccagtagtctaagactgttccattnggttnggcatgtgtgagaggtttcaagtgacgataaaacattaatgaccttagtttctgagggaatcttcattaagattanccacctgtgaaaaagtttgggacaaatgtagtattgatttcttatgcgttgcgagtgatgtcagcaccgtatgataaggaggtgcacagccactgttagccagagaggcactttaatgcatcttctttttaggatcatggtaactggtcaatatgcttctcatgtgaaaaaaaaaagtataaatnccacagctagaaaatgcccaaggcattaacaggttatgttgcctatttcttaacatacatgcacactattttattggtactgccattatatgccttttgattctcaagactggtgaactgcttgctcgttttagtaa

SEQ ID NO: 591 - DNA, 530 bp, Mus musculus
  misc_feature (44)..(44): n is a, c, g, or t
  misc_feature (46)..(46): n is a, c, g, or t
  misc_feature (50)..(50): n is a, c, g, or t
  misc_feature (54)..(59): n is a, c, g, or t
  misc_feature (61)..(65): n is a, c, g, or t
  misc_feature (67)..(69): n is a, c, g, or t
  misc_feature (136)..(136): n is a, c, g, or t
  misc_feature (272)..(272): n is a, c, g, or t
  misc_feature (307)..(307): n is a, c, g, or t
  misc_feature (362)..(362): n is a, c, g, or t
  misc_feature (425)..(425): n is a, c, g, or t
  misc_feature (439)..(439): n is a, c, g, or t
  misc_feature (502)..(502): n is a, c, g, or t
aaatctgttctgttggattctgtatatagctacacttcggttgnantggntggnnnnnntnnnnncnnngtggtctttgccttggggaggggagggccagagggagggggagggggaggggaggggcggccgaaanccaactgtttgtactgaatggcaagaatgttctagtaaatgtgtaccaaaatgtgaactactttgtacgattacagtctccacgtcgacctaacagaatattattgatattaatgtgcttttttttgtataaagtncaaacatttcgtcccaaagtctgagtactttagtncagtaaaatgttgtttcatgtcctgtcaagaattcgtatagtacgagcctggatntacgtgtcaaactgttccatttgtttatgtaaagtgatattaaaaagatataaactatagctntccattgcttttgncaaaatatacaaccacacaatgtatataattcctagtttccatatttatccgcatgtaaaggntctggtttattcatgttacagctattca

SEQ ID NO: 592 - DNA, 451 bp, Mus musculus
caggagatgcaccttctgaggagaagaagggtgaaggggatgcggccccctccgaggaaaaggccggctcagcggagacagaaagtgctgctaaagctaccactgataactccccgtcctccaaggctgaagatggcccagccaaggaggagcctaaacaagccgatgtgcctgctgctgtcactgatgctgctgccaccacccctgctgcagaggatgctgccaccaaggcagcgcagcctccaacggagactgcagaaagcagccaagctgaggaggagaaagacgctgtagacgaagccaaacctaaggaaagtgcccgacaggatgagggtaaagaagaccccgaggctgaccaagaacatgcctgaactttaagaaatggctttccacgttgcccccacctgaaccctgtctctcctgcccttctcagctccactctgaagtttcc

SEQ ID NO: 593 - DNA, 552 bp, Mus musculus
  misc_feature (40)..(40): n is a, c, g, or t
  misc_feature (51)..(51): n is a, c, g, or t
  misc_feature (236)..(237): n is a, c, g, or t
  misc_feature (258)..(258): n is a, c, g, or t
  misc_feature (262)..(266): n is a, c, g, or t
  misc_feature (270)..(274): n is a, c, g, or t
  misc_feature (276)..(282): n is a, c, g, or t
  misc_feature (284)..(284): n is a, c, g, or t
  misc_feature (296)..(296): n is a, c, g, or t
  misc_feature (298)..(298): n is a, c, g, or t
  misc_feature (308)..(308): n is a, c, g, or t
  misc_feature (314)..(314): n is a, c, g, or t
  misc_feature (338)..(338): n is a, c, g, or t
  misc_feature (344)..(344): n is a, c, g, or t
  misc_feature (377)..(377): n is a, c, g, or t
  misc_feature (381)..(381): n is a, c, g, or t
  misc_feature (384)..(384): n is a, c, g, or t
  misc_feature (388)..(388): n is a, c, g, or t
  misc_feature (391)..(391): n is a, c, g, or t
  misc_feature (413)..(413): n is a, c, g, or t
  misc_feature (441)..(441): n is a, c, g, or t
  misc_feature (459)..(459): n is a, c, g, or t
  misc_feature (500)..(500): n is a, c, g, or t
gtgtccatgcttaaacccagggatggaaggcatgtcttgnggttcgggggnattaatggtggatgttgtgtccatactgcggagtaagtaggggctggtgagtagggtaatagctttcttattcctgatggtttaattttgattctctgactttgtaagtctacagcacgtagaaagaaagaaagatgtggcccttgcatttagaaagtggaaacgcttcctttgggagacctctnntaggccagaagaacccaggtncttnnnnncccnnnnncnnnnnnngncatacttacacngntttttcagtntacacnaaacacaacctcacgctccctgcnaagcancaagacccctgaaagtgacccatgcttccggcnggcnttntgcnatntctagtgattgttttgggaatntctcactgctacctgcacccagtgactnctgcagcacaagaacccntctaatgacactacgcacggttgtttggaattcataatgtntcggttccaagtgaggggacctccagaatcaatccatgtgagttcgcttttg

SEQ ID NO: 594 - DNA, 354 bp, Mus musculus
  misc_feature (221)..(221): n is a, c, g, or t
  misc_feature (311)..(311): n is a, c, g, or t
tacgcttcttctgctacgagggctttgagctcatcggcgaggtcaccatcacatgtgtacccggtcacccctcccagtggaccagccagcccccactctgcaaagtggcctatgaggagctcctggacaaccgaaaactggaagtgacccagactacagacccatcacggcagctggagggtggtaatctcgctttggccatcctgttgcccctgggcttnggtcattgtccttggcattggcgtttacatatactacactaagctacaaggaaaatccctctttggcttctcgggttctcactcttacantcccattacggtggagtcagacttcagcaacccactgtatgaa

SEQ ID NO: 595 - DNA, 536 bp, Mus musculus
  misc_feature (237)..(237): n is a, c, g, or t
  misc_feature (249)..(249): n is a, c, g, or t
  misc_feature (255)..(255): n is a, c, g, or t
  misc_feature (299)..(299): n is a, c, g, or t
  misc_feature (308)..(308): n is a, c, g, or t
  misc_feature (313)..(313): n is a, c, g, or t
  misc_feature (316)..(316): n is a, c, g, or t
  misc_feature (318)..(318): n is a, c, g, or t
  misc_feature (375)..(375): n is a, c, g, or t
  misc_feature (425)..(425): n is a, c, g, or t
  misc_feature (427)..(427): n is a, c, g, or t
  misc_feature (486)..(486): n is a, c, g, or t
aggttcattcatcaaaggtcttagaagaaaacaaccagttaacctgattacaattttgatactgttttcctgaactaataactcaacccaatgagacttctcagcctttgtatatacaaaattcttccaaaagagagtgggggggggggggaaaccaccgttctgacagcatcaagcggactcggcatctcaccatccctgacagtgtcctgggttactccgagggtgctgtgacangtgaccaggacnaagctnaccaaggacacttatttctagattacgattcttctgtttactcnatgatttanaaagnaantnttcaaaaataaataaataaataaataaataaataaatggacagacatcaaagagctntacgttgtatatatttatcaccacagactataagaatggaattatttccntntttgtcacataactgtactaggacttgcccgagatcagaatcgatccattcgctgtttnttgttttccgaaggtcatacattgtgtttggttattgttaacagcccaat

SEQ ID NO: 596 - DNA, 319 bp, Mus musculus
aacaccccaaaacagctggctgcaatgcaagaccatggccaactccagcaaaggattatagtaatcttgagacttaggtgcggctgccttccagcaaacagggcccggatgtaccatcggaagcaaagtgtaatgtatattttgatctgtaacaaaagttgtgatctcatgttgtctttgaaagtgtggatattggtgttttgtgatttggtgatcagaactgaaattaccattttggaaactttcagacatttcccacagaacagagatgcatttaaaggtagatttcctcctggtactttacctgtctttcaagtgt

SEQ ID NO: 597 - DNA, 391 bp, Mus musculus
tgcctactgaggcacgctgactctacccacagcccttggcctagcaatgcacatccccattttgcctatagtcacagccagggccaaatagctatgcagaacagagatatctttatccagcgccaagtcatctcacatctcacatgccttacattgctgtacccgagaccacaggatgggagggtagagatgccctcccatgtttgaagatggggggactttctagaagtcagaacagaacatgtggacctttttcctgtctccaccagcccttacagttacccttgatggtatagtttgtccttgggctctgcttgctaattttctctcttgggatcagggggacgtgaactccagccctgactcgtgctccttatgctctgagtacata

SEQ ID NO: 598 - DNA, 350 bp, Mus musculus
  misc_feature (178)..(178): n is a, c, g, or t
  misc_feature (320)..(322): n is a, c, g, or t
cacagctctgtaaagtaggtaccattgtacttttcataggaggaaacaggcttcaaagagaggctgagaggctatttaggattcgaacagcaggcattactatatagaggctgtgctcaggaatttttcaatgaagcatcctcaatcgctcgaattggaatcgatttttaaatcctantctatagtctcggctagttgggaggctgaggtatcagacattagggacaggatcactttaaccctctggatcgtatagggagatctgtctcaacattaactaaaataaaattaatcacatagtagccaaccatgctaaaaannnaccgttttgtcagttttatctttaagct

SEQ ID NO: 599 - DNA, 462 bp, Mus musculus
  misc_feature (102)..(102): n is a, c, g, or t
  misc_feature (104)..(105): n is a, c, g, or t
  misc_feature (109)..(109): n is a, c, g, or t
  misc_feature (426)..(426): n is a, c, g, or t
gacagctgttctgtgacttgacagtggctcccccgggccccaaagcgtcctattcatcatctgtgacttagtctgttgtagtggtgagctgacacatccagntnngatngttggtgaaaacttgtgcccctctgtggtattgctcctgcgacattctataaatatctataaatatacctatatatacatatatatacatatatatggctgacacagcctcgcctgtagtgtcagaatcaaccaccatgctgtccttgtggagtcttgtggtccaaccaagggaacgctgtcatcctgacaaccccccctccagtgtaccacctccagtgagcccccctgtcctcctggcctgtgaacagccatccccttggccatcccaaccctgcagcaaggggatgctgcagcagcagcagctgtgcagttctntggtagccaccagtcttgctgtctcttggctgagaa

SEQ ID NO: 600 - DNA, 412 bp, Mus musculus
atgagattcgcaaactcatcctgcgcaggaaccccgggggttgggtggagaaagagacctactattgacctcagccaccaccacgtcgcccgtgtcttccctaccccaagcccaggacagccctctccggtccccccattttgtactctggggggaggggccttctctccccatggcccccctctctccttgtggcccagcctcctctcccacacctcgattacctcccacgttccctcacttcttcctctggctggcttctctccccccacagcccctgcctctcttctccctctctcttctgtgtctctccccctctctcccttgcaactctgcctctcatttcctccctgggctcttttttactcccctgggccccgtctcctggcgtatgccatctccggttctaatt

SEQ ID NO: 601 - DNA, 389 bp, Mus musculus
  misc_feature (53)..(59): n is a, c, g, or t
  misc_feature (61)..(66): n is a, c, g, or t
  misc_feature (68)..(68): n is a, c, g, or t
  misc_feature (70)..(71): n is a, c, g, or t
  misc_feature (74)..(77): n is a, c, g, or t
  misc_feature (79)..(83): n is a, c, g, or t
  misc_feature (91)..(91): n is a, c, g, or t
  misc_feature (120)..(120): n is a, c, g, or t
  misc_feature (138)..(138): n is a, c, g, or t
  misc_feature (142)..(142): n is a, c, g, or t
  misc_feature (147)..(147): n is a, c, g, or t
  misc_feature (192)..(192): n is a, c, g, or t
  misc_feature (210)..(210): n is a, c, g, or t
  misc_feature (236)..(236): n is a, c, g, or t
  misc_feature (243)..(243): n is a, c, g, or t
  misc_feature (245)..(245): n is a, c, g, or t
  misc_feature (340)..(340): n is a, c, g, or t
ggctgtctttgcacttttgttcatgctccaaagaatatttcataatgccttcnnnnnnntnnnnnncntnnccnnnntnnnnntgcccttnggccacagcgactggcctcctcctttggnccagcgtgccgccatctncacncgacnctgtcttctagggatagatgcccagggaatgaactctagttttcnaacggactagctgagatnctaacttactcaacgtgaacaggatnatatgtntnctgtgtgggcgggccaacgtgtgctcgcagggaactttggggcagaatcctgcagcagggatgcatgcagatggttctggaaagctttgctgccncagggctaagttcagatgcccagtggacctgggcacttagtaaaacaca

SEQ ID NO: 602 - DNA, 373 bp, Mus musculus
  misc_feature (279)..(279): n is a, c, g, or t
aaaaagcccctgatcgaatttcctggaggaaaagttattgtagctgtttcattgtagatttgtgctgtcattccccaaagtgctttctgctgtgttgaaagagatataagaatttacaagaagacacttgagacttgttcttgggccaatatataaggtaaacaagcaggatgcacaagagtgaggagagctaaaaggacatgtaagaaaccaatcaagatcaaggaaggtgaaataatctatatcttttattttgttttggtttaatataacagatanaccaaccattcccttaaaaatctcacatgcacacacacacacacacacacacacacgtacaaagagagttaatcaactgcaagtgtttccttca

SEQ ID NO: 603 - DNA, 489 bp, Mus musculus
gaaacagtgttgtcaggatcatctcactcccttctccttgataacagctaccatgacaaccttgtggtttccaaggagctgagaatagaaaggaactagcttatttgaaataagactgtgacctaaggagcatcagttggtggatgctaaaggtgtaatttgaaatggccttcgggtaaatgcaagatacttaactctttggatagcatgtgttcttcccccacccctatccgctagttctggcccctggcctctggcataatatcttcacaatggtgctttttttcctggggttttatccattcactcatagcaggtgattagacgatcttgattagtttcatatttcccaattgtttatctcttgtttggagttgtatcagaaagacctggaggatgattctttgagcatagttctttttgaaaacaagaaagagaaactgggcagaaagcatcacaaaaatatttgaaattgtacggtcccatgaa

SEQ ID NO: 604 - DNA, 302 bp, Mus musculus
  misc_feature (229)..(229): n is a, c, g, or t
tgttgcccaccaaccccgaggagagctggcaggtgtacagctctgcccaggacagtgagggcaggtgtatctgcacagtggtcgccccccagcagaccatgtgttcgcgggatgcccgcacaaaacagctgaggcagctactggagaaggtgcaaaacatgtctcaatccatagaagtcttggacaggcgaactcagagagacctgcagtacgtggagaagatggaganccagatgaaaggcctggagaccaagttcaagcaggtggaggagagccataagcagcatctagccaggcagttc

SEQ ID NO: 605 - DNA, 238 bp, Mus musculus
gactcacacacgagaactacccattatggctccctgccccagaagtcgcagcacggccggacccaagatgaaaacccagtagtccatttcttcaagaacattgtgacacctcgaacaccacctccatcccaagggaagggaggaagagacagccgctctggatctcccatggcgagacgctgagagccctccccgctcagccttcccgaatcctgccctcggcttcttaatataactg

SEQ ID NO: 606 - DNA, 558 bp, Mus musculus
  misc_feature (171)..(171): n is a, c, g, or t
aagctgccaaggatgagtctgaagacacaaaagaagaagaagaaggtggtgagggtgaggaggaagacaccaaagaatctgaagaggaagagaagaaagaggagagtgctggagaggagcaggtggctaagaagaaagattgagccctattcccaactattccaggaaaanttctccccaatcaggtcaacctcatcaccaaccaaccagttgagttccagatcctatacaaattaagaagtcaatacatgtataattctgagatgacttaggttggactttcaatgttgtgctatgaatttcctccttacgcagagtatctgtttgcttgcagagtggctttctggcttgctgccagcctgtgcatggtccatgcttatgagttcaggatctatggcaatgtgaatcacacagatgtttacaataataataaaaaaaaaaccacacacacaacacgaataaatgaattcactaatgttcatgtgcaacctcatgggaaaaatagtaacttgaatcttcagtggttagaaattaaagacctcgagttatgtgcaataa

SEQ ID NO: 607 - DNA, 373 bp, Mus musculus
  misc_feature (64)..(64): n is a, c, g, or t
  misc_feature (153)..(153): n is a, c, g, or t
  misc_feature (214)..(217): n is a, c, g, or t
ggtggtatcttaaacataagcacactaaaccctcaagacttgttttacccacttaaaacttttnacggattgcacctctgtaagctatttcttaaaatgtgtatgatatatttgaaaagacttccattaatataatagctttgcttgcagccnttccaatctatgttggtttacctgtagtgtttctaaagggtggtcagaggccactagagannnnattgtttgggagtgtagtgatatatattttgtgtttttatttcaagtaagtcattttaaccaaatgttcattcacattcatttataagaagtacctatatcagacaaattttaaaagaaaaacaatcagtattaatggaccaaatttcgtgtttgt

SEQ ID NO: 608 - DNA, 106 bp, Mus musculus
ggagtccagtggagtgtttcctatccccggttcagttcactcacgtgcttccgtgaatactgaatgtgactgtttagaggtggtagaactaatcccttactgtaga

SEQ ID NO: 609 - DNA, 519 bp, Mus musculus
  misc_feature (245)..(245): n is a, c, g, or t
  misc_feature (253)..(254): n is a, c, g, or t
  misc_feature (264)..(264): n is a, c, g, or t
  misc_feature (267)..(267): n is a, c, g, or t
  misc_feature (272)..(272): n is a, c, g, or t
  misc_feature (276)..(276): n is a, c, g, or t
  misc_feature (278)..(286): n is a, c, g, or t
  misc_feature (291)..(291): n is a, c, g, or t
  misc_feature (305)..(305): n is a, c, g, or t
  misc_feature (307)..(308): n is a, c, g, or t
  misc_feature (327)..(327): n is a, c, g, or t
  misc_feature (338)..(338): n is a, c, g, or t
  misc_feature (348)..(348): n is a, c, g, or t
  misc_feature (350)..(350): n is a, c, g, or t
  misc_feature (354)..(355): n is a, c, g, or t
  misc_feature (366)..(366): n is a, c, g, or t
  misc_feature (373)..(373): n is a, c, g, or t
  misc_feature (385)..(385): n is a, c, g, or t
  misc_feature (395)..(395): n is a, c, g, or t
  misc_feature (405)..(405): n is a, c, g, or t
  misc_feature (407)..(407): n is a, c, g, or t
  misc_feature (409)..(409): n is a, c, g, or t
  misc_feature (429)..(429): n is a, c, g, or t
  misc_feature (439)..(439): n is a, c, g, or t
  misc_feature (466)..(466): n is a, c, g, or t
  misc_feature (489)..(489): n is a, c, g, or t
ccacctgtgtaggaagccctttaggatgagggcaggaggtctccttcttgctgctcggtgttctttgatgtgaaactgagaacaagtctttttgagataaatgcagtgtatttcatgtttgtaagcacctctgagatgtttggcaagaaatcccctgatttccacccaaacttaccttatagagcacaacgttaaaggtcgtacaattactgtgagaactgtgaatatgtgtaactttttttttncagttttnncccagagggnagnagatnattntnnnnnnnnnatatnctttcttttttttncnnataaggatttattctcagnacaccaagtanatttatctcnantatnnaagtatatgtnatatatncctattcagacnatatacagancctgttttanananaattacagtattatttagtnaaattatctnttctatggaccaaatgtaaaatatttntacatgaagatgtgttttaaatntctatcaaatggaatcacagctagaacacg

SEQ ID NO: 610 - DNA, 459 bp, Mus musculus
  misc_feature (325)..(325): n is a, c, g, or t
  misc_feature (373)..(373): n is a, c, g, or t
  misc_feature (401)..(401): n is a, c, g, or t
atgatgctgcgtcacaccgggatgagccagttgtgcctagttcttttggttaggactctgagcaccaagctggcggacctgggagagcagcggatatggctggctgctggaggaggttttgtggttaccagaactgaccaccagagagtcaacgctcaagatgggtttttggactgtgtggaaaagtagaccacaagtcttcagagatggaggcctagatagaattcgtgtgttccatgagatgagactgagggctttcctttgctgcggcccataggaggactgtgctagagaattctatggtgacttcatttcagcctggagnccttctaaagctgtgataccaagatgaagaggctgggactaaggactntcagtaacagagttcctgctgaaatctntcatctcagactcaaaaaagtgaataccagaactcgcgtttgcaggttattcacctac

SEQ ID NO: 611 - DNA, 402 bp, Mus musculus
  misc_feature (177)..(177): n is a, c, g, or t
  misc_feature (184)..(184): n is a, c, g, or t
  misc_feature (328)..(328): n is a, c, g, or t
  misc_feature (331)..(331): n is a, c, g, or t
acacgcattgctcttatttgtcggcattacagctgcagttttgccttggggcaaaaccattcatcccattgccaaaacagttgacagtgtctgtgtgtgttgtgtgcagttttcaggatgatataacagatagcgcgtccacgctgctgcccctttggaaagagcagggcctggttnatgtagnctgcccagctgctcagtccagataaatacatggactagcaactatgcagtcatcattcctgcctttacgtgattggctggacgagggggcaaaagaacctatttataaaagctcctatatacttccacgttctatttatgcaantcntcttcacagatcattctaaaatgaacgaggtgatgtatgctgtatcagaaaccatctgtaacagttgtgtt

SEQ ID NO: 612 - DNA, 316 bp, Mus musculus
  misc_feature (167)..(167): n is a, c, g, or t
  misc_feature (233)..(233): n is a, c, g, or t
  misc_feature (275)..(275): n is a, c, g, or t
cccacccagggttacagttacagatccaagtggctgtacaacacaaacagttccactggatcaaagggaacatcctgggattcagactcagcaatggtgccaacatgaatctacctcgtgccagagtctgagtagcctagtctagcacccaacccagctaagattgntcagcagttcccatgagtgaaccctgaagaagggagttaggagaagaggctataaatcagaacacnccctcagtgtaactgaatgatgaccagggaactatttactantccttttatgatctcttgtaattctgtaacttctctgatgt

SEQ ID NO: 613 - DNA, 561 bp, Mus musculus
  misc_feature (100)..(100): n is a, c, g, or t
  misc_feature (260)..(260): n is a, c, g, or t
  misc_feature (292)..(292): n is a, c, g, or t
  misc_feature (322)..(322): n is a, c, g, or t
  misc_feature (324)..(324): n is a, c, g, or t
  misc_feature (341)..(341): n is a, c, g, or t
  misc_feature (357)..(357): n is a, c, g, or t
  misc_feature (366)..(366): n is a, c, g, or t
  misc_feature (371)..(371): n is a, c, g, or t
  misc_feature (387)..(387): n is a, c, g, or t
  misc_feature (396)..(396): n is a, c, g, or t
  misc_feature (433)..(433): n is a, c, g, or t
  misc_feature (467)..(467): n is a, c, g, or t
gatagcattaactgtcaccaccgtttgtgttttaactgccacacctgccatatttttacaaaatgtgtgctgtgactttatcaccttttttttttttttnaattcacgggttgtttactcttatatgtgactatttttgtaactgggtttacgtttggggagagggattaaggaggggatactacatttctctgtgtataatgagatctattttcaatgaaggcatgctgcagttttcatccacacatgacaatatcccntcacacacggaaagggtatacttctcatttcnggatgtttttagattttttgaggtgcttananagctattcatatttttnaggtgtttcatccagnagaattttnatgtncctgtaaatgttccanagagtcacnaccatcaaagagttgttttatttttacatagttcatnatatgtacatgtatatatgtatatatgtatatgnccgtgtatatacatatatatgtatacacacatgcatacatatgcacacacagaccatcacatgctcagagtccaggcagcatgactataacatt

SEQ ID NO: 614 - DNA, 480 bp, Mus musculus
  misc_feature (172)..(172): n is a, c, g, or t
  misc_feature (238)..(238): n is a, c, g, or t
  misc_feature (243)..(243): n is a, c, g, or t
  misc_feature (247)..(247): n is a, c, g, or t
  misc_feature (249)..(249): n is a, c, g, or t
  misc_feature (251)..(252): n is a, c, g, or t
  misc_feature (260)..(267): n is a, c, g, or t
  misc_feature (269)..(269): n is a, c, g, or t
  misc_feature (285)..(285): n is a, c, g, or t
  misc_feature (293)..(293): n is a, c, g, or t
  misc_feature (305)..(305): n is a, c, g, or t
  misc_feature (308)..(308): n is a, c, g, or t
  misc_feature (315)..(315): n is a, c, g, or t
  misc_feature (317)..(317): n is a, c, g, or t
  misc_feature (319)..(319): n is a, c, g, or t
  misc_feature (333)..(333): n is a, c, g, or t
  misc_feature (357)..(357): n is a, c, g, or t
  misc_feature (374)..(374): n is a, c, g, or t
  misc_feature (376)..(376): n is a, c, g, or t
  misc_feature (390)..(390): n is a, c, g, or t
  misc_feature (400)..(400): n is a, c, g, or t
  misc_feature (424)..(425): n is a, c, g, or t
  misc_feature (455)..(455): n is a, c, g, or t
ttttcctgcagtattgtttagccatcttctgctcttggtaaggttgacatagtgtatgtcaattaaaacaaaacaaaacaaaacaaaagtctgctttgtaaatagtaattttacccagtggtgcatgtttgagccaacgaaaatgatttaagcacagtatttactgcatcanatatgtaccacagttaagtatagtttgcaagctttcaacaggtgacatgacgtcattggttccctnagagnttgnancnntcactgcnnnnnnnntntcttgctgctgctgcngtatcttnacccttctgctnttnagaagtntnanagggaagccatatntcagaggtggagtgaagtggattnttccatcaggaactcantnttcacgacactgancaatgtgttncagtaaacaaggaagaaatccctnntctttgttctccctacccttaattgaacantccggtgagatgtctgacagtgtaa

SEQ ID NO: 615 - DNA, 279 bp, Mus musculus
caagcatacacctaatgttgggtttggggattgcaatttctactttcatagagtcatagaattttagatggaaaaaaaaaagcattttgctcgtcatttcttaatataattcaacaggaactgcaacatttgtgtaccaagcaataagtgcaaagcataaaacctcctgtgtgtaaattatccccatgttgcttgtggtagcagtgatttctttcttttaaaaaagttaacctcagagctctttctaatgttttgcgctgataagaatgcacatcccaa

SEQ ID NO: 616 - DNA, 465 bp, Mus musculus
  misc_feature (305)..(305): n is a, c, g, or t
  misc_feature (346)..(346): n is a, c, g, or t
  misc_feature (353)..(353): n is a, c, g, or t
  misc_feature (389)..(389): n is a, c, g, or t
  misc_feature (399)..(399): n is a, c, g, or t
ataacttgtgcttattttgtgcattttttcccatgctgaacccactaagtgcatgtagacaggactgttgtttgcacattgaagaggcaaactttgtagtagtcgttgtagtggtagacagataacgaaaaccgaggctgcatcatagactactcctttaaattttttttctatttttttttcctcttttcggtttttggagaaaaataaataacaccagatttcagttcagagaacactcgttcaacattcagggaaacctttatatgtcacctgctatgaatgaatgcagtttgctggcaaanttctgatgcatttgctaagcattcatgggaaaggcatgccnaaatctnttctctatgatgtgttcaatctgagggaaaaaaaanggaaaaaaantcttaggaccaggcagttgtatactttagttataaatgaatgacttcatgttaatcttgctagttt

SEQ ID NO: 617 - DNA, 415 bp, Mus musculus
  misc_feature (258)..(258): n is a, c, g, or t
aaaacagatgctctcccagtagaagcatgtcaacaaaccatcgccaggtttcataaaatatttaatgatttgcaaaagaagaaaatgacttcatactttagggagatgaacactctgtaagctttctgtacaaacgttgtgttttccttgttatattcgggggttttcctcttgcgatgtgacccatgttgggcatttttgtatcatcaattaacaactacatcttttgccaaatgcatgcctgccttttccgttctnaatatgtggtaataaagaccaaaactggctagattttgcatgaaaatggttctgaaagataagaaaacagactttgaaggttgtttagtttaaatatgtggcggatagactcaactctctcatgcacaaatgacttctgcttttcatttcctcatat

SEQ ID NO: 618 - DNA, 384 bp, Mus musculus
  misc_feature (122)..(122): n is a, c, g, or t
  misc_feature (127)..(128): n is a, c, g, or t
  misc_feature (189)..(189): n is a, c, g, or t
  misc_feature (276)..(276): n is a, c, g, or t
  misc_feature (287)..(287): n is a, c, g, or t
  misc_feature (290)..(290): n is a, c, g, or t
  misc_feature (292)..(295): n is a, c, g, or t
  misc_feature (312)..(313): n is a, c, g, or t
  misc_feature (318)..(318): n is a, c, g, or t
  misc_feature (320)..(320): n is a, c, g, or t
  misc_feature (339)..(339): n is a, c, g, or t
  misc_feature (358)..(358): n is a, c, g, or t
ctccggaagcaagaggctccaggacccaggctcaactgcagggaggatgacgagactggactctccggtccatatatggttgaccccagcacccagcctctggccacagatgctggtggagncaggnnttctgaggtgcatgtgcagcctccctccaggatcagctgaccctccactcgtgagcactgngcaggcagtaacactgcctgccactgtgtgagcgaacctactggaggtgaagtgactgtggggcactgaggatcagagaggagctcnccgccccatanttntnnnnttgatttaccctgtccnntggtntngcgctctacctttcctctntgagcaataaccgaccgcncctgctctctgcatgtgcacaggctc

SEQ ID NO: 619 - DNA, 111 bp, Mus musculus
gcaggtgatggttgatgtagcccaatactgcatcttgttaatctgttctaactctgagtagagtgtgggtttaagataacaccgattaatgtatcgccacaataacgtgag

SEQ ID NO: 620 - DNA, 360 bp, Mus musculus
  misc_feature (59)..(60): n is a, c, g, or t
  misc_feature (62)..(62): n is a, c, g, or t
  misc_feature (67)..(69): n is a, c, g, or t
  misc_feature (72)..(72): n is a, c, g, or t
  misc_feature (90)..(90): n is a, c, g, or t
  misc_feature (94)..(94): n is a, c, g, or t
  misc_feature (96)..(96): n is a, c, g, or t
  misc_feature (102)..(104): n is a, c, g, or t
  misc_feature (106)..(106): n is a, c, g, or t
  misc_feature (111)..(113): n is a, c, g, or t
  misc_feature (116)..(116): n is a, c, g, or t
  misc_feature (118)..(118): n is a, c, g, or t
  misc_feature (125)..(125): n is a, c, g, or t
  misc_feature (136)..(136): n is a, c, g, or t
  misc_feature (138)..(138): n is a, c, g, or t
  misc_feature (140)..(140): n is a, c, g, or t
  misc_feature (142)..(142): n is a, c, g, or t
  misc_feature (145)..(145): n is a, c, g, or t
  misc_feature (149)..(149): n is a, c, g, or t
  misc_feature (151)..(151): n is a, c, g, or t
  misc_feature (153)..(153): n is a, c, g, or t
  misc_feature (160)..(160): n is a, c, g, or t
  misc_feature (162)..(162): n is a, c, g, or t
  misc_feature (166)..(166): n is a, c, g, or t
  misc_feature (171)..(171): n is a, c, g, or t
  misc_feature (173)..(173): n is a, c, g, or t
  misc_feature (195)..(195): n is a, c, g, or t
  misc_feature (201)..(201): n is a, c, g, or t
  misc_feature (203)..(204): n is a, c, g, or t
  misc_feature (270)..(270): n is a, c, g, or t
  misc_feature (287)..(287): n is a, c, g, or t
  misc_feature (324)..(325): n is a, c, g, or t
tccatactctccaaatttcttaagaacgttaataatatcaattgttgactctaaccctnntntagannntcnaaagagccccacactggnaccntnaccccnnngnaggcnnntgntngttgatntagcccaatantncntnttnttantntnttctaantntgantagantntgggtttaagataacaccgatnaatgtntnnccacaataacgtgagggtaagagaaaaagcagggaagaaatttccagaaaaaaaccctccagattntcccacgggagtgtttnccctccagtgtgactgaacgaccttgcccatggcttnntccagacagcgcagctgcagtatggctggacagaa

SEQ ID NO: 621 - DNA, 568 bp, Mus musculus
  misc_feature (101)..(102): n is a, c, g, or t
  misc_feature (106)..(107): n is a, c, g, or t
  misc_feature (109)..(109): n is a, c, g, or t
  misc_feature (111)..(120): n is a, c, g, or t
  misc_feature (148)..(148): n is a, c, g, or t
  misc_feature (185)..(185): n is a, c, g, or t
  misc_feature (194)..(194): n is a, c, g, or t
  misc_feature (204)..(206): n is a, c, g, or t
  misc_feature (295)..(296): n is a, c, g, or t
  misc_feature (331)..(331): n is a, c, g, or t
  misc_feature (412)..(412): n is a, c, g, or t
  misc_feature (456)..(456): n is a, c, g, or t
  misc_feature (484)..(484): n is a, c, g, or t
  misc_feature (507)..(507): n is a, c, g, or t
agcagtgaggcgagctccctgagctcctcctctgacacggaggacacggaggtctgcgaggaccaggcaggcaaggcagcctctccctgaggcccctcggnnggcnncngnnnnnnnnnngaaaggagaaggagggcgctactccttnctccctggggggcctctgccctagagcggggccacgncccacacgnctgggagcannngccacaggctggccacctcccactcctcgagcccaccctcctaccctgagcatgccactcgtggccaagctcccttgttatttgctctnntagttccctctgcctgggatgcccttccccctctnctatgcctggcagttatcttgtccctttgaggccccacatcaagtgtcacctccttccccagctctcccgggcagaaatantcgtctgtgcttacttggttcatgcttcttgtgtgacacttctncgctgttttataattagtcgggcatgantctgtttcccaagctagactgtntctgaatcatgtctgtagcccagtgcccagtgctgggcctggcatagagtaggttctccat

SEQ ID NO: 622 - DNA, 353 bp, Mus musculus
  misc_feature (230)..(230): n is a, c, g, or t
  misc_feature (257)..(257): n is a, c, g, or t
  misc_feature (266)..(266): n is a, c, g, or t
actacacgcagaaactcaggtgctaaaatggacatgtatgtgaccacctttctgaggaccaggttccagtgagtgcccagggatgtttccttctcgactacggtaactgagctgagaagaatgggaacgggttaggagcacacagtagcccattggtgagacaaatttccaggctagcttcatccaatccattaaggagactttatgctttttcatcttgttttcatttntggcaaagcaaagcctatcctgagtgntcgtttgtntccgccctccacgccacccctgagacaccgagcatgcgcattaacccagagcgcgctaacccatgcgcagcgttggacgttagctca

SEQ ID NO: 623 - DNA, 390 bp, Mus musculus
  misc_feature (90)..(90): n is a, c, g, or t
  misc_feature (106)..(106): n is a, c, g, or t
  misc_feature (140)..(140): n is a, c, g, or t
  misc_feature (194)..(194): n is a, c, g, or t
  misc_feature (204)..(204): n is a, c, g, or t
  misc_feature (208)..(208): n is a, c, g, or t
  misc_feature (211)..(211): n is a, c, g, or t
  misc_feature (214)..(216): n is a, c, g, or t
  misc_feature (228)..(228): n is a, c, g, or t
  misc_feature (234)..(234): n is a, c, g, or t
  misc_feature (236)..(246): n is a, c, g, or t
  misc_feature (252)..(252): n is a, c, g, or t
  misc_feature (258)..(258): n is a, c, g, or t
  misc_feature (274)..(274): n is a, c, g, or t
  misc_feature (351)..(351): n is a, c, g, or t
  misc_feature (355)..(355): n is a, c, g, or t
gggagtcctttgtcacatttttcatcctgccctccttcattcaaccatgcatctatgacctcattccatgccaccagggttcttgctctnaacaaaccggggtccncgggctttggaaccaggcctccagggcaaagagnaaggggttctctgagcagagccaggttctcagacaggagcagaggaaactagcnaggaggcctnacantantgnnnggcttcccggtntcaggnannnnnnnnnnncctatnccccancccctcactctcacantcttccatacacacacacacctacacaggagatggttggtttgtcagaactcactgtaatacacaagcttgcacttntgcntcctatatctagcagcatgggatacgtttggcagt

SEQ ID NO: 624 - DNA, 461 bp, Mus musculus
  misc_feature (312)..(312): n is a, c, g, or t
  misc_feature (324)..(324): n is a, c, g, or t
  misc_feature (391)..(391): n is a, c, g, or t
  misc_feature (394)..(394): n is a, c, g, or t
  misc_feature (414)..(414): n is a, c, g, or t
  misc_feature (433)..(433): n is a, c, g, or t
aagggtgcacctgtaataggacacagtataacattgtattgctgtgctaatcattgtttttattctttgggaccagctgtccaggcaaaaagaagagtatccaaacatttagacacatgaatgggtggcagcttggttagactaactgagtcgttcaaatgtaataatacagattttagcttaatgcagaactctttagaaagctcagatggaagaaattatagttgtatggaaatgagaaagggaataagtgatgtatggcttgctacgattcaaccaacaccagttactaagtagggttgagtggggctnccttcttgtctnccaggcgaatcattacattagtctgctggccttggtggaggaagtatgccactgagggaggggaganccnttgagagtttaaaagcctcnccttgcttccagtgtagtntctgctctaagcttgaccttcaaggtgt

SEQ ID NO: 625 - DNA, 143 bp, Mus musculus
  misc_feature (30)..(30): n is a, c, g, or t
  misc_feature (35)..(35): n is a, c, g, or t
  misc_feature (44)..(44): n is a, c, g, or t
  misc_feature (46)..(47): n is a, c, g, or t
  misc_feature (63)..(63): n is a, c, g, or t
  misc_feature (81)..(81): n is a, c, g, or t
  misc_feature (83)..(83): n is a, c, g, or t
  misc_feature (90)..(90): n is a, c, g, or t
  misc_feature (97)..(97): n is a, c, g, or t
  misc_feature (100)..(100): n is a, c, g, or t
  misc_feature (107)..(107): n is a, c, g, or t
  misc_feature (112)..(112): n is a, c, g, or t
tcatgagacagtgtgatcaaccttttcttnccccnctgtgcacntnntaggtgacccttccanctgaccatcagctccccncntgtgtgncccctgnccnatgtgtntcgtncctgcactgtggactatctgtggattctgtg

SEQ ID NO: 626 - DNA, 392 bp, Mus musculus
  misc_feature (57)..(57): n is a, c, g, or t
  misc_feature (195)..(195): n is a, c, g, or t
  misc_feature (240)..(240): n is a, c, g, or t
  misc_feature (242)..(242): n is a, c, g, or t
  misc_feature (244)..(244): n is a, c, g, or t
  misc_feature (253)..(253): n is a, c, g, or t
  misc_feature (271)..(271): n is a, c, g, or t
  misc_feature (276)..(277): n is a, c, g, or t
  misc_feature (279)..(279): n is a, c, g, or t
  misc_feature (292)..(292): n is a, c, g, or t
  misc_feature (308)..(308): n is a, c, g, or t
gggaaacaattagatctcacaaactaagtatgaacattctaactcaggaccgagaantcaaaattctgctcggcagacttctcctttcaggatgatcgctttgttcctggaggacagaggaggggaatggccagagtctttttctagttagttgtatcttccttgctccctctgctgtccataatgtgagtggcntgcggaagttgagattcacaggacgagctgatggggaattaaggntntntgaggtgtntcctttagctgctggganccatnntntgacctgctggtncctagggcctgcttancccttggtgaggctgagagtcgaggactgtgggaagctggacttgaggctttctaacttgcatattcaaatagcgacgttttaa

SEQ ID NO: 627 - DNA, 380 bp, Mus musculus
  misc_feature (334)..(334): n is a, c, g, or t
  misc_feature (342)..(342): n is a, c, g, or t
gcccttttacttcttggcaagcagaaatagcccattcacagggtggcccactgtcagctgccacacaacccagtccatttgggaaccatccctttcttggggctcaaatgtacagagtcaggcatgttctcctggtgccgttggctcctcatcacacagtatctgcacctttccatgcttggtactgcccagatcttggcctcctcaaagagcctttttgctttacctaatttcatcccaccagagtgtctatcccctgtgacatctgccaggcacagactcaaaccctaagccatccatcccactggggaactagtcctgtccatctggtgtnggcgtgcnggctgcacactttgttttagggcctgaacacctgtgtg

SEQ ID NO: 628 - DNA, 556 bp, Mus musculus
  misc_feature (33)..(33): n is a, c, g, or t
  misc_feature (56)..(56): n is a, c, g, or t
  misc_feature (58)..(58): n is a, c, g, or t
  misc_feature (65)..(65): n is a, c, g, or t
  misc_feature (70)..(70): n is a, c, g, or t
  misc_feature (76)..(76): n is a, c, g, or t
  misc_feature (88)..(88): n is a, c, g, or t
  misc_feature (90)..(91): n is a, c, g, or t
  misc_feature (99)..(99): n is a, c, g, or t
  misc_feature (166)..(166): n is a, c, g, or t
  misc_feature (218)..(218): n is a, c, g, or t
  misc_feature (294)..(294): n is a, c, g, or t
  misc_feature (305)..(305): n is a, c, g, or t
  misc_feature (314)..(314): n is a, c, g, or t
  misc_feature (317)..(317): n is a, c, g, or t
  misc_feature (320)..(323): n is a, c, g, or t
  misc_feature (336)..(336): n is a, c, g, or t
  misc_feature (349)..(349): n is a, c, g, or t
  misc_feature (354)..(354): n is a, c, g, or t
  misc_feature (368)..(368): n is a, c, g, or t
  misc_feature (380)..(380): n is a, c, g, or t
  misc_feature (389)..(389): n is a, c, g, or t
  misc_feature (395)..(395): n is a, c, g, or t
  misc_feature (419)..(419): n is a, c, g, or t
  misc_feature (422)..(422): n is a, c, g, or t
  misc_feature (442)..(442): n is a, c, g, or t
  misc_feature (445)..(445): n is a, c, g, or t
  misc_feature (478)..(478): n is a, c, g, or t
  misc_feature (482)..(482): n is a, c, g, or t
  misc_feature (485)..(485): n is a, c, g, or t
  misc_feature (514)..(514): n is a, c, g, or t
atggtgggctctttttgttggagctgaaaggtnatatggaaggagataagaatttngnataccanttctnagcttnatagaaggaatnanngtcactcnggctaacataggggtacagcatccttagtaacccgagcgtggctcgaagtggtcatgatttcatccnaaacacaatgtgtaaacttactcagctaacaatgggaaatgtattgcttctntgcgcagtggacttacgtgcaatttgttcaaaagggaacaagtcattgaggagaaacaaaagcccaatacttagantcccaattttntcttatttnccnaannnnaagcaaccccccnagagttgatattnttacnatgtacatactgtnaaatatgaaagnatcgatgtntcttantttttcattatttgctaaccaaanctntacatttttcatacaatccncanccttttgagtatcaaaggggtaaaccacacccntcanccnattctggaagtgcactatttatactggtntccttgctttttttttcccattttcttgctgagatgacatga

SEQ ID NO: 629 - DNA, 426 bp, Mus musculus
  misc_feature (26)..(27): n is a, c, g, or t
  misc_feature (183)..(183): n is a, c, g, or t
  misc_feature (229)..(229): n is a, c, g, or t
  misc_feature (248)..(248): n is a, c, g, or t
  misc_feature (257)..(257): n is a, c, g, or t
  misc_feature (274)..(274): n is a, c, g, or t
  misc_feature (307)..(307): n is a, c, g, or t
tggtccccaaatctacttgcattgtnnttgtgtacacacacacacacacacacacacacaccccagtagtcagggtacccttttaatttttgtttgaaatcaacttcttcactgtttggaaatcttgcagtttcaatgtgcacactccttggactccagaccctgtctgattgatactctctncagggtataattatcaggaaatccacgcagcgggagttcagatggncccttcaggaggcaggaancctccatancaacgaaggccagcctnccattgtgatgtgttgacttctcacctcacctntcctttaaagtgaggagcagagggcggcatttctatctgtactgggctcagaaggcacagtggccatattgactttacattcaactgtgtaatatgtggaaaagactcagcatgttggt

SEQ ID NO: 630 - DNA, 154 bp, Mus musculus
  misc_feature (26)..(26): n is a, c, g, or t
  misc_feature (37)..(37): n is a, c, g, or t
  misc_feature (39)..(39): n is a, c, g, or t
  misc_feature (52)..(52): n is a, c, g, or t
  misc_feature (88)..(88): n is a, c, g, or t
  misc_feature (109)..(109): n is a, c, g, or t
  misc_feature (111)..(111): n is a, c, g, or t
  misc_feature (113)..(114): n is a, c, g, or t
  misc_feature (124)..(124): n is a, c, g, or t
  misc_feature (126)..(126): n is a, c, g, or t
gaactgtccagtccttgtaacgtgtntgaccttgggntnttcctgaaggagntccttaggcaggagatatggtcccctattcagacantaggccaggtgtggctggggntntnnttagtggccntncttagtggatgtgttggcaaccttaata

SEQ ID NO: 631 - DNA, 434 bp, Mus musculus
  misc_feature (210)..(210): n is a, c, g, or t
tatggatgcttccagcggacaaccaccatctctgtgtctctctcattctctcttcacctgccatagcaaagaaacatcccagaatcgacccttctcccattgatccatgtctcccgtgtcaccatgggcatggcatgtgaagcaatgtcctgcagatggattaccaccttttatttctgccagctaacatcctcccagcctcctgcctantactgtagactccggtgtgacccaccactggggagttcacacctagaaagagatggaactaaactctactatcagctgcttcaaaaaccttttgtctacggcctgggaagatgttctccagcccctgagcctattggttggatagagagagactgtggtggaaatgagggtcttgctgggaggggtccatgactccggggaagacgcttctcaacgagggatgt

SEQ ID NO: 632 - DNA, 166 bp, Mus musculus
tttcctttctaagcaccattgggtaagttcagaaccactgtccctctatcccaggaatatggtgaccaataccaaaagagcatggggagtctgcacagttctgcttagataggtaggaagattctcatgtgcaatgcttgcttcctcctcctcttagcactaaatt

SEQ ID NO: 633 - DNA, 216 bp, Mus musculus
  misc_feature (49)..(50): n is a, c, g, or t
  misc_feature (52)..(60): n is a, c, g, or t
  misc_feature (62)..(69): n is a, c, g, or t
  misc_feature (71)..(72): n is a, c, g, or t
  misc_feature (76)..(79): n is a, c, g, or t
  misc_feature (81)..(81): n is a, c, g, or t
  misc_feature (83)..(88): n is a, c, g, or t
  misc_feature (92)..(92): n is a, c, g, or t
  misc_feature (94)..(94): n is a, c, g, or t
  misc_feature (97)..(97): n is a, c, g, or t
  misc_feature (100)..(101): n is a, c, g, or t
  misc_feature (106)..(106): n is a, c, g, or t
  misc_feature (117)..(117): n is a, c, g, or t
  misc_feature (126)..(126): n is a, c, g, or t
  misc_feature (136)..(136): n is a, c, g, or t
  misc_feature (190)..(190): n is a, c, g, or t
gtcaggacggggaactccacctccacctgtaggcagagcaaccccaccnncnnnnnnnnngnnnnnnnngnncccnnnncncnnnnnnatgngnccnccnngaccntaagatacagntgataaatntcagcccttntcttcccctacaatgcttcttgtgaaattgtgtacctgcaagctttttgacccntcttactgcattaactatagataata

SEQ ID NO: 634 - DNA, 500 bp, Mus musculus
taactttctgctgcttgagttgcctgatgctcagagcttttggtttgaattattgcaaaagggaatgtggtctggcattaagaatgatgtcttcttggagaaaataagagttttaacgcttctagatgttagttctagatggagaaagcatcactaaacatcattttactcttactgattgttaattgtaattgcatgacacactatgaaaagggttggcttgctagtagagtgtaatggggaagggaggattctcatggttttcctgtgtgcagtgaaacttttgtgttgctcttgctttggctgtttgtgccgtaggtggagtgtttgtcattctgggatggggaaggtatccatgtatctgcttactgctttatgagttcattgttacacattatctcctaatcctagcatccatttaacaattgacttaagatttgctgatattgaaatgtaaagctactgcctttatattttcctgcttttgattctattgttgt

SEQ ID NO: 635 - DNA, 535 bp, Mus musculus
  misc_feature (135)..(135): n is a, c, g, or t
  misc_feature (193)..(193): n is a, c, g, or t
tccagcttccataacattcgagaaagaaccctaacccctaagaaagtttcatgggacccccaccctcacccccacccccacccctacaccaaggcaagaggcagggatgactccatttcatataaatagatatanatataatataaatatatatatgtaaaacactcattttctaacctttttttaaggcccnctgctttattttcaataaactaaacctaatttctaagaggtcccgaagttgggctcacttcccaggctgggtgatggggagggcagggaagaggatccttaaaagtttacacttccatgtgtctcacacgcttactgtgagaaagtggcttgttcagtgttctgaactttgcgaagggtatatgttcgcaatgcacagtgtcattctctggatgtgcacctggctcaggaaaggactgtctttgtacttgaacttaaatccaatggagaaccttaacacgggcatttgcatgactgagatttgctgctgtcttttttccatatgtctctttcttggatgtgt

SEQ ID NO: 636 - DNA, 323 bp, Mus musculus
  misc_feature (50)..(50): n is a, c, g, or t
  misc_feature (60)..(60): n is a, c, g, or t
  misc_feature (65)..(65): n is a, c, g, or t
  misc_feature (68)..(69): n is a, c, g, or t
  misc_feature (71)..(76): n is a, c, g, or t
  misc_feature (78)..(78): n is a, c, g, or t
  misc_feature (81)..(86): n is a, c, g, or t
  misc_feature (89)..(95): n is a, c, g, or t
  misc_feature (98)..(98): n is a, c, g, or t
  misc_feature (102)..(103): n is a, c, g, or t
  misc_feature (114)..(114): n is a, c, g, or t
  misc_feature (118)..(121): n is a, c, g, or t
  misc_feature (136)..(136): n is a, c, g, or t
  misc_feature (140)..(140): n is a, c, g, or t
  misc_feature (163)..(163): n is a, c, g, or t
  misc_feature (166)..(166): n is a, c, g, or t
  misc_feature (174)..(175): n is a, c, g, or t
  misc_feature (211)..(212): n is a, c, g, or t
  misc_feature (225)..(225): n is a, c, g, or t
  misc_feature (253)..(253): n is a, c, g, or t
  misc_feature (287)..(288): n is a, c, g, or t
ggccccaatggccttctgtagaccttccaaagagccccacactggcaccntcacccctangaagncanngnnnnnngntgnnnnnnccnnnnnnngcntctnnttaatctgttntaannnntgagtagagtgtggntttnagataacaccgattaatgtatcnccnacaataanngtgagggtaagagaaaaagcagggaagaaatttccnngaaaaaaaccctnccagattttcccacgggagtgtttgccntccagtgtgactgaacgaccttgcccatggcttnntccagacagcgcagctgcagtatggctggacagaa

SEQ ID NO: 637 - DNA, 317 bp, Mus musculus
  misc_feature (45)..(45): n is a, c, g, or t
  misc_feature (281)..(282): n is a, c, g, or t
atctggatactgttccaactcttcccagaaaccccacttggtagntttatgccttctctctccctagaccattctggggaaaatagtctcatgagattgcctgctccagactaagactccagatctgctccccgcatccttcaaggctcctcctacctccacttcagttgtagagttaagtgggagtctgggctcagcgttccagaccacctcccttccacgctctggggattcctggcatgcaccaagaattctttccccctacttttctcagtcagctnntgttctagacttgttccagaatccctcaatgctca

SEQ ID NO: 638 - DNA, 97 bp, Mus musculus
  misc_feature (46)..(46): n is a, c, g, or t
  misc_feature (69)..(69): n is a, c, g, or t
cctttctccatatgacttcaactggcacaggaagcatccatgtggnatggactgatttgaactggactnttctcagtgtaggcacttagcacccttt

SEQ ID NO: 639 - DNA, 132 bp, Mus musculus
gggagcattccaaagcagtatattggttccaattagagtttaccttttttgtattaatatattgctatttctaaataccactttccttccctaccagtgaaattgctagcattgaactgtattatgtgtttt

SEQ ID NO: 640 - DNA, 433 bp, Mus musculus
  misc_feature (88)..(88): n is a, c, g, or t
  misc_feature (92)..(92): n is a, c, g, or t
  misc_feature (105)..(105): n is a, c, g, or t
  misc_feature (234)..(234): n is a, c, g, or t
  misc_feature (245)..(245): n is a, c, g, or t
  misc_feature (247)..(247): n is a, c, g, or t
  misc_feature (249)..(249): n is a, c, g, or t
  misc_feature (257)..(257): n is a, c, g, or t
  misc_feature (259)..(259): n is a, c, g, or t
  misc_feature (281)..(281): n is a, c, g, or t
  misc_feature (289)..(289): n is a, c, g, or t
  misc_feature (295)..(295): n is a, c, g, or t
  misc_feature (326)..(326): n is a, c, g, or t
  misc_feature (341)..(341): n is a, c, g, or t
  misc_feature (357)..(357): n is a, c, g, or t
  misc_feature (406)..(406): n is a, c, g, or t
ctatttcaataagtgctgtaccatatgtagcatctaatataaaatacatgaaagaatgtacaggaactagcttttattgagtaatatnattncagttcatttatnctgcagcaatatatttgtaggtatactatgtaagggctttaaataaaagaggtccattaatattccttataaaaaattctagcctttcattattgcccagatgttttagaagtaaatatttatgaaganggtatttttgnantntccttttntntgatagattttcacagatattnaacattanttcagnatccacggatcatggtctaatcacatttatnagaccatgatataanccttttagcataatgnccaaataagacaattagaatccatacctgagttttgagcaatgttattntcaaaaagctgctatccaatgatgttg

SEQ ID NO: 641 - DNA, 44 bp, Mus musculus
ttcctccctttgaagatctgtccatattcaggaatctgagagtg

SEQ ID NO: 642 - DNA, 512 bp, Mus musculus
  misc_feature (213)..(213): n is a, c, g, or t
  misc_feature (223)..(224): n is a, c, g, or t
  misc_feature (226)..(226): n is a, c, g, or t
  misc_feature (267)..(267): n is a, c, g, or t
  misc_feature (278)..(278): n is a, c, g, or t
  misc_feature (281)..(281): n is a, c, g, or t
  misc_feature (283)..(283): n is a, c, g, or t
  misc_feature (288)..(288): n is a, c, g, or t
  misc_feature (291)..(291): n is a, c, g, or t
acctgaatgacatcacaaggctggtgtctttgctaagtgctccctctgaaggtctagacatcttccaagatgttcttttaattcccccccctttttttattgggggcagtggagttggtcagggaagtttaaaaaaaaaataatgtcaccatttgcttttttaaatcatgtttggtgtgtttctgttggtttttgttttttggtttgtttgtntgtttgtttnntngtttttaaaatgagactccgtagtttttctgagagataggnagagatgctangcnanaaacnctncaaagttcatgatcaacattgatttattccacatttatttccatttgtcatttttttattttaatgtgttttatgagtttctataaatgttctgattttctgctaatagccaggtgaaatttaatatagtttgttatcttcaactgttgcatttggatattttactttgaaagcattaaggtaatgtttcatatatagcaacttaggaagtaatctgaccc

SEQ ID NO: 643 - DNA, 60 bp, Mus musculus
tccagacagcgcagctgcagtatggctggacagaagcacctactattcttgaatattgaa

SEQ ID NO: 644 - DNA, 70 bp, Mus musculus
  misc_feature (31)..(31): n is a, c, g, or t
ccttgggctttggacacaacggacagaacancccaggtggcagcttcaagtttcccaagctttatttatt

SEQ ID NO: 645 - DNA, 150 bp, Mus musculus
  misc_feature (28)..(28): n is a, c, g, or t
  misc_feature (66)..(66): n is a, c, g, or t
tctaatgctacaagaatgctgtgaaatntcatttaaaataatgatgtaccctgacaagaaattttntcagtgtataaacctaggtagtattgtgcactgatttgaccattgtgaattcctccttcagtgtaagtgcattcccaataaaat

SEQ ID NO: 646 - DNA, 424 bp, Mus musculus
  misc_feature (260)..(260): n is a, c, g, or t
  misc_feature (279)..(279): n is a, c, g, or t
  misc_feature (302)..(303): n is a, c, g, or t
  misc_feature (307)..(307): n is a, c, g, or t
  misc_feature (309)..(309): n is a, c, g, or t
  misc_feature (311)..(313): n is a, c, g, or t
  misc_feature (318)..(318): n is a, c, g, or t
  misc_feature (339)..(339): n is a, c, g, or t
  misc_feature (353)..(353): n is a, c, g, or t
  misc_feature (374)..(374): n is a, c, g, or t
  misc_feature (396)..(396): n is a, c, g, or t
  misc_feature (398)..(398): n is a, c, g, or t
tgaatcaagccaacatttccatcagcttctattctttctcattttatgctttagttcagtggttaagagtccacacacatccattttaaacacaattcactcaaacaaagttgcttataatttaaattccatgccacttacaattttttctttgcatgggtgtttaaatagttctgttatggaattgttcctgcatagttctgagctgtccttttataagaagtgatgttccagtgtcttcacaatgtagtgattatcanccttacaacgaccttgtancctttctgaacacacacatcatnntcantncnnnccaanggctagaaaatacaaagcacnagcaggattcattncatccgttttcacatctttcnaacatcaggacttctaaaaatntntgggatacatgcggtagtaaaattca

SEQ ID NO: 647 - DNA, 421 bp, Mus musculus
  misc_feature (142)..(142): n is a, c, g, or t
  misc_feature (175)..(175): n is a, c, g, or t
  misc_feature (182)..(182): n is a, c, g, or t
aaggccggtagagattcaggtgaaacctctcttcttctcttcccatttatgacacctctgtaattttgaagctctctgtataaacattaattttttcatatgaccagcagaaatataaaatagttgtccatattttcacatntgtggtataatttatgaaattagagagtaactnatctgcntcttaatagaaatggcaagttttgatatgagtatatagtatataaagacaaatagtgctaagtgtaaatatttggtctgtatttcacctttggcatcagtattaacaccaactgtcaagctagtgatgttttttatgatgcccctgagtatgatgcaagagacagtcatttattttaaaaactgaaaagcaagtgaataacaatcaggttaacattgttactccctgtgacaagaattt

SEQ ID NO: 648 - DNA, 281 bp, Mus musculus
  misc_feature (198)..(198): n is a, c, g, or t
  misc_feature (217)..(217): n is a, c, g, or t
gctcccatgcttatcttgttctgtgctgctgttcgaagataaacctgtgccatttgatgagaggcaggggatgctgcggccaccagggggggttcaggacatgaggtgcccctccctgggtgctcagatcagcagatggccagagggacagtctcttcagacattagggaacgctccagcaacagtgcttctgtgtcngtctcctctcagccaccangaagaagacaatttcccctttgccgatgtcgtcggactcactttgtcttccgtgctagtgacag

SEQ ID NO: 649 - DNA, 541 bp, Mus musculus
  misc_feature (289)..(289): n is a, c, g, or t
  misc_feature (383)..(383): n is a, c, g, or t
  misc_feature (385)..(385): n is a, c, g, or t
  misc_feature (390)..(390): n is a, c, g, or t
  misc_feature (444)..(444): n is a, c, g, or t
  misc_feature (462)..(462): n is a, c, g, or t
  misc_feature (488)..(488): n is a, c, g, or t
tatgcccagtgggtaccttgtctcctctctgggaaaggatctcttctgatcctgatgggaaggggcttagccagccaaagggcagggataggaggctttgtctgctgcctgctggctaccatcttgagtgtgacttacaccagggtgcagacaaagtgagcttgacctggaagcctagaggcccaagaggcccgggtgaagcaagtatctctgagatcaagcctacccttcagctcagagagtggacccctgcctaggctcccacacatgatcctaggtcccagatatnccacccctggagcccgtttcaaggcccatcttccagaatgtttaaacctgtgtatgtaaccagtaaaatgggagtttgtactgtgtattgaatntntcttnttattggcctctgtgggctgctgggggagacctggagagttgtttattctagtntcccccaccccctgggantctttgcttttgcccagttttctttntctgttgtggataagattttgtagagttgtgtgttgtatgcttgtgtttgacc

SEQ ID NO: 650 - DNA, 401 bp, Mus musculus
  misc_feature (70)..(70): n is a, c, g, or t
  misc_feature (87)..(87): n is a, c, g, or t
  misc_feature (93)..(93): n is a, c, g, or t
  misc_feature (106)..(106): n is a, c, g, or t
  misc_feature (157)..(157): n is a, c, g, or t
  misc_feature (172)..(172): n is a, c, g, or t
  misc_feature (180)..(180): n is a, c, g, or t
  misc_feature (185)..(185): n is a, c, g, or t
  misc_feature (187)..(187): n is a, c, g, or t
  misc_feature (211)..(211): n is a, c, g, or t
  misc_feature (213)..(213): n is a, c, g, or t
  misc_feature (364)..(364): n is a, c, g, or t
  misc_feature (375)..(376): n is a, c, g, or t
ttttttaatgtctctgtggagtatttgtatgataccataatgtatatttctgtagaaacaaattatatanacagtatcaatatcatnataganaaataacactttnatgtatattgttctaaccaatcatattgtgaatcattttgaagttcattantagcgatattgatanaattgtgnacttntnttaatgtttttttttaattaaccnantattattttaaacctgagattctcacattcaccagttggtgagttttgaagaaaaactaaatttcatttcaactgacaaatgtatatggtttgagttcagtgtggaagaattttaatacaatattaaattacttgaactgaatagttcctngtatatatttnncctattcactgttgatatgtatgta

SEQ ID NO: 651 - DNA, 549 bp, Mus musculus
  misc_feature (320)..(320): n is a, c, g, or t
  misc_feature (324)..(324): n is a, c, g, or t
  misc_feature (337)..(337): n is a, c, g, or t
  misc_feature (377)..(377): n is a, c, g, or t
  misc_feature (419)..(419): n is a, c, g, or t
  misc_feature (524)..(524): n is a, c, g, or t
ctattttaggtttcctcaatgacatacaattttcttgtaaatttctaaagggaacttaaaaaaatgagagctactaaatgttatctttctgataaaacatttaatcattactccttgaaatgtatgaaccttgtgatatgctaagggttaaaaaataagtgtcgctgacataaagaattttgcttgagattgccaacattcaaaattctgtaaaagtacttttacatccacttatttgtgtttactaatgttgactaggaacagaagcaaaaatatctaaaacaaacttttttatttctacactctaaccgatatatttnaacnacctaagataatncgattaaccatatatacatcccgagcttataacaataagnatttgagataagcttttaaatttatggaagattttctttgtntctttggaagttcacttaccataaggtattttgtagtgtactttaagtaacagattttgttatacagggtaagccaaaggctgtacaagaattagtgccattggntctgatatttgtgttggaccatgaa

SEQ ID NO: 652 - DNA, 363 bp, Mus musculus
  misc_feature (323)..(323): n is a, c, g, or t
gggttacataatcaattcctgccaaccagaacctatgacccagatttggtcatgatatgcacaccataaatatgtacagtaactataccaatcaaaagaataaaacagcttttagaatttttaaatgaatatattttagaaagaccaaaacttatcggaatgccatttttgtgaaggatctttttaggggcggtctgggtctcacacggcctttgtttgcctgcactctaaagaagtatcctaggccctgtcttcacccctccagactccggggggggtgcactttaaagtcatcttcgtcattttgtgtttgttgtgagcanttttctctggctggctagacgtacagcgactccgtgtcat

SEQ ID NO: 653 - DNA, 273 bp, Mus musculus
aggttgaatgttacgactccctcactgcttgcctcctgcagtcggagctggtgaactatgagcgggtgcgtgagtactgtctcaaggtgctggagaaacagcagggcaacttcaaggccacctatcgtgccggcattgccttctaccacttgggtgattatgcacgtgcgctgcgctacctacaggaggcccgcagccgagagcccacagacaccaatgttctccgctacatccagctgactcagctgaagatgaaccgttgcagcctccaga

SEQ ID NO: 654 - DNA, 528 bp, Mus musculus
  misc_feature (175)..(175): n is a, c, g, or t
  misc_feature (182)..(182): n is a, c, g, or t
  misc_feature (184)..(184): n is a, c, g, or t
  misc_feature (187)..(187): n is a, c, g, or t
  misc_feature (190)..(191): n is a, c, g, or t
  misc_feature (194)..(196): n is a, c, g, or t
  misc_feature (198)..(198): n is a, c, g, or t
  misc_feature (205)..(205): n is a, c, g, or t
  misc_feature (220)..(220): n is a, c, g, or t
  misc_feature (228)..(228): n is a, c, g, or t
  misc_feature (230)..(230): n is a, c, g, or t
  misc_feature (237)..(237): n is a, c, g, or t
  misc_feature (249)..(249): n is a, c, g, or t
  misc_feature (251)..(251): n is a, c, g, or t
  misc_feature (254)..(254): n is a, c, g, or t
  misc_feature (279)..(279): n is a, c, g, or t
  misc_feature (281)..(281): n is a, c, g, or t
  misc_feature (313)..(313): n is a, c, g, or t
  misc_feature (315)..(316): n is a, c, g, or t
  misc_feature (318)..(318): n is a, c, g, or t
  misc_feature (324)..(324): n is a, c, g, or t
  misc_feature (336)..(336): n is a, c, g, or t
  misc_feature (341)..(341): n is a, c, g, or t
  misc_feature (345)..(345): n is a, c, g, or t
  misc_feature (372)..(372): n is a, c, g, or t
  misc_feature (381)..(381): n is a, c, g, or t
  misc_feature (402)..(402): n is a, c, g, or t
  misc_feature (410)..(410): n is a, c, g, or t
  misc_feature (417)..(417): n is a, c, g, or t
  misc_feature (431)..(431): n is a, c, g, or t
  misc_feature (440)..(440): n is a, c, g, or t
tacatttgcatccattcctgtccttgcctctcttctaccctcaccctttcacccagtcccaagctgtgtgccctctccattggctcttagagaaaacataacctcaactaagtcccaccctaagaaatctctttgacaactgtgtgatggcacacaaaatgcttcatctctgagnccagagnanccnatnntgnnncntcacagnctgctgacagtgcangtattgantntacaggntcttggagaagntnctnctcctcagaacatggacaaaggatncnacaggtgtaaatatagtaacaggacaaagaancnnanacatcnaaccaggtatcntcttncacntgcttttctgttttcaagtgctaaatncaaacactntgtattaattagttgtgtatncaaagatncttgttnccaaatggtgtttntgaataatntcaacatttccccagcaccactacattaactaaagacagaaaaaataaaataaaaacaaatgtggcaacctatgctaccaaatataaa

SEQ ID NO: 655 - DNA, 518 bp, Mus musculus
  misc_feature (303)..(303): n is a, c, g, or t
  misc_feature (310)..(310): n is a, c, g, or t
  misc_feature (314)..(314): n is a, c, g, or t
  misc_feature (355)..(355): n is a, c, g, or t
  misc_feature (368)..(368): n is a, c, g, or t
  misc_feature (375)..(375): n is a, c, g, or t
  misc_feature (378)..(378): n is a, c, g, or t
  misc_feature (394)..(394): n is a, c, g, or t
  misc_feature (417)..(417): n is a, c, g, or t
  misc_feature (455)..(455): n is a, c, g, or t
aagtgcagtggcgtttctaatggagagagaaaccacagacattttaaggaagacctgctttaaatcggcaactatgaccaactccattttctgtaggtcaccgtgtttcagtcttatagctaacttcatggtcaaaaacaacaactgaaaacatcaacacagacaggtcttataacatatctatatgtgtatatgtgtatatagagatccatgcaaacacacatgcatatgtatgcattcatatgtcagaaacaaaaggaataaacaaagggttatttccttcatatgacttttttttttttnaaatttnccanccaacagtcaccattctgaaataaataatacagggtactgnacatctctctcancaaatcnatncctacagttcctaagnacattgcacagtttgactctacnatagtactgtacctcagaatatgagatgttaactagtntctgcattgcttgtcaaatatccatttgttcttttaaaggacacagataacactatccattgg

SEQ ID NO: 656 - DNA, 489 bp, Mus musculus
  misc_feature (141)..(141): n is a, c, g, or t
  misc_feature (183)..(184): n is a, c, g, or t
  misc_feature (276)..(276): n is a, c, g, or t
  misc_feature (334)..(334): n is a, c, g, or t
  misc_feature (344)..(344): n is a, c, g, or t
  misc_feature (350)..(350): n is a, c, g, or t
atatgtcccgacagtgtgcaacggaagggaagtcctggactccaccacctcatctctgtgattgtgactcgcagttcagttctgtttataggctgttagacgaagtgctcacatgctgctccagaatatggaaacagaacnaaaacaacaaccctagtaccttcttttttttttttttttttnnagaaacagtaaaataaattatttttgaggactgtatggtatatagtgatgtgctacaactttctaggctgattttagtgcccctattaacancccctccccaggacatggaaataaccattgtttacagagctgagcattggtgacaggntctgacaggntcagtntactaaaagaaaacaaaacaaaacaaaaaaaacaaaaacaaaaaaataatacagtggcaatattaggtaacctttttcctatgaagtcttttgtaggttcttgttgtaactaatatagggtgagtttctacgttgtata

SEQ ID NO: 657 - DNA, 280 bp, Mus musculus
ttcatcatcttcatttgcttcacggcctccatctctgcctacatggctgcagcgttgctagagttcctcatcacactggccttcctcttcctctgcgccacgcagtactaccagcgcttcgataggctcaactggccttgtctggacttcctccggtgtctcagcgccatcgtcatcttcctggtggtctcctttgctgctgtgacctcgagggagggagctgccattgctgcttttgtttttggcatcatcctggtctccgtctttgcctatgatgcat

SEQ ID NO: 658 - DNA, 227 bp, Mus musculus
  misc_feature (99)..(99): n is a, c, g, or t
  misc_feature (102)..(102): n is a, c, g, or t
  misc_feature (181)..(181): n is a, c, g, or t
  misc_feature (186)..(186): n is a, c, g, or t
  misc_feature (190)..(190): n is a, c, g, or t
caggaacgtggcgttgattgatccacgtgcttgaggcctggcagcttgaccaagaaagatggggttcggcagctcctggggatgccctcacagcccccnaantggttgctgttgccttctggggtcctcggctgtgattctgaggagagtgtccaaggaacaggaaggactctgcctagangcctncctnaccgccccagaggcttctgggcctcagcttggctgtc

SEQ ID NO: 659 - DNA, 271 bp, Mus musculus
  misc_feature (55)..(55): n is a, c, g, or t
  misc_feature (65)..(65): n is a, c, g, or t
  misc_feature (77)..(77): n is a, c, g, or t
  misc_feature (80)..(80): n is a, c, g, or t
  misc_feature (121)..(121): n is a, c, g, or t
  misc_feature (232)..(232): n is a, c, g, or t
ggcgtcatctccgacatgacacagaccaaagaggccatcgtcagtgcctcctcantgcccatgtntatcattattgncgnggtcggacctgccatgtttgaggcaatggaagagctggatngtgatgatgtacgtgtatcctccaggggacgctatgcagagcgggacatcgttcagtttgtcccattccgagattatgttgaccgatcggggaaccaggtgctgagcatgncccgactggccaaggatgtactagctgagattcctgaac

SEQ ID NO: 660 - DNA, 490 bp, Mus musculus
  misc_feature (143)..(143): n is a, c, g, or t
  misc_feature (214)..(214): n is a, c, g, or t
  misc_feature (264)..(264): n is a, c, g, or t
  misc_feature (270)..(270): n is a, c, g, or t
  misc_feature (308)..(309): n is a, c, g, or t
  misc_feature (315)..(319): n is a, c, g, or t
  misc_feature (332)..(332): n is a, c, g, or t
  misc_feature (338)..(338): n is a, c, g, or t
  misc_feature (344)..(344): n is a, c, g, or t
  misc_feature (357)..(357): n is a, c, g, or t
  misc_feature (368)..(368): n is a, c, g, or t
  misc_feature (404)..(404): n is a, c, g, or t
  misc_feature (406)..(406): n is a, c, g, or t
  misc_feature (410)..(410): n is a, c, g, or t
agtacaacagcagccctcactttggacagcccagcattctgggttctagtccttgctgtcctgcacaattttgggctagcgatttgccctctctgagcctccctctgaaacagaggcggtggctcccctcccccacacttcanagtggctgggagggtaaggaggaggggtgcccactttcctctcctgcagccccaccactggctcctcgggngtgtggggtaaagatggcagcctcccatgtgcccgatcacccccttactnctgggncactccaggagagggtggaggatccagacctctggctnncctccnnnnngggagtcattggnatgtancccccntcaccctttcctnttcaccccagntcttggatttcaggtccctccaccccccattctgantntccntccttcccctccccaaccagggtttcccatgcagggtctggaagtgtgtgtgacacccactgagctgttattggaagtca

SEQ ID NO: 661 - DNA, 142 bp, Mus musculus
  misc_feature (105)..(105): n is a, c, g, or t
acatcttttaagtttcagctgcattctgatccccatagaaggaaatgtgttaagtataacagactccctaaagacataaatctgctgttgaagtatgggagctgntttaacggaaggatcattcacctacatcatggctaag

SEQ ID NO: 662 - DNA, 404 bp, Mus musculus
  misc_feature (236)..(236): n is a, c, g, or t
  misc_feature (241)..(241): n is a, c, g, or t
  misc_feature (269)..(269): n is a, c, g, or t
  misc_feature (290)..(290): n is a, c, g, or t
  misc_feature (347)..(347): n is a, c, g, or t
  misc_feature (350)..(351): n is a, c, g, or t
  misc_feature (363)..(363): n is a, c, g, or t
ttgcgtgctgcattggtattgctctgcatgtcttaattggtaactatttggatttcaatgcctggttggacactacatcatctttcccccatccatccacatccatggtaaagccacgacaaagcttgcactacttgtgtttggtgtggaatatagatgacgtctttgcctatctacagctctgttgtacttctgcggctctgatgttcctaggaactgcttggtttgttgatttnttcanctacctgttttttagacttagaaatttnatctaaaactgaagtgatctncaattgaagtctctttgtttcacttacctctacttgaatatgttactacacaaatangcnnaagcatttcttnatcatgatgtgagtttgaactatgaaggctcttggcattcc

SEQ ID NO: 663 - DNA, 274 bp, Mus musculus
  misc_feature (102)..(102): n is a, c, g, or t
  misc_feature (130)..(130): n is a, c, g, or t
  misc_feature (165)..(165): n is a, c, g, or t
  misc_feature (178)..(178): n is a, c, g, or t
  misc_feature (223)..(223): n is a, c, g, or t
  misc_feature (243)..(243): n is a, c, g, or t
gaaaaagacttgaatccaacccaagtatctttatactaaacatatcaggttccgtgtgtcacttgcagctcacagaagttttcacactacctggcataaacngactacatcgattgtaacatttttgttngagtatgcttctttttttatccatgtaatgtgttncctttaaaaacanaaatgatgactaaaataatgtgtgaggtggttcatccctaagaantcaacggaaggtcacttcantcgtacccttctagtgcttctaatgactgaa

SEQ ID NO: 664 - DNA, 304 bp, Mus musculus
  misc_feature (47)..(47): n is a, c, g, or t
  misc_feature (62)..(62): n is a, c, g, or t
  misc_feature (77)..(77): n is a, c, g, or t
  misc_feature (134)..(134): n is a, c, g, or t
  misc_feature (137)..(137): n is a, c, g, or t
  misc_feature (148)..(148): n is a, c, g, or t
  misc_feature (165)..(167): n is a, c, g, or t
  misc_feature (169)..(169): n is a, c, g, or t
  misc_feature (171)..(173): n is a, c, g, or t
  misc_feature (177)..(177): n is a, c, g, or t
gatacaggacatagcatggttctaaagtccctagtcgctgtcccatntgctccacctgtgcnaagcgaggctctcanccaggagacccagtctgcaggttgaccgtcctccgtgcagataggattggcaagccnacntgtgtgagtgnggcaccttagacctcannngngnnngggnggagccatgatcctgtgtgctgcccacccccacacctatgggcttgaatttgaccagatgagcggtggaccaggagatcgctgcttgtggggaccgacttgttctgttactcaccaggctgggaaga

SEQ ID NO: 665 - DNA, 184 bp, Mus musculus
aggcccaagggcagtgtccgttccacaacttgcttccaacaggagccgccaccctctctgaatggaagtagtggggagggtggcctctgccactgtcccctttcaggctccagagctccgaaaggccttggttcctggtccctcttgtccccaggcaggtcctgtggcctagcagttatatctc

SEQ ID NO: 666 - DNA, 421 bp, Mus musculus
  misc_feature (47)..(47): n is a, c, g, or t
  misc_feature (72)..(72): n is a, c, g, or t
  misc_feature (190)..(190): n is a, c, g, or t
  misc_feature (213)..(213): n is a, c, g, or t
  misc_feature (264)..(264): n is a, c, g, or t
  misc_feature (325)..(325): n is a, c, g, or t
ctgcatcacaacactactagcacattctcttgcaacactgccaacgntgggattgtcaccatagacttagtnggtactatatcatctcccatgagccggtgactggacctgcttcctgacctgccatccatcctcagatgagccacctgtacccttctgacagtgcagtgtgaagtcttagaagctgatnccctagaaagatcctagttgccntttgttgcatatatttactgcctgcttgagtgtttctctgtgtgggttctntctgtgtctcgtagaaatgttggggtgttttcttctgccataagggctcgtggcccgcganccaactcctttagctgtattcttccttcattttttgataagtggtttaaattctgtttcactttgtgtagtgaaccccatggtagttttctgatcg

SEQ ID NO: 667 - DNA, 501 bp, Mus musculus
  misc_feature (104)..(104): n is a, c, g, or t
  misc_feature (108)..(111): n is a, c, g, or t
  misc_feature (113)..(113): n is a, c, g, or t
  misc_feature (361)..(361): n is a, c, g, or t
  misc_feature (363)..(363): n is a, c, g, or t
gaaaaggacacgctggtcttcccaggcagggcagtgagcagacactgtaaatatttttacacaaaatttattaaagcaaaagtcatttcctgaagatccacccngggnnnngnctttgtgttggctttagaaatcaccacggggctaagaatacatttcctacatagctgcttcattgtgcttaaaggaagcaaagaagtcacgtgctaaattttaaagtctcagaaaaacatgggttttgttttctaccccctagacttttcagggttttctcttcttagctttgtcggagtatggggtaggacagggtctctagggatgcatgggtccctctgcttggtggaggctgcccaggtgcatngntcttctaagcagtgaggaagcctaggtgtatcccagttcactatgggagccccagtgtagccctgtcccctccggacatgctgcttctaattgtgttcacagcaaccatcttcactgatcaaccctgtgccacgtggt

SEQ ID NO: 668 - DNA, 497 bp, Mus musculus
  misc_feature (66)..(66): n is a, c, g, or t
  misc_feature (81)..(81): n is a, c, g, or t
  misc_feature (94)..(94): n is a, c, g, or t
  misc_feature (112)..(112): n is a, c, g, or t
  misc_feature (117)..(117): n is a, c, g, or t
  misc_feature (120)..(120): n is a, c, g, or t
  misc_feature (245)..(245): n is a, c, g, or t
  misc_feature (252)..(252): n is a, c, g, or t
  misc_feature (274)..(274): n is a, c, g, or t
  misc_feature (283)..(284): n is a, c, g, or t
  misc_feature (314)..(315): n is a, c, g, or t
  misc_feature (324)..(325): n is a, c, g, or t
  misc_feature (336)..(336): n is a, c, g, or t
  misc_feature (340)..(340): n is a, c, g, or t
  misc_feature (343)..(344): n is a, c, g, or t
  misc_feature (348)..(350): n is a, c, g, or t
  misc_feature (352)..(352): n is a, c, g, or t
  misc_feature (354)..(354): n is a, c, g, or t
  misc_feature (380)..(380): n is a, c, g, or t
  misc_feature (390)..(390): n is a, c, g, or t
  misc_feature (441)..(441): n is a, c, g, or t
  misc_feature (448)..(448): n is a, c, g, or t
  misc_feature (455)..(455): n is a, c, g, or t
acacagaccacatattccttctgggaaggccagcatcatcctgaagatgacctgtggggttggtcnttgatggctgtcccntccaccctacccntgagaagggaagctgccngttgntgntactgcacctcaccaccaactccctcatggacagacagatccctgatgtctgtcactatagacacacgtgttgtacatgtggcccttaacacttgacactcttaacactactcatggggctgggntagaggnaggcttgtggtttggggggttnttatttttnnctttcttttcttcctttcttttttcttttnntcttttttnntaatttcatantagnatnngggnnncngnagggaggaggggagggtaagtggggncaagtggggncaaggggacatatcattgtgacaacttttttgatatttactagaaatgatncaatatntcctttntgagatatttacagtattattaaagggttgggctgttttgca

SEQ ID NO: 669 - DNA, 464 bp, Mus musculus
  misc_feature (88)..(88): n is a, c, g, or t
  misc_feature (234)..(234): n is a, c, g, or t
  misc_feature (252)..(252): n is a, c, g, or t
  misc_feature (258)..(258): n is a, c, g, or t
  misc_feature (260)..(260): n is a, c, g, or t
  misc_feature (272)..(272): n is a, c, g, or t
  misc_feature (280)..(280): n is a, c, g, or t
  misc_feature (283)..(283): n is a, c, g, or t
  misc_feature (301)..(301): n is a, c, g, or t
  misc_feature (307)..(307): n is a, c, g, or t
  misc_feature (324)..(324): n is a, c, g, or t
  misc_feature (326)..(326): n is a, c, g, or t
  misc_feature (340)..(340): n is a, c, g, or t
  misc_feature (344)..(344): n is a, c, g, or t
  misc_feature (381)..(381): n is a, c, g, or t
  misc_feature (394)..(394): n is a, c, g, or t
  misc_feature (396)..(396): n is a, c, g, or t
ggcttctaaaattcactcccatggaagtctaggctttggactcgaatctgaaaagccacttattcatgtttggaaattgtggtgtggnccatagatgttcatgtaagaacggattgccccatctacacaggaaggtatttcatcactgggctgaatataaatctgattctggtttagtttttccttatttgataacattttggaagcagacgtgatggcttcacatcaatactnatcaatgtcaccagcccnatggtncnattggtgcagtntcagaatnctnagtggagaataagaactnacttanctttaattgagagacantncattattcgggttncttnacccatttgaggaaggatatttcactgagacttgtgntctcacaggattncntgctacagagaggataacgacagtgatggcatcaacagaagaagtgatttttgaactcgagtatatcc

SEQ ID NO: 670 - DNA, 435 bp, Mus musculus
  misc_feature (197)..(197): n is a, c, g, or t
  misc_feature (199)..(199): n is a, c, g, or t
  misc_feature (216)..(216): n is a, c, g, or t
  misc_feature (220)..(222): n is a, c, g, or t
  misc_feature (224)..(225): n is a, c, g, or t
  misc_feature (227)..(227): n is a, c, g, or t
  misc_feature (233)..(233): n is a, c, g, or t
  misc_feature (235)..(235): n is a, c, g, or t
  misc_feature (239)..(241): n is a, c, g, or t
  misc_feature (243)..(246): n is a, c, g, or t
  misc_feature (248)..(248): n is a, c, g, or t
  misc_feature (250)..(250): n is a, c, g, or t
  misc_feature (252)..(252): n is a, c, g, or t
  misc_feature (258)..(258): n is a, c, g, or t
  misc_feature (265)..(265): n is a, c, g, or t
  misc_feature (275)..(276): n is a, c, g, or t
  misc_feature (288)..(288): n is a, c, g, or t
  misc_feature (293)..(293): n is a, c, g, or t
  misc_feature (300)..(300): n is a, c, g, or t
  misc_feature (332)..(332): n is a, c, g, or t
  misc_feature (340)..(340): n is a, c, g, or t
tttccaaggctgcaaagggtttctcactatctgactcttgctgaacccagacttagttcttagcactccccagatctgagtatccttgcttaggggattgagtgctgactggtttgtttctatgttgaggggcaatattttaaaacttttgtcaagaaaatgtgttagaacacaggaacctaagcaatgataccatncnatatttcctgaaattancatnnntnntntcggtngnagannngnnnntngnangaaaanaaacaanatcatcctcnnaactgctaagantcatnttctttnaaatgtaatttagtttggaattatgactgtantctgttgnatagtatttaccatggtatttcatacccgtggtattttatactttgggactatcgattttagtattattagatgtttgtgtaatcacttgcttat

SEQ ID NO: 671 - DNA, 558 bp, Mus musculus
  misc_feature (193)..(193): n is a, c, g, or t
  misc_feature (198)..(198): n is a, c, g, or t
  misc_feature (208)..(208): n is a, c, g, or t
  misc_feature (257)..(257): n is a, c, g, or t
  misc_feature (291)..(291): n is a, c, g, or t
  misc_feature (296)..(296): n is a, c, g, or t
  misc_feature (316)..(316): n is a, c, g, or t
  misc_feature (323)..(323): n is a, c, g, or t
  misc_feature (330)..(330): n is a, c, g, or t
  misc_feature (342)..(342): n is a, c, g, or t
  misc_feature (349)..(349): n is a, c, g, or t
  misc_feature (354)..(354): n is a, c, g, or t
  misc_feature (359)..(359): n is a, c, g, or t
  misc_feature (370)..(370): n is a, c, g, or t
  misc_feature (376)..(376): n is a, c, g, or t
  misc_feature (391)..(391): n is a, c, g, or t
  misc_feature (393)..(393): n is a, c, g, or t
  misc_feature (395)..(395): n is a, c, g, or t
  misc_feature (402)..(402): n is a, c, g, or t
  misc_feature (411)..(411): n is a, c, g, or t
ttttttccgtcaagcttgaacaatgtaaatgattggaataatgtaaagtcatattttcatgttttcatagttatgacaagaacacttaatgtaagagtatttcgagtatgaataatgttgattggctaacacagagctcagttttaggcagtaaaatctagttcaatatccatgtaacaatgcatcagtatanttgcngtatagatgngtctgtgtgcatataagtgataagtgctcaacaaagagtggtgacagcnctctcaaggttttttttttaattcattttctatnaactngttatggaaagaccaaaatnattatgnactattnttatgtaaattnacaattntcctntactntacattttgtntacagntatagtaccttattntntnctgtgtnaagtgggtntcatactccaaggagacaaacactttctacaacttctattgaagattctgggatttccaatttttcatgtgtactatgtctgaaaatgcttttgattttatttttaaatctaacatctgatggatttttcagagtgttgtgaaacct

SEQ ID NO: 672 - DNA, 73 bp, Mus musculus
caatgcctggaccattagcaaccatgttttacctaaagaaaaggccaaaagatccataaaccctatgatcatc

SEQ ID NO: 673 - DNA, 478 bp, Mus musculus
gggttgtcaccttacaggtacatgtgttgttctgacatgtaatgaggagtaggacaggacgtctgggatagagtaggaccacccaagggacttagcagtccccagggaaatggcaaatcatggagagacctcaaggcaggtcatccagaggaaccatagtagctaccttgatactctgtgactctgttagtcccaattccgtctctctcgctgcttcccaccagagattgtaggcctagcctcctctgcacatttgggtgagcatgtgaccaggtatggccaatgaaattgaagtggaagtctataggagctactagaaaagcccatgccttttctgagagccttgctttgtttcttccttcttgattgaggatgcaatgcctggaccattagcaaccatgttttacctaaagaaaaggccaaaagatccataaaccctatgatcatctgaccaagcaagtgccaacagctctccatc

SEQ ID NO: 674 - DNA, 199 bp, Mus musculus
  misc_feature (34)..(34): n is a, c, g, or t
  misc_feature (47)..(47): n is a, c, g, or t
  misc_feature (166)..(166): n is a, c, g, or t
tctttgattgttccaatgagaatccatggctggnccgctagttactntctttattaaatccatcccccaggttagagttctagtgacttgtaacaaatagtttacaactgaactacaactatagatgcatacaaatatagatgcatactgtactaaaataaaaagntcgttcctggtatgccaataaagcgtttttatg

SEQ ID NO: 675 - DNA, 56 bp, Mus musculus
cttttcctgtgtgcagaactgactcattgctcggaatgtcagacacaaacacgaca

SEQ ID NO: 676 - DNA, 514 bp, Mus musculus
  misc_feature (338)..(338): n is a, c, g, or t
acacgacaaacaatagcacttcatctttttgagtaacattgccaagagaagaattttcctgggagagaggtttcccatcaggcaaatctcctgagtccccggcactagcactttctgggggactgtgtagaaacaaagtgttctttggcatccaaactgagagagagaggcaggtggcagcccttcttgagatatgaggtggccatcttatcagatctttgccctggagctcatgaaaagcctttctgttgtgttatttgcagtgcagatgatgtccttgtggcaacttaatggttcttcacttttttttccttcaattttaattttttttttttttngctgtgttatcaaaaacttgaatactgtgagaagtgaattttcagttgatgaatcagcatcttgttcccatggtgataacactaattgaatatatctatgagggcatgtattagttattggaaaacaatacaacactaacaatacatagctgcaatgttgtacaatggctgattta

SEQ ID NO: 677 - DNA, 447 bp, Mus musculus
  misc_feature (397)..(397): n is a, c, g, or t
  misc_feature (413)..(413): n is a, c, g, or t
ccagtctgaggcctgtgtagtcacagctgcccatgagttgagctgctaagataaagagcccgcagatgatccaaatgcaaacgggctcctgcgagcctcctttcctcccagtgtgctgcctagggacagcaacaactgctttgcccaagcagcactggaaccctggattgttagacatgggggcttatttggatactgccctattgccaaatgacttgctggttactggttcggctgctcatgtacaaatgtgtgaataatattgtgcccaccagagggggagatttttatatatagcaatttgttttataaattaaagaaagtgaaggatgtattgaaatgtgactactggggggggggtgggaaacaccctaaagtttgcaaatggctctgggcnaagaaagcgtgtgttntcagacactggtgacttcatgattgtaactcggt

SEQ ID NO: 678 - DNA, 417 bp, Mus musculus
  misc_feature (274)..(275): n is a, c, g, or t
gctatcagttaaccgatgaagtcgtttactaaatacagcacagctatgtgcgattttgaatacatacaaccttgaaactttataaagcccatttttatgactttctgcaggtgaatagggatcatgcccttttataattcacagtgtgccacaaagatcacaaacactgagggatactaaagctcttctttgttttggcagttactgtcaggccagtttctgtggatttgaatcctccactattacccattagagtgttttagacatttggggnnggggatatcaaatactgccctttgaaacttcccagaaaggtaaagctcacaactccatgtttatttctatggcttgagttaccctctgctgtgtgcagacatcataaagaggtctacttggtttcgacctcagatccagagc

SEQ ID NO: 679 - DNA, 495 bp, Mus musculus
  misc_feature (120)..(120): n is a, c, g, or t
  misc_feature (154)..(154): n is a, c, g, or t
  misc_feature (189)..(189): n is a, c, g, or t
  misc_feature (242)..(242): n is a, c, g, or t
  misc_feature (251)..(251): n is a, c, g, or t
  misc_feature (254)..(254): n is a, c, g, or t
  misc_feature (280)..(280): n is a, c, g, or t
  misc_feature (331)..(331): n is a, c, g, or t
  misc_feature (367)..(367): n is a, c, g, or t
  misc_feature (370)..(371): n is a, c, g, or t
  misc_feature (375)..(375): n is a, c, g, or t
  misc_feature (429)..(429): n is a, c, g, or t
ccatgatgctaaactgcttaattttgacctgtttatttccactgtagcagaaggaaaattaactggaataaaaataccaatttaactatggcatggaaaatgccattttgtaaatcaacnaaaaataaaacattcttcaaagacttctcacttnataaaaggtcccctgactactttgcaatgagaagnctatgcctttctctttttctccccacgccttcctttcccctctgagacagggnttctctgtntanccctggttatcctggagctcactctntagaccaggcagggctcacactcagagatccacctgcctctgcctccaaanttctgggattaatggtgtgcatcaccatgcccagcnaannctcngcttcttgagtgtgtaacgtgacattgaagcttgggaaggaggattttaaagtncagtgcaggggacccagggactacactgtacaggctgcttggttaatagttcagttgtacaaaaca

SEQ ID NO: 680 - DNA, 491 bp, Mus musculus
  misc_feature (92)..(92): n is a, c, g, or t
  misc_feature (107)..(107): n is a, c, g, or t
  misc_feature (152)..(152): n is a, c, g, or t
  misc_feature (164)..(164): n is a, c, g, or t
  misc_feature (276)..(276): n is a, c, g, or t
  misc_feature (321)..(321): n is a, c, g, or t
  misc_feature (375)..(375): n is a, c, g, or t
  misc_feature (403)..(403): n is a, c, g, or t
  misc_feature (413)..(413): n is a, c, g, or t
  misc_feature (425)..(425): n is a, c, g, or t
  misc_feature (444)..(444): n is a, c, g, or t
ggaacaaacttaacctagaactgctcattcagactcctgaaacgacccagagagggttcagaaacgccccaggaagccccaggcccttcctngcgtgattgacgatntgagttttatctctcacacctacaaggtggaagaggagaactggntccccacagttntcccctgaccctcacccctaacccccaatcacaaagaaaggtaataaaaatataaattccaaggattaggaaaagtggaatgtttttgcccctcaaagtccaccccctaganagcaatgccctctggacttgatcctgagcctaataaacctgtgtncactcctttaggtcccagcactttcttcctatgggtggtccagacaaaagtatntcctcctgtaggacgctagagggcgctntaggacagcntcggatcctgtntctggcaaccccttgcaancccacggggcttcctgggtgggaggaagagggttcaggcacttccca

SEQ ID NO: 681 - DNA, 529 bp, Mus musculus
  misc_feature (462)..(462): n is a, c, g, or t
gcttagaactcactcatttgccagaggggtccagtctgctccccccccccacacacacacacactctctaaaaccacaactcaaaagaaaggtcaggaggtgcagacaaatcgcacacctcagacacagtgggcaaggaaggaaaagggtgttccctgtggctcatgctggcaggatgaggatgcttgggattctgagggagtttgcatgatcttgtcaccaaacgatccttttcaaaatacaagtgaggagatgtggaggcgtgcagcagagcagatgaggaggggggcggcagtggccagccttccctcctcggcaagatgtaagggacacggccatttgctatgctaaagaaacagcccttcaccggaaggttctcaccacatcctcccccttaccttcactacatccctttcagagagccaggccaccaccagggcccctggcccgcccacttacatntgccaaagtgaaatgttgcatgccggcgtggaagacaaaaccaaaccgcacaaatcccagtgtgtat

SEQ ID NO: 682 - DNA, 528 bp, Mus musculus
  misc_feature (219)..(219): n is a, c, g, or t
  misc_feature (291)..(291): n is a, c, g, or t
  misc_feature (295)..(295): n is a, c, g, or t
  misc_feature (298)..(298): n is a, c, g, or t
  misc_feature (304)..(304): n is a, c, g, or t
  misc_feature (307)..(307): n is a, c, g, or t
  misc_feature (312)..(312): n is a, c, g, or t
  misc_feature (314)..(314): n is a, c, g, or t
  misc_feature (324)..(325): n is a, c, g, or t
  misc_feature (328)..(328): n is a, c, g, or t
  misc_feature (330)..(331): n is a, c, g, or t
  misc_feature (337)..(337): n is a, c, g, or t
  misc_feature (342)..(343): n is a, c, g, or t
  misc_feature (360)..(360): n is a, c, g, or t
  misc_feature (374)..(374): n is a, c, g, or t
  misc_feature (388)..(388): n is a, c, g, or t
  misc_feature (419)..(419): n is a, c, g, or t
  misc_feature (465)..(465): n is a, c, g, or t
  misc_feature (470)..(470): n is a, c, g, or t
  misc_feature (481)..(481): n is a, c, g, or t
gtcataagcaaataactcacctgtcagattttaaatggtattgaacacaaaagaaagctgttgtgttttgttttgttttcatgaaactgtgatttttcaacttatgaatgctataatgtcccagtgcgggaagctaactctgtgtgaatatcaacttgtataaaacaaaccaactgacctatacacaaacatttttcataggcactgtataaagagaanatgtatgtttattgactcaaatcagtttttcagagaggaaactttactgagatgaagaagcgggtaaattgntttnttnatttanaanaaaananaaacttgcannttntnnaaaaantgttnnattgcttcaaatttctnctattaacttcaanctatgggagtttgncggtagtcaattgaggatttttttccatttnttttctttttgttgttaaagctgtacttcagtgaacagaaaaattnccaancaaactaatgnccgtaaaagtgtaaattgcatgtgtgggcataattaccgaacctcat

SEQ ID NO: 683 - DNA, 479 bp, Mus musculus
  misc_feature (34)..(34): n is a, c, g, or t
  misc_feature (222)..(222): n is a, c, g, or t
  misc_feature (237)..(237): n is a, c, g, or t
  misc_feature (255)..(255): n is a, c, g, or t
  misc_feature (262)..(262): n is a, c, g, or t
  misc_feature (265)..(265): n is a, c, g, or t
  misc_feature (271)..(271): n is a, c, g, or t
  misc_feature (273)..(273): n is a, c, g, or t
  misc_feature (287)..(287): n is a, c, g, or t
  misc_feature (293)..(293): n is a, c, g, or t
  misc_feature (303)..(303): n is a, c, g, or t
  misc_feature (319)..(319): n is a, c, g, or t
  misc_feature (349)..(349): n is a, c, g, or t
  misc_feature (414)..(414): n is a, c, g, or t
  misc_feature (430)..(430): n is a, c, g, or t
  misc_feature (432)..(432): n is a, c, g, or t
ggctaactgttcttggtttctaagctctgtcttntacattacatttatggctccttaacctgtttgcctaaccaaccaagggcaattcccgtccatccatcacacgggatgtgagaaggatgcagccatggtctgcagcctctctcatgaagggttatctggccatggtacttggctgcttcataacttgctgtcactcctgatgagataagtgtgtctttnaaaatagtccccgtntcaggtcactggggtgtnatgtacnacnatcctnanccatccattttttncttttntttttttttnccctgagagactcccnatggcatctatagaggactaaagaagaganccgttccctcactgagtcagactgttcacagttcattatgtattttatgatggcttgtttggganccgatactttcagcantntcaactgtgttgtgggatctcctgatgctggtttctgagcttttgtt

SEQ ID NO: 684 - DNA, 324 bp, Mus musculus
  misc_feature (299)..(299): n is a, c, g, or t
aagtaccttccttgagttacacaggatactttaccagagaactttcccgaatttgctgctgtcacatagagtcccactttcactctgtgacctcacactaccaatccatggccttgtgtctcagcagtgagtaaactagcccacttcctcatttatttttgtgggtctcaactgcagcattttagaagcaaactttgatctgacactcaggagaataaacacaaatagagggcagaatgtatttggaaaagtttatgataaatttacttatattatttaaagatcatttaggatcatanatctacgtacctccatgatattttt

SEQ ID NO: 685 - DNA, 478 bp, Mus musculus
  misc_feature (316)..(316): n is a, c, g, or t
  misc_feature (405)..(405): n is a, c, g, or t
aaagagttcatatttctggccattttctgtaagccaactgaaccaatggtaaaatattttgttacttttggaatgaactctgacttcatgtcagtgtgaactttccatcacagtaacattgactctttgggcaaagaactgccctggtggagtaaatttcccaggacactggtgagtgtaccttggactgattacctcttctactgcattgaaaggtgccatgttttcctgaatgactaaatccccctcaccttgtaagtgacctcccagagtggctcatgcaccatagctctcctagggacggcccacaaacatntcattcgtgactcatttttctacttcccaagtcagtagatgtgttcaaggtaagtacaggattgttctcgtaggaataggcggttgctntcctgattggtattcccgtcgatttcatttcattgtaaagattaaacttaaacccggttttgcttaagcacat

SEQ ID NO: 686 - DNA, 397 bp, Mus musculus
  misc_feature (291)..(291): n is a, c, g, or t
  misc_feature (321)..(321): n is a, c, g, or t
  misc_feature (334)..(334): n is a, c, g, or t
  misc_feature (348)..(348): n is a, c, g, or t
  misc_feature (369)..(369): n is a, c, g, or t
gagtgagacacttcagatactgcaagctgattcatagccctctctagagaccattttaccagtgcaaaattagaccgtttctttccatgataataatggttaccaagttggatgtccttggcttttgtgaactgaatgagtcccagttggcctccatttcaaagtctttaacagagatatcctatgtagtttcccctgggtttcctttctctaaagaggagggttgaggcctgttggctgcctgggtaatgtcaccttacgcagagttcccaaaggttggtaggagggaantccttcgttgcttctcactatgctgcagtntcctgaattcacnatctgtgggtattntcctctgccctgttgttcaancctttatcacatggatggattcttacct

SEQ ID NO: 687 - DNA, 518 bp, Mus musculus
  misc_feature (103)..(103): n is a, c, g, or t
  misc_feature (128)..(128): n is a, c, g, or t
  misc_feature (309)..(309): n is a, c, g, or t
  misc_feature (351)..(351): n is a, c, g, or t
caacagagccatcaggagccaagattgggggccctcaccttcaatcccaacacttgggagacagaggcaaggggatctccgtgaattcgaggccagcctcatntacagagtgagttccaggacagccnagggttgtagagacaccgtctaaaaacaaaataaaacaaccaaaactgttagacctgctgcagcttgagccacccaggagggacttccaacctaaggagaaggttggtgggcatgggggggtgtatcctacacagaagccatatacactggccagatgtcacatggcactttccatttccntccccacttcagggctggctcctccccctcacgctccagggntggctcctaccccttcagactcctcccccttccctctgctttgtgaagctggttggtttttatttctgattaaaaaaaaaactttttcccgtgtgccacgcccactctcccagtgttactattgtgtggaatgaggtcacaggagagtgactcctccataataaaag

SEQ ID NO: 688 - DNA, 527 bp, Mus musculus
  misc_feature (135)..(136): n is a, c, g, or t
  misc_feature (138)..(140): n is a, c, g, or t
  misc_feature (142)..(144): n is a, c, g, or t
  misc_feature (325)..(325): n is a, c, g, or t
attgtgttcctctgagctaagcagcctcaggtcggccacaaaacacggactgctttcaagcagttaacgtagacatttgccagtgacccaaaccacaaggcgttattgcctaatcccacatcaccaggcagagcnntnnncnnntttttctgtagctccgggttttgtttaagggcatcggacaatgcacaaagaaagactctacattgtgccagggttctttgggctcctttctggggatggcactgtggaactcttcttgagataatatttaatgctttcttatcgtgattgtgatgtttagttgaaaactactgctgcatancaagtcttgtgactcctcctgtgtccacagaagctcttgtctgagtttaaagctataaagtgtattcacattgtgaaattattattattattattaattattattattattgaaattcattgtgtacaaatggtatgtgctctgttaggtatttagtttgtgtgtgaattctgtatggaaagtggttttgttctctgagttt

SEQ ID NO: 689 - DNA, 458 bp, Mus musculus
  misc_feature (30)..(30): n is a, c, g, or t
gacaactcttctcaagtgtgtgtgctttcntgctccaatggttcacgcttggaaggaatcaaatatcctcaaaccctttcacctggtgatgcacagaggggaaaatgtcttgctattcttaatggagatactgcattttaactcaatttggttaattttagtattaaaaccatggaaatggtgaaatccaagtgggatcattttggcagtaattttgagaccctgtccatctggatattggagaaagagaatgaactcagttccttggaagcgtcagcatctgccgcggatgtgcagatcagccaaatcaaggtgacctgcacccacgttatgttactctctcttcctttaagaacatctttcttagatttgtatcacccaaagctctctgatcccaggacagatcttccgttcttctgtggctcttttaagttaaattcatgccaagcttagagctc

SEQ ID NO: 690 - DNA, 466 bp, Mus musculus
  misc_feature (38)..(38): n is a, c, g, or t
  misc_feature (269)..(269): n is a, c, g, or t
  misc_feature (276)..(276): n is a, c, g, or t
  misc_feature (288)..(288): n is a, c, g, or t
  misc_feature (301)..(301): n is a, c, g, or t
  misc_feature (303)..(303): n is a, c, g, or t
  misc_feature (305)..(305): n is a, c, g, or t
  misc_feature (379)..(379): n is a, c, g, or t
  misc_feature (425)..(425): n is a, c, g, or t
  misc_feature (430)..(430): n is a, c, g, or t
tttttaccagtgtgaggcgacctcactccagcaagctntaggcggctgagaacaaaaagaagtctaatcactgttcgtttttttcttttcttttctttcctttgtgggaacatttcacctgctgagtgtatatgaatttgctttctaaaaaaaggcttttatgggtttacagtagggccagtggaagggagagttaataagggctgtttttacaaaacaaacaaaactaataattttaaaaagacacttcacattccttcctgttctcnaactacnacttgggaagtncacttcgggtagntntnctgtgtggctgagagatgaaggaaacccatagacaaggacctcctagtgaacaaaatttagttgttaactttanagctataaaactcccccaggcgttcgttttcgttcagacagatctntcctntgcatcatgcttaaccctgcgacatgcgtacagtat

SEQ ID NO: 691 - DNA, 528 bp, Mus musculus
  misc_feature (335)..(335): n is a, c, g, or t
  misc_feature (344)..(344): n is a, c, g, or t
  misc_feature (376)..(376): n is a, c, g, or t
  misc_feature (383)..(383): n is a, c, g, or t
  misc_feature (410)..(410): n is a, c, g, or t
  misc_feature (468)..(468): n is a, c, g, or t
  misc_feature (502)..(502): n is a, c, g, or t
agcgtggctagctaagctatccttccctcacgccttttcttctcctagttgtccaatagccaataggactcctgcatgccagggggacagcagtatcctcacacctgttaatgagttcaagtgtggtgttcgctctcgctagctgagactataccttgccagggagtctggagtgtgcctcttgaacctgtatatgtggtcccaggctttgggaaatcagggcattaaagaaaacaagagaggaggaggagggaaaaagaaggagggagaaggaggaggagggaggggggaggaggaagaaaagataaaaaagctctgttcagagccccaggtancctcagagncctagggtccttaagtttctttagagggaacncaacctnccttggcaccagatacctccaacttancccccggtttcagagcccacatagctctgagctcagggcttcactggaccactgatgnccgttcttgtttaaatgcagctcctccaccccancccactgttcgctcttgtagtagtta

SEQ ID NO: 692 - DNA, 338 bp, Mus musculus
ccataggctgcaattttccctcttgcccttggctcctggagcaaaaatgttaagggtgctcctttcccctgcctccagtcagagcacacaaggtcttgaggaagtgtccccaggaactaccttctactgggcccttggagcccagtggcttgaagtagtggctcctttgttttggagccctctgatggggttcagtgaggatttctgaacagaggcaacgttgaacagagttcatgatcaatgtgttcaagcaggtagcatacatagcttttcactgagactcctcttcacctatacaggcacaggacaacaaatcccaggctttagggccaaaggct

SEQ ID NO: 693 - DNA, 569 bp, Mus musculus
aacagaatcttcaaatccccagggaatcccaaacttaagaccccaatcccaagccctcaggaaaccccaactacaaggtcctaaggactgggaggaaggaccctgttgccaggctctcagggcatctcaaacctgactcccaggcaccaggagaccccaaacaggaagtcccatctttggaacaaggatagaggactctaatactcttagtccatggatcatctaatctctcaacctccaaattccatgggccccagcttcaagggaacccccaagtcccaaatctctgattactaatatgtgcagggccccagggctctaacaggaccccaagtcatggagtccctacttcaatctaccttccggtcacaggtccaagacactaaatctgagtcattggccccaaaggacttcacagctcctgggccagaccaacagcctgcgggagaacctgagggccccataggtccagagcagacctggggccctgaccaccaaggacagctcacgactgccccttcactgcatgtccctaaaatcagcatgactcctgtcctcttcaataaaga

SEQ ID NO: 694 - DNA, 455 bp, Mus musculus
  misc_feature (134)..(134): n is a, c, g, or t
  misc_feature (292)..(292): n is a, c, g, or t
  misc_feature (344)..(344): n is a, c, g, or t
  misc_feature (397)..(397): n is a, c, g, or t
aactgcttcctaacagggttttgagttttaaacaactgttgagtaaggaccagataactgccaaaggaaacactggtctgtgaagtctgcttatttactgagaactgtgtatcaacttttaaacacttcccatntgtgcagataaaaggggaatagggctttctgtagaattctatctgtctagtttgtaaagtgtcatgtgtactgcagatgtctgttctctgggctttatgttctgtacagtagatttcattaagaaaaattgtggacaaacttgtttctgtggtttgantgggggagaatggcgatgtgtatttaaatagctatcctgtgagatagaaatntccccaaagatctggaagtaaccctccctggccctcggaaaactctggctatntcctaggttctaaaatgaagatgtatggatactctggcagactgcatgttgtataatt

SEQ ID NO: 695 - DNA, 327 bp, Mus musculus
  misc_feature (40)..(40): n is a, c, g, or t
  misc_feature (198)..(198): n is a, c, g, or t
ccagttctaataccaggttccaagtaataactataatatnaagagaactgaacatttaatttagggctaggatacaaacttcccgatttatttgggtacctattcttactgagtttccttgataacaatctgttcctgatacccagtgataaacagttggaatatgcataactaaaaagaagagtgagaattttaaangaccagtaaaatggtctaaaaggagaatttgattctgggaaggaagaaaagacctggtttgattaagtttatcaactcaaaggtctgctcaccttcctgttgaagaatcaagtcagtctgagaggctgt

SEQ ID NO: 696 - DNA, 156 bp, Mus musculus
  misc_feature (53)..(53): n is a, c, g, or t
ttctgcaagtaaacctgtgttaacacttgtcacactgcagagtttatgatacnataacacttcctacaatgaagaaaaaaacatttgtttgttttctaagaatgtttatttgtaaacatatgtattcactatattaatatgaatttcttacctggc

SEQ ID NO: 697 - DNA, 484 bp, Mus musculus
ggtgatgcacactcggaaacggcactcggaactctaccacgaactcaaccagaagttccacactttcgaccgctaccgtagccagtcctcagccaaggagaaacccagcccccccgggggacgccctggcttgtcccagcacaggaggcatcaaagctggagcaccttcaaatctatgacactgggctcactgccccccaagccccgagaacggctggccctgcaccggacagcagcctgggagcccacagaaccgccagacggcgacttccagacagaggtgtgagtgccacgccggactgcccactgcacagaaatatatatctattttcacactccactttggaactaccaggagccagcgcccctccccctcccgaggctgggcaggaggcgcagaggactcagcctggctgggggcagccagactggcagggcctggggggccagggcccctccttgttctcagaggtcccttagccac

SEQ ID NO: 698 - DNA, 467 bp, Mus musculus
  misc_feature (85)..(85): n is a, c, g, or t
  misc_feature (96)..(96): n is a, c, g, or t
  misc_feature (98)..(98): n is a, c, g, or t
  misc_feature (103)..(103): n is a, c, g, or t
  misc_feature (108)..(108): n is a, c, g, or t
  misc_feature (116)..(116): n is a, c, g, or t
  misc_feature (118)..(118): n is a, c, g, or t
  misc_feature (120)..(120): n is a, c, g, or t
  misc_feature (124)..(124): n is a, c, g, or t
  misc_feature (127)..(127): n is a, c, g, or t
  misc_feature (129)..(130): n is a, c, g, or t
  misc_feature (134)..(134): n is a, c, g, or t
  misc_feature (149)..(149): n is a, c, g, or t
  misc_feature (153)..(153): n is a, c, g, or t
  misc_feature (161)..(161): n is a, c, g, or t
  misc_feature (164)..(164): n is a, c, g, or t
  misc_feature (168)..(168): n is a, c, g, or t
  misc_feature (170)..(170): n is a, c, g, or t
  misc_feature (178)..(178): n is a, c, g, or t
  misc_feature (181)..(181): n is a, c, g, or t
  misc_feature (218)..(218): n is a, c, g, or t
  misc_feature (224)..(224): n is a, c, g, or t
  misc_feature (228)..(228): n is a, c, g, or t
  misc_feature (230)..(230): n is a, c, g, or t
  misc_feature (247)..(247): n is a, c, g, or t
  misc_feature (270)..(270): n is a, c, g, or t
  misc_feature (285)..(285): n is a, c, g, or t
  misc_feature (291)..(292): n is a, c, g, or t
  misc_feature (331)..(332): n is a, c, g, or t
taataactgcccctgtgttaatgaaaaggaacgtttttaatcattcaaaaatttttgttacatgtaaagtgccattgtgaggaangtgtgggtgtncnaaaangtatntgtcaagntnanagtnctntnnattnaaaaaaaaaaacttnatangattatcnaanggtncngttaatanatntgttggacaatgggtgtacccattttcacaattattntcaaancaantntatgttcagatgctttnaaattttatcacatgatacaagnatataactttgtcancctttnnaagttccttttcttttactttcttattttttttccttcnnaaatcaatgaagacttgatttctgtcaatcattgtattgagggtgaatatactacctgaattttgtgcatgttacattgtagttgtaaccttttctaattcaggatgaatacaagatggttgtgattgtgcagtg

SEQ ID NO: 699 - DNA, 363 bp, Mus musculus
  misc_feature (95)..(95): n is a, c, g, or t
  misc_feature (214)..(214): n is a, c, g, or t
  misc_feature (216)..(216): n is a, c, g, or t
  misc_feature (223)..(223): n is a, c, g, or t
  misc_feature (240)..(240): n is a, c, g, or t
  misc_feature (317)..(317): n is a, c, g, or t
  misc_feature (321)..(321): n is a, c, g, or t
  misc_feature (327)..(327): n is a, c, g, or t
tccttccagggaacacttcaaatggccagtggggttcatccagtttagagggctcaggcagtttcccagacagcaggctgtgggaaagtgtcccntgcagtggcgtatcagtcctttgctttgagcaggtcagtggagcatcaggggccggatatggctcccggtatattgtgggtcacagactcaaatccctctgagtcctccaagtcttgtntntgtgagnacctgagattaacaagntaggggaggctggtgagagggcagaggttgagagtgcttggcttgcatctttaagaggacccaggactcacaccaangggnctcacnactccagctccagggacacacacatcatttaaaaca

SEQ ID NO: 700 - DNA, 505 bp, Mus musculus
gaagggctgttcctctaggcaagttgggtggtgagggcactgcctctgccctccagcctggcacagcacggctttatcccgtctgcactcagcgcaaatgccagtacttcacgtgcttggcttcctgcccccagcagccctaacaacaccagaaagcgttcctggtacctcctaaaggagtggcctctagggagatcttccttcccctttggccatcatggaggtctgcggaccaccctgtccatccctgtctgtctgctttggttttccctccccactgctccctctcactttttaactggcctcagagcaaagctcaacgttctctctggctggtgatcaaaggggccccgtgtgcctgcctggctcttcacttcagagatgggggcatgtttgtgttgggcggccgatgactctctgtaaggaaaggaaggcctgcacgtgacttgcggggtctctacctcgttgctgacattctgaggacattttctagtcactgtgctac

SEQ ID NO: 701 - DNA, 327 bp, Mus musculus
gtgaggctcaaagctctctgagaaaccgtgacagaccaggatgtcccctccgaggctcaagatgggaccaagtaggggcattaagtccctcactccccacaccaattcctgggtccatgcacagctttttcagtatagcccaaggaagccacaagacatccttgggtgtggtatggttcttccattccataccctttcttctgtgttagcctgcaggatcccttaagtacccttattccaataggccagggtggggggtgggggcgtgtcaagttgggaattttacacaaggactttgctgcccccttctggctgttagaggaaaag

SEQ ID NO: 702 - DNA, 515 bp, Mus musculus
  misc_feature (265)..(265): n is a, c, g, or t
  misc_feature (403)..(403): n is a, c, g, or t
  misc_feature (419)..(419): n is a, c, g, or t
  misc_feature (434)..(434): n is a, c, g, or t
accaacacgtccagctatgagtacacggatgtgcccttccacaaccagtattcgcacatctcgatgctggattacaaccccagggagcgggccctgtatacctggaacaacgggcaccaggtgctgtacaacgtcaccctgttccacgtcatcagcactgccggggacccctaggtgcccctgcaagggctttggggagccttcccacatcgcctgtgacccccaccccagccttctcttggtcatgcccttgccttcctagatnccgtctccccacttccccagcccagctttctgttctcagtatctctacccatgcatttcccccattttattgatctctgcttttgatactccacttctgagtctttctgcctttttatggatgcttctcttccttatngatcgaacctctcttntcctctccctccatntactctccctcctcttcctttcccactttcccacattccttacccctcactcccaccctatccctggatctgagtgcatgg

SEQ ID NO: 703 - DNA, 561 bp, Mus musculus
  misc_feature (163)..(163): n is a, c, g, or t
atccaaacttggtctgagtgagatagtatccacttcataactacaaattcatttgtatgatagtgagagtggaggtttaaaattggacaatggatgtcccatacctttaatcccagccctcgggagacagaggcaggtggttatctgtgagttcaaggctagnctgctctgtagagtgagttccaggatagccagggcttgtcttgacacaaaataaaactgagcaatccagcctagtgtgatggtacacacctgtaaacttggcacttaaaagacagaagcaggaagatctggagttgaaggctagcctgggctacataaactctgtcacacatacacacacaaaacttgtataatgctgtagtgatgtgtttgctttatcaaaatgctcaaagcttttaaaagtgctgacctattagacttgcaattccatttaaatgttcaggagaatttaattgaatttgtaatcggtgtttaagtgatttgacttgtaaaatttgttgtaaaaattgttgatttgttggctatgtgcttttgtgttccattttgcttaagtaggtt

SEQ ID NO: 704 - DNA, 558 bp, Mus musculus
  misc_feature (167)..(167): n is a, c, g, or t
  misc_feature (495)..(495): n is a, c, g, or t
tgtgccatgtgagccagatctttggctctctatcacaccatcccttgctctctgggctaatcccctggggagttcctgatgaattccccgcctcccccccagctccctgtgttttcatcttgttcttgctgttgtctggatcaggagggcggggagggtggactccntgagacaagacaagcaggtagagacagattagagggagggattgtcatagtaacattttccgaggtgacagagatgatacacaggcagctggacttctgtgaaggacagaggagctggcagacccacagggccacacctctgagggaccggtgaatggctggctaccagagacagtgctggtagacagtcaggtacctcatgggatgggccaagagatctgggatcctgggaactatgtagagaagaggatttgacaccccccacccacccacccaaggcccttcccctctgctgacagcattgttgtggtcgtggcctgctgccttntcttctgtccctgggtggggcacacccttctgtgctgtgcttgccatgagcatcaataaacca

SEQ ID NO: 705 - DNA, 318 bp, Mus musculus
  misc_feature (46)..(46): n is a, c, g, or t
  misc_feature (51)..(51): n is a, c, g, or t
  misc_feature (253)..(253): n is a, c, g, or t
gggcagtagggttcattctcctagtgccccaagtcccctcctgccntgggnctgcccagggattggacctggacctggccaaggccttttgtgtgtgtcgctgctgccgggcaacgtgcattgctgggaagccgaagccgctggaggagcgggtgggggggcggggggaggggaaaggcaaatgcagatatatattaaaaacaaataatcgaggtaccagagctgcgtctgtggcaccagctagctgcaggtncaggggatggcgggagtgaggctgtgtctgcggatggctggggtcacttctctgcccatgggctc

SEQ ID NO: 706 - DNA, 456 bp, Mus musculus
  misc_feature (50)..(54): n is a, c, g, or t
  misc_feature (96)..(96): n is a, c, g, or t
ggaggagagttaatattgcccattatcacggaggactccttagaccctcnnnnngtggccacccgatcccccttcgtgcccccaccccccaccttntacccctttctcacgggcgtgggtgccacccaagacaccctgcctccgcccgccgcgcgccgcccgtcctcggggggcccgtgtcaggccgagcgcgacgacagcgactgcgaggagcccgtggaagcctcgggcttcgcctccggggaggtctttgactccagcctcccccccacggacgacgaggacttttacactactttccccttggtcacggaccgcaccaccctcctgtcgccccgcaagccccgacccaacctcaggacagatggggccacgggcgcccccggggtgctatttgcgccctccgccccagcccccaacctgcccgcgggcaaaatgaaccaccgagacccactg

SEQ ID NO: 707 - DNA, 121 bp, Mus musculus
caaccttcattgtagatcctttatactaaagctgttgatttgtagtgtgttgaatgcatgcgggaaaatgctatgaccatacagagctaccggtaagccacattacaatcaagccaaaaga

SEQ ID NO: 708 - DNA, 404 bp, Mus musculus
  misc_feature (68)..(68): n is a, c, g, or t
  misc_feature (106)..(106): n is a, c, g, or t
aggatttggatagcccttcagtcaaattgcagacccaagctgttagagagagaacctgtgcccaattntgaaaagctaacctaggatggatgcacattatcagttntgccagtccttcccatttaaaaaaaaaaaaaaaaaagaatctctccatctctccctcttgcctaagatgggctgtgactacccccctctccctggtcctgatatagtactgatggaagacaccgactgtggaagaacaagttgaggtttgcaatgacatgagtcactgtatttgattttaggttgattttatttcacccctttttacggcatagaattctggtgccttgctccctggatttgtctccgtgctctgagtaggctctccacattctggcttacacgggaacacaactatt

SEQ ID NO: 709 - DNA, 340 bp, Mus musculus
acaaaagaggtttgtctccctcatcaaaaacaacaacaaaaatacattcaaagaaatcaagtatttattatattttttgcagatgtttccatacaattcacataacctttttgtaaagagagatgaagaaatggattaaagatttttaatatttgaaatggtaaatagaactaatttatttgtaatatatttctgttatttatagatgttcccttaatgtttttctgtgaagtactgctttaatttaagccctatccttgtgaatttaccatttctttttttaagaacatgtctagatgcatattttaaataactggaatgtaaatcatcagcatatctg

SEQ ID NO: 710 - DNA, 326 bp, Mus musculus
  misc_feature (148)..(148): n is a, c, g, or t
tgtcggcaccggacctgtcagacttccctggggtctgcagtctagaacacacaaaactcgcaggcaatcccggggccagcccaggcgggtgtgtggtttgtgcgagtccccttatatccccacttcctccaggggcctcgtccccatntagtttctctagcgacttcccagtcccagacgggaaaggctgttctatttaatcgtgtgaagtgtctgtctcccagccttggggcccccggagcctcccctcttctccaaattgctgtgaacttacccacttctccttctctgttgtaaatacccctcacggaggaaatagttttgct

SEQ ID NO: 711 - DNA, 533 bp, Mus musculus
  misc_feature (83)..(83): n is a, c, g, or t
  misc_feature (117)..(117): n is a, c, g, or t
  misc_feature (209)..(209): n is a, c, g, or t
  misc_feature (221)..(221): n is a, c, g, or t
  misc_feature (224)..(224): n is a, c, g, or t
  misc_feature (229)..(229): n is a, c, g, or t
  misc_feature (234)..(234): n is a, c, g, or t
  misc_feature (251)..(251): n is a, c, g, or t
  misc_feature (265)..(265): n is a, c, g, or t
  misc_feature (297)..(297): n is a, c, g, or t
  misc_feature (308)..(308): n is a, c, g, or t
  misc_feature (338)..(338): n is a, c, g, or t
  misc_feature (352)..(352): n is a, c, g, or t
  misc_feature (354)..(354): n is a, c, g, or t
  misc_feature (440)..(440): n is a, c, g, or t
  misc_feature (442)..(442): n is a, c, g, or t
  misc_feature (494)..(494): n is a, c, g, or t
  misc_feature (507)..(508): n is a, c, g, or t
ccatcagggccggagggacatatataatcaaatgaaactctctggagatgccatctctgtctccctgggtgccagcaccctgntaccatgtgcaccgggtggcactggagagccatnagaagtcatgagatactgtatgtgtaagcacatgtacatgagtgtgtgtgtgtgtgtgtgtgtgtgtgtatgtatgtatgtatgtgtgagtntgtgtgtgtgtntgngcgtntgtgncacgagtctcattcagnctctggggtcaaantcaattcctctcaagtgtggtaccctagagantggtggccatntacattttctccctctagcttctatgtctngtttttgctttccntncccctcctcctcccctctctctccttctctctgtgaggggggagagtgctgtacaaagtcaaacaaacaagtttacattgtaagtncnatgacccgagtcctccacatgaccttgtgaattgtgtgccgtcctcctgtgntctgtgagaactnngtggtacttcagtgtccctcccctg

SEQ ID NO: 712 - DNA, 565 bp, Mus musculus
  misc_feature (51)..(51): n is a, c, g, or t
  misc_feature (53)..(53): n is a, c, g, or t
  misc_feature (83)..(83): n is a, c, g, or t
  misc_feature (423)..(423): n is a, c, g, or t
  misc_feature (439)..(439): n is a, c, g, or t
  misc_feature (473)..(473): n is a, c, g, or t
  misc_feature (510)..(510): n is a, c, g, or t
  misc_feature (538)..(538): n is a, c, g, or t
tggagtgctacatacctacaagatcaggctaagcaggtagataggtggaantnccaaccaggtccaaagaagttaatcccagnccataggaatggcttggtgcagttggaacgggtgacaaattaagagaacttttttcctacatatgtcttaagaatagacagccttgctgtgcctcctgctgatgtcttcctttattgaagcttgctgatgcgattgtacatagcctttctatacaggtagagatatattatatatatacatataaaacatctcactatgcccaccccaaaagttacactgtggggtggagggtgaaatcacctctcagtgtttccaagtaccaaaggttcattatggaatgttctttatgctttttaggggagaacccagctgcatacatagcaagtgcttatgcaggtntaggtactacttcctntctgttggttgggaggggagagaagcttaaatgntcttctgtgacccagctgcgggggcaggctggatttntatagcagtttgtcagattgcttggatntattggctgcaataaacacactgtctc

SEQ ID NO: 713 - DNA, 378 bp, Mus musculus
  misc_feature (238)..(238): n is a, c, g, or t
  misc_feature (252)..(252): n is a, c, g, or t
  misc_feature (259)..(259): n is a, c, g, or t
  misc_feature (277)..(277): n is a, c, g, or t
  misc_feature (312)..(312): n is a, c, g, or t
ggcagctcctgcattggcggccagcccactggatactggaagacagtggttctgatgggttcagccctggagaggaaaaaggtagaggattagagcagagcacctcacagattccaccttactcttccaacttcccgactgtcagaaacggtggtcacctgcacggcccttctggaagtagaaccctgataacatgcagaacctctgagcccaaagtgggggctggtcgaggagactnaactaccagaatgnccttggncaatatggaactaccctnagcatccacctgtggggactggttaaatatttatncacgtccacagcagagaatgctatgcagcctgtgtaaaaatcaaggcctatatgcactgatgaaga

SEQ ID NO: 714 - DNA, 306 bp, Mus musculus
  misc_feature (64)..(64): n is a, c, g, or t
  misc_feature (66)..(68): n is a, c, g, or t
  misc_feature (70)..(71): n is a, c, g, or t
  misc_feature (77)..(77): n is a, c, g, or t
  misc_feature (108)..(108): n is a, c, g, or t
  misc_feature (180)..(180): n is a, c, g, or t
  misc_feature (188)..(188): n is a, c, g, or t
  misc_feature (193)..(193): n is a, c, g, or t
  misc_feature (226)..(226): n is a, c, g, or t
  misc_feature (261)..(261): n is a, c, g, or t
  misc_feature (277)..(277): n is a, c, g, or t
agacgaacgaatttactgactttgtagctacactgttcttgaaaaggcttttttttttttaagnannnannaaaagnccagaaggaagaagaagagaaggggtatatngtatattctcatcaggtggtgcacactctgatgaaatcaaacaaaaggctatagaggattgaagagggaganccaacttnccccntcctttcatggcgctgtagctcaaagactggantctgcttgttaaccattgttaactagtatttttantcccagttgcttttancctctgtatagttccttttttaaacacat

SEQ ID NO: 715 - DNA, 451 bp, Mus musculus
gatgtcttcagtcagtgtttgcctctacccggcttcccagctctttgccaacttcttctgagctgagttatcagtcgcctgtgacacgcccattctctgtcctggtcccgcccccaaccatggtggatcctggaggacctcgtacccctcccctcccccacatatgcatctctcccttccgacatggtgttccctgtgtctccatgctgcccacattcctaagcacatgagttggtctaatctttttttccattggttacctttaactctccatggcaggctcactttaatccctcacatcatgtccttcccttcttgtgagttatttgtcattaaccgacattgtcagcgacagacgtgtatctgagggtgtcatgcacgaccttcagcagggacttctgggccatggaggactgtctaatacatggacttataaactggctgcatgagc

SEQ ID NO: 716 - DNA, 333 bp, Mus musculus
  misc_feature (70)..(70): n is a, c, g, or t
  misc_feature (99)..(99): n is a, c, g, or t
  misc_feature (151)..(151): n is a, c, g, or t
  misc_feature (261)..(261): n is a, c, g, or t
cagtgactacgggacgctctttgtagtgctggtgatcattggtgtcatctgcttcatcatcattgtgctntggcctactctacaattgttggcagcgcnggatgcccaagctcaaacacgtgtcgcacggtgaggagctgcgcttcgtggnagaacggctgccacgacaatcccacgctggacgtggccagcgacagccagtcggagatgcaggagaagcagcccagcctgaacggtggggccatcaacggcccgagcagntggagcgcgctcatgggcagcaaacgcgaccctgaggactcggacgtgttcgaggaggacactcacctgtga

SEQ ID NO: 717 - DNA, 196 bp, Mus musculus
  misc_feature (86)..(86): n is a, c, g, or t
  misc_feature (104)..(104): n is a, c, g, or t
ttctttctttccaaccctgggcacttcctctgtgtctgccatttattagccatgtgaccttggccaaatcacttcacctccctgancctcagtttcctcatctntcaaatgggggtttataaacacctacctcgcagggttgttgtgaggatttaatgaggtaatgtatataaggcgtcttgcacagtgcctggca

SEQ ID NO: 718 - DNA, 444 bp, Mus musculus
  misc_feature (86)..(86): n is a, c, g, or t
  misc_feature (246)..(246): n is a, c, g, or t
  misc_feature (248)..(248): n is a, c, g, or t
  misc_feature (264)..(264): n is a, c, g, or t
  misc_feature (272)..(273): n is a, c, g, or t
  misc_feature (284)..(284): n is a, c, g, or t
  misc_feature (304)..(304): n is a, c, g, or t
  misc_feature (324)..(324): n is a, c, g, or t
  misc_feature (334)..(334): n is a, c, g, or t
  misc_feature (390)..(390): n is a, c, g, or t
gatatccgtgtgcattcaaaaccaagctgtgctcctttcgagggcaggaccccatacccctcctggtctcattttcagaacccagntgggagtcactcagaatatcactgtacatgaaagtgcctactatcaatggggtgagcagacagggaacagacccgtggcctgcataatatcacctaggggaggaagatggtcgctgatttcactctcagtgtgcaagcctggagaatccatcagtttcananctttataaaggctganccccactnncaaaaaggagnccgtgtgtattgagcaaatntccagagacaagtgggtatntgaatggtgncccctcccccaccaagggaagaggagcccaaggtgaccctaagcagacctgctttntcccttcactaatcttcaagtaacactgcatttgctccataatgcccttaattg

SEQ ID NO: 719 - DNA, 469 bp, Mus musculus
aatagtcagtgggtgtggcactccgggtcactagccgctgtgctgcttcctggactagaatgccctgccccctcgcccgccctggaagagtgactgcagcttccccacacgccttacccccactgatgcatcgacatgctggagcagtctggctccacaaagtaccaatacagttttttgagactgcctacaaaatactattttgttaaaactatgcctttaaatagacaccgatgggttatatttgttttataaaaagttgtgtacctaatgttcaatcgtgattgattttgagattatatataaatgtatatttataagcctgtcttatgtggatttttactctaagaagtgtggcacattactaataaagatatgagtttctatttatgtaaagtcattgtagcaacactcctaactgctatctgagtgatgatcctgttcattggccaccatacatacttttatc

SEQ ID NO: 720 - DNA, 435 bp, Mus musculus
  misc_feature (42)..(42): n is a, c, g, or t
ttgcttcctggtgtcatttgtgtagaattctagaaagtggtnggatttttaaaaattagatttaagacagcctaaattctcttagaagtagttagttttatattattgtagtgttattggaatgtgatcctgaaatatattactgaaaattaaaatttttattttgttaattgcaatcttggctctcagaaatgcagtataatattgatatatagctgctatcatctttctgagagttcagaacatatggcagctgtttgtgaagctattttttactgacaaattttgataagtttggctactgtaatggaaagtaggctttcttaagcactgactacatttggattcttgtaaagtttggataatacattctcaggtgctgctggactttgtgcactttggaggtactgcatgtatcttccactgtttgagatg

SEQ ID NO: 721 - DNA, 446 bp, Mus musculus
  misc_feature (57)..(57): n is a, c, g, or t
  misc_feature (77)..(77): n is a, c, g, or t
  misc_feature (85)..(85): n is a, c, g, or t
  misc_feature (119)..(119): n is a, c, g, or t
  misc_feature (166)..(166): n is a, c, g, or t
  misc_feature (225)..(225): n is a, c, g, or t
  misc_feature (235)..(235): n is a, c, g, or t
  misc_feature (285)..(285): n is a, c, g, or t
  misc_feature (317)..(317): n is a, c, g, or t
  misc_feature (375)..(375): n is a, c, g, or t
  misc_feature (410)..(410): n is a, c, g, or t
gttaatatattcgtccacagtagctttcttacagtaaccaccaatgtgctttccatnaatatgattgttataagcanctgcaagntttacaacagtaagactggaaaagaaaaggctgntcataaaaatgtgtgtgcacaaattataaaaagaaggcaattgtttngtgattgtatatgataattttaagaataaaaattgtgaaatttatgctgtccctgcttnaaatatttgnaaaatttgaactgtgtatttatgtttgtattggggaagactcctcctctntgacatcatacagcttctaaaagttaacagtntcccaaagtatgggatgctttggaagtgaaggactggataatttttggaccagtatgncagtatgtagtccagtggcaactgtgtattaattnttctatttcaggttctgtattgcatgttttcttatt

SEQ ID NO: 722 - DNA, 533 bp, Mus musculus
  misc_feature (304)..(304): n is a, c, g, or t
  misc_feature (359)..(359): n is a, c, g, or t
  misc_feature (366)..(366): n is a, c, g, or t
  misc_feature (380)..(380): n is a, c, g, or t
  misc_feature (394)..(394): n is a, c, g, or t
  misc_feature (399)..(399): n is a, c, g, or t
  misc_feature (401)..(401): n is a, c, g, or t
  misc_feature (406)..(406): n is a, c, g, or t
  misc_feature (419)..(419): n is a, c, g, or t
  misc_feature (424)..(424): n is a, c, g, or t
tacagttacactatgcacaccacatacacgtgcatccacacgcttgcccaccacatgtatgcacgtgcacatgcctgcacactaccacacatgcacacataccacactgtccacacacagacgcattggtgttcacacgcacccacaaacaattagtgtgtatcacagccctgagtgctgggtttctctgcagatgtgggtgagtctgtgacttgcttcacagagcatagccttcccgataaccgcctcagagaacagggcataggtaagttcctagagcattggaggcgaggcggcagcattntgcagcctgtggtgggcagtgccatctagaggcagacacactcagtatctgagtnaggaggntagcaggcagagcntgatattcataagntcctntntgatntcccttaaagcancattntgtacccatccctcaggtgggtagccaaggaccaccaggctgtttcagctcctttcactaacggacttttttacctgcttgtgtagctgatgtgtgcagaacccaccat

SEQ ID NO: 723 - DNA, 523 bp, Mus musculus
  misc_feature (429)..(429): n is a, c, g, or t
cattgtcacagagccaagcctggtaggatttgtctttaaaagtagcaatagtaagagaggcaagtcaagggaaagagaacagtagacatgcctctcatcattctcttggtgtctctttttcttcttcaggccaatgagaagccgaaaattaaaccccacctccatcaaacacagtttttatagattctgacttttttaaaaattcttttctaattattgtaaaaagtatattatatcttaagtcagtttccgtggcatctactgaataaaaattcagcagatctcctttctaggtgcaactgttcagtgaattccctcactaaaagcttaagcaattgtcagtcagaattctgtttgctgagtgctggtgcaggctttatgctttccacgtgaattaaatcaaatgtgaagttgatccagagagagccnaggtgactggggagccattgagtagggaattgtattggatgatggttttcatttttgttactgaaaacaaagtcttgtctagcaccgtgagaat

SEQ ID NO: 724 - DNA, 418 bp, Mus musculus
  misc_feature (202)..(202): n is a, c, g, or t
  misc_feature (229)..(229): n is a, c, g, or t
  misc_feature (250)..(250): n is a, c, g, or t
  misc_feature (335)..(335): n is a, c, g, or t
  misc_feature (381)..(381): n is a, c, g, or t
gggtctgtattttgctcattagatgtgaatatctcttattagtctgcttatgctttgcaatgatcgtattgccatcatttcttagttgttagtacatgtgagtagtactctattatgtaaattgattgcaaacttatcaaagagaaattattctatgtagctttacaacagtgctttgctaaaccatgtactagtagttaantcttccttgagaaaaataaagatacantcttataaagaacagttcctnctgactcccaggaatttttttttaagatgacactgaatgttgatgcaccttagtgcagtgaagtggcaataaaacccaaactgantcaagattgctcatggcagctgcatgtctcgctttccagagtttancaaaaccttttaatctcatgtctcactgtattctatt

SEQ ID NO: 725 - DNA, 106 bp, Mus musculus
  misc_feature (45)..(45): n is a, c, g, or t
  misc_feature (78)..(78): n is a, c, g, or t
ttgtaactttccactactctacctggtaccatatctgtggatttngggcaatattaaaactagatatccaatacatcnttctcagtttccattccatgaaaaattt

SEQ ID NO: 726 - DNA, 433 bp, Mus musculus
gtacccacagagtatgctaggtcataactgtctttcctcttcaaaacttgcagaagtctccttcttcaatgcactgtttaggagtcacgtacgaagcagccataagttggtgacatggtctctatgacatacctctaagatgaaagatagactattcctgaggctaaaactacagtctagaagtattaatctgatgtgcaccctcaggacgacaaaccattgaagctgattctgaagttctgttttctttcttggctttgccaattgcttcctccttgagttaaggacacgtctcatctcatcacccctgcacttgccctgccctaaccgtttactatgttgggttgaggatactgaaagttacgaatggagaacctaaggatgcgcatagttttcatctatgcaattttacttggttctgtcacttcatgat

SEQ ID NO: 727 - DNA, 466 bp, Mus musculus
  misc_feature (68)..(68): n is a, c, g, or t
  misc_feature (185)..(185): n is a, c, g, or t
  misc_feature (189)..(189): n is a, c, g, or t
  misc_feature (196)..(196): n is a, c, g, or t
  misc_feature (215)..(215): n is a, c, g, or t
  misc_feature (218)..(218): n is a, c, g, or t
  misc_feature (254)..(254): n is a, c, g, or t
  misc_feature (257)..(257): n is a, c, g, or t
  misc_feature (269)..(269): n is a, c, g, or t
  misc_feature (273)..(273): n is a, c, g, or t
  misc_feature (313)..(313): n is a, c, g, or t
  misc_feature (315)..(315): n is a, c, g, or t
  misc_feature (325)..(325): n is a, c, g, or t
  misc_feature (412)..(412): n is a, c, g, or t
gtatattctttaatggcatcaaggtagttatttctgaggataattcaagtacaagaattatagggtcnctgttttctgaaaagtatgtatgctatataaatgacattgaagtttcattttatttttctaatcactaaaatgtgtgatataatttatttttccaaattatcaaggtatatcagaantccnatgcttngtagttatctgatacatgncanaaatggaactttctaattcgtacgacttttataccnatnatctagtagttncagnaatattgagactcataatttttaaatttataaatatattncnattcctattntcttttacaatgaagatgacacattgagagttgataaagcgatcatggagctcagaatttttcgtgtttgtttgaatcccagaggancaatttataaacactatatatttatttactctattctcagaacagttgactgtt

SEQ ID NO: 728 - DNA, 570 bp, Mus musculus
gccagtacacgtgcatggtgacaaactcggctggcaacactactgcctcggccacgcttaacgtgtcggccgtggaccccgtggctgcgggagggcccggtggcgggggcccagggggtgggggcggtgcagggggcgcgggcggatacacctacttcaccacggtgaccgtggagacgctggagacgcagccgggggaggaggcccagcagccccgaggtactgagaaggagcccccggggcccacgactgatggcgcgtggggcggcggccggcctgatgctgcagccccggcctcggcgtccaccacggcaccggccccgcgctcctcgcggcccacggagaaggctttcacggtgcccatcacggacgtgacggagaatgcgcttaaggacctagacgatgtcatgaagaccaccaaaatcatcatcggctgcttcgtggccatcaccttcatggccgccgtgatgctggtggccttctacaagctgcgcaagcagcaccagctgcacaagcaccacgggcccacgcgcactgtggagatcatcaacgtggaggacgagctgcccg

SEQ ID NO: 729 - DNA, 68 bp, Mus musculus
  misc_feature (27)..(27): n is a, c, g, or t
ccaacgagtgaccctgagaaccaggtngggtgggtggcagattctcgaacatttgtttcatacaagca

SEQ ID NO: 730 - DNA, 572 bp, Mus musculus
tggcctgaagaaccttgttacctttgacttcccgagttggagtacaagaatgtttttattgattagtagtcatgcaggtgagcctgagcctcccccgaaagcacagttctggcagcaaattgcacacctgtgagagaacaacagagtactagaagcacacgaaggctcagggccagcaacagccaggggccagcaatggttgaggaccagcaaaggccagtggtcaaccttggcattggcagaggaccaacctttgatggactgatcttgagtatgtgacaggaggctgatctcctctactcagcctgctctgcttgcctgtgtggagtaggtggagatgagattaacaatggcaattagatgtgattttgcgaactgcattctcactaaataccatactttgtagttcctgtaacccctctcttccccacaaagacagaagaaacagcaatgtgctcgagagtacccctccctttcctcacagatcattgagaggtgaagcaagcacactcattttcaggggcttccccagatgtgtggagtgaggggatatggtgactgtgcccttcaaa

SEQ ID NO: 731 - DNA, 468 bp, Mus musculus
  misc_feature (263)..(263): n is a, c, g, or t
atctcttgcatacaccactggcagtgtgggcacaactggccaccaggagcacacatgcctggggaagaggggcctgctctgttgccttcatccctgttaaaattgagtatatgcaagccatttgcactacggaattgcatgccttgaaattccttactgtgtgcaccttagtttgaatttgacgttatgtagcatgcacaaaagaatggatgggcttgggcttgttcccaagtcacctctaccgctcattgggagcacagtgntgccctcagccaatcccaggttccgtggagcccgtgtggctccagcacttactgtgcagtggctccctttcccaccgtgctccctttcccaccgtgcccacttaagctgatggctcactaatttgcacaaatggaattgttatgatcacgtcttagcagtatcttgatttaaagtaagcccaaagcccacttctggagttcctta

SEQ ID NO: 732 - DNA, 386 bp, Mus musculus
  misc_feature (269)..(269): n is a, c, g, or t
  misc_feature (271)..(271): n is a, c, g, or t
  misc_feature (274)..(278): n is a, c, g, or t
  misc_feature (280)..(281): n is a, c, g, or t
  misc_feature (285)..(286): n is a, c, g, or t
  misc_feature (290)..(292): n is a, c, g, or t
atctcttgtgcccatgggtcatcatgctcccatcataccttgagcgtgtacacgtgtgttctatgcactcgccctgccctacctacccaacagaggacaagatggtcggcccctagctcccttctccccaacctagcctctccccacaccccgctgtgcagctgtgtgcgttggtgtgtttctgtgtcgctggcgtgtcatgtgatgtagccatgtttgctgacatgagcccctgcccttctctttttctccattggtttctagaactntnttnnnnncnncccnncccnnnaggggacaggactcctggggcctagctgggggcctgagcctgaccaccctcctgttagccctcagagtcttatttctctctattggtgaccaag

SEQ ID NO: 733 - DNA, 553 bp, Mus musculus
  misc_feature (97)..(97): n is a, c, g, or t
  misc_feature (139)..(139): n is a, c, g, or t
  misc_feature (528)..(528): n is a, c, g, or t
ttagtctttaacatcgtgtccatatatgtatatgtagtatttatatatggtcatatatatatatatatattacatatatgaaatgtgtgattatttnggagaaaatgggcccaaatgtgaaaaagatgtaaagaaaacnttataaccccttggaaatatgatgtatatttcaaagatgttaagtttaaagagaagtgacaattgcagaggcacaagaaaaaatctaccagggctcagcactcaagcactttccccacatccagggtcaaagcagtagcgattcctacacggacttttaagcgcagcatgaaatgcagcattacacgaacacacagtactgtcaaacctcaaatgctttctttctttagatgctttcccttgtacatgatcctcgtagacatgtttttatattcgctgatagtgaaagtcacgcgcaataaaatgtaacggttggaagcagtagtcacgaatcggttaaagacaagtacaaaatgttaacagttgttatctttctcctcctcgcttttntccgtggttccgatgtgttgactga

SEQ ID NO: 734 - DNA, 83 bp, Mus musculus
gattttgatctaggcagaaggccatattggttcatattgcatactgcattgtattctggatactaccaaatgattaggacagc

SEQ ID NO: 735 - DNA, 438 bp, Mus musculus
  misc_feature (31)..(31): n is a, c, g, or t
  misc_feature (126)..(126): n is a, c, g, or t
  misc_feature (156)..(156): n is a, c, g, or t
  misc_feature (190)..(190): n is a, c, g, or t
tgtaacctcagcaccggaggatggaggcagnatgcgccggaagttcgtcatctttgataacttccttcccctaaagccacatgcagctctccactgtgagccagaggggagggggcaacatctccnaaacacctcctgtgctaggcttggttgtgntctaaaagccctcgcagagctctgcccaaccctntgatgcctcccagccagcatctctcaggagcctggaacgtgacaggagatcctcatctaactccatttctgcatcaatcaatcaatgatgcaaacagctcacaggagagcccagtccccttgagctctggtcccccccctccactgcagcccagtggaatggcagccagtgtttaaccagtccttgcctctgggtctgccagatgctggggtgtaaatcttactgctagactgatgtcaccacacaga

SEQ ID NO: 736 - DNA, 339 bp, Mus musculus
  misc_feature (60)..(60): n is a, c, g, or t
  misc_feature (131)..(131): n is a, c, g, or t
  misc_feature (133)..(133): n is a, c, g, or t
  misc_feature (254)..(254): n is a, c, g, or t
cacctctttatgctgtagtttcacaaatgattgtgagttcccccaccaccaggttttttntttcccctgttaacatttctaccgtgaagtaggaggatttgggaatgctttgtaaagatgatagtcgactntntaatgtccatgaaggaggttgtacattgcctgatgtctttctgtaaatgagaaatattgctaacatccgagcattctgaagtcttgcttatcttcccgagtttcctttcatttggttttcntgtttctttggggacttggggcaagctatttattagagttttgcaaccgagttcttgtttgaagtctctgaagactacttgtaaa

SEQ ID NO: 737 - DNA, 297 bp, Mus musculus
  misc_feature (137)..(137): n is a, c, g, or t
  misc_feature (165)..(165): n is a, c, g, or t
  misc_feature (203)..(203): n is a, c, g, or t
atgtttgcgaacgaacggctgccactgccccatacactgtgtctttctagaaccctccctcagccaccccacctgccatctccacctggacacaacttgctcaaaggctggtgacttgtgggccattcatctacaantcctgaaggaacaagaggcccaagcctnggggatgcaagaatggcccattttaaaaacgttgttantcccagccgacgtttttggtgatattccagtttagtttcccaattgaaaacaagccaaacagacactcagactggtcatgtagatgttgctagc

SEQ ID NO: 738 - DNA, 341 bp, Mus musculus
  misc_feature (230)..(230): n is a, c, g, or t
ccacctttttatagccaggcctatgaaacagtagcctaagactgggtgccagaacccatggtaacaaagatggtgtttcaccgagtcaccacctttcacagacttggagattctgcactaccatgtgcctggcacatttagacaataagagatgaccaagtctgctattgagtagacaactgtttccctcgaaacagactggcacttgctggactccacctctgctcctnagagtctcagccctgaagccacattctgcctatttgtccccagacagacgactagagacaggtggtgcatccacccagagtgcaaagagggcaatttatttctggcttttg

SEQ ID NO: 739 - DNA, 546 bp, Mus musculus
agaggatactctgggactgccaatttctgcttgggatgaggacagccctcctgcctagcatcccagaggagcaagggacagctggcctttcttgcctctgaggcaggttctcactatatagccccaattgcactggatctcacggtgtagaccaggttggccttggacatgcagaggtccatctccttctgcctcctgagtactggaactgaagggttgtgctgcacgaggccactctggaaaacctatgcatccaaagagtacccgatcttgaacttctctggaggatgagacccccgcctccccactgaataactcagccggacagcccctggtggccttccacaagcagtgactgagacggaaggaaaaggaaaaggctgagatgggggggggggctccttgccagtgaacgatgggattctgagtgttggggtggggccagaggaggagaaggagagttgctggtctgatcaaaggagaggaggtgttaggatgatctgggatcggaagaattcctgagtgtgctgcagagtcgcccaggca

SEQ ID NO: 740 - DNA, 161 bp, Mus musculus
  misc_feature (26)..(27): n is a, c, g, or t
  misc_feature (52)..(52): n is a, c, g, or t
  misc_feature (74)..(75): n is a, c, g, or t
  misc_feature (122)..(122): n is a, c, g, or t
  misc_feature (130)..(130): n is a, c, g, or t
  misc_feature (135)..(135): n is a, c, g, or t
atccctaaaccatccaccgtggagtnngatatgagccagccagacccaaggnccacatgagtgtccacaactgnntagtgtcccctgggtgaccggcatgtcatgagacagtgtgatcaacnttttcttnccccnctgtgcacgtctaggtgacccttcca

SEQ ID NO: 741 - DNA, 523 bp, Mus musculus
  misc_feature (378)..(378): n is a, c, g, or t
  misc_feature (448)..(448): n is a, c, g, or t
  misc_feature (470)..(470): n is a, c, g, or t
  misc_feature (498)..(498): n is a, c, g, or t
tatctatttatgttctctggagggtggcagaaaatttactgggggaattttcccataaagcatagaagaatagaggttatgcacagagataagcttttggacagattttaaatcagaatatatgtaaagtaaaagatacatttaatgtgtatatatatgcatatatatacatatatatgtatatatatattatatggaatgttgctttcttaggaaaagtacacccatgtaaagacacacattcagaagttgtactcattgtcactgttgttccaacttgattataagtacacctgtcacttccaggaccaaaaatttcccaagcacaaagccttattttcttttaaaaataaataaataaataaagaggcttcaacnaaatggatcataggctcttttgaagggaagtgcctggagtttacggtgagatgtttactcaaccatagtncactgagggtccacaggaagtnccatttctggaaaccacaattgcccatntctctgaggatttcatgatagcaat

SEQ ID NO: 742 - DNA, 457 bp, Mus musculus
  misc_feature (58)..(59): n is a, c, g, or t
gacacccctatctggttggaagagagtaaactaattcccagagagccagagggagagnnagagagagagagagagagagagagagagagagagagagagagaggagagagagagatgctgttgacgaaaagtaaagattcaacagcccaaagagttccctgcccctgcagtgttggccagggaggccccaggctgaagtggtcaggagccagatttgtcagcccctcttcccacagtcccccaacagggagggggaagctgtccatttgcccaaagtattaatgcaactgaagctgtgatatttccaatgactgtaggaggaaaatttaaggggagagaggaacacaaacaaaaccaaccaacccctaaaatcattttcttattgtacataacgacctcattctcctgtatatgcggaagatataaccttatatttggtaagtgtttcttgtgctat

SEQ ID NO: 743 - DNA, 551 bp, Mus musculus
  misc_feature (59)..(59): n is a, c, g, or t
  misc_feature (80)..(80): n is a, c, g, or t
  misc_feature (119)..(119): n is a, c, g, or t
tagtgtgtgtataacctggacaagtgagttcagctgtagtccttgcccaaggacaaggnttaaggttgggtgaagagcanaccgttaggctttccccgactctttggggccttagtccntgagactgccagacaatcaagcaggtaccccaccaggaggccagctctggacctctgccattatcacagccctggggaggcttggcctggaacccccaagtctttactcagccctggcaaggaactcaggcagggacctgaggtggctcaagagggcacagctggcccctaggccctgactccctgcacagccaggctgcaacctgcccccatgcacactaggcagaggggtggacaggaacttatggttttagttttgtttctaaagtggtgcctgtacctccagcccccagggggccttccctggccccacttttctgccccacccaggcattgccatcccagcactttgctccatgtcacccagatgccctctgccgaatgtatctgatcgtatgtatttaaaaggattcacgggcatcagaatttctg

SEQ ID NO: 744 - DNA, 407 bp, Mus musculus
  misc_feature (163)..(163): n is a, c, g, or t
  misc_feature (174)..(174): n is a, c, g, or t
  misc_feature (380)..(380): n is a, c, g, or t
agtaactcggatagcattttccaaaccagtgctattcattctttccaagggctttgcaactcaaactattagtgtgatagtgatgtgtttatttggtagaaatgggtatactacagctttaatagccttagtggaaagagaaactttttgttgttacaaaacnctttttttttncatagaaaggtgttttgagcctacaaagagtctcttggaattgtcagactctagcattgttaaccaaattagagtagtgattgcaatatttaagtgtaaatgttgttctatgagaaaggaagcttgcttacagtttaaaacacgatgactgtttctacacacgaacttgtataccactacacaaggaaaagggggttttgtaatcnctgtagaacagtctcctattcattttt

SEQ ID NO: 745 - DNA, 388 bp, Mus musculus
  misc_feature (198)..(198): n is a, c, g, or t
  misc_feature (232)..(232): n is a, c, g, or t
  misc_feature (239)..(239): n is a, c, g, or t
gagatctcttgacagttttaaccctttgagtgcccgctggatccaagctggcagcacagcagtcttctagcatcaactttcaggatcctgctgtttcctgagtggtgtcagttgggacaaatgctacatggatgaaatcacagagatgagcagatatgctggtagcccctagttcaggctcttgccttgtggccacanacataagcattgaggtaccccaagagtcaccctntcctctntcccccaagaggctgtgctctgtgcacacacatacaggtcctgctgctcctgtgtgtgactgtattgtacatagaaaaacatacaaaattatccaatcttgaattccccgctcacgcactgctagaatgcttctgttcaagtcactagc

SEQ ID NO: 746 - DNA, 274 bp, Mus musculus
  misc_feature (28)..(28): n is a, c, g, or t
  misc_feature (45)..(45): n is a, c, g, or t
  misc_feature (121)..(121): n is a, c, g, or t
  misc_feature (196)..(196): n is a, c, g, or t
  misc_feature (238)..(238): n is a, c, g, or t
  misc_feature (240)..(240): n is a, c, g, or t
gcaagcttcatcaagcttctgtcatttncttggagcatttggagnagttttgtattcatgtgaaccagcatgagcataccatcggttgcttttctctttgggaatcattacagttgtgcanccagcacattctttgtccctatcatctttctctcttcaactgctgagccatgctattttccagccattcattganaaattgtttgggggtgtctcttgctactcaccaatactcaancnaaaattacatctgaccaggacgtatgatgtgtaa

SEQ ID NO: 747 - DNA, 84 bp, Mus musculus
atgcattccatgcatgcatgcgcacacacacacacacacacacacacagacatctatcatgtactgggtctattttggttttag

SEQ ID NO: 748 - DNA, 511 bp, Mus musculus
  misc_feature (52)..(52): n is a, c, g, or t
  misc_feature (60)..(61): n is a, c, g, or t
  misc_feature (83)..(83): n is a, c, g, or t
  misc_feature (113)..(113): n is a, c, g, or t
  misc_feature (140)..(140): n is a, c, g, or t
  misc_feature (144)..(144): n is a, c, g, or t
  misc_feature (205)..(205): n is a, c, g, or t
  misc_feature (238)..(238): n is a, c, g, or t
  misc_feature (275)..(275): n is a, c, g, or t
agttacaccatatggattttccagtgtcattctaaagccaggatgtagagtnccctgcanntccagggccaccagaggggtgncctcccctccaccttcatcaaggcgagaanctggcactgtatgcaatttagtacttnagangtaaaaaaataaataaagaaaataaaataaagaaaaaaaactgcatgcccaatgttatgcnaaagagattcgagcatgaaataaattttgtaancatggtttctgtctagtcgaaagcagatttgtttttntgaagcgattggaggtttgcagagacccgcttctgcatctcgaataaatatagtattttcccaacagaaacagaggacagtagcttggctttggtctgattctaaaattagtgtgtgtgtgtgtgtgtgtgtgtgtgtgtgtgtgtgtgtgtgtaaagatgatatttttgaaaaacacatgcttgagttgaaaaaaatagcaacatctcgagctctcagtgcgacatttcctggaa

SEQ ID NO: 749 - DNA, 417 bp, Mus musculus
  misc_feature (141)..(141): n is a, c, g, or t
agaagccattccgactctgaaggtctggtcctgccaggtgtgggcaagctgtggtctgtgggtacaggtcactaacttaagcttattctcaaagcacagatgcaaatggctgggattcgagccctagaagctgggtgtctntgaagcacaggtaaagactgttccaatcagtagcttcttgcctcttcttccagaatgttccagtcagatgtcaatcatgcatcttaatttcccactgtacctcatttatattcttttggggttttgtttatttattttttcttcatttagtgttagttggtgattttctgctattaagtggtgagacagcaggttagtgaaataaaaaacatatctttatatcaaatgtaaatattaatataaatgaacttggcatgcaacttaagtgatccaacg

SEQ ID NO: 750 - DNA, 530 bp, Mus musculus
  misc_feature (265)..(265): n is a, c, g, or t
  misc_feature (286)..(286): n is a, c, g, or t
  misc_feature (300)..(300): n is a, c, g, or t
  misc_feature (504)..(504): n is a, c, g, or t
ctcatccagatcttaggttatttatataagtcccaactggcaaatattccatctttattttaacaaaactattctttcatgatgctcattgttttattctacagggctacgtggaaggtgctgatcatgcttgcttccaatgattggattcccaagctgataatataacagactgtggtgttacatacactaggattaacttgtagtacccctttttggagaagttattcttttcattattttcctttctcatagattaattccnctgtctatgctaactttattnagatatgtgcaagnactgaagaatcaatctatttaaaatgatggctgtgtttgcctttggagaacaggttcatagtcttatgtaaaattcttccaggagcttatcttttatgaaacagaacaaaatcaaactagaacagaaccaagggtgacttgataaaatggcaagatagccccagggtagaaagaggtgttctcagttgacatgaagagttgtanctggaaagacaagtacccacccttct

SEQ ID NO: 751 - DNA, 282 bp, Mus musculus
  misc_feature (175)..(175): n is a, c, g, or t
  misc_feature (179)..(179): n is a, c, g, or t
  misc_feature (197)..(197): n is a, c, g, or t
  misc_feature (207)..(207): n is a, c, g, or t
tgtgaagcttcaactatgaccaagaacgtgtccagactttataactgtttgaaggatgtttaagatgtagactagagaaccatgtgtgtctgtcaacccggcctcattaccgatgtagcgcagcttccccggctgctgggcattggacatccgttcatttaacgcaacagtgcantttnatagtatttaccttaccnacgcaataantgcataattcaatactaacaagtccagaactattgtaacttgctgattacatgacttatgtagaacaccaagcac

SEQ ID NO: 752 - DNA, 43 bp, Mus musculus
tgcgcggcgcctgtctatcaagggcttgttaattccggatggg

SEQ ID NO: 753 - DNA, 157 bp, Mus musculus
  misc_feature (32)..(32): n is a, c, g, or t
  misc_feature (35)..(35): n is a, c, g, or t
  misc_feature (40)..(40): n is a, c, g, or t
  misc_feature (50)..(50): n is a, c, g, or t
  misc_feature (52)..(52): n is a, c, g, or t
  misc_feature (54)..(54): n is a, c, g, or t
  misc_feature (111)..(111): n is a, c, g, or t
ttatgaacccccattttcgaacactttcatantgnaactntttatttctntntnagctaaaattggagctattagtaattactgtaatgtaaacagaccataaacccattntgcgttatttggagtgcttttgttcttgttgatagtttgtacaccc

SEQ ID NO: 754 - DNA, 514 bp, Mus musculus
  misc_feature (35)..(35): n is a, c, g, or t
  misc_feature (76)..(76): n is a, c, g, or t
  misc_feature (89)..(89): n is a, c, g, or t
  misc_feature (189)..(189): n is a, c, g, or t
  misc_feature (435)..(435): n is a, c, g, or t
ttcctactcaggctcaagcagggtatacccaaatnggcattatttcgtcccataagtactgcatattggtatttancaagtgtgaaacncaaatccagtatctgatacttctgtcactgagctcagtgtcgtggagcccaaatgtaaatttgcagctatgactcgtgctgcaaaacagccagcctattnagagaggtcacgggagtcagtctcccttgaggaagtgacattggagctgagacctgaataccaagtaggaagaaagaagctaggggaagagagaatggctggaaggccccttgaggctgattacagggatcaagtgccccgagaccagaagattgcatttatcaaaataggagataagagttggggcagagtggcaggatgtaggaaggtggagggtttagaagacttcagagataaacatggacncctttttattgggtgagtttggaaggaaggggactaaggtacagtattgtttctccctcatgccgcagggtgattgtgg

SEQ ID NO: 755 - DNA, 468 bp, Mus musculus
  misc_feature (285)..(285): n is a, c, g, or t
  misc_feature (307)..(307): n is a, c, g, or t
  misc_feature (344)..(344): n is a, c, g, or t
  misc_feature (350)..(350): n is a, c, g, or t
  misc_feature (372)..(372): n is a, c, g, or t
  misc_feature (374)..(374): n is a, c, g, or t
  misc_feature (382)..(382): n is a, c, g, or t
aagcttgcagtgtcctgtgggtcattccttccccttcacacaaaatctcctgggcacagggcacacagatgccttggctctgacccatctactgagtcagggtcttcagaggaagaaccaaggaacatggatttctagcagttgtcttagctgctaagcatcattatcaggcagccagtgagcatgtgggagagcacctctatgagaggacacggccgtggatctgagaaagggtcacatagctctgccaatcgggacactcacttaacggaaattgttaggctntaggtggaggaaaattcttacnaccatcctaatagcacgcattagatgggattacaaantccccntcctgacccaagtacgctgtgntntgagaaanctcgggcttgtccagtcattccctccatgctgaagcttgcagactagggagccgcccagccctgagcatgaatcccatcctctgat

SEQ ID NO: 756 - DNA, 559 bp, Mus musculus
  misc_feature (343)..(343): n is a, c, g, or t
  misc_feature (447)..(447): n is a, c, g, or t
  misc_feature (457)..(457): n is a, c, g, or t
  misc_feature (461)..(461): n is a, c, g, or t
  misc_feature (471)..(471): n is a, c, g, or t
  misc_feature (473)..(474): n is a, c, g, or t
  misc_feature (480)..(480): n is a, c, g, or t
  misc_feature (482)..(482): n is a, c, g, or t
  misc_feature (514)..(514): n is a, c, g, or t
  misc_feature (524)..(524): n is a, c, g, or t
  misc_feature (526)..(526): n is a, c, g, or t
gtgtcagacgacctctgtcaagtgtccagctccctgccaggctcagacatattatgtccagtatcaggttccttatcagacctactatactcaggcttcttcaagtggctcaggacctcagggctgtgttcctgacccgtgctctgccccttgttccaccagctactgctgtttggctccccggagctttggggtgagtcctctgagacgctggatccagcggcctcaaggatggaatacaggatcttctagctgctgtgaggattctgggtgctgcagttctggaggctgcgggggctgcgggggctgcgggggttgcggcggctgcaacagctgctgtggntctgggtgttgctgtttgggaattattcccatgagatccagaggtcctgcatgctgtgatcatgaggatgattgctgctgttagacacaaaagaacggttatgnttccaaaatntccntcctgctatntnnttctgntnttacccaaaccggacaactgcttccctagttnttaactttgntnttttatcaaggcatcctgccagagttagcgcaa

SEQ ID NO: 757 - DNA, 243 bp, Mus musculus
atccattacctgctctttgcctttatcctggtgatgctgtctccacttgcagccttttcccaattaatcaacagtccagtaacatgcatgagctatggaggctcatgccagcgttcatgcaatggaggttttcgactgggtggccattgtggccatcctaaaatcagatgctgccgcagaaaatagataaaaggaccaagaaccagcaatgtgaataagtgccagaatttgcttcttcgtgaa

SEQ ID NO: 758 - DNA, 423 bp, Mus musculus
ctgggacttgtcctaacgcttgtctcatgccagcgaccaaccccttcccagaagtttgccatccagcatatctataagaaatcctctcccaaatgtgatgatgcaatgcgggtcgttaacaagtatacaggaaaatgtaaggacttgaatacttttcttcatacaacttttgctgatgttgtccgtgtgtgtcacaatccacccaagacttgcaaagacgggacaagtccaaattgtcatgatagttcatctaaggtatctgtaactatctgtaaactcacaaaacgggcaaggaattatacccactgcagatacaaaacaacaggaggaaagaagtcctacacagttgcctgtaaccccagaactccaaaggaccgtcccacctatccagtagttccggttcacttggatcggctattttag

SEQ ID NO: 759 - DNA, 416 bp, Mus musculus
  misc_feature (320)..(320): n is a, c, g, or t
  misc_feature (347)..(347): n is a, c, g, or t
  misc_feature (360)..(360): n is a, c, g, or t
gctggcattatgcatcaatccttatcctcattggagtaaaatatgctttggccaactggttagtcaagtctaggctgaggaagggctgcacctcagaagttggactcctgaagcatgctgaccgtgagcaagaatcagaagaagaagtatgatcttgaagtctttcttgataagccttctccctttgcgttgcctttgttcatggctttgtttcttgacctctggtctcaagaacacttgtctgaggctgactccatgctgtttgtacttccagttttgttaaagtgttggactttaagtatcttactttcagctctganagaaccatgagtgataaattcactttntacactgtgcatnccatgtaattcaagaccaatcataattgttttccaaagtttagtttcgtgtccatt

SEQ ID NO: 760 - DNA, 520 bp, Mus musculus
  misc_feature (405)..(405): n is a, c, g, or t
  misc_feature (451)..(451): n is a, c, g, or t
tgtgctggcattcctgactctaagaccaacacgtgcaatggtgactcaggggggcccttggtgtgcaacgacaccctccaaggtctggtgtcctggggtacctacccttgtggccagcccaacgacccaggcgtctacactcaagtctgcaagtacaaacggtgggtgatggagaccatgaaaacccatcgctaacatgccaggagccgagctgtgagcctttgaggttatgatcatggagtaaggacatcgtggcatccctgtaaagtcctgcctggctttacctttcctccaggacatagccaaacctcaacactaggttaagtttataaaccaatcagaaccccagagacctaaaagcaaatcaaggcaagagactaagaaacctgagggctgtggaagatnccagaaggctaaagctttccaatacaagagccagggattcctacantcctttattggaaagtggttggtaactgtgagaccttcatccactgccttggactcaggtcatccattt

SEQ ID NO: 761 - DNA, 323 bp, Mus musculus
  misc_feature (86)..(86): n is a, c, g, or t
  misc_feature (295)..(295): n is a, c, g, or t
  misc_feature (297)..(297): n is a, c, g, or t
aaaattcagtgcttgccgctacaaggtgttacttactaatacaagatgagaaaaattgagaccaagccagatctctcaagtccaantgtggtgtttacaaactatgtatctcatgtcattgaaacgggtgaccggaagactgcagaagagacgttgttccactttttttttttttttacacagattaatttgttatgggcgtcacagagagatcatatggaaagaggaaatgtgacaaaaattagcatgaatatttctaaatcttccaacttgtcaaatctgcatgtgtgggatntntgctgtttgtacagactttcagaaca

SEQ ID NO: 762 - DNA, 292 bp, Mus musculus
  misc_feature (135)..(135): n is a, c, g, or t
ctgacattttcttgttcagagacagaacaagaaaatacagttgaatttggacccatttactgacccttgtggtcaaacctttccacctctagtccgaatattcccttttggatgtaattaaatttgaaagctctncaaaatctctgtagaatctagaggcctgttgaggacaatgttgatgttgttgttgatgatgatgatggtgttggtgaagataagaaagaataacagtaaaatcctgtcttgtgacccataggccaccacgatttacggcacaaatcactgtgggaaa

SEQ ID NO: 763 - DNA, 428 bp, Mus musculus
  misc_feature (279)..(279): n is a, c, g, or t
  misc_feature (293)..(293): n is a, c, g, or t
  misc_feature (302)..(302): n is a, c, g, or t
  misc_feature (312)..(312): n is a, c, g, or t
  misc_feature (317)..(317): n is a, c, g, or t
  misc_feature (319)..(319): n is a, c, g, or t
  misc_feature (321)..(321): n is a, c, g, or t
  misc_feature (361)..(361): n is a, c, g, or t
  misc_feature (382)..(382): n is a, c, g, or t
  misc_feature (396)..(396): n is a, c, g, or t
  misc_feature (400)..(400): n is a, c, g, or t
  misc_feature (403)..(403): n is a, c, g, or t
tcaacttcctggagatggtacaccgaggcatcaagggtatggtgacagataaatacggaaagccagtcaagaacgcacggattctggtgaaaggcatccgccacgatgtcaccacagcccctgatggtgactactggagacttcttcccccgggttcccatatcgtcattgctcaggcccctggctattccaaggtcatgaagagagtcaccattcccttgcgcatgaagaaggccggccgtgtggacttcatcctccatcctctggcgacaggacccnagaacttccttccnggaccttcnagagctttancctcngntnccaggatcctcagagagagcccacacagatggattttganccccccagggctcgtaggcanccagctagtgggancaanccnatggtggtgggcttacttcacatca

SEQ ID NO: 764 - DNA, 194 bp, Mus musculus
aagtcttccggtggcggcgaccaatcatctaaaggaccaagatactaacaaaaccaaagtgatcaggacgattattgaggaggtgacacctgagggtagagtcctttcgtctatgattgaatcagaaaccaagaaacacttctattaagctgcatagaagagtctcttcatacgggccactggacagacgtgtg

SEQ ID NO: 765 - DNA, 439 bp, Mus musculus
  misc_feature (274)..(274): n is a, c, g, or t
  misc_feature (281)..(281): n is a, c, g, or t
  misc_feature (331)..(331): n is a, c, g, or t
tagtgtgagctatggcgctgccaaaggcggtcaggtctctgggggaacctccatcctacggaagaccactacagtcaagacctctagccggagatactagcagcaaggctttgagagttgggccttggtccttgcgctggtcatggcttctcaggaccgcagaggctgagtatttgtagtgcacaatttacatataatttgcatttgggaaagggctcaaatctactcaggtttttctccttggttatgcagtggaatgggagggaagttaggntcaccanctggttgatttgggggtgacctgaccatttagagggggtaggatgtccanttctacgttttcacctcagcagatctgctgagttcagggcaagctggaggaggcagaaggggttgccagagacctgcagctccttatccttgtcacctcacggtcaag

SEQ ID NO: 766 - DNA, 99 bp, Mus musculus
gaaccagtaagttgcattcgaaacggaggcatatgccagtatcggtgcattggccttaggcataagattggaacttgtggatctcctttcaaatgctgc

SEQ ID NO: 767 - DNA, 389 bp, Mus musculus
  misc_feature (89)..(89): n is a, c, g, or t
  misc_feature (188)..(188): n is a, c, g, or t
  misc_feature (204)..(204): n is a, c, g, or t
  misc_feature (236)..(236): n is a, c, g, or t
  misc_feature (276)..(276): n is a, c, g, or t
  misc_feature (283)..(283): n is a, c, g, or t
  misc_feature (308)..(308): n is a, c, g, or t
  misc_feature (311)..(311): n is a, c, g, or t
  misc_feature (319)..(319): n is a, c, g, or t
ggagaacgccagaacttgtcacccaccgacccgcgggtgcaaaaggccgcacaggcagctgtggccagctacaatatgggcagcgacancctctactacttccgagacaccaaagtcatcgatgcaaaatatcagctggtggctggcatcaagtactacctgactttggacatagaaagcacagagtnccgaaagaccagagtntctggagaacacatggacctcaccacctgccntctggctgcaggggggcagcaggagaaactgcgttgcaantttgagntccttgaagtcccctggaagaacantantcagcttntaaagcatgactgcgtgcaggtgtgaccggccccagggtgacagagtcagggccccatgggaacaagcat

SEQ ID NO: 768 - DNA, 532 bp, Mus musculus
  misc_feature (327)..(327): n is a, c, g, or t
  misc_feature (333)..(333): n is a, c, g, or t
  misc_feature (336)..(336): n is a, c, g, or t
  misc_feature (345)..(345): n is a, c, g, or t
  misc_feature (362)..(362): n is a, c, g, or t
  misc_feature (368)..(368): n is a, c, g, or t
  misc_feature (400)..(400): n is a, c, g, or t
  misc_feature (405)..(405): n is a, c, g, or t
  misc_feature (417)..(417): n is a, c, g, or t
  misc_feature (434)..(434): n is a, c, g, or t
aatcaagttctgtttctgtcccatccccttccagcaacccccctgcatttagagccgcccattccctgctgagaactgctcaaatgccgggcacctgtggggcagcgctgctccttgcaaatgtctgggtctggggaatgagagttgctgacttgggttgatccagccttatgcaaatctggaaatgcaaacaactcaagttctcagttcatcccttctgctctctgattccgagtaccctgtcagactttgtctcctaatttaaagtttaatttacagttctatcagaaatacttgagctgtgctgagggggcaggaagaggaaanttccanccnaatgaagantcacgagagggaatgtncctttncttcgcgttccggagaccccttgacttgcttncctantccctacaaccnctgagttgataattctntccgggagagcttctctgcaggggctgctgggtaatgcttgtgacctcatttcctggttggaagctgaactctgaagggcttggcagttctgtttttt

SEQ ID NO: 769 - DNA, 336 bp, Mus musculus
  misc_feature (119)..(119): n is a, c, g, or t
  misc_feature (122)..(122): n is a, c, g, or t
  misc_feature (124)..(124): n is a, c, g, or t
  misc_feature (127)..(127): n is a, c, g, or t
  misc_feature (129)..(129): n is a, c, g, or t
  misc_feature (158)..(158): n is a, c, g, or t
  misc_feature (166)..(166): n is a, c, g, or t
  misc_feature (169)..(169): n is a, c, g, or t
  misc_feature (171)..(171): n is a, c, g, or t
  misc_feature (177)..(177): n is a, c, g, or t
  misc_feature (192)..(192): n is a, c, g, or t
  misc_feature (204)..(204): n is a, c, g, or t
  misc_feature (212)..(213): n is a, c, g, or t
  misc_feature (219)..(220): n is a, c, g, or t
  misc_feature (222)..(223): n is a, c, g, or t
  misc_feature (250)..(250): n is a, c, g, or t
  misc_feature (252)..(252): n is a, c, g, or t
  misc_feature (301)..(301): n is a, c, g, or t
  misc_feature (303)..(303): n is a, c, g, or t
  misc_feature (309)..(310): n is a, c, g, or t
gtggcagcaacagccatcagcagtctgggggctctagctgctgctctggaggttgctgctgacctggccacgaagaacatggaaagcagcattgactgaagacctgcaagcctagggtntcntnttntntggttttcccgcagaagtacttagaactntctgtacntcntnttcatntccctaaagctcatntaccacgaggtnttcaggtnncccagnntnntgagatgcattggctttgctttttttntnctgacacaactaattgagaatgagatattgaaaaattagctttgaaaantntttttnntgggcaataataaagcttttgattcc

SEQ ID NO: 770 - DNA, 385 bp, Mus musculus
  misc_feature (249)..(249): n is a, c, g, or t
  misc_feature (251)..(251): n is a, c, g, or t
  misc_feature (258)..(258): n is a, c, g, or t
  misc_feature (260)..(260): n is a, c, g, or t
  misc_feature (262)..(262): n is a, c, g, or t
  misc_feature (275)..(275): n is a, c, g, or t
  misc_feature (278)..(278): n is a, c, g, or t
  misc_feature (287)..(288): n is a, c, g, or t
  misc_feature (313)..(313): n is a, c, g, or t
  misc_feature (325)..(325): n is a, c, g, or t
  misc_feature (348)..(348): n is a, c, g, or t
  misc_feature (350)..(350): n is a, c, g, or t
  misc_feature (359)..(359): n is a, c, g, or t
aacagtcacaaattctcatacccataagatggcactcagttttgctcatatttgagatgagggcatcctggactgcaggatctctgcatggtaacaatgaaatagtcaaataaaagtaaagtccacacaaatcactgaaaattgcacacaagcagctaacatgtgtatgcttacattctgatggctgaagtgtggccattacggaggtctcctcagaaccatgaagaatatgttgggaaaaccctttcngncagtttntncnaatttgattaagntcngtgactacnntccaggcagaaaactcaactctganataaagtacctntgggtttccctatgtgagacatntncaagacttntgagttacatgaaagacaccagctaa

SEQ ID NO: 771 - DNA, 485 bp, Mus musculus
  misc_feature (97)..(97): n is a, c, g, or t
  misc_feature (317)..(317): n is a, c, g, or t
  misc_feature (322)..(322): n is a, c, g, or t
  misc_feature (324)..(324): n is a, c, g, or t
  misc_feature (337)..(337): n is a, c, g, or t
  misc_feature (424)..(424): n is a, c, g, or t
ctgcctcagtctttaagggctggatttgaatgcatttatcacatttctcaggcatactgatattgttctaaacatttatattatctttccagatttncaaataattcttaagcttggtaaataaaaaatgttgcaatcttttcagagaattctaaaaagactataggatcctataatagatccaatgatctatagtgtcatatagatcctatagttataaaacattaatgcaaattggcccaaatctcatttaaaaataaatatttccaaaaaagaagtaattataagtaatgagcttgcaaatcagtgctgtggantgatnantcttagttaaaantgtttacttcgcaaaatgaaggctaatttgtgttgcctattaactaactcctactaggtttagatgactatatgaagactgttagtncaactaaaactaaacatgcttattgaattaaagaaatctgtaacttaccagttttgtttgc

SEQ ID NO: 772 - DNA, 337 bp, Mus musculus
  misc_feature (102)..(102): n is a, c, g, or t
  misc_feature (115)..(115): n is a, c, g, or t
  misc_feature (186)..(186): n is a, c, g, or t
  misc_feature (193)..(193): n is a, c, g, or t
acgagccccattcacaaattttgacccatccagtctgcttccttcatctctggattactggacctactttggctctctgactcaccctcctcttcatgaaangtgtgacctgggntgatctgcaaggatagcatcagtctaagcccagagcagctggcccagctccgtggtcttctgtcaagtgcnagagggnagagcctgcagttccagttctgagcaaccaccgtccaccccaacccctgaagggcagaacagtcagagcctcattttgagtcccagcaaggaatgagtcctcaattaggacctggccccctctacagcagcatccaataaaggg

SEQ ID NO: 773 - DNA, 404 bp, Mus musculus
  misc_feature (188)..(189): n is a, c, g, or t
  misc_feature (191)..(191): n is a, c, g, or t
  misc_feature (193)..(193): n is a, c, g, or t
  misc_feature (201)..(201): n is a, c, g, or t
  misc_feature (203)..(205): n is a, c, g, or t
  misc_feature (207)..(218): n is a, c, g, or t
  misc_feature (379)..(379): n is a, c, g, or t
atcatcgctgtcattgtggtggtgtcattagcagtcatcgcggggattgttgtcctggttatatctacaaggaagaaatcagcaaaatatgagaaggctgagataaaggagatgggtgagatccacagagagcttaatgcctagccgtgctgagtgctgaactgaggaggggccgcccgaccggaagnngncnagaagagncnnngnnnnnnnnnnnnatgtataaacctggggaagatgaagacctgcgaagggttactgctttgatagttactttgttagtttcacatttgtaacagtgaaatttgtactcgtaaatacaagcagctggacaccggcattaccgatcgtaaaattagacgaacgtcttataggtgcnaggtccagtgtggtactcagaactt

SEQ ID NO: 774 - DNA, 356 bp, Mus musculus
  misc_feature (32)..(32): n is a, c, g, or t
actcgagccttaatggtggtgtccctggtgtntgggcttcttagccatgtttgtcgccacgatgggcatgaagtgcacacgctgtgggggagatgacaaagcgaagaaggcccgaatagctatgactggaggcattgttttcattgtggcaggtcttgctgccttggtagcatgttcctggattggtcatcagattgtcacagacttttataaccccttgacgcccatgaacgttaagtacgagtttggacctgccatctttatcggctgggcagggtctgctctggtccttctgggaggtgccctgctctcttgctcctgtccaggcagtgaaagcaaagctgcgtaccgagcac

SEQ ID NO: 775 - DNA, 514 bp, Mus musculus
  misc_feature (380)..(380): n is a, c, g, or t
  misc_feature (409)..(409): n is a, c, g, or t
  misc_feature (412)..(412): n is a, c, g, or t
  misc_feature (451)..(451): n is a, c, g, or t
actgctaccatgaatgcctgtgtgctctctgtgctgtgcctcctgggtgccttggctgtcctggtagaaggggtcactgtgcaggatggagacctctcctttcctctggagtcagtgaaaaaacttaagggtctccgcgaggtacaggagcccagactggtgagtcacaagaagtttgctccccggcttcttcagcccgtggcaccacagctatgtagtagccactctgcacttccagaagcactgaggccggtctgcgagaaacccaacgccgaggagatcctgcagaggctagaggccattgctcaggacccaaacacatgtgagatctgtgcctacgctgcctgtacgggatgctagagtgacatcgcttgcctttnctctcagcccatgtggaagcccctctatnttntagaagtcacgaggctaacaaactcataccctcagcatntattgccctgccacagcggggaggaggctgaggagacagctacctggagaagccttgcctgag

SEQ ID NO: 776 - DNA, 483 bp, Mus musculus
  misc_feature (433)..(433): n is a, c, g, or t
  misc_feature (450)..(450): n is a, c, g, or t
gagcccaggctgatttgcatatcggggaaggtgattccatccgctttggacgctttgctttggagactcgagccagccctggccacactccaggctgtgtcacctttgtcctgaacgaccagagcatggccttcactggagatgccctgctgatccgagggtgtggacggacagacttccaacaaggctgtgctaagactttgtaccactctgtgcacgagaagatcttcacacttccaggcaactgtctaatctacccggctcacgattaccacgggctcacagtttctactgtggaggaggaacggactctgaacccacggcttaccctcagctgtgaggaatttatcaaggtcatggacaacctgaacttgcccaagccacagcagatagacattgctgttcctgcaaatatgcgctgtggggtccaganctccaccctcctgattngtcccagccagctgctcacatccgttatgaatg

SEQ ID NO: 777 - DNA, 376 bp, Mus musculus
  misc_feature (283)..(283): n is a, c, g, or t
  misc_feature (308)..(308): n is a, c, g, or t
taatgctgttggtggtcctggttgctgggtcctctgggatagctgcagattacgttggcctgtctccaagccaatgtatggtgccggcaaatgtcagagtggactgtggctacccctctgtcacatcggagcagtgtaacaaccgtggctgctgctttgactccagtatcccaaatgtgccctggtgcttcaaacctctgcaggagacagaatgcacattttgaagctgtccaggctccaggaagggagctctgcaccctggactcctgctgctgatggtggnccaagggtagcaagcatccccgatnctgctccctgctgcaggccaataaaggagccaggagtcctgaagaataaagacctcacagccaacaca

SEQ ID NO: 778 - DNA, 475 bp, Mus musculus
  misc_feature (29)..(31): n is a, c, g, or t
  misc_feature (94)..(94): n is a, c, g, or t
  misc_feature (104)..(104): n is a, c, g, or t
  misc_feature (164)..(164): n is a, c, g, or t
  misc_feature (216)..(216): n is a, c, g, or t
  misc_feature (222)..(222): n is a, c, g, or t
  misc_feature (234)..(234): n is a, c, g, or t
  misc_feature (257)..(257): n is a, c, g, or t
  misc_feature (259)..(259): n is a, c, g, or t
  misc_feature (281)..(281): n is a, c, g, or t
  misc_feature (300)..(300): n is a, c, g, or t
  misc_feature (319)..(319): n is a, c, g, or t
  misc_feature (354)..(354): n is a, c, g, or t
  misc_feature (412)..(412): n is a, c, g, or t
  misc_feature (414)..(414): n is a, c, g, or t
  misc_feature (445)..(445): n is a, c, g, or t
tacagcatcttctcctacaacacaagaannnaggacaatgagattcttctctttgtggaaaatataggagaatacatgttctatgttgggaatntggtagccantttcaaagcacccacaaatcttcctgatccagtccgtatctgtgtgaactgggagtctgnctctgggattgcagaattctggctgaatggaaaaccactggggaggaaaggnttgaanaagggatacacngtggggggtgatgcaatgatcantntaggacaagagcaggattcctntgggggaaattttgatgcnaaagcaatcctttgttggnggagatatgggatgtttccttgtgggaccatgtgntccccctagaaaaggtatcagacagctgtaacaatggcaaccttataaactggcaagntnttaattatgaagacaatggctatgtggtgantaagcccaaactgtggccttaagctaattg

SEQ ID NO: 779 - DNA, 433 bp, Mus musculus
  misc_feature (365)..(365): n is a, c, g, or t
  misc_feature (371)..(371): n is a, c, g, or t
tgagaattgaagctctctggctgtccagcagcccctaccctgccttcaagggctttgtgccgccattactggttttagtcctgtggcagatgaaaatgtccaattgtacctgtgagccacagtgtgacaattccttttgtttataatagtaatttgcccattccttcagacgcatgccacagacccatggaaatcttgtagagttttcttttcttagatggacagctaagtactccaggagacattagcgtctgggggtttctctggcaccgtcactcactcaggatcttatcctgatcttaccctcctccacactcaaaagggagggctaaggccaaagctgggcttacagctctaacccagancctttngcaaagctccacagactcctcaaatgacaacaccaggaacatgggtttgctacgtgaagtcc

SEQ ID NO: 780 - DNA, 572 bp, Mus musculus
  misc_feature (311)..(311): n is a, c, g, or t
  misc_feature (329)..(329): n is a, c, g, or t
  misc_feature (342)..(342): n is a, c, g, or t
  misc_feature (351)..(351): n is a, c, g, or t
  misc_feature (365)..(365): n is a, c, g, or t
  misc_feature (375)..(376): n is a, c, g, or t
  misc_feature (406)..(406): n is a, c, g, or t
  misc_feature (414)..(414): n is a, c, g, or t
  misc_feature (420)..(420): n is a, c, g, or t
  misc_feature (426)..(426): n is a, c, g, or t
  misc_feature (428)..(428): n is a, c, g, or t
  misc_feature (468)..(468): n is a, c, g, or t
  misc_feature (506)..(506): n is a, c, g, or t
  misc_feature (508)..(508): n is a, c, g, or t
  misc_feature (518)..(518): n is a, c, g, or t
  misc_feature (520)..(521): n is a, c, g, or t
  misc_feature (523)..(523): n is a, c, g, or t
  misc_feature (546)..(546): n is a, c, g, or t
gagggcatcgtccacagactcagagtcaaagactcacttggacatttctaagttgcccaggtcccggagacccagccggctgacggtgaagtatgaccggggtcatctgcagcgctggctggagatggagcagtgggtagatgctcaggtccaggaactcttccagggtcaagaagaatcttctgagccagagattgatctggaagctctcatggacttgtcaacagaagatcaaaggacacagctggaggccattctccaagactgcccaggcaacagagagccttttatctctgagctactcagtcaantcaagagacttcggagantcagcaggccttngaaataatnctggagggaccatntcctgaagcnntcagcactgccaggatccacattcctgacnctggatantggctngaaaantnttggatatggacaagggctgcagaagacaaagagagacanttgtatagcccacacttgcatatgcagccacagctggntntcagttgggntnntntgggagtcagctgtagttttgtntaatgcttttccttagcagccaagat

SEQ ID NO: 781 - DNA, 516 bp, Mus musculus
  misc_feature (423)..(424): n is a, c, g, or t
gaccatttcctgagctttctggagagtgaatctgctcttaggggaaaagctcttccctttccttctccaaaaagctagaactgagctccaggaggctgactttctacagcatgaagcctacactgtgtttccttttcatcctcgtctcccttttcccactgatagtcccagggaacgcgcaatgctcctttgagtctttggtggatcaaaggatcaaggaagctctcagtcgtcaagagcctaagacgatctcctgcactagtgtcacgtcttctggcagactggcctcctgtcctgctgggatggttgtcactggatgtgcttgtggctatggctgtggatcgtgggatatccggaatggaaatacttgccactgccagtgctcagtcatggactgggcctctgcccgctgctgccgaatgnnttaagaatgaggaggttgagaaaccaatttcaaaatgatgagcataatgaaaccacggtctcgaccaggaaacctgactcattgtcttcata

SEQ ID NO: 782 - DNA, 322 bp, Mus musculus
gtggcggcagaaactcagcccaattcaccttgcctgctgaatggcagtgtgggcttgaacatcttcagcgccatctgttctgcggtgggcatcatgctcttcatcacagacatcagtatctcatcaggatacatctaccctagctactacccttaccaggagaacttgggtgtgagaacaggcgtggctatttctagtgtgctactcatcttctgcctcttggagctcagcattgcaagtgtgtcctcccactttggctgccaagtggcctgttgtcactacaacaatccaggtgtggtcattccaaatgtctatgcagcaa

SEQ ID NO: 783 - DNA, 402 bp, Mus musculus
  misc_feature (116)..(116): n is a, c, g, or t
  misc_feature (124)..(124): n is a, c, g, or t
  misc_feature (163)..(163): n is a, c, g, or t
  misc_feature (165)..(165): n is a, c, g, or t
  misc_feature (210)..(210): n is a, c, g, or t
  misc_feature (219)..(219): n is a, c, g, or t
  misc_feature (222)..(222): n is a, c, g, or t
  misc_feature (226)..(226): n is a, c, g, or t
  misc_feature (228)..(228): n is a, c, g, or t
  misc_feature (335)..(335): n is a, c, g, or t
  misc_feature (368)..(368): n is a, c, g, or t
gccatggtccgggacactgtcatgagggacatcaccctccaggacctggtggtccacaccctggccatggcccaggacactgtcctggaggacatcaccctccaggacatggtggnccatcccntggccatggcccagggcactgtcctggaggacatcaccntncaggacatggtggcccatcccatggccatggcccagggcactgtnctggagganatnaccntncagggcatggtggcccatcccatggccatggcccagggcactgtggccctcaccctggtccacatcactgagaaatcagaagaaatgaagacacaagatgaggagtntgcatggaatccccagctgacctggcaccgggntctaaactagaattttcccttgcaaataaatagc

SEQ ID NO: 784 - DNA, 274 bp, Mus musculus
gtcttggatccccaaatctttcttaatcctgtgactgctaacacaccaggaggcaatgaagtcactttgtcccacacctagacctgggctgcatgcaaggccatcagagctacacttcctgctgtgttagagtaggtgccctggagcaaggtctggatcttggagcctggcagcctcaactggggacttgctctcatggacagtgctttgcctcctgggtgtgacttgggacacctggtgactccacccaagccccgtgttagtctggctaggt

SEQ ID NO: 785 - DNA, 505 bp, Mus musculus
  misc_feature (291)..(291): n is a, c, g, or t
  misc_feature (420)..(420): n is a, c, g, or t
  misc_feature (453)..(453): n is a, c, g, or t
ttagagttattctccatttccccataacattttcctcctttacaaaagccttagcttcataacttgaaccttcccctctgggcaggaagaggagctgagtacacaccctgtgttgttgtcttgcagaggacagtcatgctgttatctatcaccaaatttcctaggttccacttatcctttctgtttcagcctgtgctccttcatctcttagcattacactgaatttaaaatgtgtcaaacagaagaacaaagtgaagtcctggttgggggtgttgggggggtaagtggganccttgttctttaacatgggcaacagcttcctctgtgctgttaatgttgttaatggcggtcctccaacttggctatggcacagacgctgatgaggttatcaaattcaactgctctatttcaagaaagatntacttcctacggcacaggaactggtgagctgtntgggtttactcactaccacatgctttcatacctgctgtacacgttttatttg

SEQ ID NO: 786 - DNA, 365 bp, Mus musculus
aaggtagcaggtggcgtcttctcccttgatgatgtccctcctcaggcagcaaatgggtactctccggtgctgccatccccaagacatagatcctgggaaagccacaaaagcagcagtcagtgtgaagcccctgtgacagcacaggccttctatctggaactctgacagaggagcctggtgtccactcaatgatgcttcactgaacctctgctccatgatggaggcttagcagtggccacacacacacacacacacacacacacacacacacacacacacgataaatataaatacatccatcatctgtctttttaaatgttaattgtgccctcgtgtctgtctgacgtctggtcctctcgaaaggt

SEQ ID NO: 787 - DNA, 464 bp, Mus musculus
  misc_feature (298)..(298): n is a, c, g, or t
  misc_feature (324)..(324): n is a, c, g, or t
  misc_feature (328)..(328): n is a, c, g, or t
  misc_feature (353)..(354): n is a, c, g, or t
  misc_feature (358)..(358): n is a, c, g, or t
  misc_feature (364)..(364): n is a, c, g, or t
  misc_feature (366)..(366): n is a, c, g, or t
  misc_feature (385)..(385): n is a, c, g, or t
  misc_feature (387)..(387): n is a, c, g, or t
  misc_feature (389)..(389): n is a, c, g, or t
  misc_feature (400)..(400): n is a, c, g, or t
cctgcctagtttacaaatgccaagacagccaggactatacagagaagctaaagcagaggactggcatgaactcgcactagcgcgtcctgtatgtgcagtgcacctccactccggggggagaagttaccagtgggtgacacaggggagaagcataggaaagcttttaggtttcttttttcctatgtatgccaaaagaacaattgtccacctcatcggttacagaagtatgtgtcttagttttaagaaatatatattatgtgttttgggaggaagaccatgttttaaaaatactttaccntcaaagccaaagtgatggaaaaatgnctgngtttaactgacaggcacatggcaannttcntcatantnctatttttttatgtttgtntntnttcatgatatntgctaagactttggggaaaaaaaatcagccttttagaagctggtttttatgtatgctgatcttt

SEQ ID NO: 788 - DNA, 382 bp, Mus musculus
tgacactactccagtggccaatacttttggccgtgtaccaccttcataccagctgtacttcattcctcgttaaagcagaacacactggctgttgctatgctggtatctctgacttctcagggagcagtctccatatcctgtcaactattagggacatctctctcactactcctctcacatcttttcattctcccacaatccagtcatcatccatctttgtttaagaagattttccagagttaccatgcagatccatcctctgtcctcttcagtctacaacacttatatcgacagtactaagacatgtactgtgtcactaatatgttaaaagtgtaatacagacgaggtcaactgagagccatctatgctttgcttgactcaa

SEQ ID NO: 789 - DNA, 495 bp, Mus musculus
  misc_feature (139)..(139): n is a, c, g, or t
  misc_feature (201)..(201): n is a, c, g, or t
  misc_feature (392)..(392): n is a, c, g, or t
acctggagatttcccaaagattcagagggctcaacgagctgtcaagacaagattgaggcttcaccgtctcctccaagggttccagagtgaggtgggaggctggtatctggaccagactggctctggagagtaggcggcnattgaaagaaggtggtacaccagagtctagactcccatgtgaagcacaaggatgctatctgncccacctgtctcctcttccagcctcactttcacctgccctagcaccccatgctctggccctccccagcctggagctacaaagccatcaggactggacatgaggtagaggctgggcaattggccactgctcttgagacagaactcgccccctccttagtgtccagggaggcctgcggatggagaggaaggcntctatgagtctacctacctgctcatgcccaccttcccacaggctgcccatcacaccccagggagcccccagaccatgggggactcgcagctgtacagggctta

SEQ ID NO: 790 - DNA, 355 bp, Mus musculus
  misc_feature (175)..(175): n is a, c, g, or t
  misc_feature (214)..(214): n is a, c, g, or t
  misc_feature (287)..(287): n is a, c, g, or t
cttctcaatggtcagtgtgcaggctggagcaaagcgctcatgaactgtgaccatgtaagatgttaagtatttttattgtttgtattcatatatggtgtttaatccaagtcaaaaggaaaacacttactaaaatagccagttatctattttctgccacagtggaaagcatttagtntggtttagagtcttcagaggctttgtaattaaaaaaacnaaaatagatacagcatcaaatggagattaatgctttaaaatgcactataaaatttataaaagggttaaaagtnaatgtttgataatatatacttttatttatactttctcatttgtaactataactgatttctgcttaaca

SEQ ID NO: 791 - DNA, 423 bp, Mus musculus
gggcatcactctatgggcaaagtgttactcagacatgggcacctgagttcagatccctaccacctaagtaagcagacaaggtgtggtgtttttgtaatgccagtgctagaggcagaaacagacagatcctgcaggctcagtggctggccaaacagcctagccaacatagcgcgttccaggttcagtgagaaaacttgtctcaaaaatcagagggaaaagcaaatgagggtgtcagccatgtgcactcatgcaaatgccatacatgcagaagtatgtgcacacacacgcacacattaaccaacgactagcaaggaaaatgaaggtggataagaggggtgggactgggacaaaggagggtacctggatgaatatgactgaaggacgttatgtacacatatgaaaacgtcgtactgaaactcacta

SEQ ID NO: 792 - DNA, 450 bp, Mus musculus
  misc_feature (36)..(36): n is a, c, g, or t
  misc_feature (326)..(326): n is a, c, g, or t
  misc_feature (365)..(365): n is a, c, g, or t
  misc_feature (411)..(411): n is a, c, g, or t
gttacacacttcctgattctgtgcttaattctgganattgcctctggtcaggataataggaacaatctgctttcactaaatttgaaagtttcttcaatgaacaaggcaaatgaatttgcagtaacactcacagttacaaataacgtggataaatgcatggtggtgaaaatcagtattgaggacaatccgaacatcaaatatctttctgctaaagcaacttacactgcttgcatttgtactgtaaacaactacttctgggatattcaagtctttgcaaatactgttttacaaggcaaagcagaagttgtttcagctaaggagatatntcctgatggtgaaaacatatttccagtaacttcttatgnttgagacggttacaggtgaaatccttgtaacaccaagaactagatntcccccatagatccatggcaccaaaccacctgagggaat

SEQ ID NO: 793 - DNA, 383 bp, Mus musculus
ttctggctttggtggagagcttgctggtttgtcatcactcctattctgttgtctgcaattctagtctggtcactggtgaaatttcacagacctgattatgctgatattccatatcctgactggggagttgctcttggctggtgtatgatcattttctgcattatttggataccaattatggctatcataaaaatagttcaggcagaaggaaacatacttcagcgtatcataagctgctgtagaccagcttcgaactggggtccatacctggaaaaacatcgtggggagagatacagagacatggctgaacctgcaaaggagactgaccacgaaatacctactattagtggcagtacaaaaccagaatgagatgtcacctttga

SEQ ID NO: 794 - DNA, 417 bp, Mus musculus
  misc_feature (184)..(184): n is a, c, g, or t
aaggatcctggcagagaaccactctgatgcctatgggtaccactccagtgcctctgcagcataccaaatgctgctgccagtgttgctggccgttgccttgccagggtccctatgaactgtgagctctagagttctagatcctcttctgctgggctcggagactcagaagctcaacatagacacngagaaaatgaatctccaatggtggttttgtgtgggaccgtgaaaggtagcttggtccccagctgagctaaggcttgaagccctagtacttctgaaggaacagtaggtgcttcacctgtactggggtaccaggccccggtcactagctgcagacccccatagatttgtagccatcagtcacataaggacaacgtcccaagcccctccacatgtagaggatatgacccgtggtca

SEQ ID NO: 795 - DNA, 497 bp, Mus musculus
gaagcaggtcttcctgtttcagtttttgctaacttcctcttttgctactttagtcttttggagggcaaccaattgctgtgccatgtcacaagaaaaatgaatcatctcggcagttttgattatagttttactaaacacatctttgtatttttttcccacttttgaggttgaatatcattctgtagttaaaattgctttcattcatacatttaaatgttcatagttttaaatttcaaccaattgccaaaagagtgatataaaaggtttagcatgagaaaattccttttaaaataattaattaattaaaaaaatcagttgccaactgggcacacttatgaaacagttgataatttattatatgttcagaaagattcttagtaagaatatatgagaatatgcagataggttgcaatcataaaatgggataatttttcttataagtttaggctttcactgactgatgaatttctacaattaatacctcctcatagaagtgg

SEQ ID NO: 796 - DNA, 560 bp, Mus musculus
ctcatcctcgatttttcagcagtgtctttccttgacgtctcctcaatgaggggcctcagaacgattttacaagaatttattaggatcaaggtggacgtatatattgtgggaaccgatgatgatttcattgacaaacttgctcggtgtgaattcttcgatgatgaagtcacagactcaatatttttcttaacaatccatgatgctattttgcatattttgatgaagaaggactacagcacttcaaagtttaattccagccaggaaaaagaaaggaaatttgactttaccataaatacaaatggaggactacgtaatcgggaatgtcaggtaccagttgaaacgaaattctaatcaagatacaattcggaaggattctcatctgtcataacaaaaacaaccttatacctagaaagttattgctaagttcatacattgtatgaacgatatttttatttgacagaattatgtttcaaactttggaacgagattgttctagcatggtatatttttcacatatctagttatgaaattatgtaccatattcctaattttctaccttg

SEQ ID NO: 797 - DNA, 410 bp, Mus musculus
gaatacttaccagttcaggctgctgtatgaacagaccaagaatgggagctgtcttcaccagaggtggggatcattccaggcccttgacggctttcccggatgcacgttgaccagcggcgtggtgaacttcttcttggctcacacggaacaactccgaagagttggttttgatcccatcttgcaacgagtggcccacggagagttctttattgatgggctggggagactgttggtgggctcttgcccgggtgtaattataaaccaccaagtaagaacaccaccaaaggatccaaagctggctgccttggagaagacttatgacaaataccgggccaacaccaattctgtgatccaattcaaggttgcactccagtacttcaagaaccatctctactgctccacttaaaaag

SEQ ID NO: 798 - DNA, 166 bp, Mus musculus
tggatgacgtcgcatacactgtcctgaacttcaattcccagcaacccaaccggccaacttcagccccttcttctccaagagccacagaaacagtttattcagaagtaaaaaagaagtgagcataatctgtccgtctgtcctgctggctgcaccagtgatgcattcc

SEQ ID NO: 799 - DNA, 539 bp, Mus musculus
gcagggctggcatatttcctctattccaggaagtctggcgggggaagtgaccagcgagatctcacagagcacaaaccctcaacctccaaccacaatctggctccttctgacaactctcctaacaaggtggatgacgtcgcatacactgtcctgaacttcaattcccagcaacccaaccggccaacttcagccccttcttctccaagagccacagaaacagtttattcagaagtaaaaaagaagtgagcataatctgtccgtctgtcctgctggctgcaccagtgatgcattcccggattctgttcctcactggagggtctcagcacacacacacgtacacatgcacgcgagcacacacacacacacacacacacacatacacacacacacttacacacacactcatgcattcactctattgactccttcagtgtctatagaagaaaaggtggatcctggagcctacagaaaactcaacccttctaggctttcaaatttggctgagagtgaggtatcaaaatttctcaccctttcacttt

SEQ ID NO: 800 - DNA, 293 bp, Mus musculus
  misc_feature (135)..(135): n is a, c, g, or t
tatccgggagccatgactattccagcttaccctgctgggagtcctgggtacaaccctccacagatgaacaccttgcctgtcatgacaggacccccagtcttcaatccgcgtgtgccatatgtgggggctctgcanggggggccttacagtccgaagaaccatcataatcaagggatatgtacttcctacagccaggaactttgtcatcaacttcaaggtgggatcgtccggagacatagctttacacctaaacccccgcataggtgacagtgtggttcgcaacagctttatga

SEQ ID NO: 801 - DNA, 303 bp, Mus musculus
tgaccagcgatgctgtactactgataagtgcaatcaagtggacacgaaaccatctcaggtacctgcaaaagccaatggtgttcagtgtcttgcctgctatatggaggcaggcagggtgtgtattccaactcctctgaagtgcacagggagcgagacgaagtgtgttgcagttataggcacagctgttggaagcagtagtcccctttcggtagtgatggttggatctggctgtgcgacagaaagcgcctgtaacctgaatatgaccgttttggactttgtaaatatccgcaccttttgctccag

SEQ ID NO: 802 - DNA, 242 bp, Mus musculus
  misc_feature (52)..(52): n is a, c, g, or t
  misc_feature (55)..(55): n is a, c, g, or t
  misc_feature (68)..(68): n is a, c, g, or t
  misc_feature (70)..(70): n is a, c, g, or t
  misc_feature (73)..(73): n is a, c, g, or t
  misc_feature (82)..(82): n is a, c, g, or t
  misc_feature (120)..(120): n is a, c, g, or t
  misc_feature (204)..(204): n is a, c, g, or t
aaattcaaatggcatacacacgtatggaattctcaaaaaagatgagactctngcntcgccccctgctntntcntccctttgntcctggggatggccaagcactatttattgatattgatnttacttcctgtgctaagcacattattttgagaaatgttttgcagttcttatcaagtttagtgtatctggttttatactgaagtnctttggtccatgtcgaactaagtttggtacagagtgat

SEQ ID NO: 803 - DNA, 382 bp, Mus musculus
  misc_feature (121)..(121): n is a, c, g, or t
  misc_feature (131)..(131): n is a, c, g, or t
  misc_feature (135)..(135): n is a, c, g, or t
  misc_feature (141)..(141): n is a, c, g, or t
  misc_feature (156)..(156): n is a, c, g, or t
  misc_feature (176)..(176): n is a, c, g, or t
  misc_feature (179)..(179): n is a, c, g, or t
  misc_feature (184)..(184): n is a, c, g, or t
  misc_feature (186)..(186): n is a, c, g, or t
  misc_feature (191)..(191): n is a, c, g, or t
  misc_feature (213)..(213): n is a, c, g, or t
  misc_feature (229)..(229): n is a, c, g, or t
  misc_feature (272)..(272): n is a, c, g, or t
  misc_feature (317)..(317): n is a, c, g, or t
  misc_feature (322)..(322): n is a, c, g, or t
  misc_feature (333)..(333): n is a, c, g, or t
cagtgatgcattcccggattctgttcctcactggagggtctcagcacacacacacacgtacacatgcgcgcgcgcacacacacacacacacacacacacacacacttacacacacactcangcattcactntatngactcnttcagtgtctatagnagaaaaggtggatcctgganccnacagnanactcnacccttctaggctttcaaattnggctgagagtgaggtntcaaaatttctcaccctttcactttcctgacccagattgttgnaaattgacctattcagagcaccttcattcccctcccaactccaantcctnccctatcagantctgacttgaatttccataaaccttggaggtcacctaagtgcttacccc

SEQ ID NO: 804 - DNA, 557 bp, Mus musculus
agaagcaggaaatggccagtcccatatctttaaaggctgattggaagccaccatacatgagaagatcaaacctccatgggcaatctacacacccgacaactgtcatgcttacccatctgggacattcgagtctctgaaccttgtgccctcacgcctgagcccttctctgagcctttctccagaaaatccactcacagcaactagagaggctctttgtcagcaactccaagcaaactgctaggcaggattcagaagaaaagacagcatctctaacatccaccaggaaggtgcccagaaaagcagagctggtgactttggactgacagacatctggagtgtgaaaaagcagcacagagctaaccttcggagagtgttgaaattatttgaaaagaagccatatttggaggtattggagttttcctctttctgagacaatccactatttgaaaattgtagctactgaattgcctctcagtatgcgagctgatcacgtttccttagggccactagatttctgtctcccttagcccctcaagcccttttgatcatgagttcca

SEQ ID NO: 805 - DNA, 531 bp, Mus musculus
tggtcatcctcgtccataagcactaccgacatcggctcgcttgttgctctgggaaggcttcggagccacagccaagtggctatgacaacctgaccttcctcccagaccacaaggccaagtggtcgcccacccccaaccggaagccagagccgagccccaagcttgcccagccgcccctccggcctcctagccccatgtcctccagtcctacgccccccagctccacacctcctagccctcagcccaaagcttccgggtctcctaagacagtccaggctggggacagcccttcagccgtgaggtctatcctgactaaggagcggcggccggagggggagggcggctacaaggctgtgtggttcggcaaggacatcggggcagaggctgacgtggtggtcctcaacgagcccaccgccgatgtggacagcgccagtgcctcgggaagtgagggcagcgatgatgatgaccctgaccagaagaagactctccgctttggcgtggatgctgacaacacttacatctagctcagcg

SEQ ID NO: 806 - DNA, 322 bp, Mus musculus
  misc_feature (75)..(76): n is a, c, g, or t
  misc_feature (80)..(80): n is a, c, g, or t
  misc_feature (251)..(251): n is a, c, g, or t
tgtggctggtcaccctgaccttggttcccctccttggcatggacagggaactgatggtgtcagctgggagccttnntttnccccagaatgcccttctgtgagcacatggctgagcttccaaactgtccccagacacccaacctgatctgtggcacggatgggctcacatatgaaaatgaatgccacctttgcctgacccggatgaaaaccatgaaggacattcaaatcatgaaggatggccaatgctgagntcagaggtgcactcaagccatgaaacttcatgctggagaacagtgatgccccagaggctatgacatgaaat

SEQ ID NO: 807 - DNA, 397 bp, Mus musculus
  misc_feature (356)..(356): n is a, c, g, or t
gtattctaagtctgtcgtagctgctaggtcacaaagggttttaacctgaaacttgaacagacttgctctgggataatcccacaccgtgtactgcatcgctaagcagaaatacagaaccaagtagctgcttccccctcttcagtgccagtcatttgggaaattgggatctggtcctgatgctgccccggcttctgggtcttagccgtgagtgtaagaatacccacaagcctggctttcccccttcgtagcgttgtgtacaaaaacagacaccacggagaagggtttagccgtcgccagcctctacccggcctggttactattcggaatgcattttatagtaggttttttaattcaantaagtgcctcgatgctgatccttagatcagcactcaaccat

SEQ ID NO: 808 - DNA, 474 bp, Mus musculus
  misc_feature (217)..(217): n is a, c, g, or t
  misc_feature (422)..(422): n is a, c, g, or t
aagatccagattcagaggccccaggtagtcatgacatcgttgtaaacactaacacaaaagcggttttgcatggatctgtggacctgaggactgaggagaagcgtgtttagccaagcgtggtggaacacaccctacattgagaattccgcatagagacttactgggaaatagaccctgcagttacctagaatgggtaccagagagatgatgctggaancgccgacagtatggaaactgcagtggtcatgttacgatggtaggcgaaacctcccagaatcccatgcccagagatgtctcctacccgtggtccggcaatcagcaccaaggacagtgcctggcccgctgccatcgtcggttgttttaactttgggttgcattttaccatcagcaaagcacgcttctaagaaagattacctcccatntccatggcaagcactgtttttaacatagaccatctgtctttacaagggcatg

SEQ ID NO: 809 - DNA, 387 bp, Mus musculus
  misc_feature (113)..(124): n is a, c, g, or t
  misc_feature (272)..(272): n is a, c, g, or t
cagtgatgcattcccggattctgttcctcactggagggtctcagcacacacacacgtacacatgcacgcgagcacacacacacacacacacacacacatacacacacacactnnnnnnnnnnnncatgcattcactctattgactccttcagtgtctatagaagaaaaggtggatcctggagcctacagaaaactcaacccttctaggctttcaaatttggctgagagtgaggtatcaaaatttctcaccctttcactttcctgacccagantgttgaaaattgacgtattcagagcaccttcattcccctcccaactccaagtcctgccctatcagagtctgacttgaatttccataaaccttggaggtcacctaagagttacgcc

SEQ ID NO: 810 - DNA, 284 bp, Mus musculus
aatagccagagtcttcagctcacagagagaatgacactctcccagaacaacagcatcctcagaatagaccctattaagagggaagatgccggcgagtatcagtgtgaaatctcgaatccagtcagcgtcaagaggagcaactcaatcaagctggacataatatttgacccaacacaaggaggcctctcagatggcgccattgctggcatcgtgattggagctgtggctggggtggctctaatagcagggctggcatatttcctctattccaggaagtctggcgg

SEQ ID NO: 811 - DNA, 370 bp, Mus musculus
gaagtgtaccaaggcatgtgtgagaatcaatcagatgctctatgacctgttatctacagttggtgctctgctcctgatcaaccaaaaccattatcaaaaaccaaaaccattatcaaaatccagcaataatcacattgacagccaagatgaaaattagtttagaggagtgttgggcaccggacaacctgagtaggagacaacctgagtcccgccagagtactggtgctctgggcggccatactcaggagtactgctgcaaactttcaacgtggccccgggtgggtgtctggctgtgggaagccagagaaccccagcccgcgggagttggggtgtgtggacaagtggcattccgaggtctctgagcctcatg

SEQ ID NO: 812 - DNA, 418 bp, Mus musculus
  misc_feature (26)..(26): n is a, c, g, or t
agacctctactttgcttgaactgttnaaccatgttgtatcattccaagacagctcccaaagaagctgaaacactaactcacattgttccgatctgaaatgtgggtatccacgctccctctcagctggtattatgccctttgtagaccaaatttcagagctcctcttgcatcctgggagggtctacaggttcctggaagcctgggacttgtgcatacgaggtacctatgtgattgtaaacaaaagggattgctggagtaaaatttcctttaaggtgctcttcaaagcaactcccaacccatgttttcatgaataaacgtgctggtgtaaaaatgacacaggaccacaaagccagtgatataggttagtaacagagtgacagttatatccaagggaagatgtgtcatccctgaggaacat

SEQ ID NO: 813 - DNA, 413 bp, Mus musculus
  misc_feature (112)..(113): n is a, c, g, or t
  misc_feature (115)..(117): n is a, c, g, or t
  misc_feature (119)..(119): n is a, c, g, or t
  misc_feature (121)..(122): n is a, c, g, or t
  misc_feature (124)..(125): n is a, c, g, or t
  misc_feature (127)..(127): n is a, c, g, or t
  misc_feature (132)..(132): n is a, c, g, or t
  misc_feature (136)..(136): n is a, c, g, or t
  misc_feature (138)..(138): n is a, c, g, or t
  misc_feature (144)..(145): n is a, c, g, or t
  misc_feature (160)..(160): n is a, c, g, or t
  misc_feature (162)..(162): n is a, c, g, or t
  misc_feature (167)..(167): n is a, c, g, or t
  misc_feature (170)..(170): n is a, c, g, or t
  misc_feature (199)..(199): n is a, c, g, or t
  misc_feature (207)..(207): n is a, c, g, or t
  misc_feature (210)..(210): n is a, c, g, or t
  misc_feature (212)..(212): n is a, c, g, or t
  misc_feature (214)..(214): n is a, c, g, or t
  misc_feature (232)..(232): n is a, c, g, or t
  misc_feature (234)..(234): n is a, c, g, or t
  misc_feature (257)..(257): n is a, c, g, or t
  misc_feature (259)..(259): n is a, c, g, or t
  misc_feature (264)..(264): n is a, c, g, or t
  misc_feature (275)..(275): n is a, c, g, or t
  misc_feature (277)..(277): n is a, c, g, or t
  misc_feature (282)..(282): n is a, c, g, or t
  misc_feature (286)..(286): n is a, c, g, or t
  misc_feature (353)..(353): n is a, c, g, or t
cttctctgagctccgttcactcgtagcctcagcagggccaggctcttcgacgttcgatctccagaggaggcagcagctggtaccattcctggggcactcaacatccctgtgnntnnntngnnanncnccttnaacntngacccnnctgcttttcagactntntactntgntgagaagccaaagctagaagacaagaatnttattttnttntntnagatgggcaggcggggtntncaggccacacaactggcacaagntnttggntatacaggggntnggaantatnccggggcctataaagagtggctggagaaacagggctagataaaaggctcaccagtttgtggctgttntcagactaccttgctgggctaggcaaatccttgtagtgcttcacacatgaaaaactcaaa

SEQ ID NO: 814 - DNA, 473 bp, Mus musculus
  misc_feature (307)..(307): n is a, c, g, or t
  misc_feature (332)..(332): n is a, c, g, or t
atagctgccagtctgtaaccctgggcattctcacagcaaatgttaacatcctccattttgactgggttgtcgttagcatgctcaaacacagtcttttctctacttcaagatctagaaccatctctccagaagagagagagagagacagagagtgagttagtttcctatgatccagtaacacctcttccccaggaacacaggatgttctaaaaggacatccattcaactcaaagggttcagggactccctgaaacccaccagacagactaggccccctcttttccaagtatattagctgtgaagactngctgagaggcactctcagacaagtntgagctgcctgaaacagacattctctaacctgttgagctgtctgcaagttgtacagagggcttcaagtttacagcttttgtgacatggtgagctttcatggtgccgctgtctttcgagtcatttgtgatcctgcggtaacc

SEQ ID NO: 815 - DNA, 527 bp, Mus musculus
  misc_feature (198)..(198): n is a, c, g, or t
gattgtgtttcaggctccatcacatacatgcctaatggctgctgtaagacatgcatccctcaaaaccagaccagagtcccttgctctgctgtctccgtcatgaaggagatttcctacaatggctgcaccaagaacatctccatgaactactgttttgggtcctgtgggacttttgccatgtactctgcccaggtccanggtctggatcacaggtgctcttgctgcaaggaggagaagaccagtgtccgaagtgttaccctggaatgcccagatggcagtgagctgagccatacctacacacacatcgagagctgtctgtgccaggacactgtctgtgggctcccacaggcccagcaagtccgcaccaggcgttctagcccccgttttctaggaaggaagtgaatgggttgtaccgtgcacattccttcgcatcttaaactattctgctgactctctgaccttctccactcctggcttggcttcttctctgcacatatttattttcggagtttctgttccattctttg

SEQ ID NO: 816 - DNA, 381 bp, Mus musculus
  misc_feature (37)..(37): n is a, c, g, or t
  misc_feature (66)..(66): n is a, c, g, or t
  misc_feature (70)..(70): n is a, c, g, or t
  misc_feature (120)..(120): n is a, c, g, or t
  misc_feature (137)..(137): n is a, c, g, or t
  misc_feature (143)..(143): n is a, c, g, or t
  misc_feature (157)..(157): n is a, c, g, or t
  misc_feature (170)..(170): n is a, c, g, or t
  misc_feature (191)..(191): n is a, c, g, or t
  misc_feature (203)..(203): n is a, c, g, or t
  misc_feature (207)..(207): n is a, c, g, or t
  misc_feature (210)..(210): n is a, c, g, or t
  misc_feature (228)..(228): n is a, c, g, or t
  misc_feature (254)..(254): n is a, c, g, or t
  misc_feature (313)..(313): n is a, c, g, or t
caggtaccagttgaaacgaaattctaatcaagatacnattcggaaggattctcatctgtcataacnaaancaaccttatacctagaaagttattgctaagttcatacattgtatgaacgntatttttatttgacagnattatntttcaaactttggnacgagattgttcnagcatggtatatttttcacanatctagttatgnaatnatntacatattcctaattttntaccttgtagacttatcaagggtagnaaagtattttgtttattgtatttttgtagcgcagaccgattcctttccaagtcattatnttcttgctcaacattttatggtgtatttacaccactgctttgactccaatttttacaggtcatgctaa

SEQ ID NO: 817 - DNA, 495 bp, Mus musculus
aactctcctctctcagtgatggcaggcagccctggacctcagagaaaatcactccacaatccatcaatgacccacagtccaggaagctacccagagcttgccattaaagactgtactggctatggaagacatcaaaggacagctcgagtctcaccagccagtcagtctcctaatgctgaagactggctgactaagggctggggatgaagtccagaataagctgctcttcttttacccctctggacatcatctgtaaccaagcagccatttctgtggacccctttctcctttacttaggagagccttgggaaatacaaggcatggagaggggctgcacatccgtgtacttgttcatgatgtccatactgaacactgagcattgtgcacttgaaaatagatgttgagatgcacaggttagattctgcccaggttagctgaaaggtgatcctgacctctacctgcagatggatattgatgacattgcactgggctagt

SEQ ID NO: 818 - DNA, 444 bp, Mus musculus
  misc_feature (413)..(413): n is a, c, g, or t
  misc_feature (415)..(415): n is a, c, g, or t
taataactctcctcgggttgatacaactaaccttacaccaaaagaagccaactccgaggaaacctttgcctttaaaccagaaaatatcacagaagaaaatgcaacgtacatattcattgccattgaaagtgtcgacaaaagcagtttgagttcgggaccatccaacatcgcacaagtggcactgttcacccctcaggcagagcctgaccctgatgaaagtccaagtttatcaggagttagtgttgctactattgtgctgtctgttttgggcgctcttgttctagtttgtattattgtaggtaccacaatttgtatcttaaagaacaaaaggtcctcatcagcagctataacaaaattttgaaagataacatgaataaaaaagatatttttgagtttttaaagcatatcccatntnatcatgaactcaaaagtaacttcaagagg

SEQ ID NO: 819 - DNA, 524 bp, Mus musculus
  misc_feature (184)..(184): n is a, c, g, or t
  misc_feature (199)..(199): n is a, c, g, or t
  misc_feature (201)..(201): n is a, c, g, or t
  misc_feature (204)..(210): n is a, c, g, or t
  misc_feature (338)..(338): n is a, c, g, or t
gaaactgctcaccagtgtcatcataggactggtggtgtctttggtgctggtccttgtgattttgattacggcccttgtgtgtttgcggaagagctatcaccggaagcttcgagctatgaaggctggcaaggaggcccgaaagacaccaatagagacgacagctccaactgctgctatcccaggnactaacatgtacaanantgnnnnnnncaaccccgtgctggacctccccaccaaggatctgggcttggagtgccactcctccagtgacttggactatgacagcctcaattccctagatgagaactctgtggacttggacatggacagtaaggaanttcaagaggaaggatcttccaggagaccctcctgagcctgaccctgagcccctgactgcagtgctctcaggaaggtcggcaggtgcgagcgaacagcagaaaaagaatctgtccttcaccaaccctggcctggacaccacagatctgtgacggagcctgtcattcttcgagctcaaaccgtactgt

SEQ ID NO: 820 - DNA, 456 bp, Mus musculus
  misc_feature (53)..(53): n is a, c, g, or t
  misc_feature (125)..(125): n is a, c, g, or t
acttagggacattcctgtcgatgacagtggagataccaggaaaggaacgatanggcctgtatatatgaggctagcacatgtgtatcattctacagcatccaatctcataatatgtgaggtactcncttataaacgcactctaaaattagaataaagaatatacagaatatattctatagaatacaaagaagtagagaatatagtagcagctatcatgggctgagggtagcataaaggaaaggagagaaaggggagaaagtctcagacacaggaataggatctgtttcaccatggttaataatgtgccttttgaaactgctaaaagagcacattttaaatgtttttgagacagagtgattaatatgtgaagtgatggatatgtttatgtgctcgtatgtttatatgcttatttgctcatttcacaatgtacaaatggcactacattgaacgcatcat

SEQ ID NO: 821 - DNA, 439 bp, Mus musculus
  misc_feature (33)..(33): n is a, c, g, or t
  misc_feature (42)..(42): n is a, c, g, or t
  misc_feature (75)..(75): n is a, c, g, or t
  misc_feature (108)..(109): n is a, c, g, or t
  misc_feature (125)..(125): n is a, c, g, or t
  misc_feature (214)..(214): n is a, c, g, or t
  misc_feature (345)..(345): n is a, c, g, or t
  misc_feature (350)..(350): n is a, c, g, or t
  misc_feature (355)..(355): n is a, c, g, or t
  misc_feature (363)..(365): n is a, c, g, or t
  misc_feature (370)..(370): n is a, c, g, or t
  misc_feature (375)..(375): n is a, c, g, or t
  misc_feature (380)..(380): n is a, c, g, or t
  misc_feature (388)..(388): n is a, c, g, or t
  misc_feature (390)..(390): n is a, c, g, or t
  misc_feature (396)..(396): n is a, c, g, or t
aattgcttcaagcagctgtgtgctccaccttgntaatagaantattgggagcaccatttttgatggaggacccancaaaccagtttttacgcctgaaaagacacgtgnnacacttgccagatttntgggacccagatcatcacccagatgggacaggaacatcattggctgacgaggtctgggaagcatggacttctttgaaagcaagtgcacnccgcaattttgacacggacacattggcctttgatatatctactgcccagtaaatggacttgagtgttacaaaggaaagaacaaacatggtagaagttagcacagtagtgtggtaggcttggagaaacaggnagatnaaatntggccttnnnctacnttatntattntgcccagntnatgganacattgaaaggagcaatggtgaaaacccttgcagacacctgaa

SEQ ID NO: 822 - DNA, 434 bp, Mus musculus
  misc_feature (191)..(191): n is a, c, g, or t
  misc_feature (286)..(286): n is a, c, g, or t
  misc_feature (288)..(288): n is a, c, g, or t
  misc_feature (291)..(291): n is a, c, g, or t
  misc_feature (296)..(297): n is a, c, g, or t
  misc_feature (304)..(304): n is a, c, g, or t
  misc_feature (347)..(348): n is a, c, g, or t
gagtctccacaatccttgaagaaaccgcagagcccatttccccgaggaaaatgttttctctctggtgtttggctgttttttattttattttttattttaaaaaaagccctctttggcttttcccgtggtccataggcccagccatccagggctagcggtcctcttggccttctcctctgccccaggccctngtgatatttattgtagttaaaggcaatgagagtgggtgggagaagagggtctggagaggtgggaattgggtgggcaagggcacagagctgtggcngnggnggggnntcctatngttatatgtaaatatctgtacagcgggctgcccccctccccanngcattctctgtccactggtgtgcattgatttagacttctccacttagcggagactctgtgaaatcgtctgatggtctgtatggaag

SEQ ID NO: 823 - DNA, 373 bp, Mus musculus
  misc_feature (26)..(26): n is a, c, g, or t
  misc_feature (41)..(41): n is a, c, g, or t
  misc_feature (44)..(44): n is a, c, g, or t
  misc_feature (87)..(87): n is a, c, g, or t
  misc_feature (341)..(341): n is a, c, g, or t
taatgcctcttcatttacggcgacgngctcgagctctccanaanacccatccagccacccacacacaccggtgagtgtcctcacttnctgagttctcaaggaggtgctgtagggatagctgaagactctttgcatggaagtgaacccttccgcatagccccaatgtctgggagtctggtgtccaggagaacttagaagtgctttatggagagtacttgagctgagggcaaatggaggcctgaggtggaggagtgtcactctggtatgtgcaggcaagactgaatctccagaaaagtagaattctccaggtgagaagctttacagttttgcctaattttttngttctttagtgctcttcttggactcttaattc

SEQ ID NO: 824 - DNA, 479 bp, Mus musculus
  misc_feature (329)..(329): n is a, c, g, or t
  misc_feature (331)..(331): n is a, c, g, or t
aacagtttctgctgtctttgaactcatgcatctcatttttaaatttaatccttttaaaaatacaaaagccaacaaggagaggctaaggaggcagacgtgcaagcctattgtgtgcatgcacacgggtgtgcttccgaagcacactaacaagctcgctcataaccgagcccttaggaactctggttgacacaagttgcaccttcaaaatatgaagtaggcattaaatgcaaaaacgatatatatagccaggcatgttagagaatggccctgtcaagcacctccctggcagcatccctccagcccgcacagatttgctagtcctacgcttntntttgcttgcgattaggaactcttaaagctagttaaactgcatgtgcaatacggaaaccagaacggactgcaccttgtggaagaaaaacatgcttaagggatgtattgaaagcggtgtatacatttaagcgttttctacgtagccaaga

SEQ ID NO: 825 - DNA, 454 bp, Mus musculus
  misc_feature (187)..(187): n is a, c, g, or t
  misc_feature (233)..(233): n is a, c, g, or t
  misc_feature (236)..(237): n is a, c, g, or t
  misc_feature (240)..(240): n is a, c, g, or t
  misc_feature (242)..(243): n is a, c, g, or t
  misc_feature (246)..(247): n is a, c, g, or t
  misc_feature (249)..(249): n is a, c, g, or t
  misc_feature (251)..(252): n is a, c, g, or t
  misc_feature (254)..(255): n is a, c, g, or t
  misc_feature (260)..(260): n is a, c, g, or t
  misc_feature (265)..(267): n is a, c, g, or t
  misc_feature (269)..(270): n is a, c, g, or t
  misc_feature (272)..(273): n is a, c, g, or t
  misc_feature (275)..(280): n is a, c, g, or t
  misc_feature (283)..(286): n is a, c, g, or t
  misc_feature (290)..(290): n is a, c, g, or t
  misc_feature (298)..(298): n is a, c, g, or t
  misc_feature (310)..(310): n is a, c, g, or t
  misc_feature (316)..(316): n is a, c, g, or t
  misc_feature (329)..(329): n is a, c, g, or t
  misc_feature (331)..(331): n is a, c, g, or t
  misc_feature (390)..(390): n is a, c, g, or t
  misc_feature (413)..(413): n is a, c, g, or t
  misc_feature (415)..(415): n is a, c, g, or t
  misc_feature (429)..(429): n is a, c, g, or t
tgaacagaaacgcaatgctgaggctgttaaagggttaaggaagcatgaaagaagagtaaaggaacttacctaccagactgaggaagaccgcaagaatgtgctccggctgcaggacctggtggacaaattacaggcgaaggtgaaatcctacaagagacaggctgaggaggctgaggaacaatccaangccaacctggccaagttccgcaagctgcagcacgagctggaggaanccnnggnannggnntnanntnnccgantcccnnntnnannannnnnnggnnnnaganccgggagnttcacaccaaantcagcncagagtaaacacntnttgcagaggaaggaggctgccaaggggctgaaggaaagcacaggaggggctgctttggntcgcttgctgggtcacttgcctntntgggtttacttttntcctactgctgactaaataaaaact

SEQ ID NO: 826 - DNA, 537 bp, Mus musculus
gaaggcgggagctccaacgtgttctccatgtttgagcagacccagatccaggagttcaaggaagccttcacaatcatggaccagaacagagacggcttcatcgacaagaatgacctaagggacacatttgctgccctaggacgagtgaacgtgaaaaatgaagagatcgatgaaatgatcaaagaggctccaggtccaattaacttcaccgtgttcctcacgatgtttggggagaaacttaaaggggctgatcctgaagagaccattctcaacgcattcaaggtgtttgatcccgagggcaaagggtcactgaaggctgactatgtccgggagatgctgaccacacaagcagagaggttctccaaagaggagatcgaccagatgttcgcagcctttccccctgacgtcaccggcaatcttgattataagaatttggtccacatcattacccacggagaagagaaggactgagccctgaaccacagcctcaggtgacccacagcccactctccatcccagggctgtgcgcaaataaac

SEQ ID NO: 827 - DNA, 428 bp, Mus musculus
  misc_feature (385)..(385): n is a, c, g, or t
  misc_feature (390)..(390): n is a, c, g, or t
aacatggagcagaccatcaaggacttgcagcaccgtctggacgaggcagagcagatcgccctcaagggcggcaagaagcagctgcagaagctggaggcccgggtccgggagctggagaatgagctggaggctgagcaaaagcgcaatgcagagtcagtgaagggcatgaggaagagtgagcggcgcatcaaggagctcacctaccagacagaggaagacaggaagaacctactgcggctgcaggacctggtggacaagctgcagctgaaggtgaaggcctacaagcgccaggctgaggaggcggaggagcaggccaacaccaacctgtccaagttccgcaaggtgcagcacgagctggatgaggcggaggagagggcggacatcnccgantcccaggtcaacaagctgcgggccaagagccgggacat

SEQ ID NO: 828 - DNA, 276 bp, Mus musculus
  misc_feature (143)..(143): n is a, c, g, or t
  misc_feature (221)..(223): n is a, c, g, or t
caagaagaacttaatgcggctgcaggacctggtggacaagctacagttgaaggtgaaggcctacaagcgccaggctgaggaggcggaggagcaggccaacaccaacctgtccaagttccgcaaggtgcagcacgagctggatnaggcggaggagagggcggacatcgccgagtcccaggtcaacaagctgcgggccaagagccgggacattggtgccaagnnnaagatgcacgacgaggaataacctctccagcagaccctcgctgtggccaatcc

SEQ ID NO: 829 - DNA, 450 bp, Mus musculus
  misc_feature (370)..(370): n is a, c, g, or t
  misc_feature (415)..(415): n is a, c, g, or t
gaaccccacacctgaggagctgcaggagatgattgacgaagtagacgaggatggcagtggcacagtggacttcgatgagtttcttgtcatgatggttcggtgcatgaaggacgacagcaaagggaagtctgaggaggagctgtcggatctcttccgcatgtttgacaaaaacgctgatggctacattgacttagatgagctgaagatgatgctgcaggccacaggtgagaccattacggaagatgacattgaagagctcatgaaggacggtgacaagaacaacgatggccgaattgactatgacgagttcctggaattcatgaagggtgtggagtagatgctggtcttgcacggttgcctgcgcctgttntccccctccacccagaccccgtggtaggagtgcagctgggctctntagactctgagcctgcctgtgtccttgaaccttgg

SEQ ID NO: 830 - DNA, 534 bp, Mus musculus
aaatcgctccatcattgcaggctataatgccatcctctgctgtgctgtccgaggtagtcctaagcccaagatttcctggttcaagaatggcctggatctgggagaagatgctcgcttccgcatgttctgcaagcagggagtattgaccctggagatcaggaaaccctgcccctatgatggtggtgtctatgtctgcagggccaccaacttgcagggcgaggcacagtgtgagtgccgcctggaggtgcgagttcctcagtgaccaggatggctccccagagatggctaggtacaaatggatgccaggctgtgtaccagaccggaagggagttggaggagcacccttttctgctactgcatgtgtgtgtgcaactgtgcatcctggaaggactggccagcagtgacaccaggcaggtctgctgggttctgaagaaactgaccctaaggataatgttaatactgggagcataaagtgtgtgggcttcagaagtggtgactggggacaggcccttttggctggctcattgtgtagga

SEQ ID NO: 831 - DNA, 121 bp, Mus musculus
ccaaggagctgtggcagagtattcacaacctggaggctgagaagttcgacctgcaggaaaagttcaagcagcagaaatacgaaatcaacgttctgcgaaaccggatcaatgacaaccagaa

SEQ ID NO: 832 - DNA, 498 bp, Mus musculus
ggcccggaagaagaaggctctgtccaacatgatgcactttggagggtacatccagaagcaagctcagacagagcggaagagtgggaagagacagacagagagagagaagaagaagaagatcctggcagagaggaggaaggcgctggccatcgaccacctgaatgaagaccaactgagagagaaggccaaggagctgtggcagagtattcacaacctggaggctgagaagttcgacctgcaggaaaagttcaagcagcagaaatacgaaatcaacgttctgcgaaaccggatcaatgacaaccagaaagtctccaaaactcgtgggaaggccaaagtcaccgggcgttggaaatagatgaaactgttctcgtcaaagctgtgccccctgcttgtgtccttgccccgtgcatcccagctctgggtcctccttggcacccaatgcagactcctgtttggatagtgggagctggcttagctagaagccagtactctgcctga

SEQ ID NO: 833 - DNA, 497 bp, Mus musculus
  misc_feature (302)..(302): n is a, c, g, or t
  misc_feature (332)..(332): n is a, c, g, or t
  misc_feature (413)..(413): n is a, c, g, or t
  misc_feature (429)..(429): n is a, c, g, or t
taagtactaccggtctccatgggagcaggcgattggcagcgatccggagctcctggaggctttgtacccaaaacttttcaagcctgaaggaaaagcagaactgcgggattacaggagctttaacagggttgccactccatttggaggttttgaaaaagcatcaaaaatggtcaaattcaaagttccagattttgaactactgctgctgacagatcccaggttcttggcctttgccaatcctctttcgggcagacgatgctttaacagggcgccaaaggggtgggtatctgagaatatccccntcgtgatcacaactgagcctacagaagacnccactgtaccggaatcagatgacctgtgagagggaagctggggatgccacaggaagttctgcacatagaagctgctgttgntctgcttagggcaaanccattggagttgctcacctctaaagtcactcaatagcagttaagtacatttcatcttatggcacttaa

SEQ ID NO: 834 - DNA, 339 bp, Mus musculus
tctgggtggcacaaagtacatctctttcgaggaacgccaatggcacaacgactgctttaactgtaagaagtgctccctgtctctggtgggacgaggcttcctcacagagagagatgacatcctctgtcctgactgtggaaaggatatttgaaggcggcacagaagccacagcgcgtggcgcagaagattcggatgttttcctttcataaccaggcaatgctgtgttctgattcccaccagccaccacgaggcttcctcttgctgccctggcttcacatttgttgaaacccctttagttcttttcttctcagtggggacaagatccatccgtaagccccg

SEQ ID NO: 835 - DNA, 564 bp, Mus musculus
gccccgacgtctgcgatgagtataaacggacggcactccaccgagcatgcttagaaggacacttggcgatcgtggagaagttaatggaggctggagcccagattgaattccgagatatgcttgaatccacagccatccactgggcatgtcgtggaggaaacgcagatgtcctgaaactgttgctgaacaaaggagccaaaatcagtgccagagacaagcttctcagcacagcgctgcatgtggcggtgaggactggtcattacgagtgcgctgagcacctcatcgcctgcgaggctgatctcaatgccaaggacagagaaggagacaccccactgcatgatgctgtgaggctgaaccgctataagatgattcgactcttgatgaccttcggtgcggacctcaaggtcaagaactgtgctgggaagacccccatggatctggtgttgcactggcagagtggaaccaaagcaatattcgacagcctcaaggagaatgcctacaagaactctcgcatagctacattctgagaaaagagactcaacaggagctgttcgcaggcatttt

SEQ ID NO: 836 - DNA, 331 bp, Mus musculus
  misc_feature (291)..(291): n is a, c, g, or t
  misc_feature (297)..(297): n is a, c, g, or t
tatttcatagcaccagtattcaggctttcatgaacatcattttgggggagcaagacttcatctgtatgtacattcagagtcttcccatagctcttaaaccgtgtgggtgaatggtgtctaattgcacccctttgtgttctcacttgcataaagctattcaaggtactttttaaaaggcaagggttgatccccgcagcccttctctgaattctcactgctgatatctgaatgaagcaacagaaggcacgcagtaacgcagacgggaacggaagcagttccgcaggactggcncggagnctcgccacccacccacagatttggttcggtttgg

SEQ ID NO: 837 - DNA, 416 bp, Mus musculus
gaaagccctcagaaacaagttgatccacatgggagaactttcgtgataattacatccgtagtaacaaagctgtgggcttcctcatatttctggagtcagtgtcatccaccgacagttggaaccatcgccaatgtgacagtagtcttgggttttcctctttcttttggccacctgtgatcagtcattggttaaggacgccttgacaggccatcttttgatatccaagctgaagcaatatccattcagagatttcattggttgcatcataagacatgggtgaccatgtacatcgattcattttatgtttttcttttttcttttctttttatcattttgagtccttttaaatgtaattctaatctttacaattaaaaaaagacaggttcagaatggaagcgaggtcattctgcgaacat

SEQ ID NO: 838 - DNA, 387 bp, Mus musculus
ccaagcctttggatgtcaattagaaatgccttgaaatgtgtgggcattgccatcatttctggaatattaggatgatgagtgggggtcatctagctctatgaacatcccattaattgccaagcctcatatattcaccagtggtaagagaggctgaaggataaaaggcttttcatttttctgatggagaccgtttaggtctctgaatgggtctgctggctgcccagagtgagctgggaactgaatgcaccctctctgtccccgctagtgagctgtcccattctgagttaaaatcgctttatccactggtcaattaactctccccattcatcagcactcccacagttgaccagggcagcgaccattaagagttcacgatgccctgaggca

SEQ ID NO: 839 - DNA, 562 bp, Mus musculus
tccgcctccagaaaacttcagttgaagactctgatgctgcagattgcgaagcaggagatggaacgagaggcagaagagcgacgtggagagaaggggcgcgttctgaggactcgttgccagcctttggagttggatgggctgggctttgaagagcttcaggacttatgccgacagcttcacgctcgggtggacaaagtggatgaagagagatatgacgtggaagcaaaagtcaccaagaacatcactgagattgcagatctgacccagaagatctatgacctccgtggcaagtttaagcggcccaccctccgaagagtgaggatctctgcagatgccatgatgcaggcgctgctggggacccgggccaaggaatccttggacctgagggcccacctcaagcaggtgaagaaggaggacattgagaaggaaaaccgggaggtgggagactggcgcaagaatatcgatgcactgagtggcatggaaggccgcaagaaaaagtttgagggctgagccatggctcccacactgtgctctgaaggacgtccctgcagaataaacctct

SEQ ID NO: 840 - DNA, 512 bp, Mus musculus
  misc_feature (179)..(179): n is a, c, g, or t
  misc_feature (196)..(196): n is a, c, g, or t
  misc_feature (280)..(280): n is a, c, g, or t
  misc_feature (285)..(285): n is a, c, g, or t
  misc_feature (289)..(289): n is a, c, g, or t
  misc_feature (291)..(291): n is a, c, g, or t
  misc_feature (313)..(313): n is a, c, g, or t
  misc_feature (317)..(317): n is a, c, g, or t
  misc_feature (321)..(321): n is a, c, g, or t
  misc_feature (367)..(367): n is a, c, g, or t
  misc_feature (376)..(376): n is a, c, g, or t
  misc_feature (425)..(425): n is a, c, g, or t
  misc_feature (454)..(454): n is a, c, g, or t
  misc_feature (478)..(478): n is a, c, g, or t
gatacgcctgcgcagggacagcaaagaagataacgcccggcggcaagctggcactcggcgacgggagagccttggcaagaaggccaaacgctttctgggccgcatcgtggctcgcaacagccgcaagatggccttccgcgccaagtccaagtcctgccatgacctctctgttctctaangcccaatggcccccttngcttaatgggccagtaaatggctggagggactggcccaggcaactgttctagatgtctcagagttggttcatcctctgtgtttntcagnactntnaactatgcagcacacacccttntctnatgntcatggacagaaagatagtgctgaccagggaggcaactccaaatgnccagagagncctaggcccatggagatgcattgtgcaggcccacatgcataccaagcancctgaacccagcttgtggacaggactctncctttctctatgcgggtgtctgtnccctggagggaggctgttcaatatggttgctgtt

SEQ ID NO: 841 - DNA, 466 bp, Mus musculus
ttcatgctctgcactgtgacgatcaccgaagccaaggtctcctaaaagaagacagctcacatttggctgcctgttgtcaactttttatctttctcttgaccacttagaaaaacttgtctccctacttttgccttcctggcataatggaaaaagtgcaatacctcactcgctcggctatcaggagagcctccactattgaaatgcctcagcaagcacgtcagaatctccagaacctatttatcaatttctgcctcatcttgatatgtctgctgctgatctgcatcattgtgatgcttctgtgaagagctgccgccactccagacctgcaacatgccaactcagcttaaagccgagcactccgtcatgggggaagcaacgcaccgctgccttccggctgagaacagctttgtgagggtcacgattaagagtgaaactaattgttagccagtgtattcatctgcttgga

SEQ ID NO: 842 - DNA, 350 bp, Mus musculus
  misc_feature (225)..(225): n is a, c, g, or t
  misc_feature (227)..(227): n is a, c, g, or t
  misc_feature (234)..(234): n is a, c, g, or t
  misc_feature (241)..(241): n is a, c, g, or t
  misc_feature (246)..(246): n is a, c, g, or t
  misc_feature (250)..(250): n is a, c, g, or t
taacgttccctttctgacgctgtggcccttttatatagttcctcatgttgtggtgatacccaacaataaaatcatttttgttgctatttcataactgtaatttcgcctccttacctccactatgaattgtaaatattttggaaacaggtttgcatgaggggttgcaacccacaggttgagaaccactggtaagaggtctgtaaaaaatacataagttgtgtagtngnccatgcntgagagnaacgngacnctgaagctgaaaagcaccaggcatttgttatattgctcactaccacatcaacttcaaggtataaactgtcagctcataaggctcttctcattaaacattt

SEQ ID NO: 843 - DNA, 556 bp, Mus musculus
  misc_feature (331)..(331): n is a, c, g, or t
  misc_feature (345)..(345): n is a, c, g, or t
  misc_feature (364)..(364): n is a, c, g, or t
  misc_feature (376)..(376): n is a, c, g, or t
  misc_feature (390)..(390): n is a, c, g, or t
  misc_feature (427)..(427): n is a, c, g, or t
  misc_feature (429)..(429): n is a, c, g, or t
  misc_feature (483)..(483): n is a, c, g, or t
gaaaatagctcactgggtcctcacatagatgacacaatgatgacgatgatgatgatgacgacgatgatgatgatgacgacgattcaaatctcttggtcactactgtcagaacaaataccttgaaaaaatgttgtgccctttttctacacactagtatttttaagcttatgagagttaaagggggaaatgtaagaacatattctcatataaaattattcactaattttgctcaagggctgtgtacatgtacatgtacattaaccacaaatctgctctctctagggtttgatcaacaagcaggaacatcttgctgtgttggctgtgataatcnctaaagatccagantctcacctgaagcttgtcnctctcatgtatnctccttggtttaanagcgtttctcaaataatgaagataacagtaataaccnanctgtagtaagacacagctctttcttttcctgatctcccagagaggaagtggttntcccctaactttagaagtagaactagagagctagtgtataattcttactgaccatggtttcaatttccctttc

SEQ ID NO: 844 - DNA, 470 bp, Mus musculus
  misc_feature (385)..(385): n is a, c, g, or t
cggcctcatgaagcgcaggagctcggtgtgaaccacagccagacctggagcacctgtgagccagaggggtaggggacctgcctgcagaagccgcaggagttggccagaaggccccccaaagacgccttcgggccccatgggaagtccccagcccatcacgtcgacgcggccgcgaattccgagaaatgtgaaacttagggggtggggagcccggaaagcagccacggggagctgctgagaagcccccagtcctcagaggccctacgggggccccagacccctcacctccggagggaactaatgttctcgggttttgttttctgttttctgttttggtttggttctctctctctctctctctctctctctctctctctctctctcnctccctccctccctccttctctctctctcttctacttacacctcctctgggttctccaaagcccaaggtgtttttgtccaggtca

SEQ ID NO: 845 - DNA, 364 bp, Mus musculus
  misc_feature (43)..(44): n is a, c, g, or t
  misc_feature (46)..(47): n is a, c, g, or t
aggtcaacccacctctgagagacggcagtgctctagggcgcanncnntgggacccctccgatagatctgccctcttgaaaagcaaactgagggctctgctcgctggccctcggagcctacgaagatccagctgcttcgggggtaggattgacaggattggagcccagagtggactaggctgcaacagcttccggtaccgaagataacagccaaggaggaaaaggcagtcgattctgcttgagcagatcgcaaaagatcctaagcccttgtggtgtgtcacgcagcttggtcacattgccactgtggcgtggtgaacaccctcctggagctgcggcttcctgccttcatctatcacgatcgatgt

SEQ ID NO: 846 - DNA, 545 bp, Mus musculus
  misc_feature (319)..(319): n is a, c, g, or t
cagcagatccacctgcaggagaagaagatcatcgagctggaaaagctggtggaaaagaatatcatcctggaagaaaggatccaggtgctgcagcagcagaatgaagacctcaaagcgaggatcgaccagaacacagttgtcaccagacaactgtcggaggaaaatgcaaacctccaggaatacgtggagaaagagacccaggaaaagaagagactgagccgaaccaacgaagaactactttggaagctccaaacgggggacccaaccagcccgattaaactctcccctacatctccagtgtacagaggctcctcctctngaccctcctctccggccagagtcagtaccacacctagatgacatcaccctgccacccataggagctcaggcttctgcccatctgagggcgtgctggccaggtgccggtggccaccttgtgcgcatgctcggtagctgcacagtgcgcatgctcggtagctgcacaatgcatcttaggcagcgtcctctctgacccttgtgcaagaccatcctggtattggcgctta

SEQ ID NO: 847 - DNA, 431 bp, Mus musculus
  misc_feature (54)..(54): n is a, c, g, or t
  misc_feature (88)..(88): n is a, c, g, or t
  misc_feature (204)..(204): n is a, c, g, or t
  misc_feature (218)..(218): n is a, c, g, or t
  misc_feature (261)..(261): n is a, c, g, or t
  misc_feature (264)..(264): n is a, c, g, or t
  misc_feature (274)..(274): n is a, c, g, or t
  misc_feature (278)..(278): n is a, c, g, or t
  misc_feature (338)..(338): n is a, c, g, or t
  misc_feature (364)..(364): n is a, c, g, or t
  misc_feature (401)..(401): n is a, c, g, or t
acaagacctacaagaagtggagctcagaaggccgaggggggcggcgcggtcatnatgcccccatgatagcctacgatgcccttcttgnttcggggagcaactggaccgagctgtgccagcgagccatgtttcacggaggagagagtggagcgacagggacgatcgccggctgcctgttcgggttgctgcacggcctggccactnttccacggggcttntaccaggagctggaacacaaaggcagactagaagatctgggcncanccctgcaccncctntccacagaagaaaagtaaagtgtttctgacatttcccctcccagagggcagtgcggagcnccctcactcaggcttagagcttcctntaagttaccacccgaggaacacacacctcatgggtcncaatccaactgtaactttcccctccaatat

SEQ ID NO: 848 - DNA, 351 bp, Mus musculus
gaaatacttttatagctgctccaggtgcctgataataagcttatttttggaaagtgatgtaatacctgagccgtgaacagtgtgacctcactctagagacatggttgcctttgtaaaagtaaaccataaagccaaaggctctgaaccacttgctgtgaatagcaaagttgttctagacttttccatgggacttacttctaaaccttcacaaaattctcatcctgaggcaaactcacatgaaagcacactaaggagggttggtgagtttatactgacaggctaatatttatcagaaattttctgtaagatttgttttgtttttgcatgtctcattgatggtacttgacttgt

SEQ ID NO: 849 - DNA, 507 bp, Mus musculus
  misc_feature (421)..(421): n is a, c, g, or t
aagttattccaaacacagccccagccagccaatgccaacgcagtaggtcccgtacccacagcgaatgcagccctaccagctgacccacctgcatctgtggtggtgggacctgtggtggttccacgaggactttcagaccaccgaacttaccacgacctacgccacgccttctctcctgtggcctcggtggagtcggcctcgggagaaactcttcattctcctaaggtgggccagcctggtgctgctggtccagtgtcccccatgtgcccagggaggatcagacacttcaaaatctaggcttgattcggggaagtaaggttttggcagacaggacatagccaccactgaagctgggggcggggagggggtggcttgtccactgacaaagcaataccacatcacagctcgaattccaggtctnttcattcctcagagaacaggggcagagaggtaatggtcaaatttgatgaaaggcataaagccagcagcaacactggcactggtggg

SEQ ID NO: 850 - DNA, 506 bp, Mus musculus
gacggctacgatttcggcgatgaccccagtgacaagtttttcacatcccacaacggcatgcagttcagtacctgggacaacgacaacgataagtttgaaggcaactgtgcggaacaggatggatccggctggtggatgaacaaatgtcacgcaggccacctcaatggagtttatcaccaaggtggtacttactcaaaatcatctactactaatggtttcgacgacggcattatttgggcgacctggaaaagccgctggtattctatgaaggaaaccaccatgaagataattcccttcaacagactctccatcggagaaggacagcagcatcacatggggggatccaaacaggctggagacgtttaaagaacatttcaaagctggtttgcttttttaaaggactttatccaagcagagaactatactatttttcctatgggacaatggactttcaggacctcacttcattttcagagttaatgggatccatggtgcaaactccatta

SEQ ID NO: 851 - DNA, 443 bp, Mus musculus
  misc_feature (34)..(34): n is a, c, g, or t
  misc_feature (88)..(88): n is a, c, g, or t
  misc_feature (101)..(101): n is a, c, g, or t
tggagcccacatcaattgccagagcccggcgggncagtgctgccccaagagagtgaggggtcagggactgagccactaataactgggnaccctcaagaaangaagactcctgccagctcaattactcagaaggcccctgcctagggatgcaagagaggtattactacaacggcgcttccatggcctgcgagacctttcaatatgggggttgcctaggcaacggcaacaacttcatctctgagaaggactgtctgcagacatgtcggaccatagcggcctgcaatctccccatagtccaaggcccctgccgagccttcataaagctctgggcatttgatgcagcacaagggaagtgcatccaattccactacgggggctgcaaaggcaacggcaacaaattctactctgagaaggaatgcaaagagtactgtggagtccctggt

SEQ ID NO: 852 - DNA, 180 bp, Mus musculus
ggaagaactaggctcctacgcgcgtgcgagtacaagggcagactctcaaaggcaggggcagagccagcgcctgagcgtcaggcagaatcttcacaagtgaagcagtagtcccagcaatgacccagagggaaggaccagaagaatcctgggatgtgtggagcgcgggaccatcgtcttcat

SEQ ID NO: 853 - DNA, 541 bp, Mus musculus
gactcaagggactttcggtgccggtcgtctcaaggaggctcagctgcctgtgattgagaacaaggtgtgcaaccgcgtcgagtatctgaacaacagagtcaaatccacggagctctgtgccgggcaactggctggtggcgtcgacagctgccagggcgacagtggaggacctctggtttgcttcgagaaggacaagtacattttacaaggagtcacttcttggggtcttggctgtgctcgccccaataagcctggtgtctacgttcgtgtctcacggtttgttgattggattgaaagggagatgaggaataactgactaggtggaaggccgagcaaaacctctgcttactaaagcttactgaatatggggagagggcttagggtgtttggaaaaactgacagtaatcaaactgggacactacactgaaccacagcttcctgtcgcccctcagcccctcccctttttttgtattattgtgggtaaaattttcctgtctgtggacttctggattttgtgacaatagaccatcactgctgtgac

SEQ ID NO: 854 - DNA, 268 bp, Mus musculus
  misc_feature (79)..(79): n is a, c, g, or t
  misc_feature (123)..(123): n is a, c, g, or t
aatagattggttttgatgcctggttaaagattcagtacatccactgaactttctcagtgtctgtacaagttaccatctnaataaaaaagagatgaataaattagtgacagcacaggaaatttnccttcactggttctcatgggatcatctccatccatatctcgttttctctgctaattccttttgagatctttcgatagtaaccacgtttttgtaatttgaacaaaaatttttgatgaaaaatgtgagctcttgtaacaactctagt

SEQ ID NO: 855 - DNA, 500 bp, Mus musculus
  misc_feature (26)..(26): n is a, c, g, or t
  misc_feature (58)..(58): n is a, c, g, or t
  misc_feature (79)..(79): n is a, c, g, or t
  misc_feature (117)..(117): n is a, c, g, or t
  misc_feature (151)..(151): n is a, c, g, or t
  misc_feature (168)..(168): n is a, c, g, or t
  misc_feature (297)..(297): n is a, c, g, or t
  misc_feature (382)..(382): n is a, c, g, or t
attttttggtatcccggctgtgctcntgtcccgtagcctcagagatgctggagtgtcnacctacatgtatgagtttcgntatcgcccaagcttcgtgtctgacaagagaccccaganggttgagggtgatcatggctgatgaaatcttctntgtattcggggctccantattaaaagagggtgcctcagaagaggaaaccaacctcagcaagatggtgatgaaattctgggccaactttgctcgaaatgggaaccctaatggggaggggctgcctcactggccagaatatgatgagnaggaagggtatctacagattggagccactacccagcaagcccagagactgaaagcagaggaagtggctttctggactgagctccnggctaagaatccacctgagacagaccctactgaacacacagaacacaaatgaatgggaggctctgccagtctcaggaccagcggagcgaaaatggagctattccacaaaggatgacta

SEQ ID NO: 856 - DNA, 477 bp, Mus musculus
gttgcttacagtgctctgggaagccatcgtgaaaaacaatgggttgatcagagctctcctgttcttttggataatccagttcttggctcaatggcaaaaaagtacaatcgaactcctgcgctgattgcccttcgctaccagctacaacgtggggttgtggtcctcgccaagagtttctctgagaagaggataaaagagaatatgcaggtttttgaatttcagttgacttcagaggacatgaaagtcctcgatgacctgaataaaaatatccgatacataagtggttctagctttaaggaccatcctgattttccattttgggatgaatactaactggaggtccattttgtgccttgtgccagatgtcactgcattggaagagtgtataggaagagtattctcaaaatgtgatgattacatatcaccctaatccaagcttctgagcaattctggctctgctgaatctacccattttaa

SEQ ID NO: 857 - DNA, 471 bp, Mus musculus
  misc_feature (60)..(60): n is a, c, g, or t
  misc_feature (208)..(209): n is a, c, g, or t
aacatcctcccagtggcagatggaaaagcacccttcgctctgcaagtcaacactctcccnctaaactttgacaaggcaggagatcacagaacattccagattcgcatcaacgtaagctacactggagaacgacccagctccaacatggtcattgttgatgtgaagatggtatcaggcttcatacctatgaagccatccgtgaaaaagnntccaagaccagcctaacattcagaggactgaagtgaacaccaaccatgttctaatctacattgaaaagctaaccaatcaaaccctcggtttctccttcgcggtggaacaagacatcccagtaaagaacttaaaaccagcccccataaaagtctatgattattatgagacagatgaattcaccgttgaagaatacagtgcccctttcagtgatggctctgaacaaggaaatgcttaaaagtcggaacctatagatgtcctcag

SEQ ID NO: 858 - DNA, 341 bp, Mus musculus
gaacaagctcaagtatggccagactctcaggcccatctgtctcccctgcacggagggaaccacacgagccttgaggcttcctcagacagccacctgcaagcagcacaaggaacagttgctccctgtgaaggatgtcaaagctctgtttgtatctgagcaagggaagagcctgactcggaaggaggtgtacatcaagaatggggacaagaaagccagttgtgagagagatgctacaaaggcccaaggctatgagaaggtcaaagatgcctctgaggtggtcactccacggttcctctgcacaggaggggtggatccctatgctgaccccaacacatgcaaag

SEQ ID NO: 859 - DNA, 552 bp, Mus musculus
  misc_feature (43)..(43): n is a, c, g, or t
atgccatgttgtactggagctctgtaaagcctgcccaagcccntgtgaatctgcacgtgtgtgcagacttgtggcgggtggagggagataatggcacagggcatgtggttcttgagactcattaaaacaattcagcttccatactactcagaaccagtaaagttcaggggaaagaggcagtaaagttctgccaagggggagtgatacaaaggggctggcaatatcctgtgaacttagcttcttggggcttcatcttggcctattgtgagaatccacaggactgcagagattgtaaacacctaggatgagctttgcctctggcccttcctcatgatgtccatgggcctggccatcatggaagatcgaaagaatccacttcacaatcacctttttccatggtgtcaggagggagggcccccacccgcactccacatcctaatgccgtttaggaggtggttttgctggtgggatagaatcttgctaagataaacaacaacaacaatttttatttgtctcaaaaccatggttttctttggattcctttcatttcag

SEQ ID NO: 860 - DNA, 433 bp, Mus musculus
gaccggaaggaccatcaccagtgtagaagctgttctcttgcagcaggtggggtggggcctggaggaaggcaggcatggggaatcttcatttcttcccaaggggctcagggggtgatcttttgtgggctggcacttgtggacacagttttggctagaggtaggttaggcaagtccctaacttagggtccctccacatttgtaagcagaggctggagaggccatctttagacatattccagacaccctgggtgggaaaaggagagacaagtgttggtctcccaagcttagactggccttggtgttatacttcatggttggaggctgacctaccctacaagagtgtcccttgctgaagacattcaggtccccaacctgtgtcctgtcacccaagtcacccctctggtatttggagatgccaacactgccaggagtc

SEQ ID NO: 861 - DNA, 146 bp, Mus musculus
gaaggtgacaataaaatggtgacaactttcaaaggcataaagtccgtgactgaactcaatggagacacaatcaccaataccatgacattgggcgacattgtctacaagagagtcagcaagagaatttagacaaggctatatttcat

SEQ ID NO: 862 - DNA, 293 bp, Mus musculus
  misc_feature (27)..(27): n is a, c, g, or t
  misc_feature (73)..(73): n is a, c, g, or t
tggtcagctgtggaaaggaagcctcgnttgccaccatgaacttctccggcaagtaccaattgcagagccaggnagaactttgagccattcatgaaggcaataggtctgcccgaggacctcatccagaaagggaaggacatcaagggggtgtcagaaatcgtgcatgaagggaagaaaatcaaactcaccatcacctatggacccaaagtggtccgcaatgagttcaccctgggggaggagtgcgaactggagaccatgactggggaaaaagtcaaggcagtcgtcaagctgga

SEQ ID NO: 863 - DNA, 126 bp, Mus musculus
  misc_feature (97)..(97): n is a, c, g, or t
ggtgcccctccaaccaggatgaggctcttcatcgctcttcctgtcctgattgtggtcgtagccatgaccttggaaggcccagcccccgcccaggcgnccccggatttgtccggaacattggagagc

SEQ ID NO: 864 - DNA, 505 bp, Mus musculus
ctttctcttccccaagaatacacagtttgtgttatgccactacgtggtgtcccgggatcccagtgtctttcctgagcccaacagcttccagcctcaccgatggctgaggaagaaagaggctgataaccctgggatcctacatccattcggctctgtgcccttcggctatggggttcggtcttgcctgggtcggaggattgcagaactggagatgcaactgatgctgtcaaggctggtacagaagtatgagattgccctggctcccgggatgggagaagtaaagactgtgtcccgcatcgtcctggttcccagcaagaaggtgaggctgcattttctgcagagacagtagtaccgagctgggctcccgccttcatggagctcgtccagaagccctggcacagaagttcttggccagtctcatgtcacatgtcacgatgtcagattcaacaggagaactctgtgcccttcctatagacaccaaatgtctggcacaatctctactgag

SEQ ID NO: 865 - DNA, 520 bp, Mus musculus
  misc_feature (39)..(39): n is a, c, g, or t
gggcattacactcagtaggctttgcaaacccagcttctnggtactcatttggcaatcctaagtagcaagagtgaggtgacaggagtgggagatggtgtgtggggtgactgaccgcaagccagtgcttgaccgtgctggaaacccatgccactacaacctggagttgggctcctgttaattctcgcagcctggtgctggctgttacagttggtccatggagaggaactcctgtctccccagggttgtcatgagagcttttgttggaagggagcaggaggagagcatgatgcagagaacatgtgatggagtgtgtacgtccctgccagtggtcctgctggtgggtccagtgatgggaccgggcagagcccctatttccttagagaactctgaatccagataaggaactgagccatccacacgatgaaggagggcttctaaaaaaatcctgtacagaacaaactgtgtgccttcctcatcatacagtccctacctcctgactctcagggtggaactgactttt

SEQ ID NO: 866 - DNA, 299 bp, Mus musculus
cagtgatgaatggatttgcctctctgccacccccttaccagctctgcttcattcctctctaaagagatcagactttctggcccctgctgtgatgccttctacaattgtctcaggtctttatccacatccctccctatcagggatatggtatctttcatcctggcttacagaaccctcttctctcaagacccagcaaacacatacagtttctggagttatagtacaaatgcacttgtattttctcttttatataacagttttctgattccttgtgctttatgtgtatccattcttgagta

SEQ ID NO: 867 - DNA, 570 bp, Mus musculus
gcagctcttccttgctgtcagaagaaaaagctttgaagataactgaagaattaagggactggaatcaatgaactttcaatttagttttttttaatgaggtggtgatattatagcatggttaagctttaatttacatctttgattgggctctggttgaataaacctagggcatagcatattaatgaagagtgtcatccctggattcctttatttacaattttttaaaggtcgaagattttccccagagaatgacaagtggttttgacaacacactctaggccttctattaaaagcaattctgtagaaatgcaacagggagttcaactatcaatcagcctgatgatggcaaattgctctgggggttgaaatgggactgtgaccattctttttctgtgttccatatttgctgcgcataaggcttccaaaacaaatcaatgcatagaaacttaatgataatttataatgattatgtgacttttcatgtgtgttattttacaaactaaaatactggcagaagatgttattcaaaccctggggcacaatctgtggttctaattgccacctagtggc

SEQ ID NO: 868 - DNA, 457 bp, Mus musculus
aagcagctgtctgcatttgctatatgggtacagacagtacctctaacttgtaataaccccaaaggccacaacagcttccagatctcactagaaatcagttacacaggcagccggccagcctccaacatggtgattgctgatgtgaagatgctatctggtttcatcccattgaaaccaacagtgaaaaagcttgaaagattagagcacgtgagcagaacagaagtgagcaacaacaatgtcttaatatatttggatcaggtgaccaatcagacactggccttctccttcatcattcaacaagatatcccagtaaggaacctgcagcctgccattgtgaaagtctatgactactatgagacagatgaaatggcttttgctgaatacagcagcccctgcagcacagacaaacaaaatgtttgaaactcctatttgtagacaaggcattgctggaatcccc

SEQ ID NO: 869 - DNA, 333 bp, Mus musculus
gtacagacagtacctctaacttgtaataaccccaaaggccacaacagcttccagatctcactagaaatcagttacacaggcagccggccagcctccaacatggtgattgctgatgtgaagatgctatctggtttcatcccattgaaaccaacagtgaaaaagcttgaaagattagagcacgtgagcagaacagaagtgagcaacaacaatgtcttaatatatttggatcaggtgaccaatcagacactggccttctccttcatcattcaacaagatatcccagtaaggaacctgcagcctgccattgtgaaagtctatgactactatgagaca

SEQ ID NO: 870 - DNA, 449 bp, Mus musculus
  misc_feature (418)..(418): n is a, c, g, or t
aaggtggagcaggagctcaccccagagctgctgcaggagtggctggatgagctgtcagagactatgcttgtggtccacatgccccgcttccgcaccgaggatggcttcagtctgaaggagcagctgcaagacatgggcctcattgatctcttcagccctgaaaagtcccaactcccagggatcgttgctggaggcagggacgacctctatgtctccgacgcattccacaaagcatttcttgaggtaaatgaggaaggcagtgaagcagcagcgagtacttctgtcgtgattactggccggtcactgaaccccaatagggtgaccttcaaggccaacaggcccttcctggttcttataagggaagttgcactgaacactattatattcatggggagagtggctaatccttgtgtgaacntaaaatattcttaatctttgcaccttttcct

SEQ ID NO: 871 - DNA, 420 bp, Mus musculus
agaagacgctgttctctgtgttacctggcttgaagatgaccatgaatatgatgggactcctacagctcagtggcccagacaaagtcaccatcggcctcctgtccctggatgaccctcagagaggactaatgctgcttttgaatgacacccagcacttctccaacaacgttaaaggggagcttggtcagttttaccgggacatcgtctgggagccacccgtcgagccagataatacaaaacggacagtcaaagttcaaggagttgactacctggctaccagagagctcaagttgagttaccaagaagggttcccaggagcagagatttcctgctggacagtggagatatagaactgttaggagcgccactccctgccatgttgtcctcgtacgcaggcagatgacaccttatgccaacagg

SEQ ID NO: 872 - DNA, 468 bp, Mus musculus
  misc_feature (380)..(380): n is a, c, g, or t
  misc_feature (400)..(400): n is a, c, g, or t
tacttcggtgatcacactgctgtttccaaggaaacccttcagctggctgaagcatttcgggatcgctgcaatcatcatcgcactcaacaacatcctggtcatcctcgtgcctaccatcaaatacatctttggattcataggggcttcttctgccactatgctgattttcattcttccggctgcgttttatctcaagctcgtcaagaaagaacctctaagatcaccccagaagattggggctttggtcttccttgtgactggaattattttcatgatgggaagcatggcgctcattatactcgactggatctacaacccgccgaatcccaatcaccactaatcccggggagacgcgtctccactggaaacagctgaaattntctgaaggacattttagttntcttgattgggatgttagtctgaggaattagcaagattccaaagacgtttttctagctctatcatggg

SEQ ID NO: 873 - DNA, 352 bp, Mus musculus
  misc_feature (101)..(101): n is a, c, g, or t
  misc_feature (110)..(110): n is a, c, g, or t
  misc_feature (134)..(134): n is a, c, g, or t
  misc_feature (155)..(155): n is a, c, g, or t
  misc_feature (171)..(171): n is a, c, g, or t
  misc_feature (208)..(208): n is a, c, g, or t
  misc_feature (305)..(305): n is a, c, g, or t
ctgttcctaggccatagtctgccatcatgaagctgctcgcaatggtcgcactgctggtcaccatctgtagcctggaaggagctttggttaagagacaggcngacggaccngatatgcagagcctgttcactcantactttcagagcatgactgantatggcaaagatttgntggagaaggccaagacctcagagattcagagccaggncaaggcatactttgagaagacacacgagcagctgacaccccttgtcaggtcagcaggaactagtctggtgaacttcttcagcagtttaatgaacctngaggagaaaccggctcctgcggctaagtgagatgtgccaggcccagt

SEQ ID NO: 874 - DNA, 478 bp, Mus musculus
  misc_feature (342)..(342): n is a, c, g, or t
gggctacctttgagattgtcctgcacagaacatggaaggggagtgcagtccaccaggacttcctgggtttctatgtgctggacagcttccggatgtcagcccggacaaaggggctactgggacaattcttctccccactggattttgaagtatttgacctccacccaggctctgaccctacaaagacagatgccacaatggtggtgaagaatcggcagctgacagtcacccgagggttgcaaaaagactacagcaaggaccccagacatggagcagaagtgccttgctggtttgtccacgacaatggagctggactgattgatggtgttcacactgactatntcgtctctgacatcttctgagccctccagctaacacagcagcctttgcctggaacggcctatgaaggaggagaggagagcagagcatcagattaactccaccttcctgagcatactggtccctgtgtcaagacatc

SEQ ID NO: 875 - DNA, 130 bp, Mus musculus
agtgcccaatggacagcccaggcctagaaaccttggtgtctttccttttccggttgccccctacccctaccagctctgtgctgtgatgcgtgagcaaggacactaattccagtcatggtaggcagggcag

SEQ ID NO: 876 - DNA, 434 bp, Mus musculus
gacacccttgtggataacatctctgtggatcctgtgacaggggacctctgggtgggatgccatcccaacggaatgaggatctttttctatgacgcagagaatcctcccggctcagaggtgcttcgaatccagaacattttatccgaagaccccaaaataactgtagtttatgcagagaatggtaccgtcctgcaaggcaccacggtcgcctctgtgtacaaagggaaactgctgattggcactgtgttccacaaagctctttactgtgatctgtgacaagccagctgcacgcacgtcatcgaaagtgaggccattatttcaatcctttgccatactgtaaggtgcctaccacagtgatctctgctaactaatgaatgctgaccttagtctcagacataagaaggtatgagagtttcctggcaatagatcctaac

SEQ ID NO: 877 - DNA, 562 bp, Mus musculus
acctaggcacagctttgtattacgccattaagaactgctctgacaaggccaaggaacgaggtcgagatggggccatagatctgggttatgatctcttgatggccatggtaggcgcgtcagggggcccagctggtgcggtgatcacggctgctcttaagccagcgatgaaggctggggttcagcggctgatccagtattattatgatgagaaagaggtgaccacccctcagccagaggtgaccacccatcagccagagaccggaaaggatgccaccacagatatcggtgttgtggaagaaatagccatgtctaattttgtgtcagaagttgaaagtacaacttctaactgggagtggcctttattaaagaactatggtgtcttggcgtacaagagatagtaacaaaacaaccaataagtggaaaattctgacaagagaagtgtagatggatggatgggtgggtggatggtttgggatactgtcatcgcttgccagtaatttccttcttgaaacttagatttttacactctaatggggctggctaacttccacctgaacaagtg

SEQ ID NO: 878 - DNA, 438 bp, Mus musculus
  misc_feature (231)..(231): n is a, c, g, or t
  misc_feature (272)..(272): n is a, c, g, or t
  misc_feature (280)..(280): n is a, c, g, or t
  misc_feature (304)..(304): n is a, c, g, or t
  misc_feature (345)..(345): n is a, c, g, or t
  misc_feature (350)..(350): n is a, c, g, or t
  misc_feature (354)..(354): n is a, c, g, or t
agctggagagacctgtgatcctgaaccatcacgtggccctgatttgcctgcctcctgaacagtatgtggtacctccagggaccaagtgtgagatcgcaggctggggtgaatccatcggtacaagcaataacacagtccttcatgtggcctcgatgaatgtcatctccaaccaggaatgtaacacgaagtaccgaggacacatacaagagagtgagatatgcacccaggganctggtggtccctgtgggggcttgtgagggtgactacggggncccacttncctgctatacccatgactgctggntcctacagggacttatcatcccgaacagagtgtgtgcacgnccccnctgnccagctatcttcacacgggtgtctgtgtttcgtggactggattaacaaggtcatgcagctggagtaggcctgcttttgagccct

SEQ ID NO: 879 - DNA, 469 bp, Mus musculus
  misc_feature (26)..(26): n is a, c, g, or t
  misc_feature (82)..(82): n is a, c, g, or t
  misc_feature (122)..(122): n is a, c, g, or t
  misc_feature (232)..(232): n is a, c, g, or t
agctactccaggtacgtaggtgccantgcagccccggacgctcctcactgtggccctcttggctctcctggcatctgcccgnagctgaagaggtagagggatccttgctgctgggctctgtncagggctacatggaacaagcctccaagacggtccaggatgcgctaagtagcgtgcaggagtccgatatagctgtggtggccaggggctggatggacaatcacttcagatncctgaaaggctactggagcaagtttactgacaagttcaccggcttctgggattctaaccctgaggaccaaccaactccagctattgagtcgtgagacttctgtgttgcagatgtgcctgttcctccatcctgctgcccccctccaggcctgccaggtggcccctgaaggttgctttaaggggaaagtatgttctcatgtcttcacccctccctagatctcacctaaacatgctgtcc

SEQ ID NO: 880 - DNA, 367 bp, Mus musculus
gctgctgatggattacgcgggcaacgccagtgctgtcttcctcctgcccgaagatgggaagatgcagcatctggagcaaactctcaacaaggagctcatctctaagatcctgctaaacaggcgcagaaggttagtccagatccatatccccagactgtccatctctggagactataacttgaagacactcatgagtccactgggcatcacccggatcttcaacaatggggctgacctctctggaatcacagaggagaatgctcccctgaagctcagcaaggctgtgcataaggctgtgctgaccatcgatgagacaggaacagaagctgcagcagctacagtctttgaagccgttcctatgtctatg

SEQ ID NO: 881 - DNA, 565 bp, Mus musculus
  misc_feature (143)..(154): n is a, c, g, or t
gaaggcttcttctactttcaagaccgccttggtgacaccttccggtggaagggcgaaaacgtatctactggagaggtggagtgtgttttgtctagcctagacttcctagaggaagtcaatgtctatggtgtgcctgtgccagnnnnnnnnnnnnggtgtgagggtaaggttggcatggctgctgtgaaactggctcctgggaagacttttgatgggcagaagctataccagcatgtccgctcctggctccctgcctatgccacacctcatttcatccgtatccaggattccctggagatcacaaacacctacaagctggtaaagtcacggctggtgcgtgagggttttgatgtggggatcattgctgaccccctctacatactggacaacaaggcccagaccttccggagtctgatgccagatgtgtaccaggctgtgtgtgaaggaacctggaatctctgaccacctagccaactggaaggcaatccaaaagtgtagagattgacactagtcagcttcacaaagttgtccgggttccagatgcccatggcccagtagtacttag

SEQ ID NO: 882 - DNA, 467 bp, Mus musculus
  misc_feature (26)..(26): n is a, c, g, or t
  misc_feature (43)..(43): n is a, c, g, or t
  misc_feature (49)..(49): n is a, c, g, or t
gagcacgttcagttggctagacacantcacggtcacacagacngggctntctgtaacaatcaacaggaaaaagaatatggtggtgtcctttggagatgggattagctttgtgatcatcctacaccaggtttggaagaaacatccagttcaccaggacttcctagggttctacgtggtggacagtcaccggatgtcagcacagacacatgggctgctgggccagttcttccaaccctttgactttaaagtgtttggcatccgcccaggctctgaccctacaaagccagatgccacaatggtggtgaagaatcatcggttgactgtcacaaggggctcccagaaagattacaggaaggatgccagtgttggcaccaaggtcatctgctggtttgtccataacaatggagaaggactaattgatggtgtccataccgactatattgttcccagcttgttctgagtagcat

SEQ ID NO: 883 - DNA, 465 bp, Mus musculus
  misc_feature (395)..(395): n is a, c, g, or t
gtgctagccattgagcttctcgcggcctgccagggtatagagtttctgcgccccctgaaaacaaccactccgctggagaaggtgtacgacctggtgcgctccgtagtaaggccctggataaaagatcgcttcatggccccggacattgaggcagcacacaggttgcttcttgaccaaaaggtttgggaggttgccgcaccgtacatcgagaaatacagaatggagcacattccggaatccagaccgctttctccaacagcgttttcactagaatctctccgaaagaactcagccacaatcccagagtctgacgatctttaacgggcttcctcgaggacaggcacatcagatgggcctgagcttagcacagcactggtgtgttgatggagagagantctcaggaactgcctgtaatgtgtaaaactcatctcttttcaaacatactctggataggccatggcagca

SEQ ID NO: 884 - DNA, 548 bp, Mus musculus
  misc_feature (145)..(145): n is a, c, g, or t
ccctgggcactttctagatgagaacggaaagtttaagaaaagtgactacttcatgcccttctcaacaggaaaacggatatgtgcaggagaaggcctggcacgcatggagctgttcctattcctaaccagcattttacagaacttncaacctgaaacctctggttcacccaaaggacatagatgtaaccccaatgctcattggattggcctcagtgcctcctgctttccagctctgcttcattccttcctgaaaatcaaatgcctggctccagctgggacatcttctgtgatcaccctgaggctttaattcactactttccacactggacacactgctttttatccatttcttttgcctgctcataatttcataaggttctatgaacatacatttaccaatttgcagatcctgcacaaatatttctgactggtcctattttctgaaacactgttaccatatgctgtgatgatatggacctgattccaagttaaatatactctcataaaattgaaattactattgtaagataattcactgtcgcttctct

SEQ ID NO: 885 - DNA, 241 bp, Mus musculus
gtatgagcaccgaaccagctgtctgctcttcatgggaaaagtgaccaaccctgccaagtcttaatggcagtggtctgggcacctgatgtagtttggggacactctgtattcctgttttcattctaacaaagaggacagagctattttgctatgataatctctgtggtttatgataataatctgaacagcaaacagtgccattaagtgcacagatgttaatgcaactaatggttgtgccagc

SEQ ID NO: 886 - DNA, 411 bp, Mus musculus
agagggaccaagtccccagaaatgtccctgctgaggtgcaggccacgggacctgccatcagtctccctttctgtgctgttcttggtcagctttgtagcatccatgtctacagaaagcctgagccccacgcctggccctgagagcagccgctggagcctggtaagggccagggtgttggagatggtggagccactggtgaccagaaccagggacagatggcagtggttctggggccctggagctgtccagggctttatgcagacctactatgaagatcacctgaaagacctgggtccccgaactcaggcctggctgcagagctccagagaccacctcctaaacaagacccacagcctgtgtcccagactgctctgcaaagaccggactcagggttaaagtgccacgtacctc

SEQ ID NO: 887 - DNA, 508 bp, Mus musculus
  misc_feature (471)..(471): n is a, c, g, or t
  misc_feature (481)..(481): n is a, c, g, or t
ctccatatctgttccaaccgaatgacagatgtatcatctctggatggggtcgagggaaagataaccaaaaagtctactcactcaggtggggcgaagttgatctaataggcaactgctctcagttttacccagatcgctactatgagaaagagatgcagtgcgcaggtacgcgtgatgggtccattgatgcctgcaaaggagactccggaggccccttggtctgtgaggatatcaacaatgtcacttacgtttggggcattgtgagctggggagaaaattgtgggaagcccgagttcccaggtgtttacaccagagtggccaattattttgattggattagctatcacgtaggaaggtctcttgtttctcaacacaatgtctgaagctatgacctccttctttctacatttattcttttaggagttacattttaattgaaatgaaactgtatagttagttctcctcagagcntggcaagaangcaactcctactggctagtcctaaagt

SEQ ID NO: 888 - DNA, 272 bp, Mus musculus
tagctcctggaggttctgacgattggatctatgatttgggcatcaaatattcgtttacaattgagctccgagatacaggcagatacggattcttgctgcctgagagatacatcaaacccacttgtgcagaagctttggccgccatctctaaaatagtttggcatgtcatcaggaacacttaatgccctaacctccgctctcattatttttattttattgatttcagcaacacttaactgttgcattagcttctaagttgaatcagtttcctt

SEQ ID NO: 889 - DNA, 549 bp, Mus musculus
  misc_feature (66)..(67): n is a, c, g, or t
  misc_feature (69)..(69): n is a, c, g, or t
  misc_feature (72)..(72): n is a, c, g, or t
  misc_feature (75)..(75): n is a, c, g, or t
  misc_feature (79)..(79): n is a, c, g, or t
  misc_feature (81)..(81): n is a, c, g, or t
gaaattgcagccctacgatcagagctgagagccctgagaaactgggtgctcttctctctgagtgannanaangtnggananagaagtattttgtgagcagtgttaaaaagatgagccttgacagagtgaaggccctgtgctccgaattccagggctctgtggccactcccaggaatgctgaggaaaactcggccatccagaaagtggccaaagatattgcctacttgggcatcacagatgtgagggttgaaggcagttttgaggatctgacaggaaacagagtgcgctatactaattggaatgatggggagcccaacaacacgggcgatggggaagactgtgtggtgatcttgggaaatggcaagtggaacgatgtcccctgctctgactcttttttggcaatctgtgaattctctgactgagggtgcttgtttctcagccctccttgattctttagggtactcctgacgtccgcagtttgttctgaaaaataaaatatgggaaaatataaacaattcaacattggttacccaatgcattctcttgtga

SEQ ID NO: 890 - DNA, 318 bp, Mus musculus
catcctcatggacatgacttccttgactatggaccttgtgacccgccctccaatagtcaagaactcaaaggtcagtatcatcggggctatggtccaccacatggacactcaagaaaaagaggtccaggcaaaggactctttcctttccaccaccaacaaattggatatgtctaccgactccctccactgaatataggtgaagttctcactcttcctgaagccaatttccccagcttctctttgccaaattgcaacagatccctacaaccagagattcagcccttccctcagacagcctccaggtcatgtccagggaaa

SEQ ID NO: 891 - DNA, 484 bp, Mus musculus
gttctttgtgaaggatccggaaatccggctacccacaatcaccaccgtgactgtgcctgccggctacaactggagggacatcgtcagctatgtgctggaccacttcagcattgaaatctctgggggtcttgggcccactgaggagagggtgctacggattggcctcctgggctacaacgccaccactgagaatgtggaccgtgtggccgaggccctgagggaggccctgcagcattgtcctaagaacaagttgtgagcatcctctcaccagactatgccctcctggaggggctgggaatatagcaagaacgaaaagactgtgcaaggcctagagccagcaaagatgctgatgtagccaggccatgccggaaggagcagggtgaagcttcccctctccctacaaatggaaccttgtggaaacaggatgctaaacaccttctgatggagctgttgcctgcaggcgcactggtctttgggaattttc

SEQ ID NO: 892 - DNA, 487 bp, Mus musculus
agacgccaagattcccgttgaagatcgagtatacctcgttgctcagcttgcagtcgttttaaagcgtatttttgtgaaccttgtgtgggaatattttcagacctattttggatagacacggcctcctaggcatggaatgaactttctcatagccctttagtaggtgtgcacacagcagctgcccacggtgtgtagctagacgctggctgcattttacaaattcatacattgtcttcctttgatcctaatgtgtgaagacacttgatatgacttcagtctttcagtttctaaatgctatgggtattgcaatttccctctttaatactttttaattccttgcttaatgctttttaatttcccagctgaattctgggccttggttgtattcatattgttttgggatattaaggaaaggaaggtttgttgttttgttttgttttgtttttgagacagggtctgcctgggtaactctgtctatcttggaact

SEQ ID NO: 893 - DNA, 501 bp, Mus musculus
aaacctgtacccttcagtgactatattcaccccgtgtgtttgccagacaagcagacagtaaccagcttgctccgggctggttataaagggcgggtgacaggctggggcaaccttcgggagacatggacaaccaacatcaatgagatacagcccagcgtcctgcaggtggtgaacctgcccattgtagagcggccagtgtgcaaggcctccacccggattcgaattactgacaacatgttctgtgctggcttcaaggtgaatgacaccaagcgaggagatgcttgtgaaggtgacagtggaggaccttttgtcatgaagagcccctttaacaaccgctggtatcaaatgggtattgtctcatggggtgaaggatgtgaccggaaggggaaatacggcttctacacgcatgtgttccgtctgaaaaggtggatacagaaagtcattgatcaatttggataggtgtgtgggtgggtaaaggacctacactatggaatcctcatt

SEQ ID NO: 894 - DNA, 450 bp, Mus musculus
  misc_feature (292)..(292): n is a, c, g, or t
  misc_feature (302)..(302): n is a, c, g, or t
  misc_feature (332)..(332): n is a, c, g, or t
  misc_feature (371)..(371): n is a, c, g, or t
  misc_feature (392)..(392): n is a, c, g, or t
  misc_feature (415)..(415): n is a, c, g, or t
  misc_feature (425)..(425): n is a, c, g, or t
gtttcagagggacacctacgactatgatatcgccgtgctgaggctgaagactcccatcacgttccggatgaacgtggcccctgcctgcctgcctcagaaagactgggccgagtccacactgatgacacagaagacgggcatcgtgagcgggtttggacgcacgcatgagaagggccgccagtcgaacatcctgaagatgctggaggtaccctacgtggatcgcaacacctgcaagctctccaccagcttcagcatcacacagaatatgttctgtgcgggctatgaggccaanttagaggatncctgccagggggacagtggtggcccccatntcacacggttcaaaaatacctactatgtgaccggcattntcagctggggagaggggtgtncaaggaaagggaaatatggcatntacacaaagntcacgaccttcctcaagtggattga

SEQ ID NO: 895 - DNA, 562 bp, Mus musculus
ggttctttgccctcagcgagatgaagacctttgtccttcttatgattatgtacttcgacttcaagctggtcgaccccgacatacctgtgccccccattgacccaaggcgctggggctttggcacctcacagcctagccatgaggtacgcttcctctatcgcctgaagcccgtgcagtgagctcaggtctgagcataccctgcagcccagagcagcactgaatacccatcctctggctctgaggcactccttcctctccccagctctcagagatctgtcatgctccccataagacgccatccctccagcggtctctgcctgaccctcctctcaggaggaacacatgtggtcagctcagtttacaactgatggctcacccacacttgactcatcctggagggcagaccagctcccgtgagtcagatggcatcttgcaaatgctgcctcaacccatccagcctgccttactcgatgcccttactccaaatcctaccagctcagactccagggatgttgctcaatggaatcgagccatgtgtgcgactgttaatttcccactagat

SEQ ID NO: 896 - DNA, 244 bp, Mus musculus
  misc_feature (204)..(204): n is a, c, g, or t
agctgcacaggagcattcttggaaggagatacagaaatttctcaagcagcatctccttccagatttgagcagtcagctctgagtggacttgattatattcctggaaagtggagctgggcatctcctggccagcaccactcctcacttccatagaggaatgtctttgatctcttatctggcaaggaaggagagtaccacaagaanatacaggaggatggagagtgataacgtcttgaatttggaa

SEQ ID NO: 897 - DNA, 115 bp, Mus musculus
tgtcttccttctgcccgaatgatgggaagatgcagcatctggagcaaactctcagcaaggagctcatctctcaagttcctgctaaacaggcgcagaagcgttagctccagatcca

SEQ ID NO: 898 - DNA, 527 bp, Mus musculus
  misc_feature (213)..(213): n is a, c, g, or t
  misc_feature (465)..(465): n is a, c, g, or t
  misc_feature (471)..(471): n is a, c, g, or t
gaatacagcctatacatcggacaatcaaaagtcacagtccgtggtatggaagaatacctttctccagtacacctatgtaccacttgggagtcctcctctggcattgttgaattttgggtcaatggaaagccttgggtaaaaaagtctctgcagagggaatacactgtgaaagccccacccagtatagtcctgggacaggagcaggataactanggaggagggtttcaaaggtcacagtcctttgtaggagagttttcagatttatacatgtgggactatgtgctgaccccacaagacattctatttgtgtacagagattcccctgtcaatcctaatattttgaattggcaggctcttaactatgaaataaatggctacgtagtcatcaggccccgtgtctgggattgagatcttacaacaaaacctcatggacatcagatggccgatgtgtaagaggtcaaggcngcaganttcactctatctggagctttttcttctttgtgaacatcttgtatacatatctgcca

SEQ ID NO: 899 - DNA, 238 bp, Mus musculus
gggatcctcaggctatcattacctgcgttcaactgtgagcgacaggtacaaggtttttgtggatttatttaacctctcaacatatctggttcccagacactgggtaccaaagatgaatccgatcattcacaaattcctttacacagccgagtacagtgacagctcttacttcagcagcgatgaatcggattgagttcttctgaacatcagtgaaaactacaggattctcagtcggctt

SEQ ID NO: 900 - DNA, 180 bp, Mus musculus
ctgctttccacactggaaacactgacttttatccagttcttttgcctcctcataatttcataaggttctatgaacaaacatttaccaatttgcagattctgcacaaatatttctgacagttcctattttctaaaacactgttaccatatgctgtggtgatatgtacctgatcccaagtta

SEQ ID NO: 901 - DNA, 76 bp, Mus musculus
agcaagtgaccagtgacttcacccgtgtcctagacagacaagataggagcccagcttcgagtggagaagccagcga

SEQ ID NO: 902 - DNA, 449 bp, Mus musculus
  misc_feature (71)..(71): n is a, c, g, or t
  misc_feature (409)..(409): n is a, c, g, or t
aactgcgctgggaatggacgacacagagaccccagagccccacctgggcctgtggtactttattgcgggancagcctcccaccacggaagagttggcaacttttgatccggtggacaatattgtcttcaacatggctgccggctctgccccaaggcagctccagcttcgtgctaccatccgcacgaaaagtggggtctgtgtgccccggaagtggacataccgattgactgaagggaaaggaaacatggaactcagaactgaagggcgcccagacatgaaaacagacctgttctccagctcgtgcccaggaggaatcatgctgaaagagacgggccagggctaccagcgctttctcctctacaatcggtcaccacaccctccagagaagtgtgtggaggaattccagtntctgacctcttgcttggacttcaaagccttcttagtgact

SEQ ID NO: 903 - DNA, 513 bp, Mus musculus
  misc_feature (276)..(276): n is a, c, g, or t
  misc_feature (293)..(293): n is a, c, g, or t
  misc_feature (357)..(357): n is a, c, g, or t
  misc_feature (361)..(361): n is a, c, g, or t
  misc_feature (378)..(378): n is a, c, g, or t
  misc_feature (393)..(393): n is a, c, g, or t
  misc_feature (452)..(452): n is a, c, g, or t
  misc_feature (484)..(484): n is a, c, g, or t
gctccttcaagaagcgtcttcgaagactcatcacaccagaccccagtctgccccagccagggcggcgcccaccacaggatggctcctctgctcaaaactgttcgtcctctccagccaaacaagaactcattgcctgggagaaggagactcatttgtaggaagtgccagaggccaggtgactccagagccaggaacctggtcaaggctagctcctcccaggggtaacctctgctgcaccctgctgtgacctctcaggtctccggacacccctgccantcttctgggagccactnttctgttcagctggaacagcttgtcacctctcagtcctttccaagtgagctctaggaagctgantctnccaagtgttttgaactnaacatcttgactttntggattaaaaaactaagaaccagacaggcaaagtgatattttcaaggtcacacagcctntcagagccctagaccttccttgaacttgctgntctcagctgaggcgtgtgagcctccagca

SEQ ID NO: 904 - DNA, 325 bp, Mus musculus
  misc_feature (147)..(147): n is a, c, g, or t
gaatcctacggacagcagttttttgacgacttttgcagcaccaccaaacgagagttgatgaagtgtagcaggaacctgagcctagtcacggactgcatggagcacgccctgacctccacgcatcctcgcacccggtactcggctggntgggatgccaagtttttcttcatccctctatcttatttgcctgcgtcactggtagactacttattggccatatctaggggcaagccagctcaagcagcctgaaggatcccggattggtggctgttggaatgaagaaatgactcagttattcccaacactagctatctgcgcagacacg

SEQ ID NO: 905 - DNA, 367 bp, Mus musculus
gacacatgcattttctttgcacatgttgtaccaaacattgagaataaaaaaaaaagaaatttaagaaaattagtctataattatcagaaaacttaccttagaatgcatttttaacagctatgcaaatgaattggaagacccacattgactgaagaaagctaagagcaatgaataagtaagccttcactccggaggcctttcagttctgagataagtgtgtgccagacactggctggtagaggacatcagcagtcaactccaccactgtcttgtttttttcttttgttttggatgtgagatatatagatataggagatataggtagatatagatttagatatatggatctctctctacatatatatat

SEQ ID NO: 906 - DNA, 458 bp, Mus musculus
  misc_feature (32)..(32): n is a, c, g, or t
gctcagctcaggttctaactagtcttggccancactacctaagaagtggcgatcgcatcactctttcttggctttattctcattgtcttttgatcgaaacaaaagtctgctttccgctctagaagggaagcaagacacaacatcactgagcgggagtaaatgaattggttccctcataaagcaaaggcattcttctagagaaggccagtctggtttgtagggacgagaaggcacggatgaagacggagattctagtcatacgggagcaactgctatgccaaagccaggtccctaggcggaagactaactccacaggagcagagaaagaaacgtggggaggatggatggagcctgtgggatggaggatgaggaacttgggattcatcctgctcttgtcacatgttgtcacatgttgccactttcagagtgtggcatacttcactatattggcccatctg

SEQ ID NO: 907 - DNA, 363 bp, Mus musculus
gtcctccatgctgaaagatgagtctgtctgggagaagcccctccgcttccatcctgaacacttcctggatgcccagggccactttgtgaagcctgaggccttcatgccattctcagcaggccgcagatcatgcctgggggaggccctggcccgcatggagcttttcctcttcttcacctgcctcctgcagcgctttagcttctcagtgcctgatggacagccccagcccagcaactctggagtctatggtattcttgttgccccctctccctaccagctctgtgctgtggtacgagaccaaggacactaattccagacatgctctgtagggcagtttcctgccatgtataataaactagtctt

SEQ ID NO: 908 - DNA, 498 bp, Mus musculus
  misc_feature (321)..(321): n is a, c, g, or t
tcagaaatcggcctgacttttcctcccaaggtgctgggattaaaggcgtgcaccaacactgcctgctgattttattgcttagaaatgcacatgaatattactgctacagtttcaacttccatttgaagtatcaactcatttcttctcataaatataaactttttagttatatggtgatcaatttgtaactttaaagacaattgccaaaatgcaaaagcagtaatacaaaactcctaatccaaaatatgatatgtccaaggacaaactatgtcaaacaagaaaatttgatgtaagtttttcagcattgtttttctattcagnacttcctcagattttcctggataccttttgatgtaacgttttgatttataatgaatgaacgatatattgactcattcttcaaatttagtattatttctgaatcatgtaacaaccaaactatcatatattatagtactaatgcatataattaaaaactatctaatactttcatatcaa

SEQ ID NO: 909 - DNA, 490 bp, Mus musculus
  misc_feature (268)..(268): n is a, c, g, or t
ggctgtggacagtactctgctcaaagaacccaaaggcatcacccaggtgtggacgtcctgtgctcggatggatctgtggtgtatgcaccattcactgggaagatagtgggccaggagaaaccctatagaaacaaaaatgccatcaatgatggcattcgactgtctggaagaggtttttgtgtcaaaattttctacattaagccaattaagtataaaggttctatcaaaaagggggagaagctgggcaccttgctgcccctgcagaaantttacccgggcatccagtcgcatgtacacgttgaaaactgcgactccagtgaccccacagcatacctgtaagcagagacaaaggccagatcttctaaattcaaagccatctcagaaactgggacatgccctgctcccgaagaaacgtgcattctaacagaaacataaatctgtgtaaacactcacaaccctgattccaagtcatcaccgctctgacgggtgg

SEQ ID NO: 910 - DNA, 511 bp, Mus musculus
  misc_feature (76)..(76): n is a, c, g, or t
  misc_feature (83)..(83): n is a, c, g, or t
  misc_feature (211)..(211): n is a, c, g, or t
tgactccctgcatatctgccaaagacatcgtgtacattggcttgcgagacgtagaccctggggaacactatataantaaaaanctctgggaattaagtatttctccatgactgaagtagacaagctggggattggcaaggtgatggaagagaccttcagctacctgctgggaaggaagaaaaggccgattcacctgagctttgatgtcgangggctggacccagcattcaccccggcgaccggcaccccggttctgggaggcctatcttacagagaaggtctctacatcacagaagaaatttacaagacagggctcctttcaggactagatatcatggaagtgaacccaactcttgggaagacagcagaggaggtgaagagtactgtgaacacggcagtggctttaaccttggcttgtcttcggaactcaacgggagggtaaccataagccagggactgactaccttaaaccacctaagtgactgtgaatgcgccacatgaaaaccatctg

SEQ ID NO: 911 - DNA, 493 bp, Mus musculus
gccgttgcaacactctgggttatgacatccgcaaggaccggtcaggcaagagcaagaggctcttcctcatcacgcgagcccagtctcccttcaaagtttatcattaccagttcaagatccagttcatcaatcaaattgagaagccggtagagcctacttttaccatgtcgctgctgggaacaaaagaagaaataaagagaattcccatcaccctgggcgaaggaattaccagcaataaaacctattccttccttatcacactggacaaagacatcggcgagttgatcctgctcaagttcaagtgggaaaacagtgcagtgtgggccaatgtgtggaacacagtgcagaccatcatgctatggggcatagaacctcaccactctggcctcattctgaagaccatctgggtcaaagctggagagacgcagcaaagaatgacattttgccccgaaaatctggatgacctccagcttcacccgagccaggagaaagt

SEQ ID NO: 912 - DNA, 330 bp, Mus musculus
  misc_feature (206)..(206): n is a, c, g, or t
  misc_feature (219)..(219): n is a, c, g, or t
  misc_feature (231)..(231): n is a, c, g, or t
  misc_feature (241)..(241): n is a, c, g, or t
ttgttatgcgccacaaaagagccaagcacctgagaccacttggacataaccttacctggtaccagtaccactctctggatgtgattggattcctactctcttgtgtggcaaccactatagtccttagtgtaaagtgcctcttgttcatttaccgattctttgtaaagaaagaaaataaaatgaagaatgagtagagctcactgacnatgaactacatgnacaaactttcancctcattctnatttatgaaccaccttctaaacacttgacttgattcttttctaataaaggcacatcttctttgtaaatttttaccatataagaagacat

SEQ ID NO: 913 - DNA, 534 bp, Mus musculus
  misc_feature (318)..(319): n is a, c, g, or t
  misc_feature (326)..(326): n is a, c, g, or t
  misc_feature (328)..(328): n is a, c, g, or t
  misc_feature (363)..(363): n is a, c, g, or t
agcacaggagccagtttcatatttggataggtcttaccgacagggatggctcctggaaatgggtggatggaactgattatagaagcaactacaggaattgggccttcactcagccagataactggcagggccatgaacagggtggaggtgaagactgtgctgaaatcctgtcagatggccattggaatgacaacttctgccagcaggtgaaccgctgggtatgcgaaaagagacggaacatcacccactaggagtcggctcgaccaatcccccaccccgcccccacccccacatcccccactaggagtctgctcaatnnatgcctntnccctacctccagccccacaccaccccaacatcctncactggggatactggagcaaggaagagagacagggtcccaagcatgaggaggggttatggaaaactggaaagggcatggctctatggtctcataccttaggaagactgagaatccccccttctgcacaatttattgcaattgttataaatttcggccttctgaatggagta

SEQ ID NO: 914 - DNA, 537 bp, Mus musculus
  misc_feature (43)..(43): n is a, c, g, or t
  misc_feature (325)..(325): n is a, c, g, or t
  misc_feature (340)..(340): n is a, c, g, or t
  misc_feature (386)..(386): n is a, c, g, or t
  misc_feature (415)..(415): n is a, c, g, or t
aagagaaagcttccatctttgtgataatgatcagtatgctggntccgatgttgtcaacgcctttgtttctaaatgttgcttgaagaaaatccatgaatacatgggtacaataagacacaatttcatatcttagataatcatgaaaaatgaaaatattccaagtgagtaaagatgtaacagaattgctagagccacatatggtcagtgaagcacaaagatgcctttagaaggaactagaaacagggttcgagagtcataagagtgattgtgccacatgacctcatcctttgggaatttttcctgaattatgcacccacagctgttnttagaagtatataanagactaaaatgtaactagcagacatctatttgtgtagaagaagttnaggagggcagagaatataaatattaattnatattaattctcagaaaatttcaaattcacattttaaacaagtaccagtgtttaggcagttttataatgttataattgataaaataaaacttattaaaatatgatttcatttgctgttcaaa

SEQ ID NO: 915 - DNA, 500 bp, Mus musculus
  misc_feature (230)..(230): n is a, c, g, or t
tatcactcagtgctgctctcggtaggagctggtccctgtctccatcaaggacttggtgacagagagcatggagtcctccttagggcagagggttgtcttttgcatttgggaaagctccttgtacagagtctgctctgtaatctggactcaactgtttgagccagctcaaggtcaagagctaagaacttaaggctactggtagtttttaatttaaaaagtttgcttgtttntctatagggaagcaaatgtctttacctctgacacccgtgagtagggagaggaacacgtttccattctggaatctcccaggctcagggaggccaaaggtgagctaaggagaagtagaggttgacagtcaggggtactgatttgctcagggtgctattgtcacgatacactacagtggatctgccagtgtggagcagggactctttaccagggcttctacttttcattccctgccaccatgtcacctgatgtcccttactcctaggaaatct

SEQ ID NO: 916 - DNA, 529 bp, Mus musculus
  misc_feature (30)..(30): n is a, c, g, or t
  misc_feature (100)..(100): n is a, c, g, or t
tccttccactgactctatcatgtcacacanttgctgatctgctgtggccatcattaaagctctggtggtatttgtgatgaagagaaggagaaacacaggntagaaaaagaggggactatgctcccgctccagtgtgaagacacctgactggagtggactgagtgacaaccagtgtgttcaggtctctcctgtgacatccagagccctcagttctctttagacaacagtgtctgatgttctctgtgttcctgtgggctcaatgtgaagaactgtgtagcccagcctgccctgcacaccaggaccctgtccctgcattgcttgctcccttctacagtcagccttccaactccagccaaacactgggagacatctgcatcctgtgagctccacgctaccctaagctgcagctcctcacttccacactgagaataagaatctggatgtgaactttattgttcatatccttgatctgagggttgattgacaggtaaactaaagaattaagaatacttagagtttgtggaggaaa

SEQ ID NO: 917 - DNA, 533 bp, Mus musculus
  misc_feature (37)..(37): n is a, c, g, or t
  misc_feature (60)..(60): n is a, c, g, or t
  misc_feature (75)..(75): n is a, c, g, or t
  misc_feature (196)..(196): n is a, c, g, or t
  misc_feature (247)..(247): n is a, c, g, or t
  misc_feature (356)..(356): n is a, c, g, or t
  misc_feature (377)..(377): n is a, c, g, or t
  misc_feature (415)..(417): n is a, c, g, or t
catcccctggcaggctaaagtgctggggaacaaaagnatatcctctggtgagattgcagngtagcatgctgaagntgaaagatactgacctcactgttcattaacctgtcttctgtttagatttccttaagacagtggctcttacagtttgcacttggctttgaaatgctggaaatgcccagagaaacatgaggtntggatttgccatgttgagaaaatagcaccaggtagaattgaaatggatggntggtaatttgtgattttttttctagaaacttttcattttttaacaccctatttttttgaaggtagatttttagctatatatcacacgtctgaatatgtctggatgtttngtggcactcattgcatttganagggatgtgtctagtccagttgggaccacatggagctnnntttactttttgaacctttggtctcctcattctcattttaaaataagtgttgacttcctaattcctcttgaatcttttttgattttctcacttttcctcatttatagtcacattcag

SEQ ID NO: 918 - DNA, 498 bp, Mus musculus
atcaagttcaccaaggatctgccgctcttccggtccctaaccatggaggaccagatctcccttctcaagggagcggctgtggaaatattgcatatctcactcaacactacgttctgtcttcaaacagagaatttcttctgtgggcctctttgctacaagatggaggacgcagtccatgcagggttccagtacgagtttttggagtcgatcctccacttccataaaaacctgaaaggactgcatctccaggagcctgagtatgtgctcatggctgccacggccctcttctcccctggtttctgtatgcaaagctgatgggcctgctggctgacctccggagtataaacaatgcatactcctatgaacttcagcgcttggaggaactgtctgctatgacgccgctgctcggggagatttgcagttgaggcccaggcttgcatcctttccccagacccccagggatacactggcctggaaagggtacagcgctggacccca

SEQ ID NO: 919 - DNA, 528 bp, Mus musculus
aaaccaacagttgcgcgatcctgtcacctcacgttcagcctgtgtgtctacccagcggcgcggccccaccctctgagacagtgctctgcgaggtggccggctggggtcaccagttcgagggggctgaagaatactccaccttcctgcaggaggcacaggttccctttatcgccctggatcgctgctccaactctaacgtgcacggagacgccattctccctgggatgctttgcgctggcttcttggagggaggcaccgatgcctgccagggtgactccgggggccctctggtgtgtgaggaaggaactgcagaacatcagctcaccctgcgcggagtcatcagctggggctccggctgtggtgaccgcaacaagcccggagtctacacagacgtggccaactacctggcttggatccagaagcatattgcttcataactaaccaggctttatccttccctccttgtgtgctccttgggatgggacgatgaatgtggcatgctgggtcacagtgaagctagtgccccga

SEQ ID NO: 920 - DNA, 525 bp, Mus musculus
cggctgccacttggattcttatatgtgcatcacacatacgtgccagcgccaccctgcaccaccttccagagctgcgccgccgatatgcgctccatgcagcgtttccaccaggatgtgcgcaagtgggatgacatcggctacagtttcgtggtaggctccgacggctatctgtaccagggccgtggctggcactgggtaggtgcgcacacacgcggctacaactcccgcggcttcggtgtggccttcgtgggcaactacactgggtcactgcccaacgaagctgcgctgaacacggtgcgcgacgcgctcccgagctgcgcaattcgcgcaggtctcttgcggccagactacaagctgcttggccaccgccagctagtgctcacccactgccccgggaacgcgctcttcaacttgctgcgcacctggcctcacttcacagaggttgaaaactaagaactcctttgagagacccttgaagatccaggaggtattatccctgatgatcctttgagcaaccacagacct

SEQ ID NO: 921 - DNA, 158 bp, Mus musculus
agcgtcttcaagctttccaaggttaccaggttacgatgaagactgccaaagtggctgcgtctgactggacatttttacactgtttgcctagaaagccagaagaagtggatgatgaagtattttattctccacggtcattagtgttcccagaggcagag

SEQ ID NO: 922 - DNA, 467 bp, Mus musculus
agcgtgtttaccatttcctataagaaagctcagcgcgatctaggctatcagccacttgtcagctgggaggaagccaagcaaaaaacctcagagtggattggaacactagtgaagcagcacagggagacactacacaaaaagtcacagtgatatgtggagggcgaggacatggccctgggtgttatcaggtcctccagagagggacttagaaacaactcaactcttatcaattccattttatgcactgtccaacttgtctttgggtcactagcaaccttgcaagtcactggcccagtcacacaccatcagtcctaagcacttgcccagtaatgcacaggctgttgtgactcagctgctgtgacccaagaatctgtggctggtactgaattgcctggaacctcttgtaggtagaatttcctcaggacttccacatctcccttccatgtgccaaagcatttcttgtcttg

SEQ ID NO: 923 - DNA, 357 bp, Mus musculus
gattatgcaggcaatgccactgctgtcttccttctgcccgatgatgggaagatgcagcatctggagcaaactctcagcaaggagctcatctctaagttcctgctaaacaggcgcagaaggttagcccagatccacttccccagactgtccatctctggagaatataacttgaagacactcatgagtccactgggcatcacccggatcttcaacaatggggctgacctctccggaatcacagaggaaaatgctcccctgaagctcagccaggctgtgcataaggctgtgctgaccatcgatgagacaggaacagaagctgcagcagttacagtcttacaaatggttcctatgtctatg

SEQ ID NO: 924 - DNA, 424 bp, Mus musculus
  misc_feature (297)..(297): n is a, c, g, or t
ttttctcgtgacaagaagccgtggcgggaggctgagaagttctgtacgtcccagggagcgcacctggcttcggtgacctctcaggaggaacaggcattcctggtacagactacaagttctggggaccattggattgggctcactgaccagggcacagagggcatctggcgctgggtagatgggacaccattcaacaatgcccagagcaaagggttttgggggaaaaatcagcctgacaactggagacataggaacggagagcgagaagactgtgttcacgtccggcagcagtggaangacatggcctgtggatcctcctacccctgggtgtgcaagaagtccacagggtggtctgcggccagagtaggctagagctgagtctgtccttcctgagactccttcagccttgatctcacttcagggc

SEQ ID NO: 925 - DNA, 531 bp, Mus musculus
  misc_feature (106)..(106): n is a, c, g, or t
aactgcacttttaacacctgccaaaaagctctagggaaggatgacttcactaagattcccaatggggtgaatggtgtcgaggacaggatgtcggtgatatgggaanaagggcgtgcacagtggtaaaatggatgaaaacaggtttgtggcagttaccagcacaaacgcagccaaaatctttaatctttatccgaaaaaaggaagaatagctgtaggctcagatgctgacattgtgatctgggacccagaagcaacaaggaggatctcagccaaaactcatcatcaggccgttaacttcaacatcttcgagggcatggtttgtcacggggtgcccctggtgactatttcaagaggcagagtggtgtatgaagcaggtgttttcaacgtcacagcaggacatgggaagtttattccccgccaaccctttgccgaatacatttacaaacgaatcaagcagcgagaccagacctgcacacctgtgcccgtgaagcgcgccccctacaagggagaagtcaccacactgaaagccag

SEQ ID NO: 926 - DNA, 596 bp, Mus musculus
  misc_feature (27)..(27): n is a, c, g, or t
  misc_feature (69)..(69): n is a, c, g, or t
  misc_feature (166)..(166): n is a, c, g, or t
  misc_feature (296)..(296): n is a, c, g, or t
  misc_feature (490)..(490): n is a, c, g, or t
tggccacattatacagcttcctctttnctcctttgcctgtggcttattttctggatttcttgcagaaanttatgtggctaaaagtttgcaggcagatcttgctgacatcaccaagtcttacctgaatgcacatggctccttctgggtggctgagtctggagaccangtagttggcatggtgggtgctcagccagtcaaggaccctccattagggaagaagcagatgcagctctttcgcctgtctgtgtcctcacagcatcgaggacagggaatagcaaaggcactggtcagaactntcctccagtttgctcgggaccagggttacagtgatgttgtccttgagactggcagtgtgcaacatagtgctcaggctctctaccaggccatgggcttccagaagacaggccagtactttgtcagtataagcaagaagttaatgggtctttctattcttcaattctcttactctctcccttttgcttcaggaccnagggtatagtgggaaatatttaaaaaaaggtcccattccatgctagcaccaggtactctctggccccagtggtctcactgcctccatggcttgtcctatgtagcaa

SEQ ID NO: 927 - DNA, 439 bp, Mus musculus
aaagaccctgagactggtgtgaactacctaatccagggaatgacctcaaaactggctgtgttggtggccttaattattttggaacaaagtcctgccttcaagattgattttgatctccatgacctgataccgtcttgtgaaaggaccttcctttggagatattctttaagcaagttgtgaagaccctgaaacccaaaagaacgtacatgaggtttttgtgtgagcttatgctcagaacaacagtgtttagcaagtggcatttgacaggtgtgaatattttcctacaatgtggctgtgagatccttgcctgacttcctgttgctgctttagaacactaaaagtctttcaaaactggaaaaatgccctggcaggggagaataattttacccatttaaaaaaatggcccgatttttagtcatattagggatatctgtcacat

SEQ ID NO: 928 - DNA, 456 bp, Mus musculus
  misc_feature (248)..(249): n is a, c, g, or t
  misc_feature (252)..(253): n is a, c, g, or t
  misc_feature (261)..(261): n is a, c, g, or t
cgttactctgacattcatcatcactaaattttgtttgtttgtgtgtcaaaaactttatatgaaagaaagtaagaaaatggggaacagaaagaaaaagaactaggtcttttttaggtttgggaaagccctgagtgacaattatattaacaatcaccacaagaagcatgcaacttcctgctttatacctattttcaaataagcagctctgtttcagactggaaataaatgtaaacattaagcatgataannaannactgattngttccaatcttctatcttgtaggcattctcctctcactcttctaagatatggaaaattaattctaaatatattctatagaaaggaagtgatgaataacaatatgctagacctctgggaagacatataataccaatcttattgatgtatatgaggatctcttacagtcaatgtcataagcctatcatattgtctaa

SEQ ID NO: 929 - DNA, 157 bp, Mus musculus
ggattccaaaacgtccaactctgttctaccatcctcaatgtcaccttcccccctgaagtcattggaccactgttcttctttcctctcctttatatgatttttcagcttgcagaaggacttctcttcattattatcttccggtgctatttgaaaatca

SEQ ID NO: 930 - DNA, 422 bp, Mus musculus
  misc_feature (390)..(390): n is a, c, g, or t
gctgctgccacagggttcatttttggctttcgttctagaagattacaaactatgactgtgcagttcaacaggccattcctgatggtcatctctcacacaggtgttcagactaccctctttatggccaaagtcactaaccccaagtgaacctaaagctccccaagttctgaatattctgcccaggaccctaggatggagtccgcatgtggatctctgtttacatcctggcaatcatgctttgattggctgatgcaaagatggcttagacagtgacattgactatctctgtggctcccacatgctcaggagcctttggactgtcagtgtcaggcgctcaggcctcttgggagcatctgtgcatgtttctgaacctggagtctgtctttattncctcttccctggtgactcctttttatatatct

SEQ ID NO: 931 - DNA, 481 bp, Mus musculus
actccagtttgctactgcacgtgaagcagttagtgtctgacgtgcgaagcttgagctgccagatggctgcatttcggggcaatggctctgaaaggacctgctgccccatcaactgggtggagtatgaaggcagctgctactggttctccagctctgtgaggccttggactgaagctgacaagtactgccagctggaaaatgcccatctggtggtggtgacctccagggatgagcagaacttcctccagcgccacatgggccccttaaacacttggattggcctaactgaccagaacgggccctggaaatgggtggatggaacagactacgagacaggcttccagaattggagaccagagcagccagataactggtacggacatgggcttggaggaggcgaggactgtgcccacttcacgacggatggccgctggaatgacgacgtctgcaggaggccctaccgctgggtctgtgagacaaa

SEQ ID NO: 932 - DNA, 539 bp, Mus musculus
gaaatcagccttccgaacattcactactttaacatcgacatgtccaaaatgggactgatcaacaaggaagaggttttgctgcctctcgacaatccctacggcaaaataacagggacagtcaagaggaagctgccttccaggctgtgacgtcatggctccagccggttgcgatgctggggaatactgtatgcttgcctgcaaaaatttcaactcaggatattgattgctttgttctgtatgaagtaattgctttgttgttattgttgttcctagttcaacagggaacttgtagtggtatgtatgtggagtcccatgttagcaggcccaacctgctccacggccatgggcagtttccttaaaaattactgggccatgttaggagaatcacagtgatagttctccttgctgttcttgtgttctctgcctttgaatccgtctttagaatccaattgtcataaggacataatcgtaaagtactggctgccgccacattgattaatctgaacacagaagcaaacactgtcatcatcctagggata

SEQ ID NO: 933 - DNA, 431 bp, Mus musculus
agatctaccgatacacatcctttgtccccttcaccatcccccacagcacaacgagggacacctcactgaatggcttccacattcccaaggagcgctgtatctacataaaccagtggcaggtcaaccatgatgagaagcagtggaaagacccctttgtgttccgcccagagcggtttcttaccaataacaactcggccatcgacaagacccagagcgagaaggtgatgctcttcggcttgggaaagcgccggtgcattggggagatcccggccaagtgggaagtcttcctcttcttagccatcctgctgcagcatctggagtttagtgtgccaccgggtgtgaaggtggacctgacacccaactatgggttgaccatgaagcccgggacctgtgaacacgtccaggcatggccacgcttttccaagtgaaga

SEQ ID NO: 934 - DNA, 517 bp, Mus musculus
  misc_feature (294)..(294): n is a, c, g, or t
  misc_feature (296)..(296): n is a, c, g, or t
  misc_feature (311)..(311): n is a, c, g, or t
  misc_feature (435)..(435): n is a, c, g, or t
gctccagctctcatcagtcaaagaatgtcccctatatataatctcattcctttgaaaataaaagatgcatacataaagaagcaaaatttggaaaaggctgttgaagactatatagatgaattcagtactaaaaggtgctacccatgtctaaatggaggtactataattcttctggatgggcagtgcctgtgctcctgcccaatgatgtttaggggaatggcctgcgaaatccatcaaaaaatatagccttcaggaaacaaagcaaaccctggttcacatggaagggggaaaaananaaaggacaaaaaaanaaaaatcccaggactttccaacttagcatcttaccctggagctaatccgcactgccaagtggaaagcagcttgtttcatggaaatcctaccaacctctgatgctgtctgttttaatctacagtncctttctcccctctttaatgcctataatgcttccattttttcattccctaatgaagagtcagcagtgagatatgcccgggct

SEQ ID NO: 935 - DNA, 421 bp, Mus musculus
  misc_feature (365)..(365): n is a, c, g, or t
aacgatgagatttgctctcctgctcttgatgaagcacacacacatcacagctaaagtccaggaagagattgacaatgtgattgggagacaccgcagcccctgtatgcaggacaggaaccacatgccttacacaaatgccatggtgcatgaggtccagcggtacattgaccttggcccaaatggtgtggtgcatgaagtaacctgtgatactaagttcagaaactacttcatccccaagggaacacaggtaatgacatctctgacatcagtgctgcatgacagcacagagttccccaacccagaggtgtttgaccctggccactttctagatgacaatggaaactttaagaaaagtgactacttcntgcctttctcagcaggaaaacggatttgtgtgggagagagccttgcccgcatggag

SEQ ID NO: 936 - DNA, 577 bp, Mus musculus
cagctggtgtggagtttgaagaaaaatttctgaaaactcgggatgacctggcaaggttacgaagtgatgggagtctgatgttccagcaagtgcccatggtagagatcgacgggatgaaactggtgcagaccaaagccattctcaactacattgcctccaaatacaacctctatgggaaggacatgaaggagagagccatcattgacatgtacacagaaggagtggcggatctggagataatgattctctattacccccacatgccccctgaggagaaagaggcaagccttgccaagatcaaggaacaaaccaggaaccgttacttccctgcctttgaaaaggtgttgaagagccatggacaagattatctcgttggcaacaggctgagcagggctgatattgccctggttgaactcctctaccatgtggaagagctggacccgggcgttgtggacaacttccctctcctgaaagcgctgagaagcagagtcagcaacctccccacagtgaagaagtttcttcaacctggcagccagaggaagccttttgatgacgcaaaatgtgttgagtcagcaaa

SEQ ID NO: 937 - DNA, 310 bp, Mus musculus
  misc_feature (26)..(26): n is a, c, g, or t
  misc_feature (42)..(43): n is a, c, g, or t
  misc_feature (52)..(52): n is a, c, g, or t
  misc_feature (65)..(65): n is a, c, g, or t
  misc_feature (156)..(156): n is a, c, g, or t
  misc_feature (162)..(162): n is a, c, g, or t
  misc_feature (179)..(179): n is a, c, g, or t
  misc_feature (189)..(189): n is a, c, g, or t
  misc_feature (235)..(235): n is a, c, g, or t
  misc_feature (261)..(261): n is a, c, g, or t
gttattggtggcattcgtaaggccantattaccagcgtgtgnnatttcaacnaggccattcctgnttgttatctatcacacaagtgctcagagtatcctctttatggccaaagtcaataaccccaagtagacctaaagctcaccaagttctcatgnttctgnccagggctctgggacanagtctgcatntggatctctatatacatcctgtcattcaagctctgattggctgttncaaagttggcttagacagctacattnactatctctgtgatcccacatgcacataagactttggactctcagtgtc

SEQ ID NO: 938 - DNA, 485 bp, Mus musculus
tcagggtccttcaacagtagatgctgccttttcctgggatgataaagtctatctgatccagggcactcaagtgtatgtcttcctgacaaagggaggcaataacctagtaagtggttatccaaagcggctggagaaggaacttgggagccctcctgggatcagccttgagaccatagatgcagccttttcctgccctggttcttccaggctctatgtctcatcaggacggcggctttggtggctggacctgaagtcaggagcccaggcaacatggacagaggtttcctggccccatgagaaagttgatggggccctgtgtttggacaagtctcttggccccaacacatgttcttccaatggttccagcttgtactttatccatgggcccaatttgtactgctatagcagtatagacaaactgaatgcagccaagagtctgcctcagcctcagaaggtgaacagcatccttggctgcagtcagtaaa

SEQ ID NO: 939 - DNA, 484 bp, Mus musculus
ttcagaggataccacattcccaagggcacaagtgtaatggcatgtctgacttctgtcctgaatgatgacaaagaatttcccaacccagagaagtttgatcctggccactttcttgatgagaaagggaacttcaaaaagagtgactactttgtggctttctcagcaggaagaagagcttgtattggagaaggtctggcccgcatggagatgtttctaatcctgaccaacatcttacagcattttactttaaaacctctggttaaaccagaggacatcgacaccaagccagttcaaactggtttattgcatgtgcctccaccctttgagctctgtttcattccagtctgaaactgtgtagtatttcacatggatggctgagaccctgcttcttctgtgagcaaaaaggtcctcctgtcctatgtacctgcatctggtagtcctttatgaatggcagggatgctacctctatactttctcaattctt

SEQ ID NO: 940 - DNA, 549 bp, Mus musculus
  misc_feature (281)..(281): n is a, c, g, or t
  misc_feature (349)..(349): n is a, c, g, or t
gacgaactctctgaaaggcatcctgacctttctgggttttttgacaaccactttggtttaatctcacctaacttcaaagaatttggcagtaagacccattctgattccgacatcctcacaaacattgaggaccccagctcccatgtacctgagttttcttccagtagtaaaacctcaactgtcaaaaaacaagtaaccaagacctataaaatggcagacgaggcaggaagcgaagctcaccgggaaggagaaactcgcaacactaagaggggccgtgccangagctcgcccaacgagaggtatcgacacttaactttcgggagattcccctgacacccccccccccccntagattaagttaaccattactgcgaagtgcttaccaggcacgctgcacccgtttcctaacctcctttagtgttttgttggaatctcattttttttttggtcaacttttcatgctagactgtacgttccttgggggcagggacttgaccatgtgtctatttctgtaattcccaaatgcctaacagtgcagtcatttctcaa

SEQ ID NO: 941 - DNA, 326 bp, Mus musculus
ctcactcaaattcctgtttgcatctccacgagccatacataaactacaatcatctcaggaaaaggggttccccttgcatcatatctgtccaggctaaggatttggtccttctaggttctactggtccaccaagtatagagagatccctggggcctgcagttttccctccctcttcagaagggatctcttggcaacagaggtagcatgaggcatgctctgcttacttttatccttaaaggcctttcagatgcccagagtctgtctgttggtcctgagcaagccatcttccagatgggtccacgtggccttctgactgccatggcctg

SEQ ID NO: 942 - DNA, 326 bp, Mus musculus
agccaaccgttttcacagacgtggaggaccacatgtacatcgctaaggaggagtccttcgggcccatcatgatcatctctcggtttgctgatggggacgtggatgcagtgctatctcgggccaatgctacagaatttggcctggcctctggtgtcttcactcgggatatcaacaaggccctgtatgtcagtgacaaactgcaggcgggcactgtgtttgtcaacacatacaacaagaccgatgtggccgcaccttttggaggattcaagcagtctggatttggcaaagacctgggagaggcggccctgaatgagtacctgcggatc

SEQ ID NO: 943 - DNA, 463 bp, Mus musculus
attcaacaccggaaagatggctcacaggacttcaacgaaacatgggaaaactacgaaaagggctttgggaggctcgatggagaattttggttgggcctagagaagatctatgctatagtccaacagtctaactacattttacgactcgagctacaagactggaaagacagcaagcactacgttgaatactcctttcacctgggcagtcacgaaaccaactacacgctacatgtggctgagattgctggcaatatccctggggccctcccagagcacacagacctgatgttttctacatggaatcacagagcaaagggacagctctactgtccagaaagttactcaggtggctggtggtggaatgacatatgtggagaaaacaacctaaatggaaaatacaacaaacccagaaccaaatccagaccagagagaagaagagggatctactggagacctcagagca

SEQ ID NO: 944 - DNA, 477 bp, Mus musculus
  misc_feature (159)..(159): n is a, c, g, or t
  misc_feature (203)..(203): n is a, c, g, or t
  misc_feature (208)..(208): n is a, c, g, or t
  misc_feature (215)..(215): n is a, c, g, or t
  misc_feature (275)..(275): n is a, c, g, or t
  misc_feature (433)..(433): n is a, c, g, or t
gcatctgtacgaagggtctgcgtcagagtcggctgaagcactgaggaagctggctcgagagctggaggagaagctagaggggctcatggaattctacaagacgatctgatcaggccccagtcagtcaccccatccccaagacaggcagaggtcaggggngaggacctggacagaggagagcaagactgcagtcaggtccgagngaccnagtgtgnaggcctgctgctgaacacagcacaatcaggtgagaccccctggtgcctgagacgagaganctaaaggatgtgctgctgtgagagggactggaaagattgaactctggactaaacacggaagaagccagttaagagaaggactagaaagccctccccagctgagctactgcaaacaagaccccacaaaaggcaaaccagagagaaaggtgtgtgctctntaaacacatcatgagccccatccctgtgctttagagcctgtgct

SEQ ID NO: 945 - DNA, 417 bp, Mus musculus
tgatatcaagcctgttactactgggcttttcaacttgccaccgccttacaagctgcgccttgttccaagataggagtttctccttttaatcattcaaatcaaagtaattgttctctttttttctataaacagtctattttgctaagtgctacctaggccagaaacatcactcactaacagcacgtgggcatttgtttccatcttaaaacctgggtcctgaaagctcccaggacacaggcagggtgtctcagttcctcagctgtctataaactaggccctaagcacaactgacaccagatccacaaggccctcatcagacgccacctgcaagcagctgcgtgctcttctgtggcttcagaaatagaattatattctgtcactgtttcaatagagaaattaatgtaccagcccacacac

SEQ ID NO: 946 - DNA, 546 bp, Mus musculus
  misc_feature (422)..(422): n is a, c, g, or t
agcacatcgctctcaagacggaagacatcatcacagcaatccgccacttgagggagcgaggcacggagttcttggccgccccatcttcttactacaaactgcttcgggagaatctcaagtcagccaagatccaggtgaaagagagcatggacgtcctggaggagctgcatatcctagtcgactatgacgagaaaggctacctcctacagatcttcaccaagcccatgcaggaccggcccacactcttcctggaagtcattcaacgtcacaaccaccagggctttggagcgggcaacttcaactctctgttcaaggcgttcgaggaggagcaagccctacggggcaacctcactgacctggagcccaatggtgtgaggtctggaatgtaagcccccatccacacatggaccacgcaaagtgcntggacacatcagtcatctccaactggctgaaaggctgaacctcagggctccacccacgtcatggccacgccccctctattacaagagtccgccttgcctgagtcctccctgctgagtaaagcta

SEQ ID NO: 947 - DNA, 511 bp, Mus musculus
atgaagcaccctacagttctacagaacactgatggaaagaaccctgagccttgggctaagggtctgaaacacgaagactttgagctgctctgccttgatggcaccaggaagcctgtgactgaggctcagagctgccacctggccagagtgccaaaccgtgctgtgttctccaggaaagataaggctgactttgttcgaagaatactcttcaaccaacaggagctctttggaagaaatggatttgaatatatgatgttccagatgtttgaatcctcagctaaggacctgcttttcagtgatgacacagaatgtttatctaaccttcagaacaaaacaacatataaaacatacctaggaccacagtatcttaccttgatggataactttagacagtgcttgtcctctgaactgctggatgcctgcacatttcataaatattaaacaccattcagctggggggggcggtaacccaggggctggggacccaactgcttgcctccatgtggacttg

SEQ ID NO: 948 - DNA, 534 bp, Mus musculus
  misc_feature (66)..(66): n is a, c, g, or t
  misc_feature (69)..(69): n is a, c, g, or t
gatgtgcccatcatcgccatggagacctttggcgcccacagcttccatgctgccatcaaggaaggnaanagctggtcaccctgcccaagatcaccagtgtcgccaaggccttgggcgtgaacactgtcggggcgcagaccctgaagctgttttacgaacaccccattttctccgaggtcatctcagaccaggaggctgtgtctgctcttgagaagttcgtggacgatgagaagattctggtggagcccgcgtgcggcgcggcgctggctgctgtgtacagccgcgtggtgtgcaggctgcaggatgaaggccggctgcaaaccccactggcctcgctggttgtcatcgtgtgtggcggcagcaacataagcctggcgcagctgcaggcactcaaggtgcagctgggcctgaacgggctgcccgagtgatatctgctgctgccctggcctccctcagaggggtcaccgggcaccccctagtggggtgggatacacttgacaatggccccaccctcctttacctgtgtttataatg

SEQ ID NO: 949 - DNA, 356 bp, Mus musculus
attacgtgggcaacgccagtgctgtcttcctcctgcccgaagatgggaagatgcagcatctggagcaaactctcagcaaggagctcatctctaagatcctgctaaacaggcacagaaggttagtccagatccatatccccagactgtccatctctggagactataacttgaagacactcatgagtccactgggcatcacccggatcttcaacaatggggctgacctctccggaatcacagaggagaatgctcccctgaagctcagcaaggctgtgcataaggctgtgctgaccatcgatgagacaggaacagaagctgcagcagccacagtctttgaagccgttcctatgtctatg

SEQ ID NO: 950 - DNA, 545 bp, Mus musculus
ttacctacaaggctgctgcaacagaagatgctactccagcagctctggaaaaaggtacccacaacgggaataatcctcctacacaacctggcctttcccctaatggcctgaactctggtcagatggcaaattagaatgtgaaaacttagaagcaacaaggaaagtaacacctagtgtgccagattgtctagcacttccagcaaaccttcaacagcagaatcatgaagcaatgaactgaggcagaagggcatctatccaggaaccatcatccatccccaaaaatctgctatttgtttaaaagataaaaaagaactaggcaaagtggttcctccctataattccaatgctcagagactcaaggtcaaccttgagtacacagcaagactgtctcaagaaaccaagaacactttcagcagctatgaactcttatgaaggctctatgaaacagctacatctgataaacattatcactatttctagactttccaataagcaggtgttttgctcattaagcatccacaacctgcttcatgttgtaactcaaa

SEQ ID NO: 951 - DNA, 501 bp, Mus musculus
  misc_feature (269)..(269): n is a, c, g, or t
  misc_feature (431)..(431): n is a, c, g, or t
aatttgctactcttacagaccacaatgtaaatatctgatatgctatctgatatgcaggctatctgacagaggtcgcaacccgcaggttgagagccactgccttcaaggctttaatcaagagagtagtgagctgagggctttactggtaagtcaggggcaagtccaactcaatcatcctcacatactggctgctccctcaggcctgagaatgaggcttgcagcatcctctggtttcctaaccgttatccatccctgactctcatctctgnaaatagatgtcatccatgaaattaaggagtgagaatattaagcagcatttatagagctcaaaattccatgtcatcaccaggaagtgccatgttgatcacagagaacacagaggagacatatagacagggttttgctcaaaattgggatatagaatgagcctntcaggtacctatcaggagcggtaatccgtgagagagaaccgttgcaagccactctaactgtagcaatgaa

SEQ ID NO: 952 - DNA, 442 bp, Mus musculus
aaatagactcacttttccatcaatataaggaaagccattgtttctggttattaattgggtacagcaaacttccaacaaatatttcctaaagggcctgtggtggaggctactctccttcaatcagaagcctttttcagacactaatcttcaagcatttactcttactgctcctgacataaattccagtacttgggagttcttaggcttggcaagattattgatttattttccttcttatctcttactcacaactgacctgaacactgtcattctcattctgccttttgaagtagatttaagctgccaaatgtcccattctctctcgctttgaaagtacacatccaagagaagattatctttttaagtcataccatcacctagctcatgttatatttcgtatctgaaatatcccccacagacacacaatgtactttgctgattt

SEQ ID NO: 953 - DNA, 77 bp, Mus musculus
tgtacaatttcagtgcacacagaataaaattagacgctatgaatgtatgctctgcaagaatcacagaacatcacagt

SEQ ID NO: 954 - DNA, 363 bp, Mus musculus
  misc_feature (47)..(47): n is a, c, g, or t
  misc_feature (52)..(52): n is a, c, g, or t
gaacatcacagtttgagatcacacattttttctcaaatgaaaaccanttggntcatgcaaagacctttattccctgccctcccccagaaatcagaagtgactcaattgccttctcacaatcttttttatttctataaagaaatatgtcatgagaaagctgtatttgttgtttcaataagaaccgaataagctgtagaattggttaacaaccaaattttaaaagatcaagatagtgatcgagtccttctgtttaactttggggtaggtctcattctaggcctgcacctcagactcccctggttgaactcgcatgcagcagaggctccaggagttgatctcaccttcaaggttcttttgaacatt

SEQ ID NO: 955 - DNA, 544 bp, Mus musculus
  misc_feature (107)..(107): n is a, c, g, or t
  misc_feature (113)..(113): n is a, c, g, or t
tttgctctcatcagcatcaaacttgctgtcataggagtcctgcagaacttcactgtccagccttgtgaagagacacagatccccctgaagatcagcagggaaccaantttccnaaccagaaaaacccatcatcctaaaggttgtgtcaagagataaacccagaactggatcatgaatttccctcagaaaacatgttatattcttcaaggagactgtgtcatagaacacaagagaatttaattaactttagaacaacataatatgggcatactcaactttccttgatgattgaatattcagaaattcactgaacatgctcagtgactatgcagtgtatcatctattttgtgattcaaaggaaattattaactcaatggtagttgtggatgttcaccttctgattcttgtgggaatgtctacactaattccagttagttacatccattctgaattctaactgcagcaactatttctctatcattttattaatagaaacccttgtaatgatggttagtaaatgtgtatcaagttttctctttgttaa

SEQ ID NO: 956 - DNA, 387 bp, Mus musculus
  misc_feature (192)..(192): n is a, c, g, or t
tgctcctcctcaggacgacagatgtcccttcttcgagagggacctccaaagcaccgcatcaagatttgaagattatttcttcttcccccagtcacatccaacacatgcctggaaccccagattctcccattattcggctctgctggagcgactcatgagccctttacccctagctacacgcacgcacgcacngacgcacgcactcacgcacgcaggcaggcaccatatacttctttatcctgagggtaccagtttaccagaaggaagctgggatgggaaaagccagagctcaggatgagagaagcagaaggttgcctcccccaccatttcctcgagctgacacaggagtgtcctcttcagtcaggtcggaagtcaccttggttcctg

SEQ ID NO: 957 - DNA, 461 bp, Mus musculus
  misc_feature (308)..(308): n is a, c, g, or t
gcaagtttcctcatgggcatctcaaggggatttggtcttactgcagggatcatctcatccactaccaccggattccttatcagtcaggttgggcatgttattgaacatctgcaagtggcaggattctgaatcaggatggaggaatgtgtttttcctgtctgctgctgtcaacatgtttggtctgatcttttatctcatatttggacaagcagaaatccagagctgggccaaagaaaggactctcacccgcctctgaggatgtagggttggagaccaaccaaagtgctgacccttaacatactttgctnatcaccattctttctttgtacttacgaccatagacacagcgcttctctattctggctgggtgctagcattttccaaagatcttcaaaagcagatcccaggctaccctccagagtgagttagtctgtggtggaacccaggtgccactaagtttt

SEQ ID NO: 958 - DNA, 484 bp, Mus musculus
  misc_feature (280)..(280): n is a, c, g, or t
  misc_feature (295)..(295): n is a, c, g, or t
gcctgaccatgatggcccaatggagccagtttgcacgcacaggaaaccccaatggcaaggggctgcctccttggccccaattaaaccagttagaacaatacttggagattggtctagaatcacggactggggtgaagctaaagaagggtcggctacagttctggacagagacactgccaagaaaaattcaagaatggcaccgagagcagagaagcaggaaagttccagaggagctctgaggccagacctacctagaccttactgactgggccaacccaangaatagtggcacccnaagcagggcaactacaacttctttttgtttctgttcagagactttagcctggaccacgctgctgtgagcccatgtttcttaaatcatcggcccctgcaagaccagtatggtgaaccactaaatgttatcaatctggtttctacttcttgatcattgaacatactgctgtttcttcctaaagtgacttga

SEQ ID NO: 959 - DNA, 486 bp, Mus musculus
  misc_feature (39)..(39): n is a, c, g, or t
  misc_feature (67)..(67): n is a, c, g, or t
  misc_feature (105)..(106): n is a, c, g, or t
  misc_feature (136)..(136): n is a, c, g, or t
  misc_feature (144)..(144): n is a, c, g, or t
  misc_feature (154)..(154): n is a, c, g, or t
  misc_feature (164)..(164): n is a, c, g, or t
  misc_feature (188)..(188): n is a, c, g, or t
  misc_feature (223)..(223): n is a, c, g, or t
  misc_feature (253)..(254): n is a, c, g, or t
  misc_feature (259)..(259): n is a, c, g, or t
  misc_feature (261)..(261): n is a, c, g, or t
  misc_feature (265)..(265): n is a, c, g, or t
  misc_feature (291)..(294): n is a, c, g, or t
  misc_feature (296)..(298): n is a, c, g, or t
  misc_feature (300)..(302): n is a, c, g, or t
  misc_feature (304)..(310): n is a, c, g, or t
cgctttgcagacattgtcccaatgaacttgccacacaangacttctcatgatattgaagtacagggncttccttatccctaaggggacgaccctcatccccaacnngtcctccacgctaaaggatgagactgtctngggagaangcccctccgnttccatcctngaacacttcctggatgcccagggnccattttgtgaagcctgaggccttcatgccattcntcagcaggtcgtcgagcatgcctgggggannccctngnccgnatggagctcttcctcttcttcacctnnnncnnncnnncnnnnnnnctttagcttcttagtgcctgctggacagccccagcccagtgactatggcatctttacatttctggttagcccctccccctatcagctctgtgcattcacacgttagcaggcaacaaatcctagtccagaaactagcttagagtcacacgcacaataaaccagttttgtggctgcca

SEQ ID NO: 960 - DNA, 503 bp, Mus musculus
gagtctttggcaagctcttctgaatacagtactacatctacacagatgcaggggaggacagaagggcccaccttgacccctccccgagcccagccaactgttacctcttctggttttcaggactcagatttcattgaagatgtggtagctaccacccccccatatgacactggggcccatgatgatttgatccctgatatccatgtacagccagatagcctttcatttaagctgatatctgattttccagaagcaacttcccccaaatgtcctgggcgcccatggaagccagctagctgggaggatccaaacacagaaacaacagaattttctgattttgatctccttgatgctctttcttaacttacgcagcctaggtagcttcacaaatgctctcccagcctttctttctactgcccaagcacaaacattgtgacctaagtcatccagccatggtgatcagaacagcctgtcaatgggactttataactccctgtggactg

SEQ ID NO: 961 - DNA, 500 bp, Mus musculus
gctacgttcagaagttccagcgtgagttaagcaccaagtgggtgttgaatacaaggttctcaggacagtccaaggctcgctgcattgagagtcttcttcaagtgatacatttccctcaaccgctgtcgaatgatgtccgcgcggcccccatctcctgccatgtccaggttgcccacgagaaggaaaaggtgatccccacagccttgctgagtctcctactcaggtgctccatcactgaggctaaggaacgcctggctgcagcttcttcagtctgtgaggttgttaggagcgccctctctgggccaggtcagaaacgcagcatccaagcctttggagaccctgtggtgccctgaattgatgtttctgtgaccattgaaaagtctccatccacttctgaggggacttgtgccagtaatacacgttgcaggacagactcagttccggtgggtggggcactaacagcccagaattgaggaagagtcctgttctcagctggatca

SEQ ID NO: 962 - DNA, 48 bp, Mus musculus
gaggcccttcccaaagtattaatgttgtgcacccaaattacattaaaa

SEQ ID NO: 963 - DNA, 558 bp, Mus musculus
  misc_feature (302)..(302): n is a, c, g, or t
  misc_feature (346)..(346): n is a, c, g, or t
  misc_feature (356)..(359): n is a, c, g, or t
  misc_feature (363)..(364): n is a, c, g, or t
gaaatgactgcgattggtgaacaaacagaaaaggctggcatatattatatgaactatgatggattcaatacatttagtatacttaagacagactatgataattatattatgattcatctcattaacaaaaaggatgggaaaaccttccagctgatggagctctatggccgagaaccagatttgagtttagacatcaaggaaaagtttgcaaaactatgcgaggagcatggaatcattagagaaaatatcattgacctaaccaatgtcaatcgctgcctcgaggcccgagaatgaagaatggnctgagcctccaggtgggcaatatacaatgagagcaaggaggagngttgagtggnnnntttnnaccaggactccagcatcatcccttcctatccatacagactcccatgccaaggtctgtgatctgctctccacctgtctcacagagaagtgcaatcccgttctctccagcatgttacctaggataactcatcaagaatcaaagactttctttaaatttctctttgccaacacatggaaattctccattgatttctt

SEQ ID NO: 964 - DNA, 555 bp, Mus musculus
  misc_feature (177)..(177): n is a, c, g, or t
  misc_feature (183)..(183): n is a, c, g, or t
tttatgtgcacctacttcatgccagctgctgaaccacttcaattgccagctatcaagttgccaactggcaaagacctctgtggtcagagtaccacacaagccatggaccagtatacatttgaactaagcagaaggactcaagttccagaagtgttcctcagcaaagttctggagccnaacccntgaaaacccttagggagtgctgtgacactcaggattctgttgcctgtttcagcactcagagtcccctgctgaagaggcaactaacttctttcatcgaaaaaggtcaagaaatgtgtgcagattattctgagaacacatttactgagtacaagaaaaaattggcagaacggctaaggacaaaaacacccaacacctctccggcagagctgaaagacatggtggagaaacactcggactttgcctctaagtgctgctctataaactcacctcctctctactgcagctcacagattgatgcagaaatgatagacaccctgcagtcctgatcagggcccgtgcactagcttggatcttgaactgaaccactctgga

SEQ ID NO: 965 - DNA, 581 bp, Mus musculus
  misc_feature (93)..(93): n is a, c, g, or t
  misc_feature (178)..(178): n is a, c, g, or t
  misc_feature (180)..(180): n is a, c, g, or t
  misc_feature (185)..(185): n is a, c, g, or t
  misc_feature (237)..(237): n is a, c, g, or t
  misc_feature (405)..(405): n is a, c, g, or t
aaggagggccagatgttctttagagaacgtgtttaattttcacttagcaactagacgctacctttactatttaattttactaaaaaaatcttncctttttctttaaaaaagccttcgttactaaattatgaaattgaaattgtatacataagaataataaaaatcagttaaagaaatnancagtnaacaaaacacctctggcttatcaaccttttatgatagaaggaaactcagatngtcactttatttatagagagctattaagtcacgtgccatgactctgtgaaggaatggcacattacaataaaggctaatgttttgaatgtgtatactagtaaagcaattaacagtaacctgaatttaaatgtcagtcgatggaagtacagcctatgacagggctttganaaacgtttctacagtgaagcagttctacagagaacactaatgagcaatgtgtaaactgtttggaaggtgctggtgaataactggaactttccacatggcttcaccacacttgtgccagaaacatattctgaaagttgagctccataggtgctcaccgtgctgctgaatttcacaat

SEQ ID NO: 966 - DNA, 481 bp, Mus musculus
  misc_feature (69)..(69): n is a, c, g, or t
  misc_feature (71)..(71): n is a, c, g, or t
  misc_feature (84)..(85): n is a, c, g, or t
  misc_feature (87)..(87): n is a, c, g, or t
  misc_feature (89)..(92): n is a, c, g, or t
  misc_feature (257)..(257): n is a, c, g, or t
  misc_feature (260)..(260): n is a, c, g, or t
  misc_feature (262)..(265): n is a, c, g, or t
  misc_feature (350)..(350): n is a, c, g, or t
acgtactcacctgctatgtaccagacccctcctcacctccacataaatcaatgtaataagataaaaaantnttttttaaaaaannanannnnttcaaggaaagatttgatgctttgtatcaaataacgccatgtaagttaaagcccttccgtggcttacagaacggtgtcacttaagcctaaccagatgtcagggttttactattcaccggaaaccccaagggatggacctgtttgaagtgaacatgtatggctatntgnannnntaaataggtaaacctgggatgaaatgtagagttgtttttcaaagactggctgcagacattctgagatgaatatgctatgaatgtnaattgaatatatgagatgaatttcagatagctcagaaattcccttgtgggagaaacaaccttggcttgagagatctgttttgtttctgcaaatgttatgccccagtgagaccaagggtaccatttcctaag

SEQ ID NO: 967 - DNA, 519 bp, Mus musculus
  misc_feature (364)..(364): n is a, c, g, or t
  misc_feature (366)..(366): n is a, c, g, or t
  misc_feature (382)..(382): n is a, c, g, or t
caactgcctatttctatggtgtaaatatccttactttggtagatttcaagctattaacatgaagttactggaaaaggagttgagaaaacatatggaaaattactcttaaaactgtttcaggcagtttttaacctagaagcagctgaactttctaggaatacttcaacagtgcatcttcagccttctccagttccaacctacctaagggtcatgtctctcacagcaggctcaaggctgcaagagtcattgcaaatggccaactgacttgcccatttatggttttcttctcaccggtaaactgttattgtaattaacactgtcatattgaattttctagagggatgctgaccatccgacccatttntnatctgagacttggtgnactggcattttaatacttatctggacctttgtagtgatgcataattggtttgaaccccttgtcactgccacctgcccccaccaacacaaaatcctacttcattactgctgactctgctaacgttccactacttgttg

SEQ ID NO: 968 - DNA, 541 bp, Mus musculus
gactcgctccagcttatggttcaagcagttggcccagaacatgaagctagggcaacagcttgagctagggtttggctagagatgacaaccgacaggcaagggatgctaagtagtttaacagcacttacacaggtggattaagagccccgatggtgaattacagaaacgcaaacgaacctagaataggttctgtgttacatctattctataggaagctcatatggagtggtgtaacagggtccagaccttagcacagctgactccatgatggaagtggcattccgactgtaaaactcagcacatagacaccgccaccagccagaatgaaaacaaagatctaatccaccaaggtccacagttctaagaaagtctccacatgaactaaccttgctttttggcttctgtaattatgcttctggctaactgttcttgctaactgaagaatgtcaacccagaatacggttttcgtccttaaaagctcattcagagagaggctcagggctacgctggcatctggaatacccagtgtagtagccagcca

SEQ ID NO: 969 - DNA, 129 bp, Mus musculus
ttgtcaagttcaccaaggcagcccctcagctccccatggaagaactggtctcccttagtaaggaaatggtggcagctctgacaacctgttgcactctcagtgacgagttcgcctgcgttgacaacttgg

SEQ ID NO: 970 - DNA, 376 bp, Mus musculus
  misc_feature (114)..(114): n is a, c, g, or t
  misc_feature (117)..(118): n is a, c, g, or t
  misc_feature (123)..(124): n is a, c, g, or t
  misc_feature (126)..(128): n is a, c, g, or t
  misc_feature (131)..(132): n is a, c, g, or t
  misc_feature (134)..(136): n is a, c, g, or t
  misc_feature (138)..(139): n is a, c, g, or t
  misc_feature (141)..(141): n is a, c, g, or t
  misc_feature (143)..(152): n is a, c, g, or t
  misc_feature (154)..(154): n is a, c, g, or t
  misc_feature (156)..(156): n is a, c, g, or t
  misc_feature (158)..(159): n is a, c, g, or t
  misc_feature (161)..(161): n is a, c, g, or t
  misc_feature (164)..(166): n is a, c, g, or t
  misc_feature (168)..(173): n is a, c, g, or t
  misc_feature (261)..(261): n is a, c, g, or t
atgactgcagttgtgtcagcggctctggtttccagaagggaaaccattcagcacgtttgggtgaatgcccaagagacaaatgcaaaaccaaatattacttttatataacttttnaanncattnnannnttnntnnntnnantnnnnnnnnnntntntnntnttnnntnnnnnnaggagtgtccaacctgaattgaaatcacttggaatgggattccattcactggttgtacgaacactaggaggaattctagctccagtcnattatggggcattaattgacagaacatgtatgaagtggtctgtaaccagctgtggagcacgtggagcatgcaggctatataactcgagattatttggaatgatctacgtgggttt

SEQ ID NO: 971 - DNA, 406 bp, Mus musculus
  misc_feature (275)..(275): n is a, c, g, or t
gacccttccgagcaagcactatatggaaagttacccatctttggacaatacttcgctctggaaaatccagggacaatcagagtgggagaccctgtgtacctcctgggccagtgatgggaactgttcgttctggaagaacagatggctcttaaaaaaaaacttttacaaacagacatcgcttgaaacagttcttcagcctgttctttggatcggccagttccaagtttctcttctttcagatttccgtctgtttcaatgtttcctggggccagccnacaaagcaggcaaatacagctttgcgaacttagcaggtccctgttatgtttcttgtagaatgaagggattatcatattgccctgtttataaatacggagtaatccttctacgtcggaattcacttgccaag

SEQ ID NO: 972 - DNA, 494 bp, Mus musculus
  misc_feature (60)..(60): n is a, c, g, or t
  misc_feature (62)..(65): n is a, c, g, or t
  misc_feature (72)..(72): n is a, c, g, or t
  misc_feature (118)..(118): n is a, c, g, or t
aaatcaacagcccaggtttatccctggcttctcttcaaagttgatagactatgtagatangnnnncttcagnaacagataaccaactgtatacacaaaaaagaggaggctcttgggcnactgggagtaaattattaacatcaacatatgtagcatccaagtgactgctgagggaggacaagtcagaaaatgcagtctgcacacgttatatatacatcagaggcaacaagcacggtgcctatctgaacctggatggactttttaacagatcaacatggaggagacttttgaaatagaaatccagcctgatgcaaaacctgacagtgagaaagaacgtggggactgggaaaaatgacgaaagacaaagaaagacggtgtatgaaacgtgttccagtgcctaccacatggcaaattattagcatcatcattgttattcccattgttaaaacgtgattcagaggtttacctaaataaacttggctcttctatctgaaa

SEQ ID NO: 973 - DNA, 367 bp, Mus musculus
cattatggaggcttcacggtacagaacgaggccagcaaataccaagtctcagtgaacaaatacaaagggacggctggcaacgccctcatggacggggcctctcaactggtgggggagaacagaaccatgaccatccacaacggcatgttcttcagcacgtacgacagggacaacgacggctgggtaactacggatccaagaaaacagtgctccaaagaagatggtggtggctggtggtataacagatgccatgcagccaatccaaatggcagatactactggggtggcctttacagctgggacatgtccaagcacggcacagatgatggtgtggtgtggatgaactggaagggatcgtggtactcaa

SEQ ID NO: 974 - DNA, 472 bp, Mus musculus
cagcagaggaccttctgtgctgtgactgaggggaggcctgagctcggacagcccagctgctgaccacaaaatcagggagttgatctgccatctgcttgggggtcatgagtcaggattgtgtgggtctgcttgatgaggacatgtgtcacttggagtcattttcaccgaacaaagaactgttcattcctgcttgtactgccatgcccatttcagagcataccttcaccaacccctctgggtgctaggccaacctcgaaacccagttctactcagcatccaccgattcactgtccctttagagacaggctagggaccagacagcaagctggttacatctgactacaggctgggctggttccctgtcctaggctactcagaggaccgaggaatcggtgcagggcatcaccatcgcatacccacaccacctgtaggtgctgtgctggccacatgaagatcctggaacctgggtcag

SEQ ID NO: 975 - DNA, 159 bp, Mus musculus
  misc_feature (94)..(94): n is a, c, g, or t
tcagcttgccttcatttctttttatgcccaatgactgctgtaccagcatcacttgtaaagggagcctttttcacagtgagaggtagtcactccnagagactcataatttccctgattgctgagcataactgactgatcctttgatataatccgatattg

SEQ ID NO: 976 - DNA, 237 bp, Mus musculus
  misc_feature (46)..(46): n is a, c, g, or t
aaaatccaagccacacaactgttcatttgcgagggacctggtaatncctacagatggacagagcaacagactgattcatgccatgcatttgttcgctgggtaacagaatcacttgacacagcccacttatctgcactgaaaggactctggctctttaagctctcacctttcttattctcatctctagccctctttctcctccccaccccaacatggctatggccagtctctcttctc

SEQ ID NO: 977 - DNA, 466 bp, Mus musculus
  misc_feature (55)..(55): n is a, c, g, or t
  misc_feature (109)..(109): n is a, c, g, or t
  misc_feature (123)..(124): n is a, c, g, or t
agtaacttcagtcacacccaaagtccacaaacaggacagattaccatgaaatttngttaaaataaaatatggatttaatttatgaatggcatcatgatgcttgtgtatngttatttttttttnnggcaatgattctcacttatatagtcaacctagaaatagcattttttcttcccatgattcacaaagtgagattggatttctttgatagatccttgcttcaggttttagaagatgtcagcagatgacagaggacacagaagtggttattttcttgatattcatgttggattttaatataagtcaagtgaaatgtataggctgattcaccttctgctccaatttggaaaccctgtagaagttcctgttccttttgtaggatggattctggcagtagcctgactctcaccttgcattctgtataccacacatattacacatagggcctccattcctttacatgcaa

SEQ ID NO: 978 - DNA, 438 bp, Mus musculus
tgaaaagctgggtcactgccgtggccaaaataatgtctgattacccccagcagttccactccaatctgcaggatttttcagaccaactctctagctactatgaaaaatttgttggtgagtccacaagattgattgacctgtccattcaaaactaccacgtgtttctcagatacatcaccgagttactgagaaagctgcaggtggccacagccaataatgtgagcccctatataaagcttgctcaaggagagctgatgatcaccttctgattcatctactaacaaattcaaattaaaccttcacatagtaggagactttgtagactactataaagaccatcctgagccagacctgcagtcaacagcaagagcaagaagcacataggaactatacctgcaaccaagctggcataagaaccaagaccttcaaagcagcctg

SEQ ID NO: 979 - DNA, 258 bp, Mus musculus
  misc_feature (92)..(92): n is a, c, g, or t
  misc_feature (99)..(99): n is a, c, g, or t
  misc_feature (103)..(103): n is a, c, g, or t
  misc_feature (108)..(108): n is a, c, g, or t
  misc_feature (111)..(111): n is a, c, g, or t
  misc_feature (113)..(113): n is a, c, g, or t
  misc_feature (124)..(124): n is a, c, g, or t
  misc_feature (153)..(153): n is a, c, g, or t
  misc_feature (203)..(203): n is a, c, g, or t
  misc_feature (206)..(206): n is a, c, g, or t
aacccctggagaaacacctgctatttcaactccccaagatcctttaggaaaaatcattgctctaggcctctttgatttttctctcaaaagcnatagctntctncctcnctntncctttgttgcngtggaagactgaagatataaatgagcatnactgggacgggacgtctgcgtgaagactcactggagattcctttcaaatnccntctttctgtacactagatttctttctttggatccttaaagatttctttccag

SEQ ID NO: 980 - DNA, 350 bp, Mus musculus
  misc_feature (29)..(30): n is a, c, g, or t
  misc_feature (35)..(36): n is a, c, g, or t
  misc_feature (38)..(38): n is a, c, g, or t
  misc_feature (40)..(40): n is a, c, g, or t
  misc_feature (42)..(45): n is a, c, g, or t
  misc_feature (48)..(49): n is a, c, g, or t
  misc_feature (55)..(55): n is a, c, g, or t
  misc_feature (67)..(67): n is a, c, g, or t
  misc_feature (85)..(85): n is a, c, g, or t
  misc_feature (180)..(180): n is a, c, g, or t
  misc_feature (263)..(263): n is a, c, g, or t
gaagccaaagttttgatgcctgtcaaaannaaaannananannnnaanncaatancaataacaacancaacaacaaaaacccctntgttctttagcaatagaataagtcagtttatgtgggaaagagaagaatttaaaattgtaaacacatccctagtgcatggtatgattatgtaattnctttgctattatgagaatttcttaaagcttttagtttaagtgcctggcattttattatcctgcttgacttggtttaaacactntcttcaatttacaacctctgaatgacatttgggtatcatattaattatcatacacatttccttccactaaacattaaacactttgct

SEQ ID NO: 981 - DNA, 477 bp, Mus musculus
gtcacaggtgactttcaaatcttagtaaggattttcctaaaatatgaccagctgttgaaaatccaggtcatgagcctactcagtttttatggttctctacttatggaagtagaaatttgtacagtttgataagaaagagattcagctgtttttgatgtttcttaacttctcccacccctttccagggaagcttcatgcctggacaagccatgaagcagtagagtgctcctcatacctttgaagtagaaaagatgcctgcctgtttgtgtaacaggctggggaagattccaatacagagctaatcagattggcctcagaaaaaatactaacttattcgttttgttcctgtctttcagtgtagaagacttctgtattttttaaaatacaattttatttctttcaacgaatttaaaaaaaaacacctttggaacaacaagaacaacaaaagtataattacttcttctattgcttgcattg

SEQ ID NO: 982 - DNA, 188 bp, Mus musculus
  misc_feature (65)..(65): n is a, c, g, or t
ggaccagatattctcacctgtcctctaataaattctctgtccttgtaccactgctggccagaggnggaaagttgtatttgatgttcacggtccgctcagacaagctgaaaagggaacctggagaagtctgcttccctggaggaaagagggacccggtggacacagatgacacagccactgctctccgt

SEQ ID NO: 983 - DNA, 83 bp, Mus musculus
  misc_feature (53)..(53): n is a, c, g, or t
gcctgagcctccaggtgggcaatatccaaagagagcaaggagggggttggtcntcatggagaggcccttcccaaagtattaat

SEQ ID NO: 984 - DNA, 565 bp, Mus musculus
  misc_feature (130)..(130): n is a, c, g, or t
  misc_feature (180)..(180): n is a, c, g, or t
  misc_feature (199)..(199): n is a, c, g, or t
  misc_feature (211)..(211): n is a, c, g, or t
  misc_feature (311)..(311): n is a, c, g, or t
  misc_feature (338)..(338): n is a, c, g, or t
  misc_feature (345)..(345): n is a, c, g, or t
  misc_feature (358)..(358): n is a, c, g, or t
  misc_feature (372)..(372): n is a, c, g, or t
  misc_feature (376)..(376): n is a, c, g, or t
  misc_feature (385)..(385): n is a, c, g, or t
  misc_feature (399)..(399): n is a, c, g, or t
  misc_feature (417)..(417): n is a, c, g, or t
  misc_feature (437)..(437): n is a, c, g, or t
  misc_feature (439)..(439): n is a, c, g, or t
  misc_feature (444)..(444): n is a, c, g, or t
  misc_feature (460)..(460): n is a, c, g, or t
agatcgagtacagtggcaccgccttgctgctgctggtcctccctgaccctgggaagatgcagcaggtagaggctgccctccagccagagacgctgagaaggtggggccagcggttcctgcccagtctgtnggatttgcacctgccaaggttttcaatttccgcaacttacaacctggaangagatcctgcccctcattnggtcttggcaancctattcgacatggaagctgacttatcaggaattatggggcaactcaacaaaactgtctccagggtgtcacacaaggccatcgtggacatgaacgagaangggaactgaggctgcagctgcctctgncctcctntcccagcccccanccctgaacatgacntcanccccacagncccactataacagncccttcctgcttctgctntgggaggtgaccacccagantntgctnttcttggggaaagtgntcaacccagctgctgggtaattgtggtggggaggccacaggaaggcccaacctgcacggcaggacccccctgcatggcaggacccctgtgcttcagttctaataa

SEQ ID NO: 985 - DNA, 347 bp, Mus musculus
  misc_feature (268)..(268): n is a, c, g, or t
  misc_feature (280)..(280): n is a, c, g, or t
  misc_feature (311)..(311): n is a, c, g, or t
ctatgaagcccctggacagagcagtcttctggattgagtttgtcatgcgccacaaaggggccaagcatctgagaccacttgcatacaacctcacctggtaccagtaccactctctggatgtgattggattcctgcttgcttttgtgacattcattgtagccctcattgtaaagtgcttcttgtttgtttaccgattctttgtaaagaaagaaaagaaaatgaagaatgagtagaactcattgataatgcattacatgaataaaatttnaccatcattctnatgttatgaactatcttttaaacactcactnatcactttacagaagcatatcttttttggagtttta

SEQ ID NO: 986 - DNA, 537 bp, Mus musculus
  misc_feature (135)..(135): n is a, c, g, or t
gctagcttccacatcttggatctatcgactttccaatgtttaatatgtaaaggaagaaatacagtattttttgcagactttttgtcagtattctctacacaataatagcatacattgtgttattttatcacagcnaacctagaaatgacttaagagtataaagatgccagattatatcaaaataaatgacacctcacatgtaagaactgatcgtccatggatttttggacctttggtgctcctggaactggtattacagtgttatagaaggaagatgaccatggatttcaactgcaccacttgtgtgtatgtaaggtgtgcatatgtgcacactcacacatgtacttacataacacacagtgagggttaaacagatataaatacagaggaaaataccatgggctaacagcaaaatctcagaaatcagtaggctaaatggtaaatgctgaaatggtcctttgtaactatctgtgtggtacacttctaagcaaacaccagttcctatttaaatggggaatacctattttgtaagcttca

SEQ ID NO: 987 - DNA, 463 bp, Mus musculus
  misc_feature (141)..(142): n is a, c, g, or t
ggtacacttgttcacatgggaaagtatgaaatgatggagctgtctctgtacaaagcatgaatgtctgtgcacatgcagatgtgggatatggtgaaggagaaagagtggactggagagcaggcagaagggataaggtcaggnngtgtgtgtgtgtgtgtgtgtgtattgtgtgtatgtgtgtgtccatataacttcacgatctaaatgtcttgcaaaagtatcattaacatattactttattttctgtggagaattattatgctttaaaccaatattccatcatttctaaatgcatatttaccaggttttttggtattacatagaatgcaattattacagagagtatttgtataatctggtttatctgaggatagtttgtggaaatgaagtgattgtgtcagtaaaagttgtttgggtgatatatagtgccaagtcatggagcagacgtgcagaaatggaaaag

SEQ ID NO: 988 - DNA, 407 bp, Mus musculus
  misc_feature (42)..(42): n is a, c, g, or t
  misc_feature (72)..(73): n is a, c, g, or t
  misc_feature (91)..(91): n is a, c, g, or t
  misc_feature (122)..(122): n is a, c, g, or t
  misc_feature (136)..(136): n is a, c, g, or t
  misc_feature (186)..(186): n is a, c, g, or t
  misc_feature (319)..(319): n is a, c, g, or t
  misc_feature (330)..(330): n is a, c, g, or t
  misc_feature (336)..(336): n is a, c, g, or t
  misc_feature (352)..(352): n is a, c, g, or t
  misc_feature (375)..(375): n is a, c, g, or t
  misc_feature (378)..(378): n is a, c, g, or t
  misc_feature (381)..(381): n is a, c, g, or t
atgtgcctgaaagtactgccattcccttaggttgaaaccctnggaacttcctgtattgctcactggtttctnnatgatgaacatcgatctnttttatactaattcaacagtgggaaggtgcngagagcctcctggntcagagagagtgatggtggaggcacagaataggactctggtgtggctttnaagtctgagggtctctggtaattctaactctctaactgtattgaaatgctggtgacaacatctaaaaaaccataaaactttctttgctctttctgagggtaaaaaacctgcagacttaggtgattaacaactngaagccacaanaaaccnaaacttatgggacacnaatgaaagcattcctaaggaggnaanacncatagctctgactgccaccaaaaaga

SEQ ID NO: 989 - DNA, 517 bp, Mus musculus
  misc_feature (45)..(45): n is a, c, g, or t
  misc_feature (172)..(172): n is a, c, g, or t
  misc_feature (287)..(287): n is a, c, g, or t
  misc_feature (475)..(475): n is a, c, g, or t
agtaccatgatcacgttgccagctggagtccagctgggctggaantgctctgcttttcattgtgtgttcctgcacaaagtagcccgtcttccactcgaagccttaagaggctgagaaaatgagagggccggataacatcacttttacaagacaaagtggaggcaggaggccntagatctttggcaggtccatccaagaaagggagtgtcacctctggaatggaacaatgccggcactgttcttcctgggccgcacgtggagagcacacagcacaccactaacacttntagagctcaacgggaagctcaaagggctgtctgatctctatctattttttttcttgtagttcttgcttatggctaccagccctacaaactgtcaacaactctgaaggatgctcttgcatctctgcctctctctttcatcagtacttcatgtgaataggaatgtggcaaataggagagatttgggtttnctgttattatttttgttgctgtgtatgcgtaattgcctgcca

SEQ ID NO: 990 - DNA, 128 bp, Mus musculus
  misc_feature (37)..(37): n is a, c, g, or t
  misc_feature (40)..(40): n is a, c, g, or t
  misc_feature (53)..(53): n is a, c, g, or t
  misc_feature (75)..(75): n is a, c, g, or t
  misc_feature (78)..(78): n is a, c, g, or t
  misc_feature (95)..(95): n is a, c, g, or t
ctgacccttgtgtcaccactagtgactgtgagtaatnccngcttcttttttcnttgatgcctaaggcatcttatnatntacactactaccccagnagacaccactttgacacagttcctaatgctttg

SEQ ID NO: 991 - DNA, 214 bp, Mus musculus
  misc_feature (31)..(31): n is a, c, g, or t
  misc_feature (45)..(45): n is a, c, g, or t
atcacattacattcaaccggccgttcctgtnggtgatatattccngcagcaccgagaatatcatcttcatggggaaggtggtcaaccccacagcacagcagacctcggactagctggtctgttaccagcaggagaatgtgactggggagtgctgggtatgaataactctgcatccacgacttggggtagggaagggcccctgacaccaagagca

SEQ ID NO: 992 - DNA, 214 bp, Mus musculus
  misc_feature (91)..(91): n is a, c, g, or t
  misc_feature (101)..(101): n is a, c, g, or t
  misc_feature (113)..(113): n is a, c, g, or t
  misc_feature (115)..(116): n is a, c, g, or t
  misc_feature (119)..(119): n is a, c, g, or t
  misc_feature (154)..(154): n is a, c, g, or t
cccctaccttgggatatagcctggtcttagatttaattgtccttatgcctaaggtggtcataacgcaactgacctcctagggggtaacacnaatacatagncacactgagggncnnagnagtggcaactatcatcactgtacatttggagaggntgtgaagcctgtgatttctctctcaggccttccacaaggccaccctagacgtgaatgaag

SEQ ID NO: 993 - DNA, 254 bp, Mus musculus
gcatgacctgtgctgagctctacgagaagctgcctcaaggctatcgcatggagcagcctcgaaactgcgatgacgaagtgtacgagctgatgcggcagtgctggcgggatcggccctatgagcgccccccctttgctcagatcgcactacagttgggccgcatgctggaagccaggaaggcctacgtgaacatgtcgctgtttgagaacttcacctatgcgggcatcgatgccacagctgaggaggcctaggct

SEQ ID NO: 994 - DNA, 555 bp, Mus musculus
  misc_feature (158)..(158): n is a, c, g, or t
  misc_feature (171)..(171): n is a, c, g, or t
  misc_feature (292)..(292): n is a, c, g, or t
  misc_feature (301)..(301): n is a, c, g, or t
  misc_feature (306)..(306): n is a, c, g, or t
  misc_feature (333)..(333): n is a, c, g, or t
  misc_feature (348)..(348): n is a, c, g, or t
  misc_feature (365)..(365): n is a, c, g, or t
  misc_feature (383)..(383): n is a, c, g, or t
  misc_feature (420)..(420): n is a, c, g, or t
  misc_feature (422)..(423): n is a, c, g, or t
  misc_feature (425)..(425): n is a, c, g, or t
  misc_feature (463)..(463): n is a, c, g, or t
  misc_feature (480)..(480): n is a, c, g, or t
  misc_feature (486)..(486): n is a, c, g, or t
  misc_feature (497)..(497): n is a, c, g, or t
  misc_feature (522)..(522): n is a, c, g, or t
ccaacagctctgcatccaagaagcagtatgtgtagggatctggggctaatgtcactcaacagagctgccccgaggagcacgcacgtgtaccttggctgcctctctggcggtccactcctcaaaggcacctcagagacaactgggccagggaggtggancattcgctgggcnagaggacctggtcacagatggttctggaatacctggagcctttgtgatgaccagaggacactggctgcttaccagaatgtgacactacccagactgggtcacagcaggtgggagtgctctngactaagtnttctntgaaccctcgatccttttcacctgttnctgagggacccagcnccaagttgactttcgancctcccctattagacgantcactgaaccctgggttttcatcacaccccacttctncnngngaaaaagcactgatgcaggctgctggctcagcctcgtncacctggacagacacancctgcngccggagctgncccttgccaggggaactggttgatntcttgtttttctcacttctagttccactgttta

SEQ ID NO: 995 - DNA, 532 bp, Mus musculus
  misc_feature (85)..(86): n is a, c, g, or t
  misc_feature (323)..(323): n is a, c, g, or t
  misc_feature (412)..(412): n is a, c, g, or t
  misc_feature (419)..(419): n is a, c, g, or t
  misc_feature (507)..(507): n is a, c, g, or t
tggccactggcctgtacacaagaattgggacctcgcttgggatctggctagaattgcaaaatcctagcccccacccctgccccanncccagtgtgccagttcataagaatctgcattttgacaacatccacagggacattgtccagtcatttcaggacaactggtcttaagagtttccaacctttgtagaacatttaaatgtcggttaataataagtagcaggccatgttaaggccatttattatcaagaaactgaggaattttctctgcatagctttgctttctggatacaataaaatgagaaggtacacacctctagatantgccacacagagtccagaagggttttgttttaagtaagctaggaatgagttcatatgttagtgtaaggaacaaatgtattatatgtgtntcttttngtaaagaaaggtttttctttacggttttgtaagctcagcatatttgtacatatttatttattggagtttcgctagaacacaagcaaancctttgcttatgacgtcacatgtac

SEQ ID NO: 996 - DNA, 425 bp, Mus musculus
agcatggcgtagtgcccagcctggagcctcggggagccccccagccagcccttgccctgcaggagagaccgagcagccacaagctggaaaccaccggccatgaacttgtcccaggaaccaaacacctcccctgcacctgttcattcctcccagtggagacttcagattggaataccttgggatctcctcaccccactttacagaactgcccaatccaggggctctgggatatggctgcccgggattacagaaagacacggcactgccgtgccacacccatgctgcttagaagcctaagcctctgccttcaagctggatcctgtgcagggtgggcaggcaagaactcagacatgcccagcctagcccagggcggcctgcatctggccccagaagcctcctcacctggactggcacaacttcggttg

SEQ ID NO: 997 - DNA, 352 bp, Mus musculus
ctgtgctgcgtgtttctcaagaacagggaattaaggactgcaacttctaggtacaaggttataggagaccgccagccttcctcacgatgaccctggaggggctgggagaacacaagggacaatagcagccatatttggggctctggaatcatgtggtccgaggtgtaaataagcattctaggggcttgggtttttgtttttgttttcctgtcaggaattaattttgaaaactccttgaggaatgtccagcagaatgaggctcaaagggactgcatagatgaaggcagagggggagaagccctgtgtagaacagcctgtgtcaccgtcaggtgtctgatgcttccctcggtct

SEQ ID NO: 998 - DNA, 508 bp, Mus musculus
  misc_feature (428)..(428): n is a, c, g, or t
  misc_feature (430)..(430): n is a, c, g, or t
acttgagaacttgactggttgcgacagagaaaaaaaaagtgtccgagtactgaagccaagggtacacaagatggactgggttgcgacctgacggcgcccccagtgtgctggagtgggaaggacgtggcgcgcctggctttggcgtggagccagagagcagcggcctattggccggcagactttgcggacgggctgtgcccgcgcgcgaccagaacgatggacttttcgttaacattgaccaagaactgcatggacctaacattcgatctcattcagtattaaaggggggtgggaggggttacaaactgcaatagagactgtagattgcttctgtagtgctccttaacacaaagcagggagggctgggaaggggggggaggcttgtaagtgccaggctagactgcagatgaactcccctggcctgcctntntcaactgtgtatgtacatatatatttttttttaatttgatgaaagctgattactgtcaataaacagcttcctgccttt

SEQ ID NO: 999 - DNA, 442 bp, Mus musculus
  misc_feature (177)..(177): n is a, c, g, or t
  misc_feature (280)..(280): n is a, c, g, or t
ctgagttccactgagttcctaagcagtcacaacaatgacttgaccgcaagacatttgctgaactcggcacattcgggaccaatatattgtgggtacatcaagtccctctgacaaaacagggcagaagagaaaggactctgtttgaggcagtttcttcgcttgcctgttttttttttnctagaaacttcatgcttgacacacccaccagtattaaccattcccgatgacatgcgcgtatgagagtttttacctttatttatttttgtgtaggtcggtggtntctgccttcacaaatgtcattgtctactcatagaagaaccaaatacctcaattttgtgtttgcgtactgtactatcttgtaaatagacccagagcaggtttgctttcggcactgacagacaaagccagtgtaggtttgtagctttcagttatcgacagttgt

SEQ ID NO: 1000 - DNA, 524 bp, Mus musculus
  misc_feature (29)..(29): n is a, c, g, or t
  misc_feature (78)..(78): n is a, c, g, or t
  misc_feature (206)..(206): n is a, c, g, or t
  misc_feature (306)..(306): n is a, c, g, or t
  misc_feature (352)..(352): n is a, c, g, or t
  misc_feature (418)..(418): n is a, c, g, or t
  misc_feature (430)..(430): n is a, c, g, or t
  misc_feature (440)..(440): n is a, c, g, or t
tggatgacgaccaccgctgggttgcgcangcgcaagtcatgctgggttcgggccagacttgcccgctctcagagtccngttgaccatcactagccgggccctgctcagaacagactacaggcacttttaagaacttgaccgaccttttcttctatgcgcagttggccacgacgtgggtggaacgctcagatttcatcggtgaagtnaggcaccaaactgccgcgaacagttcctactgagatcctgggggcactagatgctgccttaatgtccagtggcacctgctaacctgaaagggcagctggnagaaaccccggggctgccagagggacgtgttaaaaagggcattttntttgttagtggagaagaacctactgaaccaaaggacttagccttggacctggtctcactccagcantctccccaaggntgggggcccntgtaggtaccagagccttagaggggttgccttcctcctggaagcttggggcttggggggtgggccgggcaagaatttgctcagt

SEQ ID NO: 1001 - DNA, 297 bp, Mus musculus
gaaggccgtctcagtgctaagttgacactccggggcaaggcgctgcgagtgaagctggaccttcgaaggtttcaaatctactcaaatcagtctgcgctggagtctctggcgctgatcccactgcaggccccactgaagacactgctgcaaatcggagtgatgcctttgctgaacgagcgtacctggcgtggggtgcagatcccccttcctgagggtatcaacttcgtgcgtgaggtggtgaccaaccacgcgggcttcgtcactgttggggctgacctccactttgccaaagggctt

SEQ ID NO: 1002 - DNA, 448 bp, Mus musculus
  misc_feature (267)..(267): n is a, c, g, or t
gcgcaagctgcacattagtcacgacaatataggtggcccagaaggcaaaagggcccggacggcctacactcgctaccagaccctggagctggagaaagaattccacttcaaccgctacctgacccgccgaagaaggatcgaaatagctcatgccctttgcctctccgagagacaaattaaaatctggttccaaaacaggaggatgaagtggaaaaaagataataagctgaaaagcatgagtatggccgcggcagggggggctttccncccctgagcatctgagcggccaaagtactgagcagtagtagccgggcagctctctgtagtgtcagtactaaggtgactttctgaaactccccttgtgttccttctgtgaagaagccctgttctcgttgccctaattcatcttttaatcatgagcctgtttattgccattatagcgcctgta

SEQ ID NO: 1003 - DNA, 542 bp, Mus musculus
  misc_feature (290)..(290): n is a, c, g, or t
  misc_feature (297)..(299): n is a, c, g, or t
  misc_feature (310)..(311): n is a, c, g, or t
  misc_feature (339)..(339): n is a, c, g, or t
  misc_feature (343)..(343): n is a, c, g, or t
  misc_feature (350)..(350): n is a, c, g, or t
  misc_feature (433)..(433): n is a, c, g, or t
  misc_feature (452)..(452): n is a, c, g, or t
  misc_feature (476)..(476): n is a, c, g, or t
  misc_feature (488)..(488): n is a, c, g, or t
atccagctgtaaggctctggtcagaggcattctatgggtaatgttatgtaattgtataggtaaaggccagagcagtttccagaagccattaataagctgttaggtacagaaaagcacctttaagtagagaattagatttctcctttccagaatagaaatgatcctcccctccccggagcaaaagaggcagtttctagacagtagcctactttttggaagggttaatttactcctaatttaagtagcaggcagtgaacagacagaaggcagaggaaagcattgtttttttnttttttnnnttttttttttnngagagtgagtttagtaatgtagaatgtnttcnatacaanccgtattctcattgtgagaattgtaatacttaatagaatatttcagagtttttgtttaaaccacaaattacagaatccacccnagaaaatgtttcccctccncttcctggaattggcatctaaggntcctctggcttntcctctgttgtttaactcaatggtctctagggttgatcttttcaattcctggta

SEQ ID NO: 1004 - DNA, 497 bp, Mus musculus
  misc_feature (390)..(390): n is a, c, g, or t
  misc_feature (402)..(402): n is a, c, g, or t
  misc_feature (405)..(405): n is a, c, g, or t
  misc_feature (427)..(427): n is a, c, g, or t
gaaacacatgtcctaccttgctggtatgagtacaagagttgcatggactctgtcaaggactggtgcaactggactttgattagcaggcattacagcgacctgcagaactgcttggaatacaatgcagacaagtttgggctgggcttcccaaatcccttggcagaaaacatcatccttgaggctcacctgatacactttgcgaactgctccctggtgcagcccaccttctctgatcccccagaggatgtgctcctggccatgatcatagcccccatctgcctcatcccgttccttgttactcttgtggtgtggaggagtaaagacagcgatgcccaggcctagggtccatttctcagcagccatttttccccccttttccctgctggaacncaggaatggcgntcntcccctccctacccacttactntcatccttcccacagacctgtggattggtggaaatggcagcaaaggggactcacgacacaatgtttgtag

SEQ ID NO: 1005 - DNA, 598 bp, Mus musculus
tgccaatatctactgtggtgtcattctcagccatagcagtctaagattagtcagtattagttttgtaatagtatttttgaagctggatttctctaaagctgaagtgccaattaaaatatttctataatgcttgtagaaaaaaaatccaaaaattttgaaagaaaacttctctggtgcctaaaaattaacttggggagtttttagcttttaaaagttgcatctattatttttctctaatactttgttagagtcatggctgacacttttagaagcgactttgtatttttttgttgataaaccagccttcctggaggttagtgttttttcaaatataacaaactgtgtagggtttaggagtagtcagtgttatacttactgtttagatattttaatgtgaatctattttaatttcctttgtgttttaatttgctcatagaaacattatatgtaaaacatactcaagttcacttaaaagaactcatattttatcgacataaaatctctacttaggttttatgagaatattaaagttgtaagttatcactcactttcacgcatcctccctggactatagagcaattgaattcctcacaaaatt

SEQ ID NO: 1006 - DNA, 478 bp, Mus musculus
  misc_feature (358)..(358): n is a, c, g, or t
  misc_feature (369)..(369): n is a, c, g, or t
  misc_feature (429)..(429): n is a, c, g, or t
  misc_feature (453)..(453): n is a, c, g, or t
atgagcatcggagcaccggaaactcagaaacgcctagccccgagtgagcgagcagacaccatcgctaccttttccatcggctccactggcatcgttgtgtatgactaccagcggctcctgacggcctataagccagctccaggaacctactgctacatcatgaagatggctccagagagcatccctagtcttgaggctttcgctagaaaactccagaacttccaggccaagccctccacacccacctctaagctgggccaggaggaagggcatgatactggttccgagtccgattcttccgggagagacctggctttcctaggccttgctgtgagcaccctgtgtggagagctaccantctactatatntagcatccacagggtcggtagaaaccgcagcgggacaggaaagaccctccgcaaagggtntttgtcagacaagcaggaagctgntcctgcccagaaaccggtggaagtc

SEQ ID NO: 1007 - DNA, 557 bp, Mus musculus
  misc_feature (324)..(324): n is a, c, g, or t
  misc_feature (330)..(331): n is a, c, g, or t
  misc_feature (371)..(371): n is a, c, g, or t
  misc_feature (377)..(377): n is a, c, g, or t
  misc_feature (447)..(447): n is a, c, g, or t
  misc_feature (527)..(527): n is a, c, g, or t
aaaagtgttttgctgtgtacacataagatactgttcgttaaaataagcattcccttgacagcacaggaagaaaagcgagggaaatgtatggattatattaaatgtgggttactacacaagaggccgaacattccaagtagcagaagagagggtctctcaactctgctcctcacctgcagaagccagtttgtttggccatgtgacaattgtcctgtgtttttatagcacccaaatcattctaaaatatgaacatctaaaaactttgctaggagactaagaacctttggagagatagatataagtacggtcaaaaaacaaaactgngggacnntacatttattttctatagtaatctgttgtacattttaagnagtaanactaggaatttaggagtgatgtgtgacatttctgacatggagttaccatccccacatgtatcacatactntcatattcccacatgtatcacacatgtattgtaaaattttgtagttttgatcacttgtgaatttactgttgatgtggtanccacctgctgcaatggttcctcttgtaggt

SEQ ID NO: 1008 - DNA, 444 bp, Mus musculus
  misc_feature (106)..(106): n is a, c, g, or t
gaccatcgagctgacggcacactgaccggcaccgggcaggggccagtccctcagcccctggaccactggagaaaaggaagacgaagagtttggagcacctctcccnagcatcctctcagctggagaggcagcattggatccccatgccgcacacggggatgggatgggagcagaagcccatgatgggacacttgggtgtgggccagggacagggcctctttggaattaggcagaacgactgccacagctcagacctcagagattgtgaaggcagtgccaagctcacagcagttcaggaccatcccagaaaggggtgatagccctgtttatctctccaacccagtatctcatgtgccaaagccttcccccaggtagacagaggggacattgcctgagagctcttcaggagagagatagatggttcgtcgagtgccatcttattta

SEQ ID NO: 1009 - DNA, 337 bp, Mus musculus
aaggctggccagctattgcctgatgggtgtgacagaagaaattagcaccatccttggatcccagcagttggttgctgacctcagtcattgacactgggacaaggtgtcctctgtgtcctcagacagacagttggcccagagcctggggatcgtgtttggagagggcacagtagagagaggacaaggggtgtggtaagatgtccccactctgaagcagggtggggcagtagagaagggccagttaaagggcatagctggacactcctgccaaatggtactcctatcctaatctcagctcgagtggtatgctgcgagctgtactaagcacttactctag

SEQ ID NO: 1010 - DNA, 534 bp, Mus musculus
gattacctggatatcggcaacaacccccgagtgggtaccaaaagatacatggcacccgaggtgctggatgagcacatccgcacagactgctttgagtcgtacaagtggacagacatctgggcctttggcctagtgctatgggagatcgcccggcggaccatcatcaatggcattgtggaggattacaggccacctttctatgacatggtacccaatgaccccagttttgaggacatgaaaaaggtggtgtgcgttgaccagcagacacccaccatccctaaccggctggctgcagatccggtcctctccgggctggcccagatgatgagagagtgctggtaccccaacccctctgctcgcctcaccgcactgcgcataaagaagacattgcagaagctcagtcacaatccagagaagcccaaagtgattcactagcccagggccaccaggcttcctctgcctaaagtgtgtgctggggcagaagacatagcctgtctgggtagagggagtgaagagagtgtgcacgctgccctg

SEQ ID NO: 1011 - DNA, 514 bp, Mus musculus
  misc_feature (336)..(336): n is a, c, g, or t
  misc_feature (349)..(349): n is a, c, g, or t
  misc_feature (454)..(454): n is a, c, g, or t
gagagcagagcatgctagccacttaattctctgaccgggccagcatcatgggtacctgctcccctgtgtaccccatccttaaggttttctgtctgatgagactggaggcccagtgcaatccccactgagacagcctgcagcccactgtggctcttggtgcactcaccagccaggactagacaagtaggaaagggcttctagccacactggagaaaaagaaaatcaggtagggctggccaaagacatctttgtccattcgcaaaagctcttgtcggctgcagtgtgtaagtcaggcgatgagacagaggctaccagagaaacggatgagaacagcancctgaggtttctnatccagatatccagcaattggggggtgggggaagaccatagatggtcctgtattattccgattttaataatctaattcgtgatcattaagagactttagtaaatntcccttttcccacaaaagtaaagaaaagctatcgggattctctggttctgcttaaagact

SEQ ID NO: 1012 - DNA, 564 bp, Mus musculus
  misc_feature (367)..(367): n is a, c, g, or t
  misc_feature (421)..(421): n is a, c, g, or t
  misc_feature (423)..(423): n is a, c, g, or t
  misc_feature (437)..(437): n is a, c, g, or t
  misc_feature (481)..(481): n is a, c, g, or t
  misc_feature (498)..(498): n is a, c, g, or t
  misc_feature (526)..(526): n is a, c, g, or t
tgccctatacatttgctcttcctatataagttggtgaactttcctatataacaacatagaataacaacaacagaaaatgataagtacagataaatggttaattgttggggctgggaaaatggcccagtggttaaaagtattcattcctctcgaggacccaggatcaatttccagcatccacatggcagctcacaaccatctggaactccagttccagagaatccaatgcccttctggcctttgtggaaactttcatatgtatggtatacatgcatacactacactacactacactacacacacacacacacacacacacacacacacacacacacacatacacacacagagtaaatcaatttcttanattgtttaactttcacggtacttcttggaaacaatgacattaaacatagatttntncctttgtggctcancctgctctttcatagtcaagcttgctcatttaatttttttatantcatatccagtaaacgnccttgtgtcatagtaagataaaatggtntcttactgactctgtttacttatgtgtacaattctgga

SEQ ID NO: 1013 - DNA, 434 bp, Mus musculus
  misc_feature (153)..(153): n is a, c, g, or t
  misc_feature (210)..(210): n is a, c, g, or t
  misc_feature (269)..(269): n is a, c, g, or t
acggtggtcttcatacttgtgagcatagcagttatcgttttggtcgtcttgaccattacagtgctggggcttttcaaactctgcttccacaaaagccgttcctccaggacagggaagggagctttggactcaccaggtgtggaatgtgatgcngaggctacctctttgcaccacagttctacacaatgcactgacattggagtgaagagngggactgtggcctgaaggactgagcttaggttcttcactggctgggtgcgctcttggantcgggacacttagggaaacacctcaatgctcacatcttgcctagactttttcagtcccaacaattggggaaagaagaaaattttcagtgattactgtggaagtcctccttcccatacattttattttgtgctaaatctgaaagagacacttgttccctgaaaggg

SEQ ID NO: 1014 - DNA, 558 bp, Mus musculus
  misc_feature (106)..(106): n is a, c, g, or t
  misc_feature (121)..(121): n is a, c, g, or t
  misc_feature (134)..(134): n is a, c, g, or t
  misc_feature (149)..(149): n is a, c, g, or t
  misc_feature (155)..(155): n is a, c, g, or t
  misc_feature (208)..(208): n is a, c, g, or t
  misc_feature (227)..(227): n is a, c, g, or t
  misc_feature (265)..(265): n is a, c, g, or t
  misc_feature (333)..(333): n is a, c, g, or t
  misc_feature (375)..(375): n is a, c, g, or t
  misc_feature (420)..(420): n is a, c, g, or t
  misc_feature (449)..(449): n is a, c, g, or t
  misc_feature (480)..(480): n is a, c, g, or t
  misc_feature (495)..(495): n is a, c, g, or t
tacaatgacaatgtgtgtgcatcagggggttgttacaactgagcaagagtctttgcaggcaaaactaggggaaattgctttccacagaattaatagtgtaaaaagnaaataacaaataaanatataacaccttnctatgacttgagatnttagcntataataagaaatatcacacattcaggtggtaaataattaaggaataataatnaaaaacaatctggttgaanccaaagaccttggagaatatttcaggtagattagagtnctgcgatttttgtaagtgttgtaaagttgtgtgaagagaaacagagaaataaactcactcttgggagnaaatgaaactagaaaataaacttgagttatatttttctagantcatttttatactcttgattgtactaagagttgatttaaagttangcaaatatcctataataaaataacctagnaaattaagagagttcaatatatgaatctgtnttctaaatataaatntatgtgtttaatattgtttcactgaagaaacaaattgagagcttgcttcatatgaatgtggtt

SEQ ID NO: 1015 - DNA, 396 bp, Mus musculus
  misc_feature (358)..(358): n is a, c, g, or t
gagaactgcatcacattttgacctgttctcaacagtacccatctatttcaggtgggatctctggacctttcctccttcccatcttgtctgcaatgtggcaaatggcttctttttgcatttttactccgcccccaccccaagctgaagttcatttgcagatcagcgattaagtctgaattgtgtggtggtcagtcttgtttccttttgtcaggggttattgtaaatgttagtaatttcgcctcaagccctcagtaagaacataaatattttaaaatatgtgcgtttgaaatctgtttcatgcatcctggaactgtgggatgctcaggcaagagtgactttagtctttcagtgaatgttncccagaatgtgggtagggaaggctcacaggttactctc

SEQ ID NO: 1016 - DNA, 266 bp, Mus musculus
cccttggtagggaataactcatctttaacgacaaacttaaccctaagggctatttctaacacagacagaggaatcagcttgcttttcctgttaaacgtttagggagtgtgggagatgcacagcattaaataacagttggttccatttagaaagtacccaagggaagaatggacaaataatgagagccctggcaagtggtgttataaaaacgttccaccaaaagcctacattggcttggcattcccacgtacctaagaagttctgtt

SEQ ID NO: 1017 - DNA, 173 bp, Mus musculus
  misc_feature (108)..(108): n is a, c, g, or t
  misc_feature (110)..(110): n is a, c, g, or t
  misc_feature (117)..(117): n is a, c, g, or t
  misc_feature (126)..(126): n is a, c, g, or t
  misc_feature (134)..(134): n is a, c, g, or t
  misc_feature (145)..(145): n is a, c, g, or t
  misc_feature (147)..(148): n is a, c, g, or t
aagtctaagcaagatgttttgtataaaatctgaattttgcaatgtatttagctacagcttgtttaacggcagtgtcatcccctttgcactgtaatgaggaaaaaaaananaggtatnaaaaggttnccaaattnctgcatatttntnnccgtaattatgtaccatgaatattt

SEQ ID NO: 1018 - DNA, 324 bp, Mus musculus
acaatcactgtggtcatgctgtccatctgctgcagctcagcttcttcggacatctgcccaggatttcttcaagtccttgaggccctcctcatggaatcagagtctggttatgtggcatccctgaagcctttcaaccctggctcagacctgcaaaatgcgggcacccagctgaagagactggtggataccctcccacaagagaccaggataaacatcatgaagctcacggagaaaatcctaacaagtcctctgtgtaagcaagatttaagattctgaagctcactggatttcagagatattctactgctaaagccttgtcactgc

SEQ ID NO: 1019 - DNA, 528 bp, Mus musculus
  misc_feature (63)..(63): n is a, c, g, or t
  misc_feature (183)..(183): n is a, c, g, or t
  misc_feature (209)..(209): n is a, c, g, or t
  misc_feature (212)..(212): n is a, c, g, or t
  misc_feature (273)..(273): n is a, c, g, or t
ggtgcgagagaacgtatcccaaactgggatttctaaggcaacgctaactcagaacactaccanccaagagacaccgcgggtcctggctaggcccactggggacggacagagactttctccgtgtctaattaatatttatgtatttatgtatatcctcctaggtgaaggaggggtgtatgtaantatttattctaacttatgcaggggtngcngagatatgcctccctgctgtaacacagatatttattacgatttatagggtcggtaagacangagttgtgggagggaggacccgggtggtaggactcccagcttggggattagtctgggggggggtgtaataagattaggggtaacactccgtcttccagcacttcaactctgtagtctgttgtaaggctttggaagacccttgggaatccggcctttgatgtcttctggttgcttctcaggggcagctgcaggagtcttgggtccatggattgtcagagggcggctgtctggggtcgcctagtatgtatgttctgt

SEQ ID NO: 1020 - DNA, 413 bp, Mus musculus
  misc_feature (212)..(212): n is a, c, g, or t
  misc_feature (241)..(241): n is a, c, g, or t
  misc_feature (342)..(342): n is a, c, g, or t
ttctgagactcattctaccatgaagcttaccaccacctttctagtgctctgtgtggctctgctcagtgactctggtgttgctttcttcatggactcattggccaagcctgcggtagaacccgtggccgcccttgctccagctgcagaggctgtggcaggggctgtgcctagcctaccattaagccacttggccatcctgaggttcatcctgnccagcatgggcatcccattggatcctctnatagagggatccaggaagtgtgtcaccgagctgggccctgaggctgtaggagctgtgaagtcactgctgggggtcctgacaatgttcggttgaggggaacntgggaaaattctgcctgacgagatgcctgacgagatatttttctttaacaagagctggaaaccctgctgct

SEQ ID NO: 1021 - DNA, 357 bp, Mus musculus
tatcgtgtgagctttctggtcagttgttgatttttttttttaagccataagttgtatgtagctgtgttgtggttgctataaactgtacaagaaatctgcaacccatccattctgaggcttgttctcttcatgaaacactcactaaactatattaagaatatttctgttttataaacaagacatatcttttaaatttcacttcagtgtggaaggatggaagatagcctctcagaaagatatttttaaatagtttcaaaccatgaaagtagaattctgttaaaaacggtctgtgcttccctcttgtggtacaagaaggcattcgatctctcaatgctgtttccataattttcctcgaat

SEQ ID NO: 1022 - DNA, 421 bp, Mus musculus
  misc_feature (275)..(276): n is a, c, g, or t
  misc_feature (334)..(334): n is a, c, g, or t
  misc_feature (396)..(396): n is a, c, g, or t
gatgttaactgcatttgagctttgaaatagaagaaagtacctttccagtcctaccctgagacaagacactctgaaagtgtgctttacccgcaaagaaattatcaacgattcttttctcagaaatgaaatcttcctattttatatttacttcttggattcgttttactactgacatctttagagaatcattatctttgtcttatgaatataatcaaaatttatatttttcagaatgtttatttcttgagatttttcttctctgtattttaaagagnnagcagcttccgttctaaaatatgatttttatgaggcttttcagttcggtaagagtaangcaagtggattgtaataagaacaattatgaatacgtattcagacttaaatttaactattatntcagctatctcagtatgctatataa

SEQ ID NO: 1023 - DNA, 326 bp, Mus musculus
ggagatctcaatatacacagtgcaagttgcaagggcccttattgagaggagctttacacaatgatttgtccttgaaactctcagaataagatcaagttcaacggtttttccacagtgcattctgcatcatgcttccatggagaataatagaaataagtcatgaactttcctaaattgaatcccagagtagtactaagatggatgtcttgtctgctgtaccagctgggaagaaacaaaaaatgctcttcatctgtcagctttggctaagctctgaacatcttttgcttcctgtaaaaccaccatgcttgtttcttgctctcacaata

SEQ ID NO: 1024 - DNA, 544 bp, Mus musculus
  misc_feature (201)..(201): n is a, c, g, or t
  misc_feature (481)..(481): n is a, c, g, or t
ctctgggcttgacactcaacgtaaatatgcccgtagttggaagtcttttgcaattggctgtgaagctgaacattactgcagaagtcttagccgtgaaagacaatcaggggaggattcatctggttcttggtgactgcacccactcccctggcagcctgaaaatcagcttgctcaatggagtcactcctgttcaaagctttntagacaacctcacagggatattgactaaagtccttcctgagctgatccagggcaaggtatgtcctctggtcaatgggattctcagcggtttggatgtcaccctggtgcacaacattgctgaattactgatccatggactacagtttgtcatcaaagtttaggcatcccaggaaggaaggctatcttggctgagctgaatcatttcttgctgctcagtctcctgcctcttgcccagtctcccatggctcacagaaaggggcccacatcctggaaaattatntcttccttctcctcacggagcctgatctcttcccatcaggcacgattaatcctgtgatcctca

SEQ ID NO: 1025 - DNA, 483 bp, Mus musculus
aaagcgggcttccagacagtgctgctctgaggcagcagatggaggccttaaaaggaaaactacagcgtctagaggttgccttctcccactatcagaaagctgcattgttccctgatggccgaagtgttggagacaagatcttcaggacagcagactctgaaaagccttttgaggatgcccaggagatgtgcaaacaggctggaggacagctggcctccccacgttctgctactgagaatgctgccatacagcaactcatcacagcccacaacaaggctgctttcctgagtatgacagatgtgggcacagagggcaagttcacttaccccacaggagagcccctggtctattctaattgggctccaggggagcccaacaacaatggtggagcagagaactgtgtggagatcttcaccaatgggcaatggaatgataaggcttgtggagagcagcgccttgttatctgtgagttctgagccactg

SEQ ID NO: 1026 - DNA, 434 bp, Mus musculus
  misc_feature (124)..(124): n is a, c, g, or t
  misc_feature (371)..(371): n is a, c, g, or t
ggactgtgaccttgacctgtgccatctctgcccagccccctcctcaggtccactggataaaggatggtgcacccttgcccctggctcccagccctgtgctgctcctccctgaggtggggcacgnggatgagggcacctatagctgcgtggccacccaccctagccacggacctcaggaaagccctcctgtcagcatcagggtcacagaaaccggcgatgaggggccagctgaaggctctgtgggtgagtctgggctgggtacgctagccctggccttggggatcctgggaggcctgggagtagtagccctgctcgtcggggctatcctgtggcgaaaacgacaacccaggcgtgaggagaggaaggccccngaaagccaggaggatgaggaggaacgtgcagagctgaatcagtcagaggaagcggagatgcca

SEQ ID NO: 1027 - DNA, 535 bp, Mus musculus
ggaaccctatcagacagtgccgtggtttcaattccaatgcaaacaagaatgccgtagagtctgtgcagtacggagtggccggcagcgcagctttccttgagtgtcagccccgctcgcctcaagccactgtcaagtggctgttccagcgagatcccagtgatcggcgccgtgagattcgcgcagaggaccgcttcctgcgtacagagcaggggctgttgcttcgcgccctgcagcttggtgaccgcggcctctactcctgcacggccactgagaacaacttcaagcacatcgtcacgcgggtgcagctgcatgtactgggccgggacgccgtccatgctgccctcttccccccactggctgtgagcgtccctccacctcctggcacaggccctccaacgcctccttaccaggagctggcccagctcctagcccagccggaagtgggcctcatccatcagtactgccagggttactggcgccacgtgccccccagccccagggaggcgccaggagcacttaggcctcctgaactcca

SEQ ID NO: 1028 - DNA, 471 bp, Mus musculus
  misc_feature (42)..(42): n is a, c, g, or t
  misc_feature (383)..(383): n is a, c, g, or t
  misc_feature (424)..(424): n is a, c, g, or t
tcttgtcagggcatggaccgcatgcctttgctgatgcgcgtngtcatctgtgcctcggcatagacgtggacaccaggattgctgtggagtctggggtgggggctcagggcactcggaggagggagaaaggggccatcccaggagacaggcccctgcctgggacagaggtgcctagtcaaggccaacctttcccaggtattttttccctatttattggggacagaagagacgtctgtctgggtgaggcagaaccttctcttctcccttccttgcctgttgtcctggcaggtccagcccactctacctccttagcttttcctgtgccgcctcgactcatgggtggggctgggtgcgggcatggcttaaaagaacccccccccccngccctgaggatacacgggccgtggtggaggcccagggcctntctggcatccccaagtctcccttctgcctactgcctcaggtgacggg

SEQ ID NO: 1029 - DNA, 471 bp, Mus musculus
  misc_feature (386)..(386): n is a, c, g, or t
  misc_feature (392)..(392): n is a, c, g, or t
gagaacgccaagactgggttcccgccacagtgctatgcctcccagttccaggactacggtcctccaggagctcaaaaggtgtcaggcgtggccagtcgactgctggggccatcgttcgagccttacctgttgccggaactgaccagatatgactgtgaggtgaacgtgcccgtgcctggaagctccacactcctgcaggggagagaccttctcagagctctggaccaggccacctgagccagggcctctggccgggcatgcccctgcctgccccgccgtcttgacctgccagcttcacttccatctgtgttgctattaggtatctctaacaccagcacacttcttacgagatgtactcaacctggcctactggccaggtcaccaancagtgncctttatctgacatgctcactttattatccatgttttaaaaatacatagttgttgtacctgctatgttttaccgttgat

SEQ ID NO: 1030 - DNA, 278 bp, Mus musculus
tggctttactgctgtacctccaccatgccaagtggtcccaggctgcacccacgacagaaggagagcagaagtcccatgaagtgatcaagttcatggatgtctaccagcgaagctactgccgtccgattgagaccctggtggacatcatccaggagtaccccgacgagatagagtacatcttcaagccgtcctgtgtgccgctgatgcgctgtgcaggctgctgtaacgatgaagccctggagtgcgtgcccacgtcagagagcaacatcaccatgcag

SEQ ID NO: 1031 - DNA, 320 bp, Mus musculus
acggttctgtccattcttgatgagatggagaatgtgtttgtctgggagcacctgcagacagctgaagcccaaagtcgaggtgcctggttgggcatgaacttcaaccccaaaggaggcacgctggtctggcaagacaacacagctgtgaactattctaactgggggccccctggcctgggccctagcatgctaagccacaacagctgctactggatccagagcagcagcggactgtggcgccccggggcttgtaccaacatcaccatgggagttgtctgcaagctccctagagtggaagagaacagcttcttgccatcagc

SEQ ID NO: 1032 - DNA, 426 bp, Mus musculus
  misc_feature (67)..(67): n is a, c, g, or t
  misc_feature (366)..(366): n is a, c, g, or t
  misc_feature (368)..(368): n is a, c, g, or t
gggagggacaaagcccatctgcagatgggacgcgctgcctgtctaaggaggggccctccccggtggncccaaaccccacagcaggagtggacagcatggcgagagaggaggtgtacaggctgcaggctcgggttgatgtgctagaacagaaactgcagttggtgctggccccactgcacagcctggcctctcggtccacagagcatgggctacaagatcctggcagcctgctggcccattccttccagcagctggaccgaattgattcactgagtgagcaggtgtccttcttggaggaacatctggggtcctgctcctgcaaaaaagatctgtgataacctctcaccacccaggctggatagagcnantcatccctagatcccttgtagccagagttcaggcgctgtctggtggtgcctatgagca

SEQ ID NO: 1033 - DNA, 528 bp, Mus musculus
  misc_feature (277)..(277): n is a, c, g, or t
  misc_feature (409)..(409): n is a, c, g, or t
  misc_feature (483)..(483): n is a, c, g, or t
aagcctctatatctttcatttgggagacctgagaacaagagaatatttccctttccaattcgggagacctctagacactttgctgatttagctcacaacagtgataggaattttctacgggactccagtgaagtcagcttgacaggcagtgatgcctaaaagccactcatgaggcaaagagtttcaaggaagctctcctcctggagttttggcgttctcattcttatactctattcccgcgttagtctggtgtatggatctatgagctctcttttantattttattataaatgttttatttacttaacttcctagtgaatgttcacaggtgactgctcccccatccccatttcttgatattacatataatggcatcatatacccctttattgactgacaaactactcanattgcttaacattttgtgcttcaaagtcttatcccactccactatgggctgttacagagtgcatctcggtgtanagcaaggctccttgtcttcagtgccccagggtgaaatacttcttt

SEQ ID NO: 1034 - DNA, 413 bp, Mus musculus
tgggctttctgactgcattccaaagtcccggaaaacatcacaggcaccagctatgaagctggtatctatctttctgctggtgaccattggtatttgtggttattctgccactgcccttctcatcaaccgtctccctgttgttgacaaattacctgtacctttggacgacattattccctcatttgatcccttgaagatgcttctgaaaaccctgggcatttctgtagaacatctggtgacaggactgaagaagtgtgtggacgagctgggaccagaggcttccgaggccgtgaagaagcttctggaggctctttcacacctggtataaaatcttcataaagagatttaaggaaggagtatgaaaagaaggatttgctcactctggctggctggatctctcattctatcatttg

SEQ ID NO: 1035 - DNA, 564 bp, Mus musculus
attggactacaatctagccccgggactcctaggacggggcagcatgcctgggaagtatcctcacagtgacaagagcttaggagagaaggtgccacttcggttacacagtgagaagccagagtgtcgaatatcagccatttgctctcccagggactctatgtaccaatcagtgtgtttgatatcagaagagaggaacgagtgtgtgattgccacagaggtataaggcaggagcctactcagacacccagctccggcccagcagctgggccttccttctgcattgtttacattgcatcctgtatgggacatctttagtatgcacagtgctgctctgcggaggaggagggaatggcatgaactgaacagactgtgaacccgccaagagttgcaccggctctgcacacctccaggagtctgcctggcttcagatgggcagccccgccaagggaacagagttgaggagttagaggagcatcagttgagctgatatctaaggtgcctctcgaacttggacttgctctgccaacagtggtcatcatggagctcttgactgttctccagaga

SEQ ID NO: 1036 - DNA, 361 bp, Mus musculus
aagcattccaggttcactccagtagggagagttcagctatgccatctctctggacatcttcttcgccggcctttctccttgggaagagtttggctcattcctttacttcctggagtcatggctcagatctcaccttgttggtgaggaaggaggcactgtgcccaccctgctcaatgccctgtctatacactgatgctcatgtgcttctgcacacacaatattttcactctgtacagggatttctcctgtcgtgctccctgcagactgcctcgagcccacccacgcaggtgagctgcagagtaaggctctcggtgaacagctccctgctctcctcagactcctaccacagaagcttgtgtgt

SEQ ID NO: 1037 - DNA, 129 bp, Mus musculus
ggaaatcagtactcctattgcatgtctccaaatctccagggctccaaggcatgttcttcttccctgtgaatggcactggagaaatcaatcaactgtctttcttgacatgtgaaaagagacttctggagt

SEQ ID NO: 1038 - DNA, 456 bp, Mus musculus
cagggtttccagcttacctggatgaggagcttcagactgcatcctacgagatcaaacatcagattctgcaaacaatgggagtcctcagcttgcaaggatccatgctgtcagtgggggataaagtcttttccaccaatgggcagtcagtcaactttgataccattagagagatgtgtaccagagccggtggccacattgctgccccgaggaatcctgaggagaacgaggccatcgcaagcattacaaagaagtacaacacctatccctacttaggtgtgattgaaggccagactcctggagacttccactacctggatggggcttctgtgaactacaccaactggtacccaggagagcccaggggtcggggcaaagagaaatgtgtagaaatgtatacagatgggaaatggaatgataagggctgcctgcagtaccggctggccatttgtgaatttt

SEQ ID NO: 1039 - DNA, 529 bp, Mus musculus
  misc_feature (219)..(219): n is a, c, g, or t
  misc_feature (227)..(227): n is a, c, g, or t
  misc_feature (240)..(240): n is a, c, g, or t
  misc_feature (319)..(319): n is a, c, g, or t
  misc_feature (411)..(411): n is a, c, g, or t
  misc_feature (421)..(421): n is a, c, g, or t
  misc_feature (425)..(425): n is a, c, g, or t
  misc_feature (434)..(434): n is a, c, g, or t
  misc_feature (439)..(439): n is a, c, g, or t
  misc_feature (462)..(462): n is a, c, g, or t
  misc_feature (465)..(465): n is a, c, g, or t
  misc_feature (467)..(467): n is a, c, g, or t
  misc_feature (471)..(471): n is a, c, g, or t
  misc_feature (503)..(503): n is a, c, g, or t
ggtgccttctgtctactgttgtagttacgtgttttgtgttgactctcggtggtgtgagaatgtactaatctctgtcaagacaaactgtagcatttccaccccatcctcctccctccctcacagaattctttactagaacccaaagtagacagaccgtactttgtggcagagccatgaagcatctgccgtagccgtcatttaagccacagaacagcagantttgattntacatctcgtggncagcctggctggacatgcgtgttaacatcaggaacactggctccaacatcggctctgtaacccctaactctgctctttnccttttccctacctaagcattccatggctcagggctagagtctaaagccgaaacccagagagggaagggccctgcctgtaagaatgggtttntcaaggtgancatnctgtgtgtnaaccnaaaccaccatttcctcctgtagnaantnaganctcagactgaatcttagaatattttttaaatntccttttcacaatcatgtaccgggaa

SEQ ID NO: 1040 - DNA, 538 bp, Mus musculus
  misc_feature (97)..(97): n is a, c, g, or t
cagccagagtgagtcggtctccggagaaggctctccaagtcctgaggaggaggaagaaggcagtggggaaggggcttccagtcgccggggtagggtnagggtccgcctgcctcgggtaggcttggcttccccttctaaagtctctaagggacaggagggtgatgcaacctccaagtccccagttggggagaagtcacccaaattccgttttcctagggtgtccttaagccccaaggcccggagtgggagtagggaccgggaagaaggtggattcagggtccgactgcccagtgtgggattttcagaaacagcagttccaggttccaccaggattgagggaacccaggctgctgccatctgaagccccaggacagctgtggattccccctcttgtctttccattccccagcctagccccccattttgtgtgtgacattactagcactaatcctcagagggcttgaaggtgggtaactgactcaggcaggagccagtggcctgtgccacctcattggccaaagtgcctgtatatcatgtc

SEQ ID NO: 1041 - DNA, 514 bp, Mus musculus
ggaatcgtgggatctgcttactgtgtcattgtggcatcactgggtttggcagaaggaccaaagtgcagcgatgcccatggagtatggaactacacctttgccagcactgagggacagtaccttctgaattcctctatgtggtccaagtgctatgagcccaagcatattgtggagtggcatgtgactctattttctatcctcttggcttttgccgcagttgaattcatcttgtgtctcattcaagtaataaatggaatgcttggaggcttatgtggctattgctgctctcgccaacagcaatataactgctaaaaaagaacacaagacagaagggcgtgcttcctgtatttcactgtaatttgtatattttccctgtgttgtgagactttgcaccttgtgccacatcctaccctttctgcttttgtaaggaaatgtgctgacgtcatcacatgatgtcagtgtttacattcacaaaacaaacaaggcagcaaactgcactctctccgaagggatt

SEQ ID NO: 1042 - DNA, 442 bp, Mus musculus
gaaagctgagacattgtccccaactcttcttgatgtatttattaatttagagttttaccagctatttattgagtaccctgtatatagtagatcagtgaggaggtgaatgtataagttatggcctggaccctgctgcagatgctgtgagagtctggggaaagatcacatgggtcgagggtttctctactggtcaggatgcttttctcatataagggtcgacttttttcaccagtcacataaacactatgtggactggcagtggttctctgcttcctccacatcctggagcgtcccagcacctccccacctacttttgttcccaatgtcagccaccatgccttagcagctgaacaatcgagcctcatgctcatgaaatcatggtcccaggcggctccacctcaaagagaaagcctggaaggaaatgttccaactccttagaagg

SEQ ID NO: 1043 - DNA, 519 bp, Mus musculus
  misc_feature (83)..(83): n is a, c, g, or t
  misc_feature (290)..(290): n is a, c, g, or t
  misc_feature (302)..(306): n is a, c, g, or t
  misc_feature (418)..(418): n is a, c, g, or t
gaactacctgataagtcggccagagagccaccaagtcaatcctcaacaaaaataccatcttccctacttaaaagttttttttnaaagtcgtgatattttatagttagaggagagagagagagagacaaactattcccatgactaagatacaaacctacaagtaagggttattcagtcatgcctgtgcctgatttctggaccagggccctggttttcatggacagtccagaggaaagtcgggggtttccactgatttccaagctatcagcagcacactaaacccaggagtntaagaaccaacnnnnnagtcaagagtaagaggatgttgatctcagctgtgagctcattagcaggttttactcatgcatctgttaaagctaccaccacatccttttgcaagtctgtttattaccgcttnatccaaatacatactgtgggcaagatgcacacagtgctatgaatacagtactttaagaatctccattcaacatatcagaatatgtccagccacatctatgt

SEQ ID NO: 1044 - DNA, 187 bp, Mus musculus
gagggatgaggcccctcccgcatcaccacctgcctccagtggcctggagcctgattgtgtgttgcgccttctacctttccctgtctctctatgtctgcaggcctgaggtccaagagacttgtgatgttatttgttttctgtaaagtctgtctcagggcccagctgggcatttgcagggaagctgtat

SEQ ID NO: 1045 - DNA, 547 bp, Mus musculus
  misc_feature (41)..(41): n is a, c, g, or t
  misc_feature (374)..(374): n is a, c, g, or t
  misc_feature (419)..(419): n is a, c, g, or t
gggcggactgaatgcatgctgttctttgctttgagcggganccttggttgatgccttcccagaatgcacttggctctcttcgcttccactggagacccgaccacgtgcctttacccatagtggaacacagtgccttgtggcatgcaataggtgcttaataaatactcattgaatgtatgcacgcataaatggatgaacaagtaacgactagggatgtttgaggtgctaagggttttttttactctagttcacgggtattctaaggtcaacagctagtctgtgccaattagtaatgttgtctgttttgctttgtgaactattctcgtttccacctgttccagctgtgtgagcttcatgattgtgtgacaactctntcctggacagatagcacagaaattgttacatgggctaaacctgtnttggcaaaccgaggaggcccccaaatcacactctgcagattccatgcgacttctagttttatccctgttttggtgttatttttaatttctacaaatatgtatttccttggactttgtacccgagaaag

SEQ ID NO: 1046 - DNA, 466 bp, Mus musculus
ttcagcgaggagatccatccattatttccgtcaatggtactgactttaccttccggagtgcgggtgccctcctcctcattgtggatgcctgcagtgtgcccttccgggtgaaggaaaagcggatgttcctttctgcagacgtcagtcacatggaagaatatttcaaggctagcatccccccaaggtcaatcgttctgttgagcacaagaggagaaattaagcagctgaatatctcggattcattagcagttctgggactggccaagccagcacatctgtacagcaaaggtagtgtcgtatttttgggattcagcggaaacttcgcaccgtcatggacgaagctgttcaccagtcccgatgagcagggcctcggagtgcttgagcagtttctcccgttgcagatggaggaatatgggtgctcccggaccggcagtgtccacagaagagaccttgacctgttacagca

SEQ ID NO: 1047 - DNA, 455 bp, Mus musculus
  misc_feature (34)..(34): n is a, c, g, or t
  misc_feature (47)..(47): n is a, c, g, or t
  misc_feature (263)..(264): n is a, c, g, or t
  misc_feature (269)..(269): n is a, c, g, or t
  misc_feature (274)..(275): n is a, c, g, or t
agaaaagttcatcttcctccgtggagggccgagnctgatgcctgtangttgtgtccaggagacattctaggacagctctgtgacttgtgtaactttacagaacatgctacctcaaagtgctgtgacaaaccatttggactgtagtgctcacaggatgggcacgtgtcttaatcaaagtttggttacttgtttatccgggttttttggatgtggggttttttgtttgtatttttttttctttttctttcattcttttttttttnnttttnttttnntacagtgagatcttacctattaaatatatttagtgggtcatggttcctgaaggtgagtgaattgattgtgtgtgcagatgtgtgtgtgttatgacttaaatatatttgttttgtgctgttttagagttccttttttatatatatttggagaaagtatgcaagtttcaaggcactcagtgt

SEQ ID NO: 1048 - DNA, 526 bp, Mus musculus
agcggatggttttattggtcactacaaattcaggccgaaaaagtttcccacaaccaccaccacgcccgtcaccaccacactccccgtaactacaggtctaaagcccactgtggccctgtgtcagcagaagtgtagacggatggggactctggagagcaattactgttcaagcaacttcgtgttagccggcacagttatcacgaccgtcactcgaggtgggagcttgcacgccacagtctcgatcatcagcatctacagggaaggcaacctggccattcagcaggctggcaagaacatgagtgtcaagctcactgtggtgtgcaggcagtgcccccttctcagacgaggtctcaattacattattatgggacaagtgggtgaagatgggcgtggcaaaatcatgccaaacagctttgtcaaaatgttcaagaataagaatcagaagcccatgaacgcactgaagaacaagcagtgttagcctgagctctgtcacataacctgaacttactcatcaccgctgaacgat

SEQ ID NO: 1049 - DNA, 494 bp, Mus musculus
  misc_feature (99)..(100): n is a, c, g, or t
  misc_feature (159)..(159): n is a, c, g, or t
gtgggcactggatttggatgatttccagggcacctgtcagccgaaggaattcttcccgctcaccaacgccatcaaggatgccctggcttagctcccccnntttcccatatggtacccccactctctggccaggagtttaatctcttgcaatgttaagtnccccaactgagcctcagtttctccttcccttggcacctgtgtaaggggccacagcaggctcagctatggagaacagggaactagggtaggacgatggtggggttgtgagagtcacagtgtgagcagatacacaaccctgttaaggaatgcaaattctcagactctaacctccctttacccagcctgaccaaaggacaccacttggatcaagtaggcaaatatcttacaggattgagggaccatactaattataccctctgcaaagcccaacttgaatccttcccttaggaacttaatcgtcccacttccctttccctaattccacagctgttcaa

SEQ ID NO: 1050 - DNA, 464 bp, Mus musculus
gctgacctctggagagtgtgcaccaacagcacaaactgtaccgagatcaatgagctgaccggccctgaagcgtttgaaggttattctgtgatgcaggcggtgcaggccaccatgatcctctccaccatcctctcctgcatctccttcctcatctttctgctccagctcttccgcctcaagcagggagagaggttcgtcctgacgtccatcatccagctcatgtcctgtctgtgtgtcatgatcggagcttccatctatacagaccggcgccaagaccttcaccaacagaacagaaaactctattacctactgcaagaaggcagctacggctactctttcatcctggcctgggtggcctttgccttcactttcatcagcggcctcatgtacatgatcctgaggaagcgtaaataagtgtcagaagtctgaccaccctcccacagggtggcatccatggtcacata

SEQ ID NO: 1051 - DNA, 402 bp, Mus musculus
  misc_feature (149)..(149): n is a, c, g, or t
  misc_feature (156)..(156): n is a, c, g, or t
  misc_feature (334)..(334): n is a, c, g, or t
  misc_feature (358)..(358): n is a, c, g, or t
  misc_feature (374)..(374): n is a, c, g, or t
acatgggaaggtctctccttttcttcccgcccttttttctaatgtggatgcttccattaatcctctgtttctggagccttggaagatctgtcttccattcattcatccacccatccatcattcaacatgaatgggtcatgtcacgtgtngggtgcnaagggatactctttcaaaacaatccctcacgagactcacagtctagtgaagagcacacgccagaaaccaattagagaagctaccaaccacgatggaacatcagggattcaaaacctcggggtgagagggagcctactttctctgtgttcttctaagagccctgatggctctcgattgntctgaacagaggtccacttggtcnagtgctatcatgggtnagtgcccacgaggtttccccagagaata

SEQ ID NO: 1052 - DNA, 508 bp, Mus musculus
gactatattcaggtcatgacatatgatctccatgatcctaagaatggctacactggagaaaatagtcccctctataaatctccatatgacattggaaagagtgctgatctcaatgtggattcaattattacctactggaaggaccatggagcagcttctgagaagctcattgtgggatttccagcatatggtcatacctttatcctgagtgacccttctaagaatggaataggtgaccctactgttagtgctggaccaccaggaaagtacacaaatgaacaaggactcctggcttactttgagatttgtacatttctgaatgaaggagccactgagatctttgatgccacccaggaagtaccctatgcctatctgggtaatgagtgggttggttatgacaatgtcaggagcttcaagttgaaggctcagtggctcaaggacaacaatttaggaggtgccgtggtctggcccctggacatggatgacttcagtggttctttctgtcacc

SEQ ID NO: 1053 - DNA, 436 bp, Mus musculus
  misc_feature (376)..(376): n is a, c, g, or t
tcagtatactgtcccctcggagtgtcaggcgggaggcgtcttcttcctcctctccatccttagtcagacgcgcacggaccatgtcggcgcagaccgcgagcggccccacggaggaccaggtggagatcctggagtacaacttcaacaaggtcaacaagcacccggaccccaccacgctgtgcctcatcgcagccgaggcgggtctcacggaggagcagacgcagaaatggtttaagcagcgcctggcagagtggcggcggtcagaaggcttgccttcggaatgcagatctgttacggactagggagccaggcccttgagcttgctcttggaactccatctcttcttccttccctcggcttacccaggctgttttgnatgtttcagtgcagtgttgaatgtctcattgttttgctgtcctgctatttaacacaatgt

SEQ ID NO: 1054 - DNA, 248 bp, Mus musculus
aggtggccccagtactgttgagaatgactctatctttgagcctctgagagacctgctggaaatcagtactcctattgcatgtctccaaatctccagggctccaaggcatgttcttcttccctgtgaatggcactggagaaatcaatcaactgtctttcttgacatgtgaaaagagacttctggagtccacatctcatgttgagtcacttcccttttcctcccaatagcccaagtccgcacttatcagc

SEQ ID NO: 1055 - DNA, 229 bp, Mus musculus
ggaaatcagtactcctattgcatgtctccaaatctccagggctccaaggcatgttcttcttccctgtgaatggcactggagaaatcaatcaactgtctttcttgacatgtgaaaagagacttctggagtccacatctcatgttgagtcacttcccttttcctcccaatagcccaagtccgcacttatcagctctccatgatctgggatctgtgctaatggactctgtat

SEQ ID NO: 1056 - DNA, 585 bp, Mus musculus
  misc_feature (520)..(520): n is a, c, g, or t
acgcaagtcagatgcagggacctatttttgccagacagtagaacacaattttgtccatactgtgcgtaaaatcaccttggaggtggtcgaagagcataaagtggagggcatgtttcataaggaccatgaagaggaaagacatcacaagatgccctgccctcccttaagcggtatgtctcaggggacaaaaccgtggtacaaggaattcttgcagctgattggctacagcaacttccagagagtggaagaatactgcgaaaaggtgtggtgtacagataagaagaggaaaaagcttaaaatgtctccctccaagtggaagtatgccaacccccaggaaaagaggcttcgctctaaagctgagcacttccgcctgcccaggcacacgctgctctcctgagggcgccctctgccggcggctgaggaacctaggatggaaacatttttttaaagggggggaaaaaaaaaagactgaaagcatgcagtctctttccattacttcaaagaactttctgtagtactnagaggctgggaaggtgttttaagttattctgcatattcatctgactgtacaaacatctctctcac

SEQ ID NO: 1057 - DNA, 584 bp, Mus musculus
  misc_feature (125)..(125): n is a, c, g, or t
taacatgtggacgtcggtgtcgccatacaccagctacagcgttcagaccatggagactgtgccttaccagcccttccccgcacactttactgccaccacagtgatgcctcggctgcccaccatcnccgcccagagcgcccagccaccaggaaatgcccactttagtgtgtacaatcagctatcccagtctcaggtccgagagcgggggccctctgcttccttccctagagagcgtggcctccctgggatgtgtgagaggaagccaccctcacctcacctgaacactgccaacgagttcctctactcacagagcttctccttgacccgggagtcatccttacagtatcattcagggatggggactgtggagaactggaccgatggatgacgagactacctgtatccttaacagccccagggccatgtcaatccagtgttaatctctgtgggtggccagcactgccaagaaacatggaaaggtatttcagaatgtgtgtgtgtgtgtgtgtgtgtgtgtgtggtgtgtgcgcgtgcttgaacttctacacacatgtggtcagagagcatctgtcttctgacatgca

SEQ ID NO: 1058 - DNA, 88 bp, Mus musculus
acggtttgttcagtcgatgcttagacttgtttttcaaagagacccccaagaaacatgaggcagagagagcctgtctggtgcattgcct

SEQ ID NO: 1059 - DNA, 352 bp, Mus musculus
  misc_feature (43)..(43): n is a, c, g, or t
  misc_feature (197)..(197): n is a, c, g, or t
  misc_feature (202)..(202): n is a, c, g, or t
  misc_feature (250)..(250): n is a, c, g, or t
ttccatgactcactttctcaccaggagccttccaagttccacnagctggtaatgctttttgaacagctccaagtgactttgccatttagctcaacagacacagatttggggcttctgaagtagaagtaaagagcacctaagatgtccttaggtccattttttttaatgattcatttccttcttggtcatgtaactgnacagnctgattcagaagaaaggggaacgtaatcgagaatttcactcccaggtnccaataagacattgcactacactgatggaggaagttatccaaagtactgtataacatcttgtttattatttaatgttctctcaagtgagaattgtttgtggt

SEQ ID NO: 1060 - DNA, 462 bp, Mus musculus
ggaagctaatcccaattcctctggaccccatcccccacaacctttcccaccagccttcctaacagcccaggtgaggtggctcctgtcttgcagacccatgaacttgccagggaggagcctaggaaacagaggggaaggaagcaggtaggctgcctcctttatgtgtggatacactatagatggctcatcctgtcccatgtgacctctctgtggctgggtgtcttggaggaaggctctggatgcccttccctgctacagggtgagggccctggaagggcgtgcctcactgagcatgctgaagcggccagtatataagtggacagcctgggttccctgacggagccacgtaggctctgcccacaggaaagagcattaatccgtgaccacacagtgggttcactgctactgcccacctcctcatcccggaacacatcccctcagcctcagccatcctttggaagg

SEQ ID NO: 1061 - DNA, 517 bp, Mus musculus
  misc_feature (262)..(262): n is a, c, g, or t
ccgagtggaccatcagggagtttaagatatgcagtgaagaacagttggatgcacacagactcatccgtcactttcactacacggtgtggccagaccatggggtcccagagaccacccagtccctgatccaatttgtgaggacagtcagggactacatcaacagaagccccggggctgggcccaccgtagtgcactgcagcgctggtgtgggcagaacagggacgttcgttgccctggaccggatcctccagcagttggactntaaggactccgtggacatttatggggcagtgcatgacctaagactccacagggttcacatggtccagaccgagtgtcaatatgtgtatctgcatcagtgtgtaagagacgtcctcagagcaaagaaactgcggaacgagcaagagaaccccctgtttccgatttatgagaatgtgaatccagagtatcacagagatgcaatctactcgagacattaagaattcacctgaagatcccctggataaaagcgtttcac

SEQ ID NO: 1062 - DNA, 309 bp, Mus musculus
  misc_feature (73)..(73): n is a, c, g, or t
  misc_feature (179)..(179): n is a, c, g, or t
gttagctagatttcatcactactcagtttacttcctcttaagataactactctgtgcagatagcatatttaanttgggcttcttcaggtgttagatggtgttacacatggtttggcattagggctctgttgtgcttaattttctgctgcctcgagtgacttttcttcatgttctctggnaaactcatgtctgcataattcaactttacaaaatcttatatttatagtttcttttatatgtgtaaaaaactatttccagtgacttctgtaaagcattcatttcaaggtactcactatgctgatgatgttg

SEQ ID NO: 1063 - DNA, 504 bp, Mus musculus
  misc_feature (97)..(97): n is a, c, g, or t
  misc_feature (277)..(277): n is a, c, g, or t
  misc_feature (292)..(292): n is a, c, g, or t
  misc_feature (300)..(300): n is a, c, g, or t
  misc_feature (310)..(310): n is a, c, g, or t
  misc_feature (338)..(338): n is a, c, g, or t
  misc_feature (340)..(340): n is a, c, g, or t
  misc_feature (365)..(365): n is a, c, g, or t
  misc_feature (391)..(391): n is a, c, g, or t
  misc_feature (423)..(423): n is a, c, g, or t
atcgatgagtgcaactgtgccccggcctgcagctccctgcctgggacttccatgattgcttcctagagcccattgctagaaggcaattgcatccctnaccccttatgtccctccacctggggcagaacctgcacaactgaccatgagaaccttaggcaggcaagctccccgaggcccacaagaaccctctgtggccctcactgcctctgctccaccctccgcctgccactgttaagaccagcatcaaagagggtggtggggcaatcaagatccactngaggagggttccagntgaggatntggccctgangagcctgttggctgttttggcctcattntntgtgagagcctgtggctgttaaggntccccacagcaagcctgtgtgtcctntgtcacataaaacaagccctgtgtcaggcatntcatgctcacaaaagcagatgggactgtccaagcaagatcagctaccagggatctgtatcaggcaaggtggctgcctgctg

SEQ ID NO: 1064 - DNA, 448 bp, Mus musculus
gaagtttacttatgtttcatgcacaccttagacacttagcctggcggtaatttcagacgaaaatttaaaaataattttccacatgagataaagtctcacagtgtgacatttgcccctggggacagcatgctgacaagcagtttcaggcttggtaaaagtttagttttcagatttttgggttaaagctatgaggagctatgtacggcatgacattccataactgatattactcaacacattctcatgtatagcggagtgtgggctgaagctaatatttttttccagcttttatatccttagcttttctacttccaaactaatttttttgttgctgagaataatccattcattttctctaatacagcaactacttcaacctttaatttattattaatgtatttgaaagtgtattattacctctatgtaccaacatatacactttgtgtgc

SEQ ID NO: 1065 - DNA, 497 bp, Mus musculus
  misc_feature (119)..(119): n is a, c, g, or t
  misc_feature (183)..(183): n is a, c, g, or t
  misc_feature (347)..(347): n is a, c, g, or t
tggccagccccatagttcaaaatcttcccacagggaaatacaccacctggccgtgctctttggaaccaggcacatgtaaaataaggaaaggaaaacaacagaaggtcatggagagcctnggtgacttgagacttaatctctggaaagccaaaataaacagagcatgagatgggagctggggcnacagatagcagccttgttggctgagactgtaaatacaggctggggctgagaagcctctcggttaattgatctgcagcacgtagacagactttcttttctttttactgttgctggtgttctctagagacaaatacacgtttataagaaacctaaaagcaggagancccaggagctgactcagtggtaaagcacttgcccggcatgtacaaacaaggcttccagtccaatccccagaatccactgaccccacacacacaaagaaacaaacacaagtatgcatttccattttttacttgaattacaggacccatggc

SEQ ID NO: 1066 - DNA, 445 bp, Mus musculus
  misc_feature (217)..(217): n is a, c, g, or t
  misc_feature (244)..(244): n is a, c, g, or t
  misc_feature (247)..(247): n is a, c, g, or t
  misc_feature (250)..(250): n is a, c, g, or t
  misc_feature (271)..(271): n is a, c, g, or t
  misc_feature (273)..(273): n is a, c, g, or t
  misc_feature (285)..(285): n is a, c, g, or t
  misc_feature (300)..(300): n is a, c, g, or t
  misc_feature (307)..(307): n is a, c, g, or t
  misc_feature (378)..(378): n is a, c, g, or t
  misc_feature (388)..(388): n is a, c, g, or t
gacacactgcagatcgaggagtttctggaggagacgttggggccacctgacttccctagcctggcacccaggtacagggagtccaacacagcgggcaatgacatcttccacaagttctctgccttcatcaagaacccagtgcctacacaggacaatgccctgtatcagcagctgctccgggccctgaccaggctggacagctacctgcgtgcaccantggaccacgaactggcacaggagccanatnttngtgagtcccaccgccgctttntngatggtgaccanttcacgttggctgantgcagtntactacccaagctgcacattgtggataccgtgtgtgcacacttccgccagctgcccatccccgcggaactntcctgcgttngtcgctacttggacagtgcgttgcagaagaaggagttcaagtatacgtgtccacaca

SEQ ID NO: 1067 - DNA, 560 bp, Mus musculus
  misc_feature (55)..(55): n is a, c, g, or t
  misc_feature (91)..(91): n is a, c, g, or t
  misc_feature (252)..(252): n is a, c, g, or t
acatttccatcttttcttgggcataaggaagcccaggaacagccagatggaaaantgctacttacacttgcaagaatgttaactgccaagntgacctttctatctgtgtgatgaggactcaatgtataagctgttgagggtttgctgagatcaaatgagcaagaaaaaggcacatattctcagttttatagatcaacagcctaaagctttaaaagttcacattgccccatttcctcttgggtctaatttttnatgacattacttttaattgtaactacattgcttttgaaaatatttttattgagctattgctggtttgggggaaagaatgatttttaaaaattgatcttatactcaaccatctttttggattcatatttttcctttaatactttcaatgattcatatatcattgcatttgtaaatgatgattttttttcctgctcacatatatttatacatatatacatatgtgtcataggagaatttctaatacttcaccagtggaaattcattgtcaaatctttcttgaatagatgcctgaagggttctgaattcat

SEQ ID NO: 1068 - DNA, 361 bp, Mus musculus
cagccagagcccatgtgtggaggaagtcagttctctctgctgcttgctcatttggtagcccaaccttgggtcagaggggacagaaaccaaacactaaaaagccctgtctacagtctctgggacacagctacccctataaagttctgggttctaatcctgtacatgactcttgtgggcaatgagcctgtggacagctccaaagtcagccaccctccctcatctgtaagatgggcgtccaacttgaatgcattgtcaccaaggaggcttgcgatgcagtgccttggtgtgtgacacacagtgtgccagtctttcatgacatgagaggactaatcctaggccatactgtgttaaactccaaccc

SEQ ID NO: 1069 - DNA, 336 bp, Mus musculus
  misc_feature (139)..(139): n is a, c, g, or t
  misc_feature (294)..(294): n is a, c, g, or t
  misc_feature (303)..(303): n is a, c, g, or t
aacagaacaccattatattttccacctattcataacatggaggttgggactcctaggagagccgtctgtggttccacaaacatcatcatgtttttggggagtgactgtggttgtggttacagagcaagaagtcaagaanccttccaggcagtgatggctacttcaggtataactaccattagagaggatgtggaatttcttttatctttggggaagttttgaaaagatagtcaaggaattaggaatttaaaattacagggaaaaatatgtatgtgaaaagcaataaatattttnttctctttngctatcaagatgttcacactcagatatttatta

SEQ ID NO: 1070 - DNA, 479 bp, Mus musculus
  misc_feature (278)..(278): n is a, c, g, or t
  misc_feature (373)..(373): n is a, c, g, or t
aacagacagaccaccttagaaccagaggcctgaaagcctgacctgaccagcacagattcccacttcagaaccccagggctatggaagtgcccttgtccaacgctatgggaatagtcctgtgggttgtctctgcttgccactgtggccagcattccagtgcctacagccacctgtgcctacagccacctgtgccatgagaagtgcctctcctgctctatgccctgcatttgggatgctaagaagaggtgagggtgtgagcgagaacagatccacccttntcctaggtaggatcagctctcaattggtgcttatcactagttatcaaagaacagcagagacagctgcgttatccaagaagcaagtattaggaccnaaacctgttactgtatttaaaggaactttagtttgcgtatcttacatttttataaagtactgtaattcagggggtggggtatgcaacagagacagactaacccatg

SEQ ID NO: 1071 - DNA, 528 bp, Mus musculus
  misc_feature (318)..(318): n is a, c, g, or t
  misc_feature (474)..(474): n is a, c, g, or t
cttttgcctagttgccacatctcagggaatgaacctcacccccagggcacaccttgcagaatgcaagacccctgccctttccaggggcagtgtggcctctctgcatctctcccttggagagagttgagtaactttccactgagtgacagctggaggaaggggcatacagacacaaagaggcccaagcgaggcggaaatgtgccttcaactcaccctccttgtggaatcctcccccaacaaggcctttctgcaggggactatcgatagctctgacatttgtctaatcaataattagtttctcttatttttttttttttnactaatgatacttattataagactctagttctcacagacatagaataaggtttgctgtgtgataagcagtttgctatttaggttaacaatttttttttaattcgggtttcttagttagaggaacaattcctgtaagtttttatttcctttctgtantcattgctgtaaggataatgactatctattagtcaccctggtgcatgagatgta

SEQ ID NO: 1072 - DNA, 443 bp, Mus musculus
  misc_feature (287)..(287): n is a, c, g, or t
  misc_feature (302)..(302): n is a, c, g, or t
  misc_feature (311)..(311): n is a, c, g, or t
  misc_feature (324)..(324): n is a, c, g, or t
  misc_feature (327)..(327): n is a, c, g, or t
  misc_feature (330)..(330): n is a, c, g, or t
  misc_feature (342)..(342): n is a, c, g, or t
  misc_feature (387)..(387): n is a, c, g, or t
tggcaacttcggcagactagatcttgtcgtttcccaatgcagcataaaagactatgatctatttctcttcaaataatctttgagatcccagggagaaaaaaaaaaatgctctgttgtgtggagctataatgtaaatgtgtttgtttaaaaaccagacgaggcaagggagtgatttattggtcctacgggaccgtagctgattctctcctctcagactctaaacacttctttcccaaggacagaaatgggtgactctgcttctcactagcaaactgtcatggcatttntcccactttctgtgnagcgtcatnaacatgatacatnttntantcaccagtaccnggcgtaagatccggtgagctgaaatgatccacctttcgatgtgancccatccaaagagatgatcctgttctggatgggtgactttctgtatcagttacact

SEQ ID NO: 1073 - DNA, 531 bp, Mus musculus
  misc_feature (422)..(422): n is a, c, g, or t
  misc_feature (434)..(434): n is a, c, g, or t
ggtgccccgtgtgataagtttcagccagacacgaaaggaatgcagcggttaaagcatagcgacttagcttccaggccgatttccttaagactggggaacgaagaactatttattctgccttaaagggatggcaactgggtggagatgacgtcaggcgaatgtagactatgggtacactcctagtgggctaatgtagcatagagagaaagcaggtaggtgtttctctgttatgtaagcaataactttttctgtgtcttatggagtatgactagcaattatttatttccatgctagacggttctttgcatgtgggttccttataggtgcagacatctcggccaatggaggtccactggccactttgtcatttggacgagctgttactggattgaaattcacataccatttcactaaaaattgtnccttagaaaacncaaagctgttgcacacagtgacgaacggcagattcggaacaccaaagggagacgaagtcactccctagttcccacggcttctctcggaggtgtttgc

SEQ ID NO: 1074 - DNA, 493 bp, Mus musculus
  misc_feature (307)..(307): n is a, c, g, or t
  misc_feature (309)..(309): n is a, c, g, or t
  misc_feature (311)..(311): n is a, c, g, or t
  misc_feature (315)..(315): n is a, c, g, or t
  misc_feature (319)..(319): n is a, c, g, or t
  misc_feature (352)..(352): n is a, c, g, or t
  misc_feature (421)..(421): n is a, c, g, or t
  misc_feature (433)..(433): n is a, c, g, or t
gaacattgcatgctaggcagctaatgtttgtaatcaaaggagtactttataccagtggttggaagaggcaccattcccagctggggtaagactgccagctcttcactgatccaaaccctttccaacacaaaactgttcatcttcctctgcaccaatcctgggagaactaacggcatccacatttcaatctcactgatctgtagtagcactctctccagatgattaaactgtagcatcgttacggactcactctctccagattaaactgtagcatcgttacggactcactctctccagattaaactgnancntcgntacngactcactctctccagattaaactgtagcatcnttacggactcggagagaagcgtgcttccagtaaccaaatgagctggagaaccagttagcttttaaaagnctgatcattctntctcagttttaccttaaataccgtttatattttgtgtacacgtgaacactttcactggtg

SEQ ID NO: 1075 - DNA, 542 bp, Mus musculus
  misc_feature (32)..(41): n is a, c, g, or t
  misc_feature (44)..(51): n is a, c, g, or t
  misc_feature (55)..(55): n is a, c, g, or t
  misc_feature (57)..(61): n is a, c, g, or t
  misc_feature (64)..(69): n is a, c, g, or t
  misc_feature (279)..(279): n is a, c, g, or t
  misc_feature (335)..(335): n is a, c, g, or t
  misc_feature (339)..(339): n is a, c, g, or t
  misc_feature (370)..(370): n is a, c, g, or t
  misc_feature (374)..(374): n is a, c, g, or t
  misc_feature (376)..(376): n is a, c, g, or t
  misc_feature (396)..(396): n is a, c, g, or t
  misc_feature (399)..(399): n is a, c, g, or t
  misc_feature (402)..(402): n is a, c, g, or t
  misc_feature (408)..(408): n is a, c, g, or t
  misc_feature (431)..(431): n is a, c, g, or t
  misc_feature (478)..(478): n is a, c, g, or t
cttcgcttctggctagacaggcaaaagtgtgnnnnnnnnnnggnnnnnnnnatgncnnnnntgnnnnnnctggtgcctaggagccaggatgcccacatcacctgccaggcccttggcgtatgtgaggccccggctagccctctgcagtgcttccaaaccccacacctgagaacgcggtctccagcctgctccagaggacaagcctcagcctgcaccctcagccctgtgtcagtctgtatgtcccagctctaactacagaccaccaccaccaccaccacnaccaccaccaccaccaccaccaccaccaccaccaccaccaccaccacagtggtttntggntccccccggtgatggggggcggcaggcccangtcntntggaagccttcagaaggggnttnggngccttngcctccaccagagccaagccagntcccatagctcccacagcccacagggactgagaagaactgttgtggntccaagaagacatcgggtagaagctgggtatagccacaccaaccccttgctaacatttctatga

SEQ ID NO: 1076 - DNA, 120 bp, Mus musculus
  misc_feature (63)..(63): n is a, c, g, or t
  misc_feature (70)..(70): n is a, c, g, or t
caataatctgtcactgtggactcaggctcccttctcactccacatggaagcatgagcttcggnccaaagntcagaatgggcaggcagcaggcctggaagtcaggctgtgcgctcacttgt

SEQ ID NO: 1077 - DNA, 70 bp, Mus musculus
tctgtctgtgacttaatgtaactgttatcaccgcgcttgtgaccttttacgtcattgttttgtgttcacc

SEQ ID NO: 1078 - DNA, 44 bp, Mus musculus
acaaccacttcttttcctcggctatacatatacctcattcacaa

SEQ ID NO: 1079 - DNA, 120 bp, Mus musculus
  misc_feature (38)..(38): n is a, c, g, or t
caataatctgtcactgtggactcaggctcccttctcantccacatggaagcatgagcttcgggccaaaggtcagaatgggcaggcagcaggcctggaagtcaggctgtgcgctcacttgt

SEQ ID NO: 1080 - DNA, 288 bp, Mus musculus
  misc_feature (33)..(33): n is a, c, g, or t
  misc_feature (52)..(52): n is a, c, g, or t
  misc_feature (55)..(55): n is a, c, g, or t
  misc_feature (61)..(61): n is a, c, g, or t
  misc_feature (67)..(67): n is a, c, g, or t
  misc_feature (78)..(78): n is a, c, g, or t
  misc_feature (80)..(82): n is a, c, g, or t
  misc_feature (96)..(96): n is a, c, g, or t
  misc_feature (133)..(133): n is a, c, g, or t
  misc_feature (142)..(143): n is a, c, g, or t
  misc_feature (146)..(146): n is a, c, g, or t
  misc_feature (154)..(156): n is a, c, g, or t
  misc_feature (160)..(160): n is a, c, g, or t
  misc_feature (176)..(176): n is a, c, g, or t
  misc_feature (218)..(218): n is a, c, g, or t
  misc_feature (226)..(226): n is a, c, g, or t
atacagcctccttgctatgtccacacactcacnacatttctacacttttaanacntcagtntccatnttaagtttatnannngtggcccatttgtnctgttctcagtatatgcaaacacattggacttcactntttattctnntanataagaannncaanatggagatgtatacantctttgctatattaggtttataaactgttttaaaaaaattcntccttttnccaaaatgatgaactaagtgattggtaaaccctaagccctgtatgagtggagggatagttta

SEQ ID NO: 1081 - DNA, 114 bp, Mus musculus
tctgtactatgaagtcactaaaagaaggagaggggtgaacaccgaactgtttctgagctaggagccctgatatttcccctcaataagggcagctcctagttgatatatttgata

SEQ ID NO: 1082 - DNA, 321 bp, Mus musculus
  misc_feature (236)..(236): n is a, c, g, or t
cacctccattttgctatgactgttaaaagtttcattcctgagggttttggaatccattacaaattttaaattaggaaggaaaagaaaatcatcttccttgatttggacctgaactgtgagttttcagtgttggtaacagtttcacattcccacccatcagacgtgtcactgggacacagccacactggaactcattccctaacactggcccgcaaatacagcactgcttcaaagantggaatggttcgcttgcaggtcccggacaagcttttattactaaatatttccattgtaaaggagcttcccgcttttgaagtgcaa

SEQ ID NO: 1083 - DNA, 291 bp, Mus musculus
ggcttagctgtcactttatctacaaaatgctgacaggtgtgcttcaggacactgtgcgaaagtccctcgagggcagtcatgcacacaacccagacaccagaccccgtgggccaacagatcacaccatttttgctgtttttaagttattttaatttaatacattccccccagtggagacagttcacaaaacagttctcgaatttaaatatacaactttgactagtatctatcacgtggtgtcaagccagattttgtatttaaagcatggagttttaaattccacatgcggga

SEQ ID NO: 1084 - DNA, 546 bp, Mus musculus
  misc_feature (67)..(68): n is a, c, g, or t
  misc_feature (328)..(328): n is a, c, g, or t
  misc_feature (332)..(332): n is a, c, g, or t
  misc_feature (351)..(351): n is a, c, g, or t
  misc_feature (366)..(366): n is a, c, g, or t
  misc_feature (406)..(406): n is a, c, g, or t
  misc_feature (408)..(408): n is a, c, g, or t
  misc_feature (434)..(434): n is a, c, g, or t
aggagtttcattctcagtctcggagggggcatctagtgaaggtttgtgagctcaattctgccttccnngtgacctcaggtacgggagagaatgatgctggattaggtgaagagcatcgggttcttggtgcctacaacagattcttcaccgagtttgttctagacttgcatcactaataagatgctgtactgtgtctcacaggccgtttaatcaaaccttaagctcacaagccaacccacagctctgtgcgagagacttcatgcgggtttttgtttaacaagcttctaagtgattcctgccattaaaagcacagaagcagaagctattnaagntgcccaggttgagtggtgncagtgctggaccacncctttaatcccagtactccagaggcagaggcagaggggantntgagttcaaatccagcctgcctggtntacacagtgagttccaagacagccagggctacacagaaaaataaataaattctcagattatctaagattacaacgtttgcttgggagggaccatgactacctctgagcttat

SEQ ID NO: 1085 - DNA, 515 bp, Mus musculus
  misc_feature (221)..(221): n is a, c, g, or t
  misc_feature (239)..(239): n is a, c, g, or t
  misc_feature (242)..(242): n is a, c, g, or t
  misc_feature (246)..(246): n is a, c, g, or t
  misc_feature (283)..(283): n is a, c, g, or t
  misc_feature (297)..(297): n is a, c, g, or t
  misc_feature (302)..(302): n is a, c, g, or t
  misc_feature (328)..(328): n is a, c, g, or t
  misc_feature (337)..(337): n is a, c, g, or t
  misc_feature (340)..(340): n is a, c, g, or t
  misc_feature (343)..(343): n is a, c, g, or t
gcgagtgtgcttataagcctgcattcagtgaatgtattgggagactaggtcttggtggtgttccttttgagtttcaagaatgagaagttttcttaaatagtaatgcaaggtcagtaatgtccgccaaagggatgcagtgttttatggtaacaattattctggaaataaggtcgccccatggagccccaggataagtctgcgctaattcatgctgccttacngggcagtgccaccttttnttntccnatttctactgccttggacagtcaccaggagcacctgnatagcaatgcaccntttcnacaaggcaagcttgaatttttttatncacatacantcnacnatttttataaatgtgttaaacaatttgacccatttttatcataaatatttttagtgaaatttttagtagtatgagttcaaccacatttgataaactatggtttttttattgacttatttagaattgtatatatgtgtgcaattgtgtggctaatcagctgtctaaaacttca

SEQ ID NO: 1086 - DNA, 278 bp, Mus musculus
cacactgcttgtaactgactactctcgtgacaaacaaaagttgtacttgaaagaaagggtaacaacatgtgtacattgatgcttgcctaatgtagcatggagacttgtactcacgcacacctgtggtacttagggtccatctgtctaatgctggttaatgtcaaaagaagagggtatctcaatggatgccaccccttgctttgaccattgcatgaactgcttctaaattattttattacctaaaattttaaaatatgccattcgttgcacacattcac

SEQ ID NO: 1087 - DNA, 519 bp, Mus musculus
  misc_feature (204)..(204): n is a, c, g, or t
  misc_feature (212)..(212): n is a, c, g, or t
  misc_feature (217)..(217): n is a, c, g, or t
  misc_feature (223)..(224): n is a, c, g, or t
  misc_feature (227)..(227): n is a, c, g, or t
  misc_feature (367)..(367): n is a, c, g, or t
  misc_feature (374)..(374): n is a, c, g, or t
  misc_feature (383)..(383): n is a, c, g, or t
  misc_feature (402)..(402): n is a, c, g, or t
gagccatagatggataccccactatcacagtgacttagcctggtttgtagcctcgcctggcctttaccttgacttctcccagccatggccctggatcccccagacaatcgtcttcgcccaccgcatggtgccaccaaagatctctactgtcagtggtgactcatattcccagagacttcgaaaagctctggcgctgggttaaanaaaaaaanatcanaacatnnaantcaaacacccttaggcaaaaggggtggaggaaagctccaccctctccaagctcgggcaaaagttcagcgagggatgattcgtgaatcaggcttgctccagctttgcgaggaaatgcactggcgagagcggagagcttgancctgcantcgccctantctcaccaggtaggtgatntccggaccgcacgaccatgcgcgacaaacgctcctccgcgctaaactgttaccaacccttcagaaaagcatagatgtgcaaagattaataaataatagaaagatgctcccgcggctt

SEQ ID NO: 1088 - DNA, 489 bp, Mus musculus
  misc_feature (298)..(298): n is a, c, g, or t
  misc_feature (301)..(301): n is a, c, g, or t
  misc_feature (314)..(314): n is a, c, g, or t
  misc_feature (352)..(352): n is a, c, g, or t
  misc_feature (366)..(366): n is a, c, g, or t
  misc_feature (410)..(410): n is a, c, g, or t
  misc_feature (427)..(427): n is a, c, g, or t
gaacagatccggttatgcatcatgtatatcactgggatgtgtaccgagagtcaccatggaaacctgggtatgggactcagagtcaccatggaaaccagccactgggtatgcctgtcaggaagcttctagagtgtgttcacggaagtgggaagagccaccctgcgtgttggcagtgccatctcttcgtgatctggggtcctggacagaatgaaaaggagcaagcaagtggagtaccagcagtcacccctctctgcttcctgactgtgggtgccatgtgaccagctgtttcatgttcctnccnctgtgcctccccnccatgacggactgtgcacgctcacactgtgagccagcncgaacccttccttntttaaggtgctttttgttacagcggtgagacgacggctaatatnctgcagaaacacgtgcncggtgtgcagggctcacgtggacgacacaatccctgctgcatctcatttgactagctctcag

SEQ ID NO: 1089 - DNA, 448 bp, Mus musculus
  misc_feature (279)..(280): n is a, c, g, or t
  misc_feature (287)..(287): n is a, c, g, or t
  misc_feature (291)..(291): n is a, c, g, or t
  misc_feature (298)..(298): n is a, c, g, or t
  misc_feature (301)..(301): n is a, c, g, or t
  misc_feature (303)..(303): n is a, c, g, or t
  misc_feature (305)..(305): n is a, c, g, or t
  misc_feature (312)..(312): n is a, c, g, or t
  misc_feature (314)..(314): n is a, c, g, or t
  misc_feature (324)..(324): n is a, c, g, or t
  misc_feature (340)..(341): n is a, c, g, or t
  misc_feature (349)..(349): n is a, c, g, or t
  misc_feature (374)..(374): n is a, c, g, or t
  misc_feature (393)..(393): n is a, c, g, or t
gcaaatctcagcaatgtcctgtctttgtcatctgataaggggcagggggaggttgtcagttatgagagacattttcttggaacggaaaactaaaggagacaccagcagtttagtgtcaacaaacactgagcaacatagcaaacaccaggctacaaacactcctgatagcatctctttccatgaaccgcactgcaaaagataagctatgcccagagaccaggccagcctcctctgttttaatgagttccaggtcagtcagagaccctgtctcagaaaacnnaagtggncgantcctgangancnanaccagantntcacctctgncctatgtactcatgtnngtatatgnttccacataaccctgcaactgcacncacttgaacacacacaaanatatatgcatacacatatatacatacaaaagttcactgatattactacatttgca

SEQ ID NO: 1090 - DNA, 456 bp, Mus musculus
  misc_feature (41)..(41): n is a, c, g, or t
  misc_feature (56)..(56): n is a, c, g, or t
  misc_feature (421)..(421): n is a, c, g, or t
gcccgacagctgctgcaagacagtggtggcccgctgtggtncagcgagcccacccntccaacatctacaaggtagagggaggctgtatggccaagctggaacagttcgtggctgaccacctgctgctcatgggagcggtgggtattggggtagcctgtcttcagatctgtgggatggtcctcacctgctgcttgcaccgaaggctccagcaacaattttattaaaggacacccatgtaccctgctgactggcccacccaagggaccacatctccacttcctgaaccaggcctgcaaagtcatcgctggggctgtggactcgctccaccctatgcagaggccaccaaatgtctgtggttgtggttcctgtgcatcccgactggcaggggcctcagctaactcctccattcctaagtactcanccactgccaaaatccttgccaagggatgatcctgg

SEQ ID NO: 1091 - DNA, 383 bp, Mus musculus
  misc_feature (151)..(151): n is a, c, g, or t
gttggcactgatattgggcaccttcggggagcttgctatggccttacagtgctacacctgtgcgaatcctgtgagtgcatccaactgtgtcaccaccacccactgccacatcaatgaaaccatgtgcaagactacgctctactccctgganattgttttccctttcctgggggactccacggtgaccaagtcctgcgccagcaagtgtgagccttcggatgtggatggcattgggcaaacccggccagtgtcctgctgcaattctgacctatgcaacgtggatggggcacccagcctgggcagtcctggtggcctgctccttgccctggcacttttcttgctcttgggtgtcctgctgtaaagccatggccatctagctccac

SEQ ID NO: 1092 - DNA, 496 bp, Mus musculus
  misc_feature (253)..(253): n is a, c, g, or t
  misc_feature (255)..(255): n is a, c, g, or t
  misc_feature (257)..(258): n is a, c, g, or t
  misc_feature (287)..(287): n is a, c, g, or t
  misc_feature (304)..(304): n is a, c, g, or t
  misc_feature (313)..(313): n is a, c, g, or t
  misc_feature (324)..(325): n is a, c, g, or t
  misc_feature (335)..(335): n is a, c, g, or t
  misc_feature (337)..(338): n is a, c, g, or t
  misc_feature (342)..(342): n is a, c, g, or t
  misc_feature (358)..(359): n is a, c, g, or t
  misc_feature (376)..(376): n is a, c, g, or t
  misc_feature (381)..(381): n is a, c, g, or t
  misc_feature (383)..(383): n is a, c, g, or t
  misc_feature (385)..(385): n is a, c, g, or t
  misc_feature (387)..(387): n is a, c, g, or t
  misc_feature (421)..(421): n is a, c, g, or t
  misc_feature (429)..(429): n is a, c, g, or t
  misc_feature (455)..(455): n is a, c, g, or t
  misc_feature (467)..(467): n is a, c, g, or t
ggtcaaatggttttctatttttcataagcctagtcttttttaatgttttttttttaatgtaaaaccttgtcctgcagattaaatgtgtcactgaagtatgcctgagacttccagccccacatctgaagcatacctaggaaaaaactgctgggtggccttggagggcctgggcattttctacaagtttcacaatagtagcacatatataatgcatgtttcctttgactctctcagtttctcctacagtgatgantngnntaccaggctttcctgctcattcctttttncctggcaggaaacaatntcaaagtgnccaaatgagcnngattgtgttnanntgangatgtagttacacttnnccatgaacctttaactntttgntncntntctgattgtgagacaaacttaaatttccatcctntccccaantcctcagtggtcactatttcaaaggnccctggtaactntactgggcattttcccagatgtttacaga

SEQ ID NO: 1093 - DNA, 476 bp, Mus musculus
  misc_feature (105)..(105): n is a, c, g, or t
  misc_feature (271)..(271): n is a, c, g, or t
  misc_feature (290)..(290): n is a, c, g, or t
  misc_feature (311)..(312): n is a, c, g, or t
  misc_feature (327)..(327): n is a, c, g, or t
  misc_feature (329)..(329): n is a, c, g, or t
  misc_feature (332)..(332): n is a, c, g, or t
  misc_feature (335)..(335): n is a, c, g, or t
  misc_feature (341)..(341): n is a, c, g, or t
  misc_feature (356)..(356): n is a, c, g, or t
  misc_feature (372)..(373): n is a, c, g, or t
  misc_feature (420)..(420): n is a, c, g, or t
  misc_feature (422)..(422): n is a, c, g, or t
  misc_feature (441)..(441): n is a, c, g, or t
aaaatcaatgtattcctgcctgctcaacagtgaacaaaagctattgagaatgtaaaaatcccagttttctgttttagagccaggcagctgctagaaccttccatntttgagcatctttaaatcagattgtctgagaattcagagggtaaagagggctgatcagctggcacattttaagcacagtggctggaagtatggagtgctaatgctgacactgttgtatgcattggaaggtggagtcctttgctgtcagtcaagtgcttacctactnaatgtgacactgaagctcnctgggactgtggttgaagctnntctggcctgaggaantnttnatnttgtantaggaagcacacaancctgtttccttatccnnctacacagtgagactattaaggaaaactaacaggatggtggctcatntnctaccacaagggtgctaanccttttccaaacacttgatatttctataggacctt

SEQ ID NO: 1094 - DNA, 460 bp, Mus musculus
  misc_feature (304)..(304): n is a, c, g, or t
  misc_feature (330)..(330): n is a, c, g, or t
  misc_feature (342)..(342): n is a, c, g, or t
  misc_feature (344)..(344): n is a, c, g, or t
  misc_feature (359)..(359): n is a, c, g, or t
  misc_feature (361)..(361): n is a, c, g, or t
  misc_feature (368)..(368): n is a, c, g, or t
  misc_feature (371)..(371): n is a, c, g, or t
  misc_feature (391)..(391): n is a, c, g, or t
  misc_feature (398)..(398): n is a, c, g, or t
  misc_feature (412)..(412): n is a, c, g, or t
  misc_feature (424)..(424): n is a, c, g, or t
tgtgtactacacaagcagccagcagatccacgtgggtatcctgagccccactgtggatgacgatgacaaccggtgtctggtggacgtcaacagccggccacgtctcatcgagtgcagttacgccaaggccaagaggatgaagctgcactggcagttctcccagggaggctccatccagaaccgcaagtccaagcgctgcctggagctgcaagagaacagtgacatggagtttggtttccagctggtgcttcagaagtgctcgggacaacactggactatcaccaatgtcctgaggagcctggtntcctgaccctccacaggcgccaccgnccaccgctttgntnactgtgtagcatcancntgcaatnccncctgctgtcacgtggggctncccggantctgagagggaganccaagtgggtgncctccccccacaaaagagctttgtatttcctattca

SEQ ID NO: 1095 - DNA, 530 bp, Mus musculus
  misc_feature (294)..(294): n is a, c, g, or t
  misc_feature (335)..(335): n is a, c, g, or t
  misc_feature (351)..(351): n is a, c, g, or t
  misc_feature (358)..(358): n is a, c, g, or t
  misc_feature (368)..(368): n is a, c, g, or t
  misc_feature (370)..(370): n is a, c, g, or t
  misc_feature (394)..(394): n is a, c, g, or t
  misc_feature (396)..(396): n is a, c, g, or t
  misc_feature (420)..(420): n is a, c, g, or t
  misc_feature (432)..(432): n is a, c, g, or t
  misc_feature (435)..(435): n is a, c, g, or t
aaaggctcattaaacagtcgcactgatgttggagagtatcacaggccttgcgaaggtctatttatgatgtcacaatgatgtgaagttcaatgaaaatctatgaagacagtaaagaggtaaataccctctctttctggaactaaaatttaatacaggggaactaataggaatcacagacaattagaaagcacaaaacaggatgtcatcctcttaagctgtgcagttaggtagttgctacattagtaataatctgattcagatgcttgcacagtaaatagaattaattccccaccntcttttagagatggagatagagcttagtgacaaagcacttntctagcatttaggcantccttanttctaacccnancggtgtgaaggaactatatgcatntntcatgagcatatgatgtatgatcncactcacttgtntcncctgtgtacacacctggggcaaatggaggaactttatctaattcaagtcaaaagaagtatagaagctccatgtacggttcctataacttttctat

SEQ ID NO: 1096 - DNA, 511 bp, Mus musculus
  misc_feature (345)..(345): n is a, c, g, or t
agatgtgtagctgccatgctttttctgaatggacaggagaaacataagctaccaagtattcatttctgagggtgctttgtagggaaagaaaggctggcacttcctcagaaccctctgtcttgttaacgggtatcttttgttggtgtgttttgctcttacattacagatagaatatcgtgtgtgagctgatgaataattactttcagttattttgcttttgtataagccatctgagaccttgctatgctgtataagttgtgtgacggagcagtgtgagtatgaaataaagcagatcactttccttttgtattatctatggatgccactatgaacgctgacattaanccactcaagagttttctatgaataagtgtaagtaaatgctttgatatatataaacctaaataaaagattgtattgagacagagacattggcaaaggaagttttaaggcagttctttaggtgtaaaaggcttgctgtaaaatggtgcgttattccacttattaaaga

SEQ ID NO: 1097 - DNA, 537 bp, Mus musculus
  misc_feature (279)..(279): n is a, c, g, or t
  misc_feature (303)..(303): n is a, c, g, or t
  misc_feature (489)..(489): n is a, c, g, or t
gtttggagtgcatctctgatcttgaaagaactcagagaactcttagggtgaaatgggaactgtgggagacaacccatatggggaaaactaaagatgtcaggggggcgacaagaccaacacagaagaaggtatgggaatatcagaggcaaaacatggtttcccatggtctcaactgtagaagtgcaggagggctatcatacacatgcacacagaagctgaggtcaggtgacccctctggggacatgttcataggcatcccatcctcacagagaactgagntattcaacaatgctcatggcattnctgatgcttctgtcatacattggtattctcgaggagtctatctgtatttctctttaatgagttctttcctagttctcacagctgtttttataagacagagggaaatgagcagattttctaatcttggagatttttatacagtaaagcattctagttgtcactgaaatctaaatcttagaattcttntcttatttaaatacatgtatagagacagtgtagattttcatgtaccta

SEQ ID NO: 1098 - DNA, 289 bp, Mus musculus
  misc_feature (146)..(146): n is a, c, g, or t
tttcgccgtggcttagataatgactatgtggagtctccatgctgagagcacccttatagggactttctctatgaataaccactataacgctgtagtctagaaatcggtagactgctccaggccctgcttgtgcagaggtgtggggngagtccgggctacctatatatacatatgtatgatactcatgtacatttattacgttacatatgaatatattatatgtctctgtgtcattgtgtcatcctacttctgacacgatcttccttggccaggcagagcatggcttcac

SEQ ID NO: 1099 - DNA, 372 bp, Mus musculus
tctcccttttgccaaaacggactggagaaagagcatttggtttttattctctgctcttggaatatgaaaagacctaaccaagaccaagacctcgctatgaaatactagcttaatccaagccttaaaattcaaaatattacccaagttcaatttctggtttctggaggcactaaacatgtacgtgtcaccatccttaccaagtacttacccaaaatttggtaagagggcactgggtaccttagcagcactccaacacagttgagcgtggtctaacagagaaaagggataaatggagcagcctgaaacaactggagcagggtgagacccaccattagacaccaagccatggcagaaagcagcagctagcacctt

SEQ ID NO: 1100 - DNA, 433 bp, Mus musculus
  misc_feature (360)..(360): n is a, c, g, or t
  misc_feature (381)..(381): n is a, c, g, or t
tgagatctgaacttgcaccatttgcttatctggaggacagaagccctgaactctacctgcccaaacccagcttccttctgtttgtgggcatggtcccttgggatactggtagataaaagaagacgagagaggagtgggtaaaagctggaggagagttggggagacagaggagaggaaaggggtggaggaaaccctgagaattcagaaagtggcaacctagcccccccagtggcatttggacagagtctaggtttggcaagctctgggcagggtcctctggggaaatggccctggaaaacacaggaaaaaggaactcggtatcctaaacagtgcacccctatacctggaaacataggacanctcttgcccactgccaccttncccacggtactgtactacgaacaccctgaaaacgcccacatgtgtgaactgt

SEQ ID NO: 1101 - DNA, 502 bp, Mus musculus
  misc_feature (35)..(35): n is a, c, g, or t
  misc_feature (38)..(38): n is a, c, g, or t
  misc_feature (370)..(370): n is a, c, g, or t
aatcgtgttccaagagcactttgtaactcactganggnggaggggaagcaccttttgggtttgcgataccaatcaacataaggtgttgttgactcgggtacaataaaactctcaacacacacaaagcccatcaggcaagagtacagtaagcctaaggggacttgctgctcaaaccaaaaattaactctgaaggtcagtctacctgacattacctaggcatggtgttgtccaagctgcgcatcggtgcacagtgtggcctggcacacacgcaggcgggcgacggaacttgaagggttattgacatgcaaatgctggtgtttgatttcctgtgttgttgcctcagcgttaagggcatttccgtttgcagttntactaaagacactctgagaaatattccgagtttcgtattaacctttcctgtccatgtaacaacttcatgaccattactgcattgtcaaattcctactgacgacattataactgtacgggagcttaactttat

SEQ ID NO: 1102 - DNA, 324 bp, Mus musculus
gatggcaatctcttccaaaggaaacttctttcttctaagcccactgaattgggctgcagaattgcccggttggcaaggccttgtaagcttaagaatctgaatttgagcttcaggacccatattttacaagcccggtgtggctgcacacacttctaatcccagcattggggagggagatgaaaacagtatcctgggtatcgctggccagcctcctctgttttaatgagttccaggtcagtcagagaccctgtctcagaaaacaaaagtgggcgaatcctgaggagcaataccagagtctcacctctggcctatgtactcatgttt

SEQ ID NO: 1103 - DNA, 420 bp, Mus musculus
tgtccccgaagctcctatctgaggagtacactattaagtcaccaggcatttggagtggatctttccagaaggtcttcccaactgagaatgtaagggaagaagcaagagctagccccgtctctgaccctgagatagaaagctatttatttgtgttcagtgttcgaggcatgactagtgttgctaattagtctaataaatccccacacttcctgcagtgaacactaatggtattgttctaaccctttttctttctttgtaagtggtcagtcattcacagtaagctatgacgtaagctgtgttctaacatacaaaccgtagttgtaagacaattccgtgaaggctcattcccacccacccgcacataccacattgcattgtagggttgactttagttggcaccgcacctgtacattatacatt

SEQ ID NO: 1104 - DNA, 310 bp, Mus musculus
  misc_feature (39)..(39): n is a, c, g, or t
  misc_feature (72)..(72): n is a, c, g, or t
  misc_feature (164)..(164): n is a, c, g, or t
  misc_feature (166)..(170): n is a, c, g, or t
  misc_feature (173)..(173): n is a, c, g, or t
  misc_feature (184)..(184): n is a, c, g, or t
  misc_feature (186)..(186): n is a, c, g, or t
  misc_feature (189)..(189): n is a, c, g, or t
  misc_feature (192)..(193): n is a, c, g, or t
  misc_feature (204)..(204): n is a, c, g, or t
  misc_feature (217)..(217): n is a, c, g, or t
  misc_feature (219)..(219): n is a, c, g, or t
  misc_feature (223)..(223): n is a, c, g, or t
  misc_feature (226)..(227): n is a, c, g, or t
  misc_feature (229)..(229): n is a, c, g, or t
  misc_feature (231)..(231): n is a, c, g, or t
  misc_feature (233)..(234): n is a, c, g, or t
  misc_feature (240)..(241): n is a, c, g, or t
  misc_feature (255)..(255): n is a, c, g, or t
  misc_feature (263)..(263): n is a, c, g, or t
  misc_feature (266)..(266): n is a, c, g, or t
  misc_feature (285)..(285): n is a, c, g, or t
ttctttccttgcaaatgggttcccttgcaaatgggttcntagggcttcagtcctgcaataccgagaagatcntgcagagggcgggatagtcagtgttcttcaagataaagaatcgctccacctactggcggacagaaaagatttccaattcacgccccactttntnnnnnccngcccaaccccnanccnagnnacatttccagnacctagagacctntnttcnatnntncngnnctaagnnactgaagagacttngggggganttntttgtttgtttttaagggnatggatttgagggaacaccaggttc

SEQ ID NO: 1105 - DNA, 363 bp, Mus musculus
  misc_feature (32)..(32): n is a, c, g, or t
  misc_feature (153)..(153): n is a, c, g, or t
  misc_feature (274)..(274): n is a, c, g, or t
  misc_feature (313)..(313): n is a, c, g, or t
gggtcctgtttgttccagaaagagacttcctncctggcatgaaatattagcatagtgttcacagtacatgagctttgatttatttttcttccaccaatgtgattagtttccactactctcaagcaagagtccgcaatgccaaagtcatggtgntctgagaatgttgtcggtcggcaaatccactacacatttctaaagaaaaatagagaggcatgaccataaaaattaaatgctcttcttggcaataatgtatatttaccacgtgcctctgacnttctataaatattgcctgcaccggaaccatttctgtccntactatctctccttgagttttttatggctcaccctgaggcatagcatgaa

SEQ ID NO: 1106 - DNA, 435 bp, Mus musculus
  misc_feature (143)..(143): n is a, c, g, or t
  misc_feature (146)..(147): n is a, c, g, or t
  misc_feature (152)..(152): n is a, c, g, or t
  misc_feature (183)..(183): n is a, c, g, or t
  misc_feature (187)..(187): n is a, c, g, or t
  misc_feature (213)..(213): n is a, c, g, or t
  misc_feature (220)..(220): n is a, c, g, or t
  misc_feature (259)..(259): n is a, c, g, or t
  misc_feature (270)..(270): n is a, c, g, or t
  misc_feature (282)..(282): n is a, c, g, or t
  misc_feature (295)..(295): n is a, c, g, or t
  misc_feature (322)..(322): n is a, c, g, or t
gttaacccctgtcaaagactatgataataggcctcctacagctcatcctgggtagggtgtgtgtgtgtgtgtgtgtgtgtgtgtgtgtgtgtgtgtgtaaaggaggtggcaccagaagccaggccaggggtgaggcagagccnccnncaatncaaaaggggaagtagaaaggatggagaagtngggntctgaacataaaccgtatatctcctntgatttntgaccaggtgcaggagaaggcctgataatgtcacatatntcggttctttncctgtagaaatnttaagtggacganccatcagaaccataagagtaccacttngtatcctcattgaaattagtactactgtgactcaaaagctgatagtaaagaaataatactctgtagagaaaaaggtttcaagctgaattgattcatgtactgactaatacaga

SEQ ID NO: 1107 - DNA, 200 bp, Mus musculus
agggtctctgtattcctatatatacaaaggtaacttgtatcttttacttaaaaattatattattaacaaggtaaatatatcctaatactatgtgtttattatatactatatagtcaagaatactaagttgtagaaatatttagaaagcatacctttgaatttaagtatctaatgcctcaagcaaatctgctagtttcaga

SEQ ID NO: 1108 - DNA, 123 bp, Mus musculus
  misc_feature (40)..(40): n is a, c, g, or t
  misc_feature (79)..(79): n is a, c, g, or t
ttttacgaagcaggacatccaggaatcttttcatgaaggntctgacaaccagaccttaccaggtggtaccggtttcatnccagagtcaggttaagagcgtacgttttactcctgattgtttgt

SEQ ID NO: 1109 - DNA, 179 bp, Mus musculus
  misc_feature (115)..(115): n is a, c, g, or t
aaacagggtgagagttcctcccgctttctgagcaggcacggtaggggaaagtaactgaaatcacaaaagaagagaagaaagatgggaaagagaaagctttcagactttgaaagantctttttgagtgatattggatggtccttaaaatgtattcattacctgacaataaagtttaactg

SEQ ID NO: 1110 - DNA, 240 bp, Mus musculus
  misc_feature (27)..(27): n is a, c, g, or t
  misc_feature (49)..(49): n is a, c, g, or t
  misc_feature (65)..(65): n is a, c, g, or t
  misc_feature (77)..(77): n is a, c, g, or t
  misc_feature (86)..(86): n is a, c, g, or t
  misc_feature (88)..(89): n is a, c, g, or t
  misc_feature (98)..(99): n is a, c, g, or t
  misc_feature (126)..(126): n is a, c, g, or t
  misc_feature (131)..(131): n is a, c, g, or t
  misc_feature (144)..(144): n is a, c, g, or t
  misc_feature (199)..(199): n is a, c, g, or t
  misc_feature (201)..(201): n is a, c, g, or t
gggattccccagtgatcactaattaangaaaatgccttacagccagatnttatggaggcattttnctgaactgaggntccttcctntnntgataattnntagcttgtgtcgagccatgacagaaantgagnttccaagagcatnggcctcattttcttcagccagtggttggtagaattggaccagggccaaggtgtcntnttcaccttgtgacctctagtttcctgtgtgatatcccaa

SEQ ID NO: 1111 - DNA, 407 bp, Mus musculus
  misc_feature (27)..(27): n is a, c, g, or t
  misc_feature (49)..(49): n is a, c, g, or t
  misc_feature (65)..(65): n is a, c, g, or t
  misc_feature (77)..(77): n is a, c, g, or t
  misc_feature (86)..(86): n is a, c, g, or t
  misc_feature (88)..(89): n is a, c, g, or t
  misc_feature (98)..(99): n is a, c, g, or t
  misc_feature (126)..(126): n is a, c, g, or t
  misc_feature (131)..(131): n is a, c, g, or t
  misc_feature (144)..(144): n is a, c, g, or t
  misc_feature (199)..(199): n is a, c, g, or t
  misc_feature (201)..(201): n is a, c, g, or t
  misc_feature (353)..(353): n is a, c, g, or t
gggattccccagtgatcactaattaangaaaatgccttacagccagatnttatggaggcattttnctgaactgaggntccttcctntnntgataattnntagcttgtgtcgagccatgacagaaantgagnttccaagagcatnggcctcattttcttcagccagtggttggtagaattggaccagggccaaggtgtcntnttcaccttgtgacctctagtttcctgtgtgatatcccaaacagggtgagagttcctcccgctttctgagcaggcacggtaggggaaagtaactgaaatcacaaaagaagagaagaaagatgggaaagagaaagctttcagactttgaaagantctttttgagtgatattggatggtccttaaaatgtattcattacctgacaataa

SEQ ID NO: 1112 - DNA, 172 bp, Mus musculus
aatctgagttgtttcaatttaggccaagtactagaacaaggaatcatcaaagatatatgggtagattttattatgtacacaaagacaaatggaccctgagaaatgtatgcgtttgtaaacttgccatgggtccgaatattttcaagccatgtaatccattaattttgtggga

SEQ ID NO: 1113 - DNA, 343 bp, Mus musculus
  misc_feature (109)..(109): n is a, c, g, or t
  misc_feature (112)..(112): n is a, c, g, or t
  misc_feature (114)..(114): n is a, c, g, or t
  misc_feature (126)..(126): n is a, c, g, or t
  misc_feature (129)..(129): n is a, c, g, or t
  misc_feature (131)..(131): n is a, c, g, or t
  misc_feature (137)..(137): n is a, c, g, or t
  misc_feature (143)..(143): n is a, c, g, or t
  misc_feature (145)..(145): n is a, c, g, or t
  misc_feature (162)..(162): n is a, c, g, or t
  misc_feature (188)..(188): n is a, c, g, or t
  misc_feature (214)..(214): n is a, c, g, or t
  misc_feature (249)..(249): n is a, c, g, or t
gtacacaaagacaaatggaccctgagaaatgtatgcgtttgtaaacttgccatgggtccgaatattttcaagccatgtaatccattaattttgtgggaagcttaataantcngnagcttttatttnttntnattttnattgtntnttagttgactgaatttnggtgaagttttttttttttttatgcnatatttcctgtgtaatattttgtaantccttcacctgtttcttttatggggacttttcttntggggcaagttcagtgtatttatgtgaaactttataagagaactaatttttccatttgcatattaatatgttcctctatacatgtaaagacaca

SEQ ID NO: 1114 - DNA, 542 bp, Mus musculus
  misc_feature (277)..(277): n is a, c, g, or t
  misc_feature (340)..(340): n is a, c, g, or t
atgcatgctgcccaccctaggcaatggcatagaagcagtatatagatcagtatccactcacacacacttatacacatacacactcggtgtgcttgcacacacacacacacacacacatacacacacacacacacacgaacaaggaacaccaaaacagtgttgattgttgtgtttaaagacatgtttttttttcacctgaagaatggacttaaactatgtatttaaaaaaaaatagcctcagtgttagagatggtgaatgtatccagtttcagttacnaaaacaatttcctgaattttaagcattcagtgagctgccaattttgattttgtgttgcttttnatccaaatggctttctcttttcttttacttttttcttttttctttgtaaattggaggaagtggggggcggggagcagcaatattgtgtttgaaaaattatactctgtacctggctttcctgtgttatgttaaccacttcaatgtttttattctgctttggttttatagtgtctgtgaggcattcgatgcaactatacagtta

SEQ ID NO: 1115 - DNA, 216 bp, Mus musculus
tcacagtttccaagacttcttggtcttagattaggcaaggggtgggtagtaagtgaatgtgcagagtcaaatctaagacatcgttttcaatggctttaaagtaaatgaccaacataattgtactgaagagcccagcaggagctctgctctatcttaacgggctcagaagactgaaggaagttcaggtgtaaagccaggagtggcactttccaaaga

SEQ ID NO: 1116 - DNA, 525 bp, Mus musculus
  misc_feature (464)..(464): n is a, c, g, or t
gatctcactggactgatgtcacatatccgctggactggctctgctcccagaaaacctacatacatgcctggagcgaggatgccggctggcagaagatggacagctgagagaaagtacttgagtgttcaagctcagaggagcatatcatcccttcagagtagggaggggagtatccttggtccatcagcatcacacgtcaccagaacgtcagggcggccggtatgaactctggagatcactaaactctttgcatgctgaatagctatttatatattatataaataaataaatatataaataaatatatatctcacaaatgcgggccacatgtcaaattcagctttgctttttttacaaataaacttactgaaaacaaatgctgaaggaagtatttggaaagacatctatttaaatttttattacgtttgatgttaaagataaaacatatatatatattataaatncacactgcagataaagctttattagaaaacacactagctgacaggcggtatgaaacttcaa

SEQ ID NO: 1117 - DNA, 519 bp, Mus musculus
  misc_feature (27)..(27): n is a, c, g, or t
  misc_feature (450)..(450): n is a, c, g, or t
gtctagcatggctttgatgcaaccccnaaatgtatgcattttctggctttggagacccacttatcattatcattactaccatcaccaccaccactaccaccaccgtcaccatcactgtcatcaccagctcagggtgctacgcatcatcatggtgttttattaatgacagtaactggatgaatcccacctgtctctaactgagagcaaaaaggccagacagaagaggagcagaaagaagagaagcgggctgctttccttcagcttcatacccggggaaaccgagtaagcctctgggaaggtctaccctgattccttccccagagcactggataatgtggaatgaaacacaaatacttttgagtacatgttcacagtgcagggcaagctgccgagaaagaactctttacctcctcatcaagttttcctcctctttgagttcctaaccatgancctcgcgtggactgttatcaccaaccaaactttcaataggtggatgggatcactaggtcattttgttct

SEQ ID NO: 1118 - DNA, 246 bp, Mus musculus
  misc_feature (158)..(158): n is a, c, g, or t
  misc_feature (175)..(175): n is a, c, g, or t
ggcatcgggagagcgtttactcctagtcctaccagtaaggcgtccacttgcaatggtaactgagtccacaaacagctgttagaacctagacagcagcatgactggctcagagctcttgcccatgagcagatgtttacaagagaggaaaagattgcttnctacgactgcatcagcntctgcacctgcgtaaggaggaagctcactcactcaagagcacctccatgtaccgcgtcacactggaaggag

SEQ ID NO: 1119 - DNA, 181 bp, Mus musculus
  misc_feature (48)..(48): n is a, c, g, or t
  misc_feature (147)..(147): n is a, c, g, or t
gtatctttagttacattcagatttgtaactttataaacatgttttctncctgaggtactttttaaggaggtagtgtacatgggacctttttgaagtagactggataagggccagtagcgacttgcgactagactttaaactttgctntttcaggtggaggcttcgtttctgggatcccact

SEQ ID NO: 1120 - DNA, 127 bp, Mus musculus
gaaatcaaggctttccacatttgaggacgataatcaggacaccgctgcagacaagtgaggtgcagagagacagagataccgccacgttctgaccacttagcttcttcctgacagaaatttggcatat

SEQ ID NO: 1121 - DNA, 426 bp, Mus musculus
  misc_feature (93)..(93): n is a, c, g, or t
  misc_feature (97)..(104): n is a, c, g, or t
  misc_feature (106)..(106): n is a, c, g, or t
  misc_feature (108)..(108): n is a, c, g, or t
  misc_feature (122)..(122): n is a, c, g, or t
  misc_feature (204)..(204): n is a, c, g, or t
  misc_feature (217)..(217): n is a, c, g, or t
  misc_feature (227)..(230): n is a, c, g, or t
  misc_feature (254)..(254): n is a, c, g, or t
  misc_feature (377)..(377): n is a, c, g, or t
gcttaacatacgtgaaaccctgggtcagatctctagcactgcatcaaccaagcatggtagcaaacactggtaattccagcacaagggagctgnagtnnnnnnnncnanggtcagctgcatancaaactggaggctggtctgagaccctgtctcaaaacaagtaaaatattcagctgatacttgaatttctcccccctccacccnagtcacctagttntttttttttnnnnttttattttataagctgaggagtnaactgattggcaattctaatacattgtatgtagggacactccaaatgatggtaacatattttttgagacctttagcttgggtgagaacagaccttgctttcaagccttactcaatgtaccacncctttgactacataccaagtcaagtgttttctacttatccttgagccag

SEQ ID NO: 1122 - DNA, 516 bp, Mus musculus
  misc_feature (393)..(393): n is a, c, g, or t
  misc_feature (401)..(401): n is a, c, g, or t
ggtctaggagttagctcagctgcaagatgaggcaggatactaatgtggctttgctgggaaacatgaaacactaactcatgattgaaactaaattcagtgattctcaaggataaccttttgagatctacatgtttctatcatccatattcatatacattatatctatatatgatattacaaagaacctttagaaagggtgaaggaaagaagtgtgctcatgaggcctcagactctggtgttgggagaagatttgtgatcttgtctttggccttggggcccttctacaaataagccaatgactttgtatccactgctctttatcattcaaactaacagcttgtgcctgaattataagtgtattttattttccctctaccaatatttccctcccanccttgctncaagctacattcatctcattattatgaatgagtataaatcaaactgcccaatcttatttaatgttgtttcaggatatagatctattgttcattatcaccacatgcaccagcaaaa

SEQ ID NO: 1123 - DNA, 550 bp, Mus musculus
  misc_feature (107)..(107): n is a, c, g, or t
  misc_feature (147)..(148): n is a, c, g, or t
  misc_feature (241)..(241): n is a, c, g, or t
  misc_feature (264)..(264): n is a, c, g, or t
  misc_feature (305)..(305): n is a, c, g, or t
  misc_feature (324)..(324): n is a, c, g, or t
  misc_feature (347)..(347): n is a, c, g, or t
  misc_feature (352)..(352): n is a, c, g, or t
  misc_feature (390)..(390): n is a, c, g, or t
  misc_feature (396)..(401): n is a, c, g, or t
  misc_feature (412)..(412): n is a, c, g, or t
  misc_feature (429)..(429): n is a, c, g, or t
  misc_feature (441)..(441): n is a, c, g, or t
  misc_feature (443)..(443): n is a, c, g, or t
  misc_feature (477)..(477): n is a, c, g, or t
agaaatacaccattaattcacagcagtgttctcagggaataccgtaagcatcacctacggaggaaaggaagaaacgccaagggaagtcagggcctttgtgatttgtncagggcacctcagagaggtctgtgttgggagaaaatacanncaaagatgagagagagtacagcagcagccagtgtggagggaggcatgtgggagttattcgcaggtgagtggagcagtaagtcacagccagttncaaagacagaaaaaaaaattatntgggctggttattcagggagaaagtgttttatctgcaccangtagaaatgttgtgtatgngcttttgcaccccaaagaggaanccagngacccaggtcaatagaagtctggttccttgagaatccncaaagnnnnnncttagaacagncatctctttcttacttnttgttaaagacnanagaaatagcatttctattgcaaccagatgccgtnggtctctagaattacgactcagagtttaaagtcatgtcctactaaaatatcagtgtattagtgatgctgtctt

SEQ ID NO: 1124 - DNA, 479 bp, Mus musculus
  misc_feature (284)..(284): n is a, c, g, or t
  misc_feature (286)..(286): n is a, c, g, or t
  misc_feature (288)..(289): n is a, c, g, or t
  misc_feature (373)..(373): n is a, c, g, or t
gagagatgtttgatgctgtcagtgttgtaaggacacagatttgtggaggactgggagcagtagtattcagaaccaaaaatatgtctctttgtgaaaaggaaatcataactggaattgtctgatattttttaacaaaaattcagaacctcagcactcggtggaggcttttgtccttcccgggagcagtcgagaggtgaccttggtagccaccatggtcagagaccacacaggcattgtgggtaggtgggctccagttttccttaatgagtcgcgaacgctgtgcntncnncagaacgaagtctacaagtcaatgggttttttctttttatataataattatataacttatgcatttatacactacgagttgacntcggccagccaaagacacaccacacacaaacaaacacacacacacacacacacacacacacaagagacaatcaaaacatatgatgtggccttgaattttaactctg

SEQ ID NO: 1125 - DNA, 541 bp, Mus musculus
  misc_feature (63)..(63): n is a, c, g, or t
  misc_feature (274)..(274): n is a, c, g, or t
  misc_feature (313)..(313): n is a, c, g, or t
  misc_feature (341)..(341): n is a, c, g, or t
  misc_feature (356)..(357): n is a, c, g, or t
  misc_feature (442)..(442): n is a, c, g, or t
gaggaggaagcatcttcgccagcaccagaagctccttgaggctgtaggaccctcttcaggcantcctgacacccctcaaccttaaggcaggctagggaggagcacagattgggatactggcagcagcatggggaagaaaaagtctatccatccatctgtccaaccgtccaaccgtccatccatccatccatccatctacttgctgtcagtggaaacactacctctagaggcaaccaatagggatagagcagctaatgaaacaagaccatctgancccacgacaaggaagaatggggatggctcgaatgtgttnccaatggagacaggggatgagtacagantggccaaggctgagnncacggccagagggtatcaaagtatgtccacaaccaaggaagattaagcaggggcattgcattgagaaatgacgtcattgaagtantcctgtagacaacagggatgggatgggacctatccagccagagaagacggtgatttgggctcaagagagcagtagtcacccttgttggttttacagaag

SEQ ID NO: 1126 - DNA, 452 bp, Mus musculus
gactgtcatttatctaagcattgctgtgagaccacttgagttttctttgagatttccttcatgttcgtttggggagttcttcaatattgaattctatgcaggtttactgggacaagcagatagaagtgtatttgtgtttttaaaacttgagggacttacatctttcttgttttggtttgtttattgagccaatcacctcacatcatgtagcttattaaaaagtgggaatatttataatttccctatgatgttacttttaaaaagtgtgaagttagtctcataatgtaggttgtaatataaaatgtgttgaaaattaagaaaatattctaaagagtttaatgatcattttaatgtagcagaacacaagggcagcatctgtagtcattaaagaagaaaggtattctcaaatattttccataactaacaaaattataactgtttcttctgtttgg

SEQ ID NO: 1127 - DNA, 510 bp, Mus musculus
agagcacgtatgacagccactctgtaagattcaagaaaggttcatctctcatgatctgtcagatacgcattgtatgctaatttgttcagccttttgaaagccatgcatgcatatgtacatattttaatcccataattgacaaacttgatctaccgcactgagctcagagtcctacgtctgtcgtacatgtaacaacagctttaaccgggtactctctgtgcattgtagaatagatttaataattatgtagcatgtacatttttattttgtactcgtgacttcattgtgactgtggtgatgacagcccttggtgtgctgtctgtattgctgtgttctatcccttcccagccttctaagttcctaggccaatatacattcagagtttctatggtctgattggtgtttcttgcagccacttggaaggagaaaaaggacctggctcgataagcaaatcgcagatcccccacccccacccccaagaattagattctgaatttatgcccgtgtggt

SEQ ID NO: 1128 - DNA, 353 bp, Mus musculus
tccttcagagccatgatagtgagaacagggactgtcttagagatcactctccataaagatgggagtcacaccatgtggggatcacactgtatccactcagagtcacccaggtatggaggcgccctggatgctgatgctgagactcccctcaggccaggctctcctctaccttcttgcccagctcccaagctcctattctgattatttgttgtttctgagtggacacaaggtgacttttgtcctgagtgccttcacccttcacatggccataggggctcagctcctaaagatgccggatgtgggggtatgcacagcaggccagtgtgatgagccactttgaactcagaatctgc

SEQ ID NO: 1129 - DNA, 37 bp, Mus musculus
ggaccgtaagagcacccagatcgagcctgtgtgatgg

SEQ ID NO: 1130 - DNA, 269 bp, Mus musculus
ggcatttttctaaagctagagattcagttagtgcctttcttgctaatggatctgatatatgtctctccacagttgaaatctatctttgtagaaatcatcgaatgtttttttttctttagactttccaacacctgaaaaatggtttaagactttttcctgtttcctcaacccagtcccaggcatttaaggctgccacatgaaataatgtcaaggtttctcatcatattcagcctgtatatctgctttaggacaatgacctcaccaagtag

SEQ ID NO: 1131 - DNA, 533 bp, Mus musculus
  misc_feature (49)..(49): n is a, c, g, or t
  misc_feature (71)..(71): n is a, c, g, or t
  misc_feature (73)..(73): n is a, c, g, or t
  misc_feature (138)..(138): n is a, c, g, or t
  misc_feature (152)..(152): n is a, c, g, or t
  misc_feature (167)..(167): n is a, c, g, or t
  misc_feature (179)..(179): n is a, c, g, or t
  misc_feature (200)..(200): n is a, c, g, or t
  misc_feature (241)..(241): n is a, c, g, or t
  misc_feature (248)..(248): n is a, c, g, or t
  misc_feature (261)..(261): n is a, c, g, or t
  misc_feature (306)..(306): n is a, c, g, or t
  misc_feature (373)..(373): n is a, c, g, or t
  misc_feature (478)..(478): n is a, c, g, or t
aagcacatagtaggccaggttcgttccagcagcttcgaaggctggagcnaagtctgtagtgaggtgtcccnancagtttcatgccagagtatttctacctatttcccactcagggacggggccctgttccgaggttancggtctggatttcntagagaaagggaagnacacacctgtanaatgtcaccctcagtcctggntcagcacaaaacatactggggtcccatgccaggccctgaancttggtntagctcaagccantggaccctcattctaagcatataagtgagccaccattccctaaanctcaaagtggccacctcaaaaacacagcccacccctaaatcccccagtgaccagtattggggaacanggatggaccttagtctatgacatcagatggggtgtctccatgcattcgtccctttccctccccaacagtgcatccccaccctcaccccatagcaccattggcatntatatattcttcactatgctattcatagtgacaccaacgggatgtgctatagtcc

SEQ ID NO: 1132 - DNA, 380 bp, Mus musculus
  misc_feature (210)..(210): n is a, c, g, or t
  misc_feature (212)..(212): n is a, c, g, or t
  misc_feature (230)..(230): n is a, c, g, or t
  misc_feature (257)..(257): n is a, c, g, or t
  misc_feature (270)..(271): n is a, c, g, or t
  misc_feature (275)..(275): n is a, c, g, or t
  misc_feature (320)..(320): n is a, c, g, or t
ggtaagttccagatactattcaaatacctgcaattgtttagtatatttaattctctcgagaatcatataagaaatgtatcattatttcaatctatggatgagaaaactgaggtgaagggcctgagaaccaggtcacagttggcaatgtcagtatttgaacttggcactttcatggagatggtactttgttgacgggaggttggactgctntntggttgcagagttgagcntcaggaatccgggatttcatggtcacncaccgagggactnncctntcccatgtttcctgatcacttagacaaattctcaccttttccctnttacagatttgcagataacggaaaggggctgacctttgccaggtttgtaacggctttaat

SEQ ID NO: 1133 - DNA, 548 bp, Mus musculus
  misc_feature (391)..(391): n is a, c, g, or t
gaccgatttattcagactctacattttataagctccgagggtgagcttgcacctattcatgactgaggttcagtgggcctggtggtgaaggtctgtgactgtagcgactgaagaaactgagacagggggatttaaaggtcaaggcggagagtgggctgggaatatagctgaacggtaaagttcttgctgagtacatatgagactctgggctcgatctccaggatagaggaaaaactggggtctgaagcgagagtttatttctttgtgaacttaagtcattttatttacctctgtatgtctccataactttatttacaaatgaatgagaatactaacgtgtgtcagtccttaatatcataccacacccataataagtgctttgtccatagangcaatgttgctggtgacagtggtggccaatttcaggtttgccaaaaccactcatcgcccagaacaagcagtaagcaatccctgcttaaatcaagataacccggggtttcccagcttaaccaggaatgtagtctttcccgccctcttctgtaaatgaa

SEQ ID NO: 1134 - DNA, 310 bp, Mus musculus
  misc_feature (58)..(58): n is a, c, g, or t
  misc_feature (68)..(68): n is a, c, g, or t
  misc_feature (171)..(171): n is a, c, g, or t
  misc_feature (213)..(214): n is a, c, g, or t
  misc_feature (240)..(240): n is a, c, g, or t
  misc_feature (279)..(279): n is a, c, g, or t
  misc_feature (285)..(285): n is a, c, g, or t
cctatgtgaagtagttggagagccatccacagtgaccagctgaaggttaaaaggagancaaatggctnttcacacactggtatctaaggccatgactggcattaggataaatggcagcaatttcaatttcatggttattaggaaccaataattttataatcattattttancctaggaccatatgtagacttcatgttttatttgaattatanncatatattataggcttgtaattattncttgtaatggttcagtttggactgaaatctctgttgagncaattncatttgtgatggcttatggaattaa

SEQ ID NO: 1135 - DNA, 92 bp, Mus musculus
  misc_feature (28)..(28): n is a, c, g, or t
  misc_feature (58)..(58): n is a, c, g, or t
tttttatgaagggtttgacaaccagacnttaccaggtggtaccggtttcatgccagantcaggttaagagcgtacgttttattcctgattgt

SEQ ID NO: 1136 - DNA, 361 bp, Mus musculus
  misc_feature (155)..(155): n is a, c, g, or t
agctcaccttcctactgtgtgggatcacccagcctggctgaaaggaaacggagtgcctgggctaaggagatgctgcccagcggcagactggccctaccttcttcccttggcagctgacttgagaaatctggtttcaatagaacccacagaaaaangtttattccatggtccctgtaattggaaaaacactggttcccaagtttccatggggttttccctgcagctgtactagctgagatcgagtgcctggtctgagctaattacagcttctccccgtcaggaaattgtgggatttgaaaagaagggaaagagagcctagaggtctcccaagctctccagggctggcagcattctccaggct

SEQ ID NO: 1137 - DNA, 436 bp, Mus musculus
  misc_feature (317)..(317): n is a, c, g, or t
ttcggccacctggatatgcacagtggtggccagtcaggacctatgcatggctttggcttcgggttgcccacgtccagggcatatgcagagtatcttggtggctccctgcagctgcagtccctgcagggcattggcacggatgtctacctacggctccgccacattgatggtcgggaggaaagcttcagaatctaatggtggattttggccggctagcctgccacactcctcggaggacctcctaggcctggcagggggccgctgggctcgcacagactgccacttcgctttatggagcttaaggggccccttcaganacaggtggacttagatggagctgggcaccactcctcctcagcagggctcactgctttctacctcccggccttggggggaggaagcaggtgcctctgaggcctctgataccagctctgct

SEQ ID NO: 1138 - DNA, 445 bp, Mus musculus
  misc_feature (150)..(150): n is a, c, g, or t
  misc_feature (154)..(154): n is a, c, g, or t
  misc_feature (380)..(380): n is a, c, g, or t
gtcttacagttcagtccactagctagaagtgagcactctgagattctcccaagagtctaataaaacccccctccccatcttgggtggatatatgcaagccttgccagatagcagtgagctagtttcatatgactacctgcctgcctaggncagnctctctctataccctgcaaattgactgtggatgcccaaggttctgcttatggcagaaaggtccagcaaagcccagctttgtggtacccagacagtgagaagccccaagaaagaagaaactgagagcaaagctaagtatttgagggggaagaatgttacatttaaaaaaaaaacaacaagtttttgtataattaagtgtcttcacaagtagcccagggctatagccnaggcttacagtgattctgtgtttgagtcatgagtcacactacatgcccctgtgtaattggtgaca

SEQ ID NO: 1139 - DNA, 231 bp, Mus musculus
gtgttcccatttctcactggcatagcaagggtgcggggcataaggcgacttgtctcaggagctgtcacaggatttattactgtgacttgaaaaatctgtcttctatatactaaaggtataaataatcctatctgtctttgctgttacgttggtcactgtaaacctgtcaaatcatagtatgccaagtatctgtctatgataatttttgaatattttgaatctcccgttcct

SEQ ID NO: 1140 - DNA, 564 bp, Mus musculus
  misc_feature (452)..(452): n is a, c, g, or t
aagaatgccgcatcaccgagtgggtcagcgtctgcaagtgagcagacccaagctcctctgggtctcaagaatggttgtcctcttggtgcctggcttctgccgctagcggatctgagccaggcagcaagcagcagccttggctcctgagagaggtggttggctcttacagccccgagggtctacaatcaccagacagtccagatctgattgacattcctccgctcacctctgtaggttcccctctttctgttcctagctcagacagctgggggtgatagtggagactgttccacaccctaggacaggtcaccaaagcagcccagcctggcatgcctacctcctgtcatctcttcttcccttccccaggagtgataggcaatgcactgaagctgatgggcaccggggaagaaaactaaaaggcagaaatggccgtcatcgggctgaagtgactntaagggctccagacctctgctcctgtctttcacttaacagatatttatttttgcgctctctttgagacactctctggggaaaaagaagctccggagtctacaggctgattaa

SEQ ID NO: 1141 - DNA, 432 bp, Mus musculus
  misc_feature (27)..(28): n is a, c, g, or t
  misc_feature (331)..(331): n is a, c, g, or t
  misc_feature (333)..(333): n is a, c, g, or t
  misc_feature (363)..(363): n is a, c, g, or t
  misc_feature (366)..(366): n is a, c, g, or t
tcaccgctgctcaagatggccagaggnngcgttatcctgctaggctggctcctgttggttgtgaccctgtcagccactctgggacttgggatgcctgcaaaggagaagagaggttggaccctgaacagcgctggctaccttctgggcccacatgccattgacaaccacagatcatttagcgacaagcatggcctcacaggcaagagggagttacaactggaggtggaggaaaggagaccaggaagtgttgatgtgcccctgcctgagagcaacattgtccgcactataatggagtttctcagtttcttgcaccttaaagaggccggggccntngacagcctgcctggcatccccttggccacntcntcagaagacctagagaagtcctgagaccatgtccactgtgcacgtgtgtcctgtgctgtaatttaa

SEQ ID NO: 1142 - DNA, 176 bp, Mus musculus
ctgtgatcaactgtgcagacaacacaggagctaaaaacttgtatatcatctctgtgaagggaatcaagggacggctgaacagacttcctgctgctggtgttggggacatggtgatggccacagttaagaaaggcaaaccagaactaaggaaaaaggtacatccagcagtggtaatt

SEQ ID NO: 1143 - DNA, 453 bp, Mus musculus
  misc_feature (38)..(38): n is a, c, g, or t
  misc_feature (51)..(51): n is a, c, g, or t
  misc_feature (53)..(53): n is a, c, g, or t
ctttccgggcgttcaagatgtcgaagcgaggacgcggntgggtcctccggngngcgaaattccggatttccctgggtcttccggtcggagctgtgatcaactgtgcagacaacacaggagctaaaaacttgtatatcatctctgtgaagggaatcaagggacggctgaacagacttcctgctgctggtgttggggacatggtgatggccacagttaagaaaggcaaaccagaactaaggaaaaaggtacatccagcagtggtaattcgacaacgaaagtcatatcgaagaaaagatggggtgtttctttactttgaagataacgcaggggtcatagtaaacaataaaggagagatgaaaggctctgctatcacaggtccagtggcaaaggagtgtgcagacttgtggcccagaattgcatccaacgcaggcagcattgcatgattctccagtg

SEQ ID NO: 1144 - DNA, 125 bp, Mus musculus
tagcacgcctgctggcccgggttcagtctcctgccccacgaagccgggcggataactgagctctctgcttttaaccctgattatggaccaggctgggtctttccactaacctgaggctgaggtag

SEQ ID NO: 1145 - DNA, 455 bp, Mus musculus
  misc_feature (131)..(134): n is a, c, g, or t
  misc_feature (277)..(277): n is a, c, g, or t
  misc_feature (345)..(345): n is a, c, g, or t
  misc_feature (356)..(356): n is a, c, g, or t
  misc_feature (382)..(382): n is a, c, g, or t
  misc_feature (424)..(427): n is a, c, g, or t
tgctgccatccatgtactggttacaggaagcctgcacctggtgggcggggttctgaaactgctggatccctctatgtcccagtagccaaggaccatcctacatcggtctgcctttccacagactcttatannnnctcagtgccttgtgatttctgctctcagattttttcggactggcccagggtcctgggctcttggtagagtgtagggatgggagaggctctctgtacctcggcctctccttcctctggcagagacagcagggtgcttcccagantccccaccatcgtagcaggctttcagcctggcccatctccctgctgcctccaggctcaggtccagctnactgttgcagnctgcctgagcagcctggatcctgccntgaggttagaccagagacctcctcctccctcccaatgctttnnnngcaaaagagagggcccttgcctggcatt

SEQ ID NO: 1146 - DNA, 457 bp, Mus musculus
  misc_feature (430)..(430): n is a, c, g, or t
tgaggtgtctgtctgcaaactgcatgcactgcgttcacccacgtacagctgggatgagaactgtcagtgtggaagggcctactgttaaagccctgagtgagctaggtaggtgactgttgtgcccttcattgcctttggctaaagactgtccacatgtctgtccaggcacatgacaggtgtgagggcctcagcgttgggttcttcatctgtctttctcgtttgtccctaattgctcggtagcaacctagaagactggactctgcccagggtggctctttgtgaaagtggtttattctggccaccggagaaagatggctgaacagtggcaccagtctgcttcatgctgcacagaacaccgtcttaagtaaggtggccaaaagaggttgctgcagcaagtgcaactctgccagggccatggccaggggctccnatgaactgagactcttcattctgttta

SEQ ID NO: 1147 - DNA, 505 bp, Mus musculus
  misc_feature (26)..(28): n is a, c, g, or t
cagttttcagattcacctgtgcgtgnnncccccactcccatcccaccctgttctttccatagaacttttgatatcaggcaaacggtttcctttttgagatattttaacagagaaggggtgggggagaagcagatgaagctgtactacccagccctcttcttgtttgtatttgtttagggttgtgaggttgtgtaaaatagtactagcttcttacttgagaactacagtttctgcttatcatttattcttccttgtggcacttaatattttaattgtcttaagctttttgatgtatatatcctctggccccttacatgctgccagaggagaaggtgtttgtttgagattcattccacttgaagtgtctcctgggatccccacagctgcgtatggctgggaaatggacttaaggcttgggcttgaattggtggctcctacctgtgaggtcccatcgtgagtcactgggatttgtgttgcatggaaggcagtctttcctgttgtaaat

SEQ ID NO: 1148 - DNA, 219 bp, Mus musculus
gttgggagagtgattatgcagttttcttctgtcttgactgtttcctgcgactgtctttgtttttaactctgaacatgttctctaactctgtgctaccacatttctgtgtgtgaagtcatgcagccagtgtatcagccctttgtacttagaagtgtggcccctcctctctagcctcttctccaccattgaacattgcacataggattacgaagtgttcag

SEQ ID NO: 1149 - DNA, 209 bp, Mus musculus
  misc_feature (38)..(38): n is a, c, g, or t
  misc_feature (125)..(125): n is a, c, g, or t
  misc_feature (157)..(157): n is a, c, g, or t
  misc_feature (162)..(162): n is a, c, g, or t
taccctgggcagactcccaagtctgctgtccctcctgnattttaaagggctcatccttagtgacccaggtgccgtgtcttggtgtcagttctccttgcttctgctttcttgctgcctgtaatcantgtggccacagacattcctgcctaaacttaanccctnctgtgagcaaaaggtactgtgagttccttgagaaataggtactgtac

SEQ ID NO: 1150 - DNA, 359 bp, Mus musculus
  misc_feature (179)..(179): n is a, c, g, or t
  misc_feature (181)..(181): n is a, c, g, or t
  misc_feature (243)..(243): n is a, c, g, or t
  misc_feature (245)..(245): n is a, c, g, or t
aatggtgacatcaagtttctgactaaaggagataataatgaagtcgatgatagaggcttgtacaaagaaggccagaactggctggagaagaaggacgtggtaggaagagctcgagggttcttaccttatgttggcatggtcaccatcataatgaatgactatccaaaattcaagtatgntnttttggctgtgatgggtgcatatgtgttactaaaacgtgaatcctaacatgagaagcagttncntgggaccagaccgaaatgagttctgttgaaaaagagaaaagctaatatatttgaaatgttccactttctgtataaagagaaaccaggtggggatgtttttgtcttatctaaata

SEQ ID NO: 1151 - DNA, 383 bp, Mus musculus
  misc_feature (43)..(43): n is a, c, g, or t
  misc_feature (95)..(95): n is a, c, g, or t
  misc_feature (133)..(133): n is a, c, g, or t
  misc_feature (206)..(219): n is a, c, g, or t
ccttggtccaggtttcgacagagaactcgctcttgggtccgcncggtcctcttgcgctaattgcgggtcctacagggtccacatgtgcgctctgngtctcttaggacagtaaccagagccgcggcggcccacnggtcagccgcgtagacgggagcggagaggagataagatggcggcccagctacgcagacaccaggggcggcgannnnnnnnnnnnnntgacgacctccctacgagaacatgcctctcgcaaaggatctccttcatccctctccagaagaggagaagaggaaacacaagaaaaagcgcctggtgcagagccccaattcctactttatggacgtgaaatgcccaggatgctataaaatcaccacggtctttag

SEQ ID NO: 1152 - DNA, 331 bp, Mus musculus
  misc_feature (92)..(92): n is a, c, g, or t
  misc_feature (109)..(109): n is a, c, g, or t
  misc_feature (123)..(123): n is a, c, g, or t
  misc_feature (148)..(148): n is a, c, g, or t
  misc_feature (231)..(231): n is a, c, g, or t
  misc_feature (291)..(291): n is a, c, g, or t
  misc_feature (294)..(294): n is a, c, g, or t
tcaggcctggccaccggctcatagagccaccactaagtaagaatgtacagactgtgtgaccagaggagacttgggaccagccttgggaccanccttgggactgtttttngtgtaggggctgcntgttctcccattacctccatctganccctcccagagacactgctgggagacttccttcctctaacgtggtgttcaggatgcttccctctgagcttcccatcgctaganccttccctttgggctccttggagtgagatgcaggctcatccatcagcttttacggggagnccngaggggagcggttgcaatgttgagtaaaggcttcctt

SEQ ID NO: 1153 - DNA, 519 bp, Mus musculus
  misc_feature (46)..(46): n is a, c, g, or t
  misc_feature (430)..(436): n is a, c, g, or t
  misc_feature (438)..(438): n is a, c, g, or t
  misc_feature (440)..(442): n is a, c, g, or t
  misc_feature (444)..(445): n is a, c, g, or t
  misc_feature (447)..(448): n is a, c, g, or t
  misc_feature (451)..(452): n is a, c, g, or t
gcaatgttccggatcgagggtctcgcgcccaagttggacccggagnagatgaagcggaagatgcgtgaggatgtggtctcctccattcggaacttcctcatctacgtggccctgctgcgagtcactccatatatcttaaagaagctggatagcatctgaggacgggcagtcaggtggatgcatggcatgaagacctggtgacggcttctcctcctgtctgcagctgaattggcccagaaaggtgtaaggctgattaaacggacatataaactacttgttgagaacaagtaggactttgagaactgacctccatagctgaaatataaagccacttgggaagtgcaaaaagatgtcttgtgttcatggtgcccttaggcccatgaactccacccctgtgagtgttgatggagtggttaataatgtcaggctnnnnnnngngnnntnncnnttnngtttaccacttctgttcaaagtgttatttgtgaagtctgtttggaagtcagcatacacccacaatga

SEQ ID NO: 1154 - DNA, 557 bp, Mus musculus
  misc_feature (427)..(427): n is a, c, g, or t
  misc_feature (429)..(429): n is a, c, g, or t
  misc_feature (449)..(449): n is a, c, g, or t
  misc_feature (517)..(517): n is a, c, g, or t
agtaaactggcgcttcctgcctgaaaccatcttcctgcatcgtgccttccatctagccctgttggctgcccaccttagcctcctcttgctgtttgccctctgtaggtggcacagaacaggggaaagtattctggcactgctgaaggatccttccaaaaggaaagttccaccccaagccctcacacctaaccagattgtttccatcctcttcacctccaacttcattggcatctgctttagccgctcgctccactaccagttttatgtctggtatttccacacactgccctacctcctgtgggccatgcctgcacgctggctcacacacctgctcaggttgctggtgctgggactcattgagctctcctggaatacgtacccatccacgtccttcagctctgccgccctccacctgtgccacgctgtncntcctgctgcagctctggctntcccccgagtccttccctaagagcattcagccaagcaggaaaactcactgaaacccaccccttccttntaggacgtgctcagcatcatgggtggaacggactctgtgt

SEQ ID NO: 1155 - DNA, 140 bp, Mus musculus
  misc_feature (28)..(28): n is a, c, g, or t
  misc_feature (44)..(44): n is a, c, g, or t
  misc_feature (57)..(57): n is a, c, g, or t
tttccaagaagataacaatgtgaggaanccctttctattttatngacttcccctccntggctgctgggtctgtggtcgatcctgctgtgactctcccctccacaccccacccaccaaggaattgcagacggtcctctcgg

SEQ ID NO: 1156 - DNA, 185 bp, Mus musculus
acagctctgaggtggctagagagccaggatcccagagaagtggggccgctgaggcttgtgcagctacgttctctcattaccatggcacggaggcttgggggtattgggccctcagctgtaacttctgatgatggtgtgtgactaccttggcccagtggtctttttcctgcctcactgggagagag

SEQ ID NO: 1157 - DNA, 98 bp, Mus musculus
tcatgaccaagaaggcaacgttggggaggaacagggtgtatttaagcttacacttggcacagtgctgttcaatcaccaacaggagagtcagggaccag

SEQ ID NO: 1158 - DNA, 521 bp, Mus musculus
  misc_feature (262)..(262): n is a, c, g, or t
  misc_feature (404)..(404): n is a, c, g, or t
ttttaataactcctccgctaatgggatcttggggatgtcttcctcatttatgctggagtttttactggcttactcttgtgcaggtcttgcactggtgtccacaggtgctgtgagctgatgtgtttggctgccgtgtgtggcgtatccagaagccaacatctcccagctctgccgacaactcttacattctctctgttcactcttctgtgctgttccctgagcctgggacggaggaggctcaggcaggtgagtgattcatccncagctgagcctgagagttcatcatccttggcactggcaggggagcctgcattcactactgctcactgcataaaccaagaaagtggagagcactgcggatctacgcggttggcgttgtggcctcttggttgattttttttttnccctttaatgagtgtggagtggccttccttatctgactatatttggtttgatgtcattttgtcaaatattagaatagctgtgcctgtatgttttttagttgcatttccctggagttc

SEQ ID NO: 1159 - DNA, 505 bp, Mus musculus
tgcgcttcctacagggactttgagtctaacaaatgcttcccctgcccagatcaaggctgcccacagatgggtcactatgctgataagtttgccaacaatacaagtgtggagccacagaagttcttcctgaacacaggagaagccaagaactttgcacgctggaggtaccgtgtttccttgacattctctggaaggacggtcacaggccaagtcaaagtgtctctgtttggaagtaacggcaatactcgccagtgtgatatcttcaggggaattatcaagcccggtgctacgcattccaatgagtttgatgccaagcttgatgtgggaacaattgagaaagtcaagtttctttggaataaccacgtggtaaacccaagtttccccaaagtgggcgcagccaagatcactgtgcaaaagggggaggagcggacagagcacaacttctgtagtgaagagaccgtgagagaagacatcctgctcactctcttgccttgtaaaacctcag

SEQ ID NO: 1160 - DNA, 300 bp, Mus musculus
  misc_feature (257)..(257): n is a, c, g, or t
aaaaggagtgcccagctcctttcctcatttcaaagttgctaccagtgtatgcagtaattagacaaagaagaaattcagtagaccattttattgcctagttgacaacattgcttgaatgctggtggttctatccctttgacactacacagttttctaatatgtgttaatgctacgtgatgagatgccctggttcctagtgccaaaggttcaacttaatgtatatacctggaaacccatgcatttgtgctttttttttnttttatggtgcttgacgtctgtaaacagcccatcctctgcaag

SEQ ID NO: 1161 - DNA, 396 bp, Mus musculus
ccagctttaccagacaccatggagaaggtccttgttcttctgcttgtgtccctccttgcagtggcctatgcagctcccggaccccggggtcttattatcaacctggaggacggtgagatctgtttgaacagtatgcagtgtaagagcagatgctgccaacatgacaccatcctgggcatttgcccgttgcacacacaaggccatggagaacagcgagtgctccccaaagaccctctatgggatctactaccggtgtccctgtgagcggggcctgacctgtgagggggacaggagcatcatcggcgccatcaccaacaccaactatggcatctgcctcgactccaggcgctccaagcagtgagatcacgcagttagctgggttataccttcttctct

SEQ ID NO: 1162 - DNA, 463 bp, Mus musculus
  misc_feature (419)..(419): n is a, c, g, or t
ttaagcccaggcagggacttgctcattctaggcaagtgctctaccactgagcgggagtcacccctacttcctggatagtaggcttttttagttgtgtgttttgttttgagacagtgtctcactttgtagctgtggctatcctggaactcaatcagtagatgcccagagatgatgtgcctgcctctgccgtccaatgctgggattgaaggtgtgcacagccacaccagcttaaggttttgttaaagaagacgataggtatggctggattatatagtcttcaggttcacatgaacttggctgtattctgataacattgagaccgttttccaccaagttagcctcatttgttcagtaacacatcttaccgaggaaaggaggcaaggaagtgcccttttgtgtctcctcattgttcacagccntgttggtctcgaacactcaacatatgattgctcgatcactttag

SEQ ID NO: 1163 - DNA, 343 bp, Mus musculus
gagcagtgtaaacctcacagggctttggatcccctcggacccccttggacacagaggagaaggaagggaaggagtgggtcgggatgcacaggaatctttcctgtatcggaccaggaaagaaagctggctgtgggtctgtagggtcatgactgttgtctgcctcttttcaccctgtaagtgaatccctgaacttggttccctctgaagccagtcttggttaactaattctattttactataactttaaaagtgaaagatattctctaaatttatagcaggtgccttatttcctttgaatcaaatcattccataccagaatttcccttggtttactatagataat

SEQ ID NO: 1164 - DNA, 175 bp, Mus musculus
  misc_feature (116)..(116): n is a, c, g, or t
  misc_feature (123)..(123): n is a, c, g, or t
  misc_feature (148)..(148): n is a, c, g, or t
tggcttttcccagtctgttcacatcagaggtagaccctaagggacgcatctaccatcagagacaatggaaagtcctggctgccggaacgcctcagtgaggtaaagtctcttggcgnttttganctgggaccagcccagccattctcancctctcgacatgtaatttcatttcttt

SEQ ID NO: 1165 - DNA, 49 bp, Mus musculus
ggcagcattacacccgtcaaatatgaatacccagatgagctccagtgtg

SEQ ID NO: 1166 - DNA, 341 bp, Mus musculus
  misc_feature (69)..(69): n is a, c, g, or t
  misc_feature (73)..(74): n is a, c, g, or t
  misc_feature (82)..(82): n is a, c, g, or t
  misc_feature (90)..(90): n is a, c, g, or t
  misc_feature (96)..(96): n is a, c, g, or t
  misc_feature (187)..(187): n is a, c, g, or t
  misc_feature (202)..(202): n is a, c, g, or t
  misc_feature (260)..(262): n is a, c, g, or t
ggcagcattacacccgtcaaatatgaatacccagatgagctccagtgtgtgaacctcaagctcctgccntaanngaggactngtgccaanagcccnacatagagaaggtgacagatgacatgttgtgtgcaggagatatggatggaggcaaagacacttgtgcgggtgactcaggaggcccactgantctgtgatggtgttntccaaggtatcacatcatggggccctagcccttgcggtaaacccaatgtgccgggtannntctacaccagagttttaaatttcaacacctggataagagaaactatggctgaaaatgacttgagtatcacattgtccca

SEQ ID NO: 1167 - DNA, 194 bp, Mus musculus
  misc_feature (96)..(96): n is a, c, g, or t
acaataatgtggctcctgtctttcttcctgggaggcaggagttggttgtgtctgcccctttgctccttgtctgtgaattgctgttgacacacacanctagtgggcaaaggccagggcatgtcacaacctggatttccttcacctttaatgaggcacaagaagggacttctcaactggccagttgaagcttagct

SEQ ID NO: 1168 - DNA, 446 bp, Mus musculus
gaatgagtccagcatctttcacatcccaagacctgtaagcctcaacatgacagtgaagggccagaatgaagaccctggctccctccttacccagttccggcggctgagtgaccttcggggtaaggagcgctctctgttgcacggtgacttccatgcactgtcttcctcacctgacctcttctcctacatacgacactgggaccagaatgagcgttacctggtggtgctcaacttccgagattcgggccggtcagccaggctaggggcctccaacctccctgctggcataagcctgccagccagcgctaaacttttgcttagtaccgacagtgcccggcaaagccgtgaggaggacacctccctgaagctggaaaacctgagcctgaatccttatgagggcttgctgttacagttcccctttgtggcctgatccttcctatgcagaa

SEQ ID NO: 1169 - DNA, 229 bp, Mus musculus
  misc_feature (26)..(26): n is a, c, g, or t
  misc_feature (203)..(204): n is a, c, g, or t
gtcgcgccaaaaagggccgcggccantgtgcagcccattcgctgcacgaactgcgcccggtgcgtgcccaaggataaggccatcaagaagtttgtcattcggaacattgtagaagccgctgctgtcagggacatatctgaagcaagcgtcttcgacgcctacgtgcttcccaagctctatgtcaagctgcattattgcgtganntgtgccatccatagcaaggttgtta

SEQ ID NO: 1170 - DNA, 72 bp, Mus musculus
gggcttgtctgtgaagacgaccatggtgtgcgccggcggcgatatccagtctggctgcaacggtgactctgg

SEQ ID NO: 1171 - DNA, 206 bp, Mus musculus
  misc_feature (81)..(81): n is a, c, g, or t
atgtgtgtgagctgtggcaatgacatcgccctggtcaagctctcaagaagtgcccagctgggagatgcagtccagcttgcntgcctccctcctgctggtgaaatcctacccaacggagcaccctgttacatcagcggctggggccggctctccaccaatggacctctgccagacaagctgcagcaggccttgctgcctgtggtgga

SEQ ID NO: 1172 - DNA, 292 bp, Mus musculus
gctcctggaagtattcagcacagagttccagatgcggctcctctggggcagccagggtgccaacagcagccaggcctggcgctatgagaagtttgacaaagtcctcactgccttgtcccacaagctggaacctgccatccgctctagcgagctgtgaccccggagatctcgcctctctgcagctgcgggcagcattcggcggcagaggggctcaggacattccctccagagcaccacagggacactgtgatcagcccaagaatgttctgggttcaaatccaggatctccctt

SEQ ID NO: 1173 - DNA, 390 bp, Mus musculus
  misc_feature (337)..(337): n is a, c, g, or t
tcttgcccatgatgcgcccattgttcaccaggagacttttgccccaatcctctatgtcttcaaattccaggatgaagaagaggtctttgaatggaacaatgaagtaaaacagggactttcaagtagtatctttaccaaagatttgggcagaatcttccgctggcttggacctaaaggttccgactgtggcatcgtgaacgtcaatattcctaccagcggggctgagattggtggtgcgtttggcggagagaagcacactggcggtggccgggagtctggcagcgacgcctggaagcagtacatgaggagatccacatgtaccatcaactacagcacntccctccctctggctcagggaatcaagtttcagtgatactgcgtgggcttggc

SEQ ID NO: 1174 - DNA, 522 bp, Mus musculus
  misc_feature (261)..(261): n is a, c, g, or t
  misc_feature (282)..(282): n is a, c, g, or t
  misc_feature (289)..(293): n is a, c, g, or t
  misc_feature (299)..(299): n is a, c, g, or t
  misc_feature (301)..(301): n is a, c, g, or t
  misc_feature (357)..(357): n is a, c, g, or t
  misc_feature (366)..(366): n is a, c, g, or t
  misc_feature (458)..(458): n is a, c, g, or t
  misc_feature (480)..(482): n is a, c, g, or t
atgcctacagctcctattgttactacttcactgaagaccgtttaacttgggctgatgcagatcttttttgccagaacatgaattcaggctacctggtgtcagttctcagtcaggctgagggcaactttgtggcctctctgattaaggagagtggcactacagacgccaatgtctggactggactccatgatcccaaaaggaatcgtcgctggcactggagcagtgggtctctgtttctctacaaatcctgggcaactgggntctcctaacagttccaatcgntggctannnnntgtatntntgacttcaaacacaggatacaagaaatggaaggatgacaactgtgatgcccaatantcatttgtntgcaagttcaaaggctgaagtcacctgaaaaaaaatagtcatataaagcaaaattgaaattactatagtgtcagaaattaaattggaccatntatcaaaagcaaattagatccnnntcttcctggagagacattcttgcttcactgtcctatggta

SEQ ID NO: 1175 - DNA, 239 bp, Mus musculus
  misc_feature (134)..(142): n is a, c, g, or t
  misc_feature (144)..(144): n is a, c, g, or t
gcatctctcgggacaactggcacaagcgccgcaagaccgggggtaagcgaaaaccctaccacaagaagcgaaagtatgagctgggacggcccgctgccaacacgaagattggccctcgccgcatacacacagtnnnnnnnnntncgaggaggcaataagaagtaccgtgccctgagattggatgtggggaacttttcctggggctctgagtgttgtactcgcaaaacaaggatcattga

SEQ ID NO: 1176 - DNA, 454 bp, Mus musculus
  misc_feature (144)..(144): n is a, c, g, or t
  misc_feature (274)..(274): n is a, c, g, or t
  misc_feature (348)..(348): n is a, c, g, or t
  misc_feature (381)..(381): n is a, c, g, or t
  misc_feature (385)..(385): n is a, c, g, or t
  misc_feature (422)..(422): n is a, c, g, or t
  misc_feature (427)..(427): n is a, c, g, or t
  misc_feature (429)..(429): n is a, c, g, or t
ttatcagcaccagagacagcagatgctgtgcctggagcggcataaggaacctccaaaggaactagagtcagcttcctccgatgaggaaaatgaagatggcgacttcactgtgtatgaatgcccaggcctggcgccaacaggggnagatggaggtgcgcaacccactgtttgaccattccacgctgtcagcaccagtgcctggtccccattccttgccgccgctgcagtgactcctaggcccacatgcctgcagcccacagcccaccagtggggnacgagcgagtcctggtgttccccatggaaaagagcagcattgtgacccccgcatgcttttggcaggagggaggncgccacccctggactcccttgccagggagattntccngccttatgtgggagatctagcatctgcttgcacattnctctntntggtatgaaccctcaaactggagat

SEQ ID NO: 1177 - DNA, 102 bp, Mus musculus
ccctggtttttataactatggtgcgatcagtaaggattcctgtaatactgctttaaagatgctgctcagagggcgggcggcctccattataggacacctgta

SEQ ID NO: 1178 - DNA, 344 bp, Mus musculus
  misc_feature (34)..(40): n is a, c, g, or t
  misc_feature (42)..(43): n is a, c, g, or t
  misc_feature (45)..(45): n is a, c, g, or t
  misc_feature (47)..(47): n is a, c, g, or t
  misc_feature (185)..(187): n is a, c, g, or t
  misc_feature (189)..(190): n is a, c, g, or t
  misc_feature (287)..(287): n is a, c, g, or t
ggctgcattgttatttcctaaagcatatatttannnnnnntnntnantttctgaagagaagcaccctgtatagttcttctggcttttgcacccagatcttcgacaatgaaggtggctgtcatctttcttctcagtgctttggccctgctgagtttagcaggtaacactttttcagctaaggtgannngnnaaagaggctagttgccatgatgcagtggcgggatgtcccagaatttatgatcctgtgtgtgggactgacggaattacttatgccaatgaatgtgttntgtgctttgaaaacaggaaacgcatagagcctgtcctcattcgaaaaggtgggcctt

SEQ ID NO: 1179 - DNA, 90 bp, Mus musculus
tgaattcccactttgtggccatatggtgtcagatgaatatgagcaactctcttctgaagcactggaggctgcccgtatttgtgccaacaa

SEQ ID NO: 1180 - DNA, 279 bp, Mus musculus
gtgcctttgggaagccccagggcacagtggccagggttcacattggccaggtcatcatgtccatccgaaccaagttgcagaacaaggaacatgtgattgaggctctgcgaagagccaagttcaagttccctggccgccagaagatccacatctcaaagaagtggggcttcaccaagtttaatgcagatgaatttgaagacatggttgctgagaagcggctcattcctgatggctgtggtgtcaaatatatccccaatcgtggtcctctggacaagtgga

SEQ ID NO: 1181 - DNA, 473 bp, Mus musculus
  misc_feature (147)..(148): n is a, c, g, or t
  misc_feature (152)..(152): n is a, c, g, or t
  misc_feature (158)..(161): n is a, c, g, or t
  misc_feature (201)..(201): n is a, c, g, or t
  misc_feature (204)..(204): n is a, c, g, or t
  misc_feature (220)..(220): n is a, c, g, or t
  misc_feature (225)..(225): n is a, c, g, or t
  misc_feature (295)..(295): n is a, c, g, or t
tcaagcatcccaacttcaatagcaggaccctgaacaacgacatcatgctgatcaaactggcttcccctgtgaccctcaatgccagagtggccactgtggctctgcccagctcctgtgcacctgcaggcactcagtgtctcatctctnnggcntggggnnnncaacaccttgagctttggtgtgaacaacccagacctgctncantgcctggatgccccantgctncctcaggctgactgtgaggcctccttatcctggaaagatcaccaataacatgatctgtgttggcttcctngagggaggcaaagattcctgccagggtgactctggtggccctgtggtctgcaatggacagctccagggcattgtctcctggggctatggctgtgccctgaaggacaaccctggtgtgtacaccaaggtctgcaactatgtggactggattcaaaacaccattgctgcaaactaagcat

SEQ ID NO: 1182 - DNA, 360 bp, Mus musculus
aggaaagctggcaacttctatgtgcccgcagaaccaaaattggcctttgtcatcagaatccgaggtatcaatggagtgagcccaaaggtgcgcaaggtgctgcagctgctccgtctgcggcagatcttcaatggcacctttgtgaagctcaacaaggcttcaattaacatgctgcggattgtggagccatacattgcatgggggtaccccaacctgaagtcagtaaacgagctcatctacaagcgaggctacggcaaaatcaacaagaagcggattgccttgacagataattccttgattgctcgatctcttggtaagtttggcatcatctgcatggaggatctaattcatgagatctat

SEQ ID NO: 1183 - DNA, 421 bp, Mus musculus
tggcaacttctatgtgcccgcagaaccaaagctggcctttgtcatcagaattcgaggtatcaatggagtaagcccaaaggttcgtaaggttctgcagctccttcgtcttcgacagatcttcaatggcacctttgttaagctcaacaaggcttcaattaacatgctgcggattgtggagccatacattgcatgggggtaccccaacctgaagtcagtaaacgagctcatctacaagcgaggctacggcaaaatcaacaagaagcggattgccttgacagataattccttgattgctcggtctcttggtaagtttggcatcatctgcatggaggatctaattcatgagatctatacagtcgggaaacgcttcaaggaagcaaataacttcctgtggcccttcaagttatcttccccacgaggt

SEQ ID NO: 1184 - DNA, 232 bp, Mus musculus
aattaggtatccaaggacaaccttgaatttctcagcccactacctaggcttggattacacagtgctgaggatcaaacccagggctttgtgttgtgctaggcaagcactctaacaactgagctacatccccagccctacatattttagactccagagtcttctgttgagcaaccaagggacaacctaaaacaacttctccagtgagtgcagggaaatagcaatacaaagtgtc

SEQ ID NO: 1185 - DNA, 500 bp, Mus musculus
  misc_feature (334)..(334): n is a, c, g, or t
  misc_feature (338)..(338): n is a, c, g, or t
  misc_feature (395)..(395): n is a, c, g, or t
  misc_feature (399)..(400): n is a, c, g, or t
tgagacagcttgtcgtcctatagcccaagctggcctcaaattaggtatccaaggacaaccttgaatttctcagcccactacctaggcttggattacacagtgctgaggatcaaacccagggctttgtgttgtgctaggcaagcactctaacaactgagctacatccccagccctacatattttagactccagagtcttctgttgagcaaccaagggacaacctaaaacaacttctccagtgagtgcagggaaatagcaatacaaagtgtccattgctgcagtgcaatactcatttgttggatacaaaggacattatccacattttactaatatnccanaactggaattatgaggaaggtggattacaatgaacagggcaggcagaacaggaaaanttannaagtatttgacaagactttagaactttaaataataggtctgattaatttgcagacaatgatagaaagtttgttttgactgatacccattaggctttctaa

SEQ ID NO: 1186 - DNA, 533 bp, Mus musculus
  misc_feature (308)..(308): n is a, c, g, or t
  misc_feature (311)..(312): n is a, c, g, or t
  misc_feature (323)..(323): n is a, c, g, or t
  misc_feature (343)..(343): n is a, c, g, or t
  misc_feature (378)..(378): n is a, c, g, or t
  misc_feature (380)..(380): n is a, c, g, or t
  misc_feature (429)..(429): n is a, c, g, or t
  misc_feature (458)..(458): n is a, c, g, or t
ttttgcaatagttgccgcctaacctcatgcacacctgtatactgtatgcacatgcacatgtacacattagaacagaggcctgcacctttaagccgaatcccataacatgaagacatcaggctacacttgagcatcgttaagctgttttagctatggcctatttcatgactggtcctggctccaccatgtacttggtcaggcatgcagtggtgaactaagtaacgtggtgtgaaacttcctaacaggttataaagagatttctcatttggggggttttctcaagtaggtgacctgaaggctgctccctnaannacatccctctntcccccaccttccatccctntcctggggactgagcagttgctcttgcctggcctntntgcctcattccatccctttatgaaggcctctccaggctttaaaggaaancctgaccttcaaggccacatcctgcttancccttcctgactgtattcttcctgcctaataccctccccttctactcccaggcctggtcatagcctggaagccat

SEQ ID NO: 1187 - DNA, 166 bp, Mus musculus
ttcgaccccaacgaggtcaaagtcgtgtacctgaggtgcaccggaggcgaggtcggcgccacatccgccttggccccgaagatcggtcctctgggtctgtctccgaagaaagttggcgatgacattgccaaggctaccggtgactggaagggtctcagaattacag

SEQ ID NO: 1188 - DNA, 381 bp, Mus musculus
  misc_feature (292)..(292): n is a, c, g, or t
  misc_feature (300)..(300): n is a, c, g, or t
  misc_feature (302)..(302): n is a, c, g, or t
  misc_feature (316)..(316): n is a, c, g, or t
atagtagctcccagaggaagcaagccatgctgggaaaaaggaagtgggtcaaaaaagcgtagggctgcactgtgatgtgaggaccgccatatgcaagaggcctttgagggtccaggaggatggccaccctcgctctaggccgtaatgcatgtgcttaaatgcaagacaaatggagccatagccagccgtacccagcctggctcaccctcctccagacaccagacaccagcctcctggttgtggtgagaggagaagggaacaggtctggtggatgccaagcaactagttagtncctcccantnctgacctagatttncattcctcatcaggactagaaattagtaccaattgaactagcttgttttgacaggtctatttcac

SEQ ID NO: 1189 - DNA, 270 bp, Mus musculus
gctatggagacttccgcgctgatgacgctgatgagtttggctacagtcgcgtaaggagaacttgcctggcccccagcaccgctgatgccagaccttctcccgctgccaggaagctgttgtcgactccagacctggttgagggagtatagattgggtctagcttgcttcagtgtacagaaacctcctctgtcgtggctagcattgaagctggggtggagaacccgaggttagttgggggcagacccgcacagtggtaatgccgtccagtct

SEQ ID NO: 1190 - DNA, 434 bp, Mus musculus
  misc_feature (49)..(49): n is a, c, g, or t
  misc_feature (240)..(240): n is a, c, g, or t
  misc_feature (282)..(282): n is a, c, g, or t
  misc_feature (306)..(306): n is a, c, g, or t
  misc_feature (357)..(357): n is a, c, g, or t
  misc_feature (359)..(359): n is a, c, g, or t
  misc_feature (381)..(381): n is a, c, g, or t
  misc_feature (383)..(383): n is a, c, g, or t
acccctgttcctcctatgagaagttccagcacaatgactgcttcccttntccagaacaagggtgtcccaaaatggggcactatgctgatcaatttgaggggaaaactgctactgtggaacaaacctttttcctgaatacaggagacagtggtaactttactcgttggagatacaaagtatcagtcacactatcaggagcaaagaagctgagtgggtacatcttggtcgctctgtacggangtaacggaaactcaaagcagtatgaagttttcaaaggatccntccaaccagaagcaagatatattngtgacattgatgtggacgtcaacgttggagaaatccagaaggttaagttcntntggaacaacaaggtgataaatntnttccggcccactatgggagcttcacaaatcacagtgcaacgcggtaaagac

SEQ ID NO: 1191 - DNA, 487 bp, Mus musculus
  misc_feature (185)..(185): n is a, c, g, or t
  misc_feature (226)..(226): n is a, c, g, or t
gtttatcatggcttatagtgtcagagggttatatgagagtctgtcatagtatgaagatacagcagcagatgagcacagcagctggagaccaccacatcttcaactgctagcatgaggcagagagtgaactgggtagggtgagcactatacctgtggttttctaccttcctaatgctgcaaccctntttatagttccttatgttgtggtgaactgcccccccccccnatacaattatttttgtgtgtgtaattttgctactggtatgaattgcaatgtaaatatttttgaagatagaggtttgccagaggggtcacgaccctcaggttgtgagagcaccactgctctaatctatcaatgcctactggccctgcggtacacgtccttcaggaaggctgtgtcacccaactcttcccaaatggtgccaccaactgaagaccaagtgttcaaatacccgaatctatggagaatttttctcatccaatcccc

SEQ ID NO: 1192 - DNA, 236 bp, Mus musculus
tagttgattgctaaactcagtaatgctgtcttaactacgatgctcaatgattaatgacaggtggggggttctcctgtgcttgacccctttcttctgaagccatcaatacgaagaaccgaaccgaaccggcctctcaacagctaacatagggtttggaagcagcattagatcctttgtagcaatctggtctacagactttaactcaagctaagactaaacttgctactttgttgaat

SEQ ID NO: 1193 - DNA, 411 bp, Mus musculus
  misc_feature (303)..(303): n is a, c, g, or t
gagaagtatgccaagtacctgccccacagtgccggacggtatgctgccaagcgcttccgcaaagcacaatgtcccatcgtggagcgccttactaactccatgatgatgcatggtcgtaacaacggcaagaagctcatgactgtgcgaattgtcaagcatgcctttgagatcatccacctgctcactggtgagaaccctctgcaggtcctggtgaatgctatcatcaacagtggcccccgagaagactcaacacgcattgggcgggccggtacagtgagacgacaggctgtggatgtgtccccnactgcgtcgagtgaatcaggccatctggctgctgtgcacaggggctcgtgaggctgctttccggaacatcaagaccatcgccgagtgccttgcagatgagctcattaa

SEQ ID NO: 1194 - DNA, 425 bp, Mus musculus
  misc_feature (208)..(208): n is a, c, g, or t
ggctcatccttatggattcacaagagtaatgtcaagttaccgttggaatagaaatttccagaatggaaaagatcagaatgactggattggaccacccaataacaatggagtaacaaaagaagtgaccattaatgcagacactacttgtggcaatgactgggtctgtgaacacagatggcgtcaaatcaggaacatggttgccttcagnaatgtggtcaatggtcagcctttttcaaactggtgggataataacagcaaccaagtagcttttagcagaggaaacagaggattcattgtctttaacaatgatgactgggctttgtcagccactttacagactggtcttcctgctggcacatactgtgatgtcatctctggagataaggtcgatggcaattgcactggacttagagtgaatgttggca

SEQ ID NO: 1195 - DNA, 453 bp, Mus musculus
  misc_feature (307)..(307): n is a, c, g, or t
  misc_feature (317)..(317): n is a, c, g, or t
aggactccgcagtacaagctgtcatggcggcccgactgttaagcttgtatggtcgctgcctgtcagcagcgggggcgatgagagggctcccggctgctcgcgttcgctgggagtcctccagggctgtaatcgccccatccggtgtggagaaaaagcggcaacgagaaccgaccatgcagtggcaggaggacccagaacccgaggacgaaaacgtctacgcgaagaaccctgactttcatggttatgatagtgaccctgtggtggacgtctggaatatgcgagctgtcttcttctttggtttttccantcgtcctggntctttgggaccaccttcgtggcttatgtgcctgattacaggatgcaagagtgggcccgccgggaagctgagagacttgtgaaataccgagaagtcaatggccttcccatcatggaatccaactacttcgatcccag

SEQ ID NO: 1196 - DNA, 412 bp, Mus musculus
  misc_feature (76)..(76): n is a, c, g, or t
  misc_feature (349)..(349): n is a, c, g, or t
gaaattctgcaagcacgcttcccaatgccacgttatatcaacacagagcatggcggcagtcaggctcggttcctgntgtctaaagttaacccatctcagacacacaataacctgtatgcctgggggcaggaaactggagcgcccatcctgacagacgatgtcagcctacaggtgttcatggatcacctgaagaagctggctgtgtctagtgcctcttaagctggtggccccgcctggaagtggaagacaatgctgtcagattgtgctcacgttgttgatagcgtcctagcaacattcacctttcggggaggttctaataaataacccaaggaatttttatatatgtatntcttcaggctataatacgtcttcaggttgtaatttatttgtattcctctctgtctgttttcct

SEQ ID NO: 1197 - DNA, 340 bp, Mus musculus
  misc_feature (280)..(280): n is a, c, g, or t
  misc_feature (283)..(283): n is a, c, g, or t
  misc_feature (288)..(288): n is a, c, g, or t
aagactcaggttattacactctacaaatacttgatacaacctcaagacctgaattaatacgtgcagaattctttgttcacagcccacttttaggctacaagaagcatcttgccccttctcaactcacaattaagttggtgccatctagggttgaagaaaatgacaatattctcctgcaggtttatcatctgccacagaagcttcaaggctttgcctggcacaaaggagtacttccacttgaccattttaagatagcaagccattcattcctcacccattnaantatgntggggagtgcatatcaagacagagtgataatatgtaatgatggaaccctggt

SEQ ID NO: 1198 - DNA, 260 bp, Mus musculus
atgagttgtaggtgcactgatctgctagagctgtaatattgtaaatactggactcaggaactttcgttgggagaaaattgagagaacttaagtctcgaatgtaattggaatcttcacctcagagtggagttgaaaatgctatagcccaagtggctgtttactgcttttcattagcagttgctcacatgtcttggggtcagggagaggaggaattggctattttaaaaattgagaaaaaggtgggtcagggtgtgtgttca

SEQ ID NO: 1199 - DNA, 437 bp, Mus musculus
  misc_feature (87)..(87): n is a, c, g, or t
  misc_feature (101)..(102): n is a, c, g, or t
  misc_feature (104)..(104): n is a, c, g, or t
  misc_feature (108)..(108): n is a, c, g, or t
  misc_feature (132)..(132): n is a, c, g, or t
  misc_feature (147)..(147): n is a, c, g, or t
  misc_feature (152)..(153): n is a, c, g, or t
  misc_feature (159)..(159): n is a, c, g, or t
  misc_feature (198)..(198): n is a, c, g, or t
  misc_feature (244)..(244): n is a, c, g, or t
  misc_feature (251)..(251): n is a, c, g, or t
  misc_feature (287)..(287): n is a, c, g, or t
  misc_feature (327)..(327): n is a, c, g, or t
  misc_feature (329)..(329): n is a, c, g, or t
  misc_feature (335)..(335): n is a, c, g, or t
  misc_feature (358)..(358): n is a, c, g, or t
  misc_feature (372)..(373): n is a, c, g, or t
ccagagctgtccaggtaagaggctgcagggcgggcagggcggggctcggctctgggtcattgagtaactctcccatccttctccctntcctgccaggaatnngntctngcccggttcaaaagcaatgtgacnaagacaatgaagggntttgnntacatnctggccaagctacaaggtgaggccccttccaaaaccctngttgagacagccaaagaggccaaagagaaagcaaaggagaccgcantggcagntacagagaaggccaaggacctggccaacaaggccgncaccaagcagcagcagcggcagctcgtataactcgcttcntntccctntccccagtgtacgtgattattanagagcaacctgcanncctctctgctgtctggggtggtgggtcagggccctgtcctggtcagcatctgcaccaaccagct

SEQ ID NO: 1200 - DNA, 91 bp, Mus musculus
tgtgtgaactctgacaatagcggctggaccgaaatccgtcgggaagcctgggtctcctctagcttatttggcgtctccagagctgtccagg

SEQ ID NO: 1201 - DNA, 525 bp, Mus musculus
  misc_feature (158)..(158): n is a, c, g, or t
  misc_feature (172)..(173): n is a, c, g, or t
  misc_feature (175)..(175): n is a, c, g, or t
  misc_feature (179)..(179): n is a, c, g, or t
  misc_feature (203)..(203): n is a, c, g, or t
  misc_feature (218)..(218): n is a, c, g, or t
  misc_feature (223)..(224): n is a, c, g, or t
  misc_feature (230)..(230): n is a, c, g, or t
  misc_feature (269)..(269): n is a, c, g, or t
  misc_feature (315)..(315): n is a, c, g, or t
  misc_feature (322)..(322): n is a, c, g, or t
  misc_feature (358)..(358): n is a, c, g, or t
  misc_feature (398)..(398): n is a, c, g, or t
  misc_feature (400)..(400): n is a, c, g, or t
  misc_feature (406)..(406): n is a, c, g, or t
  misc_feature (429)..(429): n is a, c, g, or t
  misc_feature (443)..(444): n is a, c, g, or t
gaactctgacaatagcggctggaccgaaatccgtcgggaagcctgggtctcctctagcttatttggcgtctccagagctgtccaggtaagaggctgcagggcgggcagggcggggctcggctctgggtcattgagtaactctcccatccttctccctntcctgccaggaatnngntctngcccggttcaaaagcaatgtgacnaagacaatgaagggntttgnntacatnctggccaagctacaaggtgaggccccttccaaaaccctngttgagacagccaaagaggccaaagagaaagcaaaggagaccgcantggcagntacagagaaggccaaggacctggccaacaaggccgncaccaagcagcagcagcggcagctcgtataactcgcttcntntccctntccccagtgtacgtgattattanagagcaacctgcanncctctctgctgtctggggtggtgggtcagggccctgtcctggtcagcatctgcaccaaccagctctgtctgccgggcagca

SEQ ID NO: 1202 - DNA, 382 bp, Mus musculus
  misc_feature (36)..(36): n is a, c, g, or t
aaagcagcggtctgtcttcagagacgttctgagggnctgtggaggaacgggattttccaacagaaactgttaaatttggtcctgagcgcatgtatattgatagctgggtcaaaaaacatacctatgacacgtttaaagaggttcttggatcagggatgcagtaccacttgcagacaaatgaattccttcgaaatgtatttgagcttggaccccctgtgatgcttgatgctgcaacacttaaaaccatgaagatttctcgttttgaaaggcatttatataactctgcagctttcaaagctcgaacaaaagctcgaagcaaatgccgagataagagagcagatgttggagaattcttgtagatgtctgaatttgatggctgttt

SEQ ID NO: 1203 - DNA, 494 bp, Mus musculus
  misc_feature (133)..(133): n is a, c, g, or t
  misc_feature (334)..(334): n is a, c, g, or t
  misc_feature (400)..(400): n is a, c, g, or t
gaattcgcaatctgaacccaagtgaaaaaacaaaattgcctgaattgtactgtatgtagctgcactacaacagattcttaccgtttccacaaggtcagagattgtaaatggtcaatactgacttttttttttnattcccttgactcaagaccgctaacttcattttcagaactgttttaaacctttgtgtgctggtttataaaataatgtgtgtaatccttgttgctttcctgataccagatcgtttcccgtggttggttagaatatattttgttttgatgtttatattggcatgtttagatgttgggtttagtcttctgaagatgaagttcanccattttgtatcacacagcacaaccagtgtctgtcagtttccacgcataaagtttagtgagacgtntatatgtaagatctgatttgctagttcttcctggtagagttataaatggaaagattacactatctgattaatagtttcttcatactctgcatat

SEQ ID NO: 1204 - DNA, 396 bp, Mus musculus
  misc_feature (112)..(112): n is a, c, g, or t
  misc_feature (115)..(115): n is a, c, g, or t
cacttccaggtgtcaactttattctttccaattgtatgaatcatgttggtggagagtttaagcattagaatagaaagcaggaaatgtgattgccctaattgtagaaattctnatnctccccccccccccccaaattaaatgaaaacatgaacgctagatgggaatgatgggagaaataatatatttatttcggtgaaattttgcatgtgtgaaagtttgttaactaggatcttcgaaatcctagactttgcttttgtcttactgtgggaaacaaagtctcttgcagacactagcattttaaggtgacaaaggtcagagattgtttcctttggtttaaggagcagccaagcattcttcaattgggggctagggtagggtatggctgttgataacaca

SEQ ID NO: 1205 - DNA, 277 bp, Mus musculus
caaaaaggaggcaccacccatggagaagcctgaggtggtgaagacgcacctgagggacatgatcatcctgccggagatggtgggtagcatggtgggcgtgtacaacggcaagaccttcaaccaggtggagatcaaaccagagatgatcggccactacctgggcgagttctccatcacctacaaacccgtgaagcacggccggcccgggatcggtgccacccactcctcccgattcatccccctcaagtagccgaggccaataaagactggttttggt

SEQ ID NO: 1206 - DNA, 426 bp, Mus musculus
  misc_feature (107)..(108): n is a, c, g, or t
  misc_feature (114)..(114): n is a, c, g, or t
  misc_feature (116)..(120): n is a, c, g, or t
  misc_feature (216)..(216): n is a, c, g, or t
  misc_feature (219)..(219): n is a, c, g, or t
  misc_feature (242)..(242): n is a, c, g, or t
  misc_feature (258)..(258): n is a, c, g, or t
  misc_feature (261)..(261): n is a, c, g, or t
  misc_feature (284)..(284): n is a, c, g, or t
  misc_feature (293)..(293): n is a, c, g, or t
  misc_feature (374)..(374): n is a, c, g, or t
gaaatcccaagcatgttttctggcttgcttcatgatgatctgaatctgaaatcccactccttttggacagattatcacaactactgcattcaggtggggtggggtgnngtgggntnnnnntgttttctggagaaacgacatcacacacgtggtgccatgacccatcttcctttacaactcaattccttgattttgcctcagctcccagactgaggnaanattaagcaatggacagcaggatntcatctcatttgagtnaanttacaaatgatacctggaacctntcacatttncctaattggcttattcacatgcattagacattgctaaactagtttgattttagttattgatgtggtttttttttttttttnatgaatagtgcccagtagatggagaaagatttgcaacctcaaattttccacc

SEQ ID NO: 1207 - DNA, 444 bp, Mus musculus
  misc_feature (182)..(182): n is a, c, g, or t
  misc_feature (185)..(186): n is a, c, g, or t
  misc_feature (224)..(224): n is a, c, g, or t
  misc_feature (227)..(227): n is a, c, g, or t
  misc_feature (230)..(230): n is a, c, g, or t
  misc_feature (238)..(238): n is a, c, g, or t
  misc_feature (244)..(244): n is a, c, g, or t
  misc_feature (248)..(248): n is a, c, g, or t
  misc_feature (250)..(250): n is a, c, g, or t
  misc_feature (264)..(264): n is a, c, g, or t
  misc_feature (270)..(270): n is a, c, g, or t
  misc_feature (291)..(291): n is a, c, g, or t
  misc_feature (327)..(327): n is a, c, g, or t
  misc_feature (339)..(339): n is a, c, g, or t
tgggtctggttgtgactcgccacctttgtgatggatgtttacaggcacccaaccagacgtcacctctctgcacttcatccccagctgcacctgcctcccccacttaacctctgggaaggacatggagagctgaagtgacaaatgggctcattctcaggccactctgtcggcattgcttgatnccnngttgaccttaagctgggaagactgcagacccaagactnttnatngtagtttnagggantcantntgaggagggctatnccaggnccaggcaggggttaacctctnccaggttgacagaactgagatactgcactgggaagnccatgcttcccnggctagaaatctatttttggaagtgtgagtggtgcgcatagtgtgaatggtgtagatccttgatttccataaacctgtaaaagcaatacttagaggctgacttat

SEQ ID NO: 1208 - DNA, 507 bp, Mus musculus
  misc_feature (141)..(141): n is a, c, g, or t
  misc_feature (149)..(149): n is a, c, g, or t
  misc_feature (169)..(169): n is a, c, g, or t
  misc_feature (203)..(204): n is a, c, g, or t
  misc_feature (208)..(209): n is a, c, g, or t
tgtccaggtcctgaaaatcgctcaggtttttaagaaccccaagttcaactccttcaccgtgcgtaatgacatcaccctgctgaagctggccactcctgcccagttctctgagactgtgtctgccgtgtgtctgcccactgnttgacgantgacttccctgctgggacanctgtgtgccaccactggctggggcaagaccaaanntacnnaatgccctcaagacccctgacaagctgcagcaggctgccctgcccatcgtgtccgaggctaagtgcaaggagtcctggggttccaagatcaccgatgtgatgatctgcgcaggcgccagtggcgtctcttcctgcatgggtgactctggtggccccctcgtctgccagaaggacggagtctggaccctggcaggcattgtgtcctggggcagtggtttctgctccacttccacccctgccgtgtatgcccgagtcactgccctcatgccctgggttcaggagatcttggaagccaact

SEQ ID NO: 1209 - DNA, 263 bp, Mus musculus
  misc_feature (173)..(173): n is a, c, g, or t
  misc_feature (201)..(201): n is a, c, g, or t
  misc_feature (232)..(232): n is a, c, g, or t
  misc_feature (234)..(235): n is a, c, g, or t
atatctgatctttgcactccaacaacggaagctcacagagccccggtaatctgattgtattgtgtgtgtaacattggccaaaagtgtttacaggtcaacctagggtttggtcactacgggaggccagtgatctagcatccaatctgtaggagaactccaagtgcctggacctnccagggcagtttagggttctgccactantccatgagacattggtcattaggtggttgtntnnttcttccatcttgagaaagggaccctga

SEQ ID NO: 1210 - DNA, 313 bp, Mus musculus
  misc_feature (36)..(36): n is a, c, g, or t
  misc_feature (288)..(288): n is a, c, g, or t
taaggaaacgcctaactgcactcctgaattctttcntactcaagaggtgggatccccaaacccaggcctgtccttgaagatccctgccttgtcctgcatgtacatggctgcttcaagtgaagcttcagtcttcttacctgctgtggtcactcctgaagactctgtcccgaagtttggtgctggctgctccagcccagcatgacttccatataaagatgcttagtttgccccctccacagagctgttcccctcacccacctgttattctggaggggtcagaggaggccngggcttgactcatctcagggaacat

SEQ ID NO: 1211 - DNA, 269 bp, Mus musculus
  misc_feature (130)..(130): n is a, c, g, or t
  misc_feature (220)..(220): n is a, c, g, or t
tcacgacttcattgagcacatccttcgcaagctgccccagcaaaaggagaagctgtccctgatccgcaagcatgcgcagaccttcatcgctctgtgcgctaccgacttcaagtttgccatgtacccgccntcgatgattgcaactggaagcgtgggagcagccatctgtgggcttcagcaggatgatgaagtgaacacactcacgtgtgatgccctgacngagctgctggccaagatcacccacactgatgtggattgtctcaaagcct

SEQ ID NO: 1212 - DNA, 366 bp, Mus musculus
  misc_feature (129)..(129): n is a, c, g, or t
  misc_feature (159)..(159): n is a, c, g, or t
  misc_feature (161)..(161): n is a, c, g, or t
  misc_feature (163)..(163): n is a, c, g, or t
  misc_feature (169)..(169): n is a, c, g, or t
  misc_feature (193)..(193): n is a, c, g, or t
  misc_feature (236)..(236): n is a, c, g, or t
ccacatgactgaaccattttggatgtaagaagcgccttgatgcctcaccacgtgttcccaagactgagcgtccgggtctctccgtcgcatactcttgctgactaaagtagctgctacctaagggatatntcttttgccagttggacacaggtgaacggntncntaagtntcatgtttggtgaatttgggcttntacttccaaacatggttcattgtagatgtattttactgttatntgatggagggaattcgctatgggccatgaccaaaacgcatctaaatgggggcagatggagaccatagacggaatctaaaacaaagctgccttgtgtaagggaagagggtgaggtgatctttaatcccctt

SEQ ID NO: 1213 - DNA, 277 bp, Mus musculus
  misc_feature (58)..(58): n is a, c, g, or t
  misc_feature (252)..(252): n is a, c, g, or t
atcgacaccgtctctgtgccgtatgtcttccggtactttgtagctgagctggcagccnatgaacatcaaagtgaaactggatgtcatctgacttgatccccgccatctgagctaggagataagaacaggaggtgtcctgtataacacaagtgagggtattatgggctcactctgggtctatacaagaatttcagtactgaagccaagaacaggcaggtgaaaattcaagacttctgagtctctgtaacctanctgaagttggttttcatatcttttt

SEQ ID NO: 1214 - DNA, 496 bp, Mus musculus
  misc_feature (310)..(310): n is a, c, g, or t
  misc_feature (312)..(316): n is a, c, g, or t
  misc_feature (318)..(318): n is a, c, g, or t
  misc_feature (320)..(320): n is a, c, g, or t
  misc_feature (335)..(335): n is a, c, g, or t
  misc_feature (345)..(345): n is a, c, g, or t
  misc_feature (347)..(347): n is a, c, g, or t
  misc_feature (371)..(371): n is a, c, g, or t
  misc_feature (462)..(462): n is a, c, g, or t
  misc_feature (471)..(471): n is a, c, g, or t
atgcctgatgttcctgtcatacagccaaggccaggtagctgaagaagacttccccttggctgaaaaagaccttccttctgccaaaatcaactgcccagagggtgccaacgcctatggttcctactgttattatctaattgaagaccgtttgacctggggggaggctgatctcttttgccagaacatgaatgcaggtcacctggtgtcaatactcagccaggctgagagcaactttgtggcctcgctggttaaggagagtggtactacagcttccaatgtctggactggacttcatgaccctaaaagtaancnnnnntngncactggagcagtggntccctatttntncttcaagtcatgggccactggagntccaagcactgccaaccgtggttattgtgtatcgctgacttcaaacacagcatacaaaaaatggaaggacgaaaactgtgaggcacagtantcctttgtntgcaagttcagagcctaaagtcacc

SEQ ID NO: 1215 - DNA, 508 bp, Mus musculus
  misc_feature (451)..(452): n is a, c, g, or t
  misc_feature (460)..(463): n is a, c, g, or t
  misc_feature (465)..(469): n is a, c, g, or t
aatatgtatcgagcttctaccccaaggtaaataaataacatttggagaccattaaaatgtaggatggcatagaagaggcctttactaagattaataattaaagaaacacagcctttaaagtaaaaaacacactgtgcctttgaaacttgctaaaaagattaacttctgtcccaaaaggtatcagccatgcgctaccagcctccctgcccctacagtggcagtggctgcattcttggtgaatggtagtggaagggattaaacctaggcctcagtcatgcttcccagtcactggtactgatttgtatgcacccgcttaggtgtgaaggtagttttggtgtgtatcacaagttagcctgtgtagcgaagacaggttttctccaccgtgttttttgttacacatgactattcacaaatgtgctgcagacagtaaaatgagaaatacccttccaannaaaaaaannnnannnnngttttggggtaggggtgtccaagacggtctcttggttta

SEQ ID NO: 1216 - DNA, 105 bp, Mus musculus
ggctggaaacctggtagtgaaacaataatcccagatccagctggaaaactgaagtatttcgacaagctaaactgaaaagtacttcagttatgatgtttggacctt

SEQ ID NO: 1217 - DNA, 422 bp, Mus musculus
  misc_feature (315)..(315): n is a, c, g, or t
  misc_feature (349)..(349): n is a, c, g, or t
  misc_feature (351)..(351): n is a, c, g, or t
ggagctcaaactgactgactatcgtgggaaatacttggtttttttcttctacccactggatttcacctttgtgtgtccaactgaaatcatcgcttttggggatcgaattgaagaattcaaatctataaatactgaagtggtagcatgctctgttgactctcagtttacccacttggcctggattaatacccctcgaagacaaggaggactggggccaataaggattccacttctttctgacctgaaccatcagatctcaaaggactatggtgtataccttgaagactcaggacatactcttagaggcctctttanttatcgatgacaaaggagtcctgaggcagattantntgaatgaccttcctgtcggaagatcagtggacgagacactgcgtttggttcaagccttccagtacactgac

SEQ ID NO: 1218 - DNA, 418 bp, Mus musculus
  misc_feature (271)..(271): n is a, c, g, or t
  misc_feature (274)..(274): n is a, c, g, or t
  misc_feature (276)..(277): n is a, c, g, or t
  misc_feature (282)..(282): n is a, c, g, or t
  misc_feature (374)..(374): n is a, c, g, or t
  misc_feature (383)..(383): n is a, c, g, or t
  misc_feature (385)..(385): n is a, c, g, or t
tgctataatccctgaaccaactttggatactgaagtgcaagagcagaaggataaagaaggactcaaaaaagcaacgtggaatgagtttgtcatgaaactgaacaatagcaaaaatgaccaggagaaggatggcatcgacatagaattgagagtcttctttggtcagctgactgatgaagaactaatgaaaataatgactaacattttccacccaatgttggaagaggagaaaacacagccagttgttgatgaccctgaatttgaggattanacnannagagntggcgatgggttttttgtaccaaatcagccacagtaacatagacagcagtatgaagttaggcaacgagtgaaacagccactgtgctgttgtntaacagatntntgccccaatatgtgaactgccttatggtgaaaa

SEQ ID NO: 1219 - DNA, 421 bp, Mus musculus
  misc_feature (380)..(380): n is a, c, g, or t
gtccccaacagcttcattcagttgataatttggccctcagctttggagaaccctgaggctggaggctgacaactttttttaccatgggattgccaagaagccttgtgagaatgtcccagcctgctgctctggttaggctgaggttaataccctggtgttgtggaagcttcctaagtggctcagatacatactagggttgaaaacatggtttctaagtttctacatgagtcagaagcaacctgaagagaagaaaccgcacagctgggaaaatggggagagcttagtgtgtaagaacacttactacaacagacaggaggacccaaggtcagatattcagcacccatgctaaaaacactggtttgaccacatgaacacgtgantctgcaaggtggggcagtgactactgctagagcctggtggc

SEQ ID NO: 1220 - DNA, 514 bp, Mus musculus
gtgtcatgccctacgttggtataatcacatcaagtcgtatgaaaaagaaaaggccagcctgccgggagtgaagaaatctttgggcaagtatggccctagcagtgtagaagacaccacaggaagtggagctgcagatgctaaggatgatgacgacattgatctctttggatctgatgatgaggaggaaagtgaggaagcaaagaagctacgagaagaacgccttgcacagtatgagtccaagaaagctaaaaagcctgcagttgttgcgaagtcttccatcctactagacgtgaagccttgggatgatgagacggacatgacaaaactagaggagtgtgtccgaagcattcaagcagatggcctggtgtggggctcctctaaattggttccagtgggatatggaattaaaaagcttcaaatacagtgtgtagttgaagatgataaggttggaacggatatgctggaagagcaaattactgcttttgaggactacgtacagtccatggatgtggct

SEQ ID NO: 1221 - DNA, 489 bp, Mus musculus
aaggatgggctgatcatccgcaagcctgtgactgtccattcccgggctcgttgccggaaaaacaccctggcccgacggaagggcaggcatatgggcatagggaagaggaagggtactgccaatgctcggatgcctgagaaggtgacctggatgagaaggatgaggatcctgcgccggcttctcaggagataccgggaatccaagaagattgaccgccatatgtatcacagcctgtacctgaaggtcaaagggaatgtgttcaaaaacaagcgcatcctcatggagcacatccacaagctgaaggcagacaaggcccgcaagaagctcctggctgaccaggctgaggctcgcaggtctaagaccaaggaagcacgaaagcgccgggaggagcgcctccaggccaagaaggaagagatcatcaagactctgtccaaggaggaggagaccaagaaataaagcttccctcgtgtctgtacatagcggcctggc

SEQ ID NO: 1222 - DNA, 585 bp, Mus musculus
  misc_feature (326)..(326): n is a, c, g, or t
  misc_feature (424)..(424): n is a, c, g, or t
  misc_feature (512)..(512): n is a, c, g, or t
  misc_feature (532)..(532): n is a, c, g, or t
tgatcgtggtagtcctcttccagcacttccggaaaaagcgatgggcggacagggctgataaagccgaggggacaaaatcaaaagaagaggaaaaactcaaccaaggaaacaaggtctctgtttttgtggaagatacagactaacacttcgagaagctgaggatttttgaggacaccatcagcaccccttgaaatcaatagaaatgtttccagcgatgacctgtctgtcgtcctacaggttctgcagcacaaacctgcccagatgagcaacgcccctgcctggcagctttgggttctgcctgagctactagactcagacttaccttngttgctacggttctatctaattccagagtgcaattgtgtgttagcttttgcaaaccaagaggttacatatttgtccttccacattcctatggtgtgtnactcccatatttctgtgcatcagaggggtaagaagccaactagcttgtctgccagaacataccttctcatattttagtttctttagancagcacacaggtgtgctcangggtctgaagagatagctcatctatcctcttgcagaagatcccagttcagttc

SEQ ID NO: 1223 - DNA, 86 bp, Mus musculus
attaaggctcgggacctgcgcggcaagaagaaggaggagctgttgaaacaactggacgatctgaaggtggaattgtcccagcttcg

SEQ ID NO: 1224 - DNA, 378 bp, Mus musculus
  misc_feature (39)..(41): n is a, c, g, or t
  misc_feature (43)..(45): n is a, c, g, or t
  misc_feature (47)..(62): n is a, c, g, or t
  misc_feature (64)..(65): n is a, c, g, or t
  misc_feature (67)..(67): n is a, c, g, or t
  misc_feature (69)..(69): n is a, c, g, or t
  misc_feature (72)..(73): n is a, c, g, or t
  misc_feature (76)..(79): n is a, c, g, or t
  misc_feature (81)..(82): n is a, c, g, or t
  misc_feature (85)..(87): n is a, c, g, or t
  misc_feature (90)..(90): n is a, c, g, or t
  misc_feature (93)..(94): n is a, c, g, or t
  misc_feature (96)..(97): n is a, c, g, or t
  misc_feature (101)..(101): n is a, c, g, or t
  misc_feature (105)..(105): n is a, c, g, or t
  misc_feature (117)..(117): n is a, c, g, or t
  misc_feature (119)..(119): n is a, c, g, or t
  misc_feature (134)..(134): n is a, c, g, or t
  misc_feature (144)..(144): n is a, c, g, or t
  misc_feature (146)..(146): n is a, c, g, or t
  misc_feature (148)..(148): n is a, c, g, or t
  misc_feature (179)..(179): n is a, c, g, or t
  misc_feature (204)..(204): n is a, c, g, or t
  misc_feature (332)..(332): n is a, c, g, or t
  misc_feature (334)..(334): n is a, c, g, or t
aggctcgggaactgggttggcgtaggggtagcgggagannngnnncnnnnnnnnnnnnnnnngnngnanttnnccnnnntnnggnnnccnaanngnnaggnggcnccgcgtccaagntntccaagatacgagtngttcgcaagntntntcgcccgagtcctcactgttattaaccagantcaaaaagaaaacctcaggaaattntacaagggcaagaaatacaagcccctagacctgcgacccaagaagactagagccatgcgccgccggctcaccaagcacgaggagaagctgaagaccaagaagcagcagcggaaggagcggctgtatcntntgcgcaagtatgcagtcaaggcctgagatgacaacgacaataaa

SEQ ID NO: 1225 - DNA, 377 bp, Mus musculus
  misc_feature (162)..(162): n is a, c, g, or t
  misc_feature (203)..(203): n is a, c, g, or t
  misc_feature (215)..(215): n is a, c, g, or t
  misc_feature (275)..(275): n is a, c, g, or t
  misc_feature (279)..(279): n is a, c, g, or t
  misc_feature (283)..(283): n is a, c, g, or t
  misc_feature (296)..(296): n is a, c, g, or t
  misc_feature (347)..(347): n is a, c, g, or t
gaatattttccgtgacttccgggagattgaagtggaagtgtacatcgcagcctgttacagtcctgtggtcgcccagcttgaagctggacacttctttgatgaatctatcactaagcagcatgtctttgcctctgtccatgacgctgtgacctttgccctcanccaccggaagtctgtccctaagagccctgttttggccaccnaactctgacttntgctgcaggagactgcctacctctggaggttgtgacaggtcaccctcatgaaaccccctncctntggnccacctccaggtnccacctgggactccattccatgtacctgcacatacaattcatggatggatnccctgggactcccaagttcagtgctacagg

SEQ ID NO: 1226 - DNA, 366 bp, Mus musculus
cccatgatgctcgtactattcggtaccctgatcccctcatcaaggtgaacgacaccattcagattgatttggagacaggcaaaataactgacttcatcaagtttgacactgggaacctgtgtatggtgactggaggtgctaacttgggaagaattggtgtaatcaccaacagagagagacatcccggctcttttgatgtggttcatgtgaaagatgccaatggcaacagctttgccactcggctgtccaacatttttgttattggcaagggtaacaaaccatggatctctcttcccagaggaaaaggaatccgcctcaccattgctgaagagagagacaagaggcttgcggccaaacagagcagtg

SEQ ID NO: 1227 - DNA, 373 bp, Mus musculus
  misc_feature (255)..(255): n is a, c, g, or t
gtgaggccctcacttcatccggcgactagcaccgtgccggcagtctacagcatggcttccgtctccgagctcgcttgcatctactccgccctcatcctgcacgacgacgaggtgacggtcacggaggataagatcaatgccctcattaaagcagctggtgtcagcgtcgaacctttctggcctggcttgtttgccaaggctctggccaatgtcaacattgggagcctcatctgcaatgtaggggctggtgggccngctccagcagctggagctgcgcctgctggtggtgctgctccatccactgccgccgccccagctgaggagaagaaagtggaggcaaagaaggaagagtccgaggagtctgaagatgaca

SEQ ID NO: 1228 - DNA, 503 bp, Mus musculus
gtggaactcccaaaacgtcggcaatggctatgacattgccttaatcaaactggccagcccagtgaccctgagcaagaacatccagacagcttgcctcccacccgctggcaccattctcccgagaaactatgtctgctatgtcacaggctggggcctgctgcagaccaatgggaacagtcctgacaccctgaggcagggccgcctgctggttgtggactatgccacctgctccagcgctagctggtggggaagctctgtgaagtccagcatggtgtgcgctggtggcgacggcgtgacctccagctgcaatggggactctggcggaccactgaattgccgggcatctaatggccagtggcaggtgcatggcatcgtgagcttcggctcctctctgggctgcaactacccccgcaagccatccgtcttcaccagggtctccaactacattgactggatcaactcggtgatggcaaggaactaactgaagacattactgccactgt

SEQ ID NO: 1229 - DNA, 161 bp, Mus musculus
  misc_feature (33)..(33): n is a, c, g, or t
  misc_feature (96)..(96): n is a, c, g, or t
  misc_feature (121)..(121): n is a, c, g, or t
aacttatcagacagcaaacatcccgaatttgtnttgaagagcatcatggacaagggacaaaatgtgaagactcacctagaaaaagcattttctatntacagtccacattagagccttaatntgctctttccatatctgtctttagtccttttggtataagt

SEQ ID NO: 1230 - DNA, 315 bp, Mus musculus
actgctatgccttgtttcagataccacagacctggtttgatgcagaactggcctgccaaaagaggcctggaggacacctcgtatctgtgctcaatagcgctgaggcttcattcttgtcctccatggtgaagagaacaggaaacagctaccaatacacttggattgggctccatgaccccactctgggtgcagaacccaatggaggtggatgggaatggagtaacaatgacgtgatgaattactttaactgggagaggaacccatctactgccttagaccgtgctttctgtggcagcttgtcaagagcttctggat

SEQ ID NO: 1231 - DNA, 556 bp, Mus musculus
  misc_feature (123)..(123): n is a, c, g, or t
  misc_feature (126)..(126): n is a, c, g, or t
gaatcttaagttgctctgttacactagaaaatccttcctgacccacacctcaggcttcagctgcagcaagatgactgttgctaacgagttgcgttcgaaggtttggctgtcgggagcccttantcntcatcaatggcagcaagccacggctttcaagttttaataaaatgccaagaaggaagctgtccccattcattctctgaacaaaaccctccttgttcattggcccagggtggctatgagatactaggagagggggtgccaagcccagagcatggctgccaccccattctcctacctgtggtgacagcttcaagttgaaaggtatgggggaattgagtcatttagttgtggtttgtattgcactgaaacccttatttgtgttgtgaaattgctgctcatggggtctcaactatgtggtttctcttttatttggtcaagttcaaggctgtgcattagaagtttggctgtcattgtgatgtgtaactgatctcaagctggtattcattacccctgcagagtcttctaaacaaaggccctgtgtggaggactgcaa

SEQ ID NO: 1232 - DNA, 388 bp, Mus musculus
actgcagtgaccacatcctgagcgttcctccataagaaagaatagagttatcctctgtctttgcccaccatggttctcattagtaacttagagggctcagtgctacttctaggacctttagtctctgaaatctgggaaaaatgtttatttgcatagtttgttagtgcctcttaaatgtcaaacaggaatacatttcagtagaaactttaatttcattttcaattgtttgtaaattcatcagtatttagtaaattgatcttttttttatatttctgcttccaatgcaggtgcaatttaatataatagactttttaaagaaattaatgctaacatcattcttgagctttttatataaatatatttaatttggaagcgtgtgtgtgcacat

SEQ ID NO: 1233 - DNA, 543 bp, Mus musculus
tcaaggtccctttactgctttataaaataattttgataggtggactgctttctagaatttgatagtgggaccacatagggtaaatcttgatttgtatgggttcatttctgatttttttagggagatctttgtgtcagtcaaattggcagtggggaaagatcctggcactgtttaactgtgagctttctttcatgtctgacctggagctgaaaaaaagtcctatggagtgttcctgcaatccaacttcttaggttgtctctcccctatactgtgacttacttaactcgcaaattgaaaatatggtctcaaggtagaagaggaagcctgagaatccaaagggctttagtcataaaagaatctagctcatgagtactattcttattaccagacagccacgagaagaagttaacttactatgtatatccagatgcaaaacattcacagatgtgcctaaagaaaccgcgacttaggccagttcagaactaacaactgtttcaggtagaggtgcatgcctgatggtagacatcgattccattaactgca

SEQ ID NO: 1234 - DNA, 457 bp, Mus musculus
  misc_feature (232)..(232): n is a, c, g, or t
  misc_feature (235)..(236): n is a, c, g, or t
  misc_feature (238)..(242): n is a, c, g, or t
  misc_feature (245)..(245): n is a, c, g, or t
gggacactggtggtctctactaaaattagggtgtctctagccaggaggtgacctacatttggctgctttgcccactggtaacttgtgatttcttctccttctaatgtataagaatacattagctagaattgttgccaagattgttcttgatcacgcagaccctcttacgtaactacactattatataactcctttatggattgaataaagctgttggtttccagaccttganaannannnnnaanacaaaataagtctgacctaaagttgttagtaaaataacctcaattagagcattattcatataaatgtactttattgttttaaacagaacaaaagaagaggcagaaacatttgcatataagtcctagcttataaacatagtttttagtggtggcatctctaacacgtcattcagggactgtttccttttgcctccttgtactgtaagcactga

SEQ ID NO: 1235 - DNA, 540 bp, Mus musculus
  misc_feature (214)..(214): n is a, c, g, or t
  misc_feature (253)..(253): n is a, c, g, or t
  misc_feature (430)..(430): n is a, c, g, or t
gacggccttgagtgcatggccatgacgattcagatcctcctcaagctggacaggctggacctagcccggaaggagctgaagaagatgcaggaccaagatgaggacgccacccttacccagctagccactgcctgggtcaacctggctgtgggtggtgagaagctacaagaagcctactacatattccaagagctggccgacaagtgctcccccnacactgctgctgctcaatggccaggcagcctgccactcngcacagggccgctgggagactgcagagggtgtgctgcaagaggcactggacaaggacagcggccaccctgagaccctcatcaatctcattgtactgtcacagcacctgggcaagccccctgaggtgacaaaccgatacttgtcacagctgaaggatgcacacagggcccaccccttnatcaaggagtaccaggccaaggagaacgatttcgatcgcctggcaatgcagtatgcgcccagtgcttaaagtggagatgccctggtgaccccaactgtgtgccgcgggat

SEQ ID NO: 1236 - DNA, 322 bp, Mus musculus
  misc_feature (51)..(51): n is a, c, g, or t
  misc_feature (56)..(56): n is a, c, g, or t
  misc_feature (123)..(123): n is a, c, g, or t
  misc_feature (126)..(126): n is a, c, g, or t
  misc_feature (134)..(134): n is a, c, g, or t
  misc_feature (151)..(151): n is a, c, g, or t
  misc_feature (235)..(235): n is a, c, g, or t
  misc_feature (250)..(250): n is a, c, g, or t
  misc_feature (265)..(265): n is a, c, g, or t
gggtgaagctgcttacatctgttcacctggtgccaccgagtccttctcctntcccngtggcagaaggtgctctgaagaggcggctgatgccagaagtcagcatgcctctctgagagaggtggnagnccttagangttagcatccccctcangcggaagtctgtggagagctttagttagatccgaggctgcttcagattgatctccaggtgaggtgagaggaaacgggaatcctntgaattaaaaacacngcaaagaagcctgtntcttggtgttgcaggtggaagtgtggggagtcatcctgtgacctcttgcttaactct

SEQ ID NO: 1237 - DNA, 502 bp, Mus musculus
  misc_feature (42)..(42): n is a, c, g, or t
  misc_feature (119)..(119): n is a, c, g, or t
tgccttgccagctcacagaattttgcatgggacttaacagcnctgtatcaactgatcctttagcatcttcagtgaggctaggcctaacccagaaatctctatgactttatagaaggttntaggcagtttgataaaagagtctatcctctggacttagaactttctagagcatgcttgtcagtggagggcttgtttttatgaccttgattcaagtggctggttgggtattgaaagagtattttgttgattgaaatcatgtcgaggtagtttggcttttctgtagataaataaatttgggatggactttttaagggggagtttatggcttgttgaagacactgttgaatagtttcttactaaatagagtgacaaacttatctatagccttgaaacctggatgagccacatgcgcaaaaaactcctgtaggctttcagtgtatcatttactttttcagggggttttattgtgcttaaacctttccagtgcccacagatctgaaaa

SEQ ID NO: 1238 - DNA, 481 bp, Mus musculus
  misc_feature (236)..(236): n is a, c, g, or t
  misc_feature (239)..(240): n is a, c, g, or t
  misc_feature (250)..(253): n is a, c, g, or t
  misc_feature (256)..(257): n is a, c, g, or t
  misc_feature (295)..(295): n is a, c, g, or t
  misc_feature (385)..(385): n is a, c, g, or t
  misc_feature (387)..(387): n is a, c, g, or t
gttcagattcagtccggagcccacgcttgaggacatccgacgcctccatgcagagtttgcagctgagcgggactgggagcagttccaccagcctcggaacctgctgctagccttggtgggagaagtgggcgagctggcagaactcttccagtggaagtctgatacagagcctggtcctcaagcatggccaccaaaggagagagcagcccttcaggaggagcttagcgacgtcctcntcnnacctggtagnnnntanncagcccgctgccatgtggatttacctcaagcagtaatntccaaaatggacaccaaccgccaacgttacccagtccacctgtcccgaggttctgcctgcaagtacactgacttgccccgtgggaccatntntgaaaaccaggctgtgggggctggagaccctgcctcggagctgagagaccaggcttccacataaaaacgaggtgctaatctggccttattaagt

SEQ ID NO: 1239 - DNA, 505 bp, Mus musculus
  misc_feature (308)..(308): n is a, c, g, or t
gagaatcctgggtagtgtgaaatattttgctaatcctatggggggggcacctgttacagaaagggaaagttagtagtcgtccttttactgactgtcacagtggatcggaaggacaagcatgtgcaaatactcatctcagtaaggtcgggtgtgggtgaaaggacacagaactgctgctgactttccgaatgtgtggaatccccttgtgaggtatccagccctagaaagccgagaacaggaagtaatgctttggggctaacccacagaaaggttagtttaccattagaatagatgggaagaaggctctntcaagagttctaggtctcatttagtttataaagggaagctttgggtccagatggtgaaagaaaaggcaacacaacactaaagattttattcatgtttgagaaaaggtatctgaactccagctcaaaggggatagttaaaatagtattatttaacttagttggtatttataataaatggcgatcttaattactcataa

SEQ ID NO: 1240 - DNA, 232 bp, Mus musculus
  misc_feature (72)..(72): n is a, c, g, or t
  misc_feature (74)..(78): n is a, c, g, or t
  misc_feature (80)..(97): n is a, c, g, or t
gatgcacctgtcttgagacagcccctggtgcttccccctgggtcagtccaagcccaaggccctgttggcctncnnnnntnnnnnnnnnnnnnnnnnnccgacttgcgcggaggcggaagctcgggtgcgttcaagattcggcgtcacccgtgattcaccgccatggccgaggaaggcatagctgctggaggtgtaatggacgtcaacactgctctacaagaggtgctgaaga

SEQ ID NO: 1241 - DNA, 393 bp, Mus musculus
  misc_feature (72)..(72): n is a, c, g, or t
  misc_feature (74)..(78): n is a, c, g, or t
  misc_feature (80)..(97): n is a, c, g, or t
gatgcacctgtcttgagacagcccctggtgcttccccctgggtcagtccaagcccaaggccctgttggcctncnnnnntnnnnnnnnnnnnnnnnnnccgacttgcgcggaggcggaagctcgggtgcgttcaagattcggcgtcacccgtgattcaccgccatggccgaggaaggcatagctgctggaggtgtaatggacgtcaacactgctctacaagaggtgctgaagaccgccctcatccacgatggcctagcacgtggcatacgcgaagctgccaaagccttagacaagcgccaagcccatctgtgtgtgctcgcatccaactgtgatgagcccatgtatgtcaagctggtggaggcactttgtgctgagcaccaaatcaacctgata

SEQ ID NO: 1242 - DNA, 432 bp, Mus musculus
  misc_feature (136)..(136): n is a, c, g, or t
  misc_feature (271)..(271): n is a, c, g, or t
  misc_feature (286)..(286): n is a, c, g, or t
  misc_feature (298)..(298): n is a, c, g, or t
  misc_feature (301)..(301): n is a, c, g, or t
  misc_feature (305)..(305): n is a, c, g, or t
  misc_feature (348)..(348): n is a, c, g, or t
  misc_feature (360)..(360): n is a, c, g, or t
  misc_feature (386)..(386): n is a, c, g, or t
  misc_feature (388)..(388): n is a, c, g, or t
  misc_feature (394)..(394): n is a, c, g, or t
gcagggtttccttattgacacttcccaggatgtaaggggccagattaactttgctacacaagaaacaggcttctatcagctttgtctaaaaaatgagcagaatcgcttcagttctatacaagtgtatctcaacttnggagtcttctatgaggggcccgaggtggatcacaagcagagtcaaaggaagcaactgaacgacactctggatgcgattaaggacagcacacaaagggtggagaaccaagttttccacatgtggcgcttctacaantatgccaggatgagnaaagtggctganttnttcntcctgcagtctaactacacctatgtgaactggtggtccacagntcagagccttgntattgttctttccggggccctccagntntatttncttgaaaagactttttactgcttcaactactgacacaa

SEQ ID NO: 1243 - DNA, 498 bp, Mus musculus
  misc_feature (286)..(286): n is a, c, g, or t
  misc_feature (410)..(410): n is a, c, g, or t
aggaaacacactggctggcccatgtgcacatctgtgatccaccagcagtcttttagttacttaaaagttgtagttaaaaaaatttctcatttaattttccagtctcgattgcaataacaaaatcaaccacacagtcagatgtctcaacaaacacctgtcatcccagtatttgggaagtgcaggcaggaggatcaggggttcaaggccagcctgggctaacagtaagtttgaggctagccttgtctgttacataagtaataacaataaaaatcaatcaaagtcctgntcaggaattttaaattgaacgacatatccttcttttctagtggtgctattttcaaatcaaaaaactttgcattggctatttgtttttacaaacatggttgagtttcacacggttccttgtgatntccatttgggtgacccgagggtttgtttgaggaaggtgactataatgaaggttagcattttctgttcaaatagttcttgttcaggcaa

SEQ ID NO: 1244 - DNA, 464 bp, Mus musculus
  misc_feature (348)..(348): n is a, c, g, or t
  misc_feature (438)..(438): n is a, c, g, or t
gctatggtacatcagtgttttgctttaaaatatgtaggttttctaatagtaccttatgttatccataaatatttctaaaagcgcctttaacattaccttttttcaacattatcttttataaacaataagggttattgcttttaggaactctggggaaattctgtgtagcttaaaatcagtcattaaaactcacaatagagtaagtaaatagagccacctgttctgacatgtaaataagcatagtttgttccaaagatggaacattgaagcccagctgtgtctactgtaatatattactcaaaagctactgggcgttttacagtaagcacttcatgtcaacagctacancaaacaccaaatctgaaccactagtgtggctgcttcgcaaggactaatgtcagagggttaggctgcaagtgatcagtgtttgacagcccntgcagtgatcttctttaactcattta

SEQ ID NO: 1245 - DNA, 476 bp, Mus musculus
gggaatcagccttggacagtgccgccttccagagcagaatcactgagccccacggctgaagctgcatctgatgaaactgatgggtactgcttgtccctcagctcacacttggcggtggcctctcgatcactctgggtcttgggagctcttgccttcacctgtggatccacttaagacattgtggtctgaagctcaggccacagtgcctgcctcgttccctcagcctccctcccagggctccagagctcagctcttccttttctagaagcatgtgaagatgcccaagagcctggagacattgccatccttcctacagaaactgtttctcctcctcccctccagccttcacacaagggccttggctttgttgagacagagcctgtgctggcacttgctgttagggtaggaagaggcacaaagaggaccccggtagcggtgatctgtggccttctgtgggtagcaccaagccagtcagt

SEQ ID NO: 1246 - DNA, 309 bp, Mus musculus
cttgcagggctctggtggatgaattagagtgggaaattgcccgcgtggaccccaagaagaccattcagatgggatccttccgaatcaatccagatggcagccagtcagttgtggaggtaccttatgcccgctcagaggcccacctcacagagttgcttgaggaggtgtgtgaccgaatgaaggagtacggggaacagattgacccttctacccaccgcaagaactacgtacgcgtcgtgagccggaatggagaatccagtgaactagacttacagggcatccgaattgactcagatatcagcggcaccc

SEQ ID NO: 1247 - DNA, 479 bp, Mus musculus
  misc_feature (302)..(302): n is a, c, g, or t
  misc_feature (398)..(398): n is a, c, g, or t
  misc_feature (411)..(411): n is a, c, g, or t
aggtgcactctctataatacaatctactgtacagttagcaagcgaagtgttaaatggagaagatgcttgtttttattaaacatttggagatttagataatttacattttaactgaatgtctaaagtgattatcttcccctccctcccccaagttaatcttccatctttgtttttgggtttcaatgaaggctttacataagaaattattaaacaaaacaaggggggcaataaatgtatataacattaataatgtcgcgtaggtgtaggttcctggatgcatttggatgtacagactgactggngggactgtattgcgatgatgattggtgtagaaacgtatgggtctgggtggccttttacatcttgcctaccattgcatgaaacattggggtttcttncaaaatgtgtgtngtcatacttcttttgggagggggttgttttcttcttttatgaaactcctactggagctcaatttgtaa

SEQ ID NO: 1248 - DNA, 192 bp, Mus musculus
  misc_feature (59)..(59): n is a, c, g, or t
  misc_feature (122)..(122): n is a, c, g, or t
gaagaggagggcttacccttgcaaggcagccacactggagatggcacctaagaaagccnaaggcgaaaccgaaagaggtcagaaaggctcccctaaaacaagacaaagcagcaggggccccntctgactgccaatggaggccagaaggtcaaacgcagtgggagcaggcaagaagcaaatgcccatgggaaa

SEQ ID NO: 1249 - DNA, 522 bp, Mus musculus
  misc_feature (203)..(203): n is a, c, g, or t
  misc_feature (206)..(207): n is a, c, g, or t
  misc_feature (357)..(357): n is a, c, g, or t
  misc_feature (380)..(380): n is a, c, g, or t
  misc_feature (460)..(460): n is a, c, g, or t
  misc_feature (488)..(488): n is a, c, g, or t
caaccaaatgatgaaacgccgggatatgacaaatgggtcatgcaagcccgtgaacaccttcgtgcatgagcccttggcagatgtccaggccgtctgctcccaggaaaatgtcacctgcaagaacaggaagagcaactgctacaagagcagctctgccctgcacatcactgactgccacctgaagggcaactccaagtatcccnaanntgtgactacaagaccactcaataccagaagcacatcattgtggcctgtgaagggaacccctacgtaccagtccactttgatgctactgtgtagggctccacataggccaaaccagtgagatgtctatgtctcccaacctcatcacctgtntcccctctgtctaccattctttntctgaaagaagtaagtcatgttaggacttccatatgacaaaacatgcgttcctgtcctgtgtcatgctcccagatccctntcttgctgtagacaaatgaagcaagatngccctcaccagaacatgtcccttcaaccttagac

SEQ ID NO: 1250 - DNA, 512 bp, Mus musculus
  misc_feature (223)..(223): n is a, c, g, or t
  misc_feature (276)..(276): n is a, c, g, or t
agatgttcctcggaagctgctgagccacggcaagaagcccttcagccagcacgtgagaaggctacgctccagcatcactcccggaactgtcctgatcatcctcactgggcgccacaggggcaagagagtggttttcctgaagcagctggacagtggcttgctgcttgtgactgggcctcttgtcatcaacagagttcctctgcgcagaacacaccagaagttntgtcattgccacctctacaaaagttgatatcagcgatgttaaaatccccaaanacctgactgacgcttacttcaagaagaagcagctgcgcaagcccaggcatcaggagggcgagatcttcgacacagagaaggagaaatacgagattacagagcagcgaaaggctgaccagaaagctgtggatttgcagattttgccaaagattaaagctgttcctcagctccagggctacctgcgctctcagttttccctgacaaacgggatgtatcctcacaaactggtcttctaa

SEQ ID NO: 1251 - DNA, 494 bp, Mus musculus
  misc_feature (173)..(174): n is a, c, g, or t
  misc_feature (285)..(285): n is a, c, g, or t
  misc_feature (304)..(304): n is a, c, g, or t
  misc_feature (313)..(313): n is a, c, g, or t
  misc_feature (319)..(320): n is a, c, g, or t
  misc_feature (323)..(323): n is a, c, g, or t
  misc_feature (331)..(331): n is a, c, g, or t
  misc_feature (337)..(337): n is a, c, g, or t
  misc_feature (344)..(344): n is a, c, g, or t
  misc_feature (368)..(368): n is a, c, g, or t
  misc_feature (370)..(371): n is a, c, g, or t
  misc_feature (373)..(374): n is a, c, g, or t
  misc_feature (437)..(437): n is a, c, g, or t
  misc_feature (439)..(439): n is a, c, g, or t
  misc_feature (441)..(441): n is a, c, g, or t
  misc_feature (446)..(446): n is a, c, g, or t
  misc_feature (449)..(449): n is a, c, g, or t
tccttctgacttggctttgccatttttttgttttttgagacagggtttctctgtatggccctggctgtcctggaactgtgtaaactaggctggcctcaaactcagaaatccacctgcctctgcctcccaagtgctgggattaaaggcgtacaccaccactgcctggccttgcnntctttacaaacacctaggggtggccctatggttttgttttagagaaaagaggtcccttacctcacccccaagacccttggcttcaaggacagagtcagaacaccaagaganaaccagttataacccaggncctcacaantgctcnncanagcatttntaccantcagttntcattcccagccccacctacagtntnntnnaagcaggaccagtgaacttagaaactaaagccattttgaccgaatattcaaagaaagcatttntntntgatnttnccagccaaagagctggactgcctgcctaggtccttgcagggaact

SEQ ID NO: 1252 - DNA, 311 bp, Mus musculus
  misc_feature (100)..(101): n is a, c, g, or t
gaactggtggttggacttatgtctgttttgatgggaacacgattatggatgaggggaggtaggcctcgggccctaggagggtaactgcaccccccccccnnaagacccttggcttcaaggacagagtcagaacaccaagagaaaaccagttataacccagggcctcacaagtgctcggcaagcatttctaccaatcagttgtcattcccagccccacctacagtctcatcaaagcaggaccagtgaacttagaaactaaagccattttgaccgaatattcaaagaaagcatttctctctgatcttgccagc

SEQ ID NO: 1253 - DNA, 377 bp, Mus musculus
  misc_feature (27)..(27): n is a, c, g, or t
ttggcgtctttgctaagggtcacattngaagtaacgctactccgggacaatctttaggagtcaggatggctgaagacatcaagactaaaatcaagaactacaaaactgccccctttgacagccgcttccccaaccagaaccagactaagaactgttggcagaactacctggacttccaccgctgtgagaaggcaatgacggccaaggggggtgatgtctccgtgtgtgagtggtaccggcgtgtgtacaagtccctctgtcccgtgtcatgggtctcagcctgggatgaccgcatagctgaaggcacatttcctgggaagatctgacctggctccgcccacctctcctctgttctttgtctttctccccggatagaa

SEQ ID NO: 1254 - DNA, 496 bp, Mus musculus
gatactctgagatttgctgttgtgcttaaagacaaaagtctggactcagccacaaactactacagcctgtccacctgaaatcttgacttacccagtccccacctgtctcttcctgccttctttatctgtaagaacacaaatttggcattacagttaagggagtgatttgaattgattgacaagtcctggcatgtgacaattttactaaattaccaagtttggtttttaataatttcacaatattatgcgccaagatctaattttaaaaatgtacgaggactttgtgctgaaaatacagagtatttttttaaagtaaggctgtcttggcttaaaagcagattacagaaatgtaagccagcgtaagagcagtggctggatgtaaagcgcccagcaggaaccacaggcactctgtgctgtttgtacttgaggtatgtaccatttgtatacctgaatttattttaaagataaactgaaatgcacatagccaagtcttgac

SEQ ID NO: 1255 - DNA, 514 bp, Mus musculus
  misc_feature (30)..(30): n is a, c, g, or t
  misc_feature (443)..(443): n is a, c, g, or t
  misc_feature (467)..(467): n is a, c, g, or t
  misc_feature (475)..(475): n is a, c, g, or t
tccggcctctggtgatcaagacaggacagnctctgtcgtctgcagagattcagagcttctcatgccagtaccctgaagtcacagagggcttcactgagggctttttcaccaagtggtggcgctgctttcctgagaggtggttcccatttccttacccatggagaagacctctaaacagatcacagattttacgggaacttttccctgtttttacccaacttccatttccaaaagactcctccttaaacaaatgtttcctgatccagccggaacctgtggtgggtagcaagatgcataaggtgcatgacctgttcaccctcggcagcggggaagccatgttgcagctcatccctcccttccagtgccgaacacactgtcagtccgtggccatgccgatagagtctggagatattggctatgccgatgctgcccactggaaggtntacattgtagccagaggggtccangcctttgntcatctgcgatggaaccactctctcggatctgtaggaaa

SEQ ID NO: 1256 - DNA, 428 bp, Mus musculus
  misc_feature (330)..(330): n is a, c, g, or t
  misc_feature (386)..(386): n is a, c, g, or t
  misc_feature (391)..(391): n is a, c, g, or t
taccccacagagtagtccaagtaaatgtgggtataaatgtagacgtgttatcatgtgtgctgtcatcttaaaatgtgttacaaacgcttctggaattttgactgcacatgtatcttcatgatttataaagctactgtgacctctaatttggaaaaacccattgtaatgattttcaaagtaaagaaagaaacaggatgtctttttaaggttttaagttcatgcattaaataaaatgtatgggaaagcccaaagacaaactttctaatacccttttatactagggaaatttcacttgctgttttgtaccttgacagatggtaagactataanctgaagttcatattgtaagaactgtttgctaaaattgtcaagtaaaaagaaatccntgccntgtatctataaaaagatgtatgagctattatgttgtc

SEQ ID NO: 1257 - DNA, 543 bp, Mus musculus
  misc_feature (281)..(281): n is a, c, g, or t
  misc_feature (325)..(325): n is a, c, g, or t
  misc_feature (354)..(354): n is a, c, g, or t
  misc_feature (356)..(356): n is a, c, g, or t
  misc_feature (358)..(358): n is a, c, g, or t
  misc_feature (362)..(363): n is a, c, g, or t
  misc_feature (367)..(367): n is a, c, g, or t
  misc_feature (372)..(372): n is a, c, g, or t
  misc_feature (451)..(451): n is a, c, g, or t
  misc_feature (457)..(457): n is a, c, g, or t
  misc_feature (518)..(518): n is a, c, g, or t
ttcttcatggaaaccagtagcccggaggggatgaggtaggcaccttgccaccctcccgggagagagacacaagatgtgagagactcctgctcactgtgggggtgtggctggcctgcttgtttgcctgaggatgctcctctgttggactgactctatccccctggattctggagcttggctggcctatgtcccaccagaggagcatctcagcagccttccaccagcaacctgagggcctgccagcttcgtggctctgggctctcattacctgtatggccgtnccacagagctcagtggccagaggctttgaaacaggaagtacatntcaggttcaggaaccactgtgagctcatnantntctnntgancaatntgaggcctggaccagtggacacggagggagggtggcgagaggatgatggggatgatgaggggaacacgctcccttcctntccttntcatccaccactaccactattcagtgtggagcagtggcaaaggtgaccgacctccacaatntcctagtgatgctggaccatttcta

SEQ ID NO: 1258 - DNA, 199 bp, Mus musculus
tctgctcacagcaggcgctgctgcacacagcatcagccctcgggctgtgtggcagttccgcaatatgatcaagtgcaccatccccgggagtgatcccctgaaggattacaacaactatggctgctactgtggcttgggcggctggggcaccccagtggacgacttagacaggtgctgccagactcatgaccactgctac

SEQ ID NO: 1259 - DNA, 527 bp, Mus musculus
  misc_feature (208)..(208): n is a, c, g, or t
  misc_feature (214)..(220): n is a, c, g, or t
  misc_feature (288)..(288): n is a, c, g, or t
  misc_feature (291)..(294): n is a, c, g, or t
  misc_feature (296)..(296): n is a, c, g, or t
  misc_feature (313)..(313): n is a, c, g, or t
  misc_feature (328)..(328): n is a, c, g, or t
  misc_feature (364)..(364): n is a, c, g, or t
  misc_feature (387)..(387): n is a, c, g, or t
  misc_feature (394)..(395): n is a, c, g, or t
  misc_feature (405)..(405): n is a, c, g, or t
  misc_feature (411)..(411): n is a, c, g, or t
  misc_feature (442)..(442): n is a, c, g, or t
  misc_feature (445)..(445): n is a, c, g, or t
  misc_feature (449)..(449): n is a, c, g, or t
  misc_feature (486)..(486): n is a, c, g, or t
ctctttagcactgtccactttgaatgccgagtgtcataagaaattgcatgctatcttcactcacaatcctgcccttccctcacagagctggaactccaagcctggccccaaagaccctccatcacgaagagcactttacagataagaatcttcctccccagttcttcatgcctccttcctgccctttccttactttgtgttggatttntttttnnnnnnnccaaatatgtgtgtatgtagacttcatggtagtgtttcttatttatttggttgctgctaagccttgancannnngnttcaccttcctgggctntccccagtggtcacntcctgcctggcttcctacttgggtatagcatgtccnaaactgggctctgaacactacancctgccnnttggagctgncctatnctctgggggtgttagagagtttgtggggatnctncttnctgagtaccccaggacttgggaaataatgcaagagtntccctttcagtacataggtaagcttggctatgttcaatatg

SEQ ID NO: 1260 - DNA, 498 bp, Mus musculus
  misc_feature (354)..(354): n is a, c, g, or t
  misc_feature (358)..(358): n is a, c, g, or t
  misc_feature (392)..(392): n is a, c, g, or t
  misc_feature (446)..(447): n is a, c, g, or t
tgcctgcagcaggttagtggtcagagccttgcccgagcctcttgtgtgcaccagagaggacagcatctgataacagagctgactgccccttatatttccttactgctaactcctaatgatctggtaggaaatgtgagtcagtcactttagtactgactcagcaggggtgtgctggggctgggtactgactgagggtgcaatagcaatcaaaccaaagctaggtcattttaagagtttggtggactccagatatttgagccttttcactttacacagaaaagttaagacaggaatggggacatatacctgtaatcttcaggatgtgggaggctgaggcaggagattgcgactttngagngccagcttgagctacatagagagttgcaggccancctgagatacacagtaaaacacacacacacacacacacacacacacacacacannacaatcactgctacatactttataatgtctgtgttcaagtacctcatgggc

SEQ ID NO: 1261 - DNA, 534 bp, Mus musculus
  misc_feature (142)..(142): n is a, c, g, or t
  misc_feature (343)..(348): n is a, c, g, or t
  misc_feature (354)..(355): n is a, c, g, or t
  misc_feature (386)..(386): n is a, c, g, or t
aaggactgacgcgaccatgtgcaatgtgggctcatgggtctgggtgggtcccgtcactgcccccattggcctgtccaccctggccgccacctgtctctagggtccagggccaaagtccagcaagaaggcaccagaagcaccnccctgtggtatgctaactggccctctccctctgggcggggagaggtcacagctgcttcagccctagggctggatgggatggccagggctcaagtgaggttgacagaggaacaagaatccagtttgttgctgtgtcccatgctgttcagagacatttaggggattttaatcttggtgacaggagagcccctgccctcccgcnnnnnntcctgnncgtggtggctcttagcgggtaccctgggagngcctgcctcacgtgagcccttctcctagcacttgtccttttagatgctttccctctcccgctgtccgtcaccctggcctgtcccctcccggccagacgctggccattgctgcaccatgtcgttttttacaacattcagcttcagcatt

SEQ ID NO: 1262 - DNA, 520 bp, Mus musculus
  misc_feature (255)..(255): n is a, c, g, or t
tgacagctttcccatcagtagaagtgggaacataccttcttaggtatttactattaactacatgtaggcagtttatagcttctgatcagtgtagtagacattacaaacactggttgtaatggggttttctgtagactttacttgagaggtgagtataaagcattttttagtcatcatcatgacgatgctgctcaagtgcagatccagaacagtacagcgttgggttcctagagcatttggtaaactgttgtgggntttcttctttctgttgccaaaactgcttttccactaattcatgcctttcaagcattttaaatatgacaatatttataaatgtgtggtttggaggaattgtttaaattctttttcctaattttcttttttcaggatagattatttcaacaagtaatttgtagtgatgactgtgttgacttcaattttggagtgtagtagctgtgtttaaaaaaaagagtaataaccatttggttcttattgaagccaacacggaatttgctgctgt

SEQ ID NO: 1263 - DNA, 40 bp, Mus musculus
tttgttagcttcctgggttcccatgaactcagggatttgt

SEQ ID NO: 1264 - DNA, 447 bp, Mus musculus
  misc_feature (399)..(399): n is a, c, g, or t
aagagctgttcctctccaaagctgttcacaagtcctgcattgaggttaatgaagaagggtcagaagccgctgcagcctccggaatgattgcgattagtaggatggctgtgctgtaccctcaggttattgtcgaccatccatttctctatcttatcaggaacaggaaatctggcataatcttattcatgggacgagtcatgaaccctgaaacaatgaatacaagtggccatgactttgaggaactttaaatgacgacgtttgagtacaaagaaagcaggaacaaagcacattatgtttgcaagtggtatatatttaggatttctgttttatagtgttacttagggaaatatttaaatagttctggatagtagtaatccatgtgacctataagttagcctntcaaaagctgttatcagtataaagagtatggtcccattgtgtcattgt

SEQ ID NO: 1265 - DNA, 186 bp, Mus musculus
gcagccgccgcgatgttgatgcctaagaagaatcggattgccatctacgaactcctttttaaggagggcgtgatggtcgccaaaaaggatgtccacatgcctaagcacccggagctggcagacaaaaatgtgcccaaccttcatgtaatgaaggccatgcagtctctcaagtctcgaggctacgtg

SEQ ID NO: 1266 - DNA, 89 bp, Mus musculus
ctcgaggctacgtgaaggaacagtttgcttggagacatttctactggtaccttacgaacgagggcatccagtatctccgagactacctg

SEQ ID NO: 1267 - DNA, 89 bp, Mus musculus
caactgctgggcttgccttctgttagtgtggtagtacatgacagaggcattagactattttttagctgccctcataaatatataacgaa

SEQ ID NO: 1268 - DNA, 434 bp, Mus musculus
aaagagcttcaaggtcccgttctagatctcgttcaaggtccagatcaagttccagagattaaccctgacctcgacgttctttgcacactataacagaacactttcctacttgcttaggcagttactcttccgagtttatactcgcctcttctttaagaggatttcctgaaaagggaacaccggaatttgatttgtggccaaatttactgagaaaaagatgaggttctaaaatggtggtatgaagccctctcccttctttgtagaattaagataattttgattttgtagcctttgagctaaaataacttttgtaaagattaagctcatttagattttttttaaagtattgcagcaggatctgctgcagggttctgttgttttgttttgcttatttttaaattaactgttcaggctttggatactgcaggctttag

SEQ ID NO: 1269 - DNA, 498 bp, Mus musculus
  misc_feature (341)..(342): n is a, c, g, or t
  misc_feature (345)..(347): n is a, c, g, or t
  misc_feature (396)..(396): n is a, c, g, or t
  misc_feature (409)..(409): n is a, c, g, or t
  misc_feature (429)..(429): n is a, c, g, or t
  misc_feature (431)..(431): n is a, c, g, or t
  misc_feature (469)..(469): n is a, c, g, or t
  misc_feature (471)..(471): n is a, c, g, or t
cccctccaagaaaggtggccgatgagagggcttcttgtgacctcgatccctcagcaccctctgtgccctagcctgttgtccccctccctactcccttatatcattcctgggcccctagatgtgtcctcagctaacctccttctctctccaagtgttctgagcctgggtagctctgggctaccatgtggtgcacttctgacagacaccaggggtttctaagcttcagctcaggtccagcctgtcccttccaccagcctttgcctccgtcctcaccacactacctggtttcttgggtctccatctgggcttcctcgtctgctgagcttttgtcccagctcctnntgnnncaacacaagctagagctgtacccaagaagaagactaacagaaaaccaantcagagttgggancccaccccaccccggcacantntcgttttgagtggaaccactcagagtaaagggactctntnttcactttcttgaacccagaaccaggg

SEQ ID NO: 1270 - DNA, 214 bp, Mus musculus
gcagcatgaatagaagcctccagctgctgtctacaccctggctgggtgcctacctaaagcccccaaccactgtctacatcctggctggctggatgcctacctggtacccacttgccatgcagaggcctgtccgggaggtcacagccttaggcaaacagttgaacctgtgtcaactgcccgcttcctccctcgtgcacctcaatctatggatctg

SEQ ID NO: 1271 - DNA, 408 bp, Mus musculus
  misc_feature (179)..(179): n is a, c, g, or t
gatttctgaagcctccttagtcgatctcaacaccaggctgaagaagaaagtgaagatggaatatttcaggccaaacatcgtggtgtcaggctgtgaggctttcgaggaggatacttgggatgaactcctgattggtgacgtggagatgaaaagggtgttgagctgtcccaggtgcgttntgactacagtggacccagacaccggcatcatagacaggaaggagccactggagaccctgaagagctatcgcctgtgtgatccttctgtgaagagtatataccagtcatctccactttttgggatgtatttctcggtggagaagcttgggagcctgagagtgggtgaccctgtgtaccggatggtggattagtggatcccatggctgacacgcttccaggtccgaggaga

SEQ ID NO: 1272 - DNA, 505 bp, Mus musculus
  misc_feature (331)..(331): n is a, c, g, or t
  misc_feature (403)..(403): n is a, c, g, or t
accaattgttcaagccttcttcgggtcccagaacaacttctgtgccttcaatctgacctttggggctcccacgggccctggctactgggaccaatactacctttgctggtcaatgcttctgggcatgggcttccctccggtggatatcttctctccactagtcctcggaatcatggcggtagccctgggagccccaggactcatgttcctggggggaggcctatttctgctgctgcgccacaggcggtattctgagtaccagtccataaactgaaacccactctccagagggaagggcagtgtctcagactgtcggagggtggggggcccnagggtcatgatctgcttttctgcagaacctcagaagccagcctcaacctactggggtgctcccagtaagttntccttccaaacccacggagaggccacgctcacgggttcccaaactcccgtttcctgtggatgaaacttgaaggcctacatgagtgactgttggctgccctaa

SEQ ID NO: 1273 - DNA, 469 bp, Mus musculus
  misc_feature (348)..(348): n is a, c, g, or t
  misc_feature (419)..(419): n is a, c, g, or t
ttgatgtggacataggccctctttttcagactccccgtgaagtggcgcagcaagctgtggatgcagatgtccatgctgtgggtgtcagcacacttgctgctggtcataaaaccctcgttcctgagcttatcaaagaactcaccgccctggggcggccagatatccttgtcatgtgtgggggcgtgattccaccacaggattatgaatttctgtatgaagttggtgtttccaacgtctttggtcctggaacccggattccaagagctgctgtccaagtgcttgatgatattgagaagtgtttggcagagaagcagcagtctgtgtaacatctggatctttagttatganctgaagcagcagtctgtgtaacatctggatctttagttatgaccgaagaaggtagtggtaaatccgtttcngtcaggtaatcccagcagctcttagaatgcttgctttggaaacctcacat

SEQ ID NO: 1274 - DNA, 555 bp, Mus musculus
  misc_feature (407)..(407): n is a, c, g, or t
  misc_feature (416)..(416): n is a, c, g, or t
  misc_feature (445)..(445): n is a, c, g, or t
agcactggttgtcttgcaactaactctgtagaacagtctggcctcaaactcacagagatccacctgcctctgccttcctagtacagggattaaaggtatgtgcctccatgtcctgcaaattattaaacttaaaaattaaataaaattttaaaatttaaccgattcttccttcaatttagtgttgatttgtgtactagaaactcaagttcctgtgttaatttaataaaataatgacatttatcttacaagaaatagtggagggtatttatggatggatcctcagccagacctactattgcttcaataaaagtagtgtttatcaccccctgtacaatggaataggggacatggtagataggccttccaggattgtgtcagctcctcacatgggaatgatattgttaatntcaggttcnaaactctggaaaagatgtgtgtgacgctntcttaaatgaatgttgatggacagatgcatttgctataatgacagtctaaatctattacataaagtaaatgaattttcagatctagaaacacgctgatctgtatacactt

SEQ ID NO: 1275 - DNA, 544 bp, Mus musculus
  misc_feature (329)..(329): n is a, c, g, or t
  misc_feature (509)..(509): n is a, c, g, or t
gatgtcatccttgtgatggcatgctcctttgctgggtaccatgtagggccatttttttccccctgcagttttcttaatacatttgtcacatgaattctttgtacaaggacttccttcagtaaaactattgacatatttctactggtgcctaatccacatctgtatcaacatagctattgtttatattaatgataaattctgctgacttattttataatagtttctaatttctagctgtttaggtgggccatttgatcattatttgtgtcagaataatgtgaagtgaagtgattgctaagctctgaccagaaaaaagtgtccaagaaaanttaatttcctttgttttactatatgctcaaaataagtactgaaaatatttaggctctgaacccagaggtcagaggattgttatttaactccattttatttgcttaaagaaatcaaaacacaaggtagatttaagtaataaagataaaagtactaaaatattgtaaaacattctgtattgntcttactttagaaatttgcctatttccaggcttaa

SEQ ID NO: 1276 - DNA, 496 bp, Mus musculus
  misc_feature (81)..(81): n is a, c, g, or t
  misc_feature (100)..(100): n is a, c, g, or t
  misc_feature (333)..(333): n is a, c, g, or t
  misc_feature (352)..(352): n is a, c, g, or t
  misc_feature (370)..(370): n is a, c, g, or t
  misc_feature (435)..(435): n is a, c, g, or t
ccagagtaacacctttgctgtcttcttaggatgggtgagtgcacggggctcgggctctttgctgaatacttttcgttcctntgccgaggaaagaatccangtcaggtactcaattagtcaatctccctgcttctaatctgcagtgaattctgtatgatgcctgccctatttcataagcacagagcttcagtcgtgcctaccccagagctctggaaacaggcttaggagtgcttcctgtattgtctgtaaatccttcacctaggaacactgatgcaaggatggactctacctggtacctgtcaaagtgctcaggtgcctgaggtcttttaccanctgctctttcacatgagcnccagtacaagaaatgctnccatcacagctaccttggcacagaggggcctcagctgtcagtagccatcagttgaacaagccaanccttgtccacgtggaccattcaatcaaaaggagatgaatagcttcctgttttagatggctg

SEQ ID NO: 1277 - DNA, 474 bp, Mus musculus
aaaaggcctaatctcagaagcatgagccacgggggctggctcctcttagaaaggaaccggaagcctggttattgagctgagtgagctgggtttgagtttagatccccaacacgaggacctcagagacaacatttgacaggacacaccactcctgagcatcagggattggggacaggagtgagctcacaggtacagcacgggcctccgttctacagggcccctccttgctcttctggaaagggagctgggctatgtggggtgtcttactgactgccttgtaaccttcctgcttcccacgtgtctcatatctgcctctccccccacaccctttctctgggaactgtgacgtcacaacccgaagataatgttttcccagcttggggtagggtgaagtgggacctgaaaaaaaattttaatataaggagatatttatacacagtgttagggatgtaatcttatctcagctaggcagtg

SEQ ID NO: 1278 - DNA, 157 bp, Mus musculus
acagatcaccccttcttactatacaacttcagatgccgtcatttctacagagactgtattcatcgtggagatttcactgacctgcaagaacagggtccagaacatggctctttatgccgacgttagtggaaaacaatttcctgtaacccgcggccag

SEQ ID NO: 1279 - DNA, 190 bp, Mus musculus
gttgccatgatggtactgattgcccatcttgagtgaggggtgaggtgacctgtccttcccctaactcctaataaaggcagttggtagtcctggccagtgctaatgccagaaggagtgtcagccttggagattagcagagcctctgtttgaggccttagaggtatgaggatcatacggagcatgagaggcc

SEQ ID NO: 1280 - DNA, 419 bp, Mus musculus
aactcgtccgactcttctatgatgtctgagctccctgacagctgccctttacctcacagtctccattggacctcagccaggaccagcctctgtctggtccgagatgaccctctggtccaggcctcgctgacacttttgttctcagcttctgccatctgtgactactgatatcctggatggacaccttgctggacttgaagtccgctagttggactttgcctagggctttcatcttgccttgccctccctttctgtcccatctgcagcctcaccaggtgggcttgtagcctctattatgcaaatattcgtagctcagctttcagagcgctaactctaaaggaattcacctgagccttgagagagaacctgggctagggctagagttagggctacatactccaaggtgacctcacatttga

SEQ ID NO: 1281 - DNA, 435 bp, Mus musculus
  misc_feature (276)..(276): n is a, c, g, or t
  misc_feature (285)..(285): n is a, c, g, or t
  misc_feature (289)..(289): n is a, c, g, or t
  misc_feature (356)..(356): n is a, c, g, or t
  misc_feature (410)..(410): n is a, c, g, or t
gggtcacagtggttgtgctgatcctggggctcattcttgcaatttctggggtcatctggagacagccacagaaccgcactccccttcactttaaggtgcctgctgttcctctactcccactggtgagcatctttgtgaatgtttacctgatgatgcaaatgacagctggcacttgggcccgatttgggatctggatgctgattggatttgctatctactttggctatgggatccaacacagtatgaaagaagttaagaatcatcaaactctacccnaaacaaggncccnaactatagaccttgatctcacaacttcctgtgttcacagcatttgacctaaccatacctaattgttntcttgttctcctatacaataatggagagtactcttgaccccacgaagagctggncctctcatgtggtgttagtgacgga

SEQ ID NO: 1282 - DNA, 340 bp, Mus musculus
  misc_feature (146)..(146): n is a, c, g, or t
  misc_feature (166)..(167): n is a, c, g, or t
  misc_feature (173)..(173): n is a, c, g, or t
  misc_feature (175)..(175): n is a, c, g, or t
  misc_feature (191)..(191): n is a, c, g, or t
  misc_feature (196)..(196): n is a, c, g, or t
  misc_feature (219)..(219): n is a, c, g, or t
  misc_feature (221)..(221): n is a, c, g, or t
  misc_feature (229)..(229): n is a, c, g, or t
  misc_feature (280)..(280): n is a, c, g, or t
  misc_feature (304)..(304): n is a, c, g, or t
  misc_feature (314)..(314): n is a, c, g, or t
aagccagagtctggagctggcctctgtgactgctctagctcttctcctggaactcctgccagaaagtcagggtcggtgtccagccctagagaaagggacctgtgaatactttcactcgatttcccaggccccacccaaggaagggnccttccccagacatgagctnncctcantnctttgtggaaagcagntcctntacatttgacctgaaggggactntnggctaatncaggagaagccagggatgcagagtaagagagcttcttgcttaggctatttnttagatgaagaaggtatccctaanccacgatggntccttcatggcaggaaccagagaggt

SEQ ID NO: 1283 - DNA, 531 bp, Mus musculus
  misc_feature (384)..(384): n is a, c, g, or t
  misc_feature (394)..(394): n is a, c, g, or t
  misc_feature (396)..(396): n is a, c, g, or t
  misc_feature (419)..(420): n is a, c, g, or t
  misc_feature (422)..(422): n is a, c, g, or t
  misc_feature (445)..(445): n is a, c, g, or t
gtcagccaacctcctgaaatgggcagccagcagttttgagacagccatgttcataaactatgagcaggtcaacatggacgaccggtttgggcagatcatgattgaaaacctccggaggcgaagttgtgacctggcaggagtggaaacctgcaaatcactggagtcccagaaggaacggctgctgttgaatgggtgggagacagcgtctgcagtgaacatgatggagctgtacagtgggctacctcgggcagaggtaaacagaatagaatccctcgagttcctggatgagatggagctcctggagcagctcatgcgccattactgcctgtgctgggccacccgcggcggccaggagcttggtttgaaggagataacctattgatntgctgaaggntngtgctggggtggaaggtgaaggnntntagctaagggagtgccagggccntcctgagagatgtgcagcctcactttgttggtcctgctgcacatccggaacccgtggttacaaaggtggtcacaccagatcctgtt

SEQ ID NO: 1284 - DNA, 97 bp, Mus musculus
tctgtaccaggcaacagctccagttctcacaccggccaaaatcactggcaagggcaagaagagaaactaactgtgaatgagtaataaagttgtgtct

SEQ ID NO: 1285 - DNA, 489 bp, Mus musculus
  misc_feature (60)..(60): n is a, c, g, or t
  misc_feature (73)..(73): n is a, c, g, or t
  misc_feature (412)..(414): n is a, c, g, or t
cgctgcacccaaggcgcgtagaggaagaagtaaagcaagtccacgttggccccgacgccngcgtacagacaancgcgccggctttggctcccctctttctccagggacacggattggaccacggacggggcgtgatggtagtcggtaccgggacctccttggcgctgtcctccctcctgtccctgctgctcttcgctggcatgcagatctacagccgccagctggcctccaccgagtggctcaccattcaggggggcctgctgggctccggccttttcgtcttctccctgactgccttcaataatctggagaatctggtctttggtaaaggcttccaagcaaaaatcttccctgagattctcctctgcttgctgttggcgctctttgcctccggcctcatccaccgagtttnnngtgtcaccacttgcttcatcttctccatggttggtctgtactacatcaacaagatatcgtccactctgtaccagg

SEQ ID NO: 1286 - DNA, 461 bp, Mus musculus
tgagtgctcggcaacttcacgacttccctcttcctgcctcctgtgcccaccgttcttaggcatcagcatgccgggtccaacgcccagtggcaccaacgtgggctcctctggccgctctcccagcaaagcggtggccgcacgggctgcgggatccactgttcggcagagaaaaaatgccagctgtgggacccggagcgcaggccgcaccacctctgcagggactggggggatgtggcgattctacacggaagattccccagggctcaaagtgggccctgtcccagtgctggtgatgagtcttctgttcatcgctgctgtatttatgctgcacatttggggcaagtacacgcgatcatagattgggctacatccatctgtcatctgaagaagaagaagaaggaaaaaaacccaacatatcttggaccaaaagtgtagtgattttctgttcacgtgtattattt

SEQ ID NO: 1287 - DNA, 116 bp, Mus musculus
aggaagagctaaggatgcccgagacaaaaaccatcttcaaggacctgccgctgccccgattggctctcaactgtgttggtgggaagagttctacagagctgctccggcacctagcg

SEQ ID NO: 1288 - DNA, 311 bp, Mus musculus
  misc_feature (161)..(161): n is a, c, g, or t
  misc_feature (163)..(163): n is a, c, g, or t
  misc_feature (207)..(207): n is a, c, g, or t
  misc_feature (256)..(256): n is a, c, g, or t
  misc_feature (265)..(265): n is a, c, g, or t
  misc_feature (267)..(267): n is a, c, g, or t
gcccggaggaaccatggtgacctatgggggaatggccaaacagcctgtaacagcctctgtgagtctgctcatttttaaggacctcaaacttcggggcttttggttgtcccagtggaagaagaaccacagtccagatgagttcaaggagctgattctcactntntgcaacctcatccgccaaggccggctcacagccccatcctgttntgaggttccactgcagggctaccagcaggctttggaagcctccatgaanccttttgtntnttcgaagcagattctcaccatgtgattgctccagaggaccagga

SEQ ID NO: 1289 - DNA, 520 bp, Mus musculus
tcttcagccaagaggtctgtgtcctggacatttcctcctatactctacttttataaagtgaggacgagtattgagtccacactcaacattaacagtgggcttaataggagaagagacctgaagtaatgtttccttattgggcattcctttgtcatggcttcttctgtgacatggaagctgggctaacctgatttgaacttggctatcccctgttttttcagggctataatcccagcagttgggaaggggagataggagaattagaagtaataggcttgatgtacatgcctgtaattctagcactggggaggttgaggcctgaagagctggagttcaaggaatgtctgtgctattcagggagaccttatttcctttcttccccagatgcagttggttgatgttttatgagacagttctgttctaggctgacaggttgtttactgtctagcaatgagttagccccgggaggtagggaagggctgtccccatgtcataactgaagcccaagatacctgaacat

SEQ ID NO: 1290 - DNA, 435 bp, Mus musculus
  misc_feature (103)..(103): n is a, c, g, or t
  misc_feature (107)..(107): n is a, c, g, or t
  misc_feature (316)..(316): n is a, c, g, or t
agaggtacctggtaggcatccacaggggacatgatctcagaagtcttggaagtcctgaggctggatgttgctagtgatggtcacaagccatgcaccttatcantganaccctcacttggtctttagatctgtgtgcctggtttgcagatccattggtttctcagtccaggacccaagaacgagctccaccaaagagcaggaacccctggagtttgaaggcccccgagagctgggcctttttactgttgggcagtctcttaaacctcatgatactgagttggtactttttttggtccctatttcacaagggttaggnatagattaaccaagaaaggacaagtgacagactgaaaggggctggaaaaacaaagaggaaaaggcctgtcacttctgtatagttgatggttcctgtcacaagcccaggtcacaaacaga

SEQ ID NO: 1291 - DNA, 391 bp, Mus musculus
  misc_feature (189)..(189): n is a, c, g, or t
  misc_feature (344)..(344): n is a, c, g, or t
actatgtgtgttgttcccaaaagaatgactgtcttggttcatcagtgaattcactatccagaagagactgtggtatattttaaacctgttgggccaatgagaaaagaaccatgctgcggagcgagatggacacttgtctgaacctcatcactaactccagcggctagaatgtgttttcatgcccggccntttgttccccccgtccatgtgtcctttagtttcaaacagatctttatagtttgtgcttcataagccaattcttattatgattttgggggactgttcttcaaagagcttgccagtgaagatctagagacagagcgaaggcttcttcaagttctganccttggctgtggacaaaacaatcttaagttgggcagctttcctcaac

SEQ ID NO: 1292 - DNA, 421 bp, Mus musculus
  misc_feature (324)..(324): n is a, c, g, or t
  misc_feature (346)..(346): n is a, c, g, or t
tattcaatcgagtaaacggccggcgacccctcaccacctccccatccctcgaggggacccaagagacctacacagtggcccacgaggagaacgtccgatttgtgtccgaagcctggcagcaggtagagcgacaactggatggcggccctgccgatgagagtggcccacggcctgtgcagtatgtggagagcactcctgatccccggctacagaactttgtacctattgacctcgatgagtggtgggcacagcagtttctggctaaaatcaccaactgttcctagcagctgtccgggaaggaatgttgccatagtggaccctttngccagaagaggaccatggtgcnccgatccaccttgtggcctggctgggtaccggccacacctgaagtgccaacatttggacttttgcacctgttgtt

SEQ ID NO: 1293 - DNA, 484 bp, Mus musculus
agatggaactacatgcgctgtccaccggccgtgagcctcgggtggccacggtcacccgtatcctgcgccagacgcttttccggtaccaaggccacgtgggggcatcactggtcgtgggcggggttgatttgaacggacctcagctctacgaggtgcacccacatggttcctacagccgtctgccctttactgcccttggctctggtcagggtgcagccgtggcactgttggaagaccggttccagccaaacatgacgctggaggctggcgcaagagctgttggtggaagccatcacagcagggatcctgagtgacctgggctctgggggcaatgtggatgcctgtgtgatcactgcagggggtgccaagctgcagagagcattgagcacccccaccgagcctgtgcagagagctggccgttaccgatttgctcctggaaccacacctgtcctgacccgggaagtgagacccctgaccctggaac

SEQ ID NO: 1294 - DNA, 509 bp, Mus musculus
aagatagggctgtctccaaggccatgatcgcctattggaccaactttgccaggagtggggaccccaacatgggcaactcacctgtgcccacacactggtacccttataccttggagaatggcaactacctggacatcactaagacgataaccagcgcttccatgaaggagcacctgagagaaaagttcctgaagttctgggctgtgacattcgaggtgctgcccacagtgactggtgaccaggacaccctcactccccctgaggatgactcagaggttgcccctgacccaccttcagacgactcccaggttgttcctgtcccacctacagatgactctgtggaggctcagatgcctgccaccattggcttctaaagtcttataagctggggctggagagatgggtcaggaattaagatcactcactgttcttctaaaggtcctgtgttcaattcccagcacctacatggctgctcacaactgtctgactccatctactggtgtgcagat

SEQ ID NO: 1295 - DNA, 207 bp, Mus musculus
cctgtccggaccctccaagtggagaccctggtgcagccccctgaatcgtgcacggaatctgctgccattggagacacgctccacatacactacacgggcagtttggtagatggacgcattattgacacttctctgaccagagatcctctggtcatagaactcggccaaaagcaggtgattccaggtctggagcagagccttttggac

SEQ ID NO: 1296 - DNA, 424 bp, Mus musculus
attacttcctgggtgcctgaacatattccaaagtaacactgctacacaagctgtgtgtgctagcaggctaaaaacagccatagctgtcttcatagggatatgtccatgaacgtatacttaggttaaacattattctggtagacagcgcaggtggttgttagcaaggaccatactgtttgattacttgttaatgttaaacaaaaatggttttgaaaactgttttctgttcaacagatcttagtcagtgcttggaagccgcaaagcactctcaaagtatttctgagggaattgatatgggtggcaaaagagaacttacagctatgcattgcttgtagcagttccctttctcagaaacattatttttgttgctctaaataaagcattgcctgtcttgtttgagattttacagccatactctgctatg

SEQ ID NO: 1297 - DNA, 454 bp, Mus musculus
  misc_feature (201)..(201): n is a, c, g, or t
  misc_feature (300)..(300): n is a, c, g, or t
  misc_feature (327)..(327): n is a, c, g, or t
  misc_feature (348)..(349): n is a, c, g, or t
  misc_feature (403)..(403): n is a, c, g, or t
accagctccttattcacaggtgaagcagaaactctatgtaaccagcaagcttctgctttttaaagttattttcacattacaacactggggaaatgaagagagggtgtcttttgctttgggttatggtcagaaactggtttctctggcacacgtgggcagtcagccacacttcagacctgacagcgggggaggggggggggncggtctgtttagttaggcttggtacatctgttatcacagatgctcagtggaccaagactgtctcgctactctctccccactctctgaaattttaatttntgtttagaggtgcatggttcaaatatncagcattctaaaaaaaaaaannttgatttaagaaaatgctgtatgatgttagaagacattgtaattatcatcccgntgtctttgctgtactcgtgctgaagtgttttcacagtcctttgtctagaag

SEQ ID NO: 1298 - DNA, 528 bp, Mus musculus
  misc_feature (185)..(185): n is a, c, g, or t
  misc_feature (211)..(211): n is a, c, g, or t
  misc_feature (246)..(246): n is a, c, g, or t
  misc_feature (257)..(257): n is a, c, g, or t
  misc_feature (392)..(392): n is a, c, g, or t
  misc_feature (446)..(446): n is a, c, g, or t
  misc_feature (471)..(471): n is a, c, g, or t
aattctttaaccactgttgggagcaacaagaaggctgaagtccttaaccccatgatcaatagtgtgtttttagagggctccaatagcaccacatatgtgcaggacgccctccagctgctgctcccggtactgcaggtctcccacatccgcaccagctgtttgaaagctacagcccagccagattncagctagttcaatagcaggccacatntcttcactacataccatttaaaggcaacggacttntatgtcactgnccagaccatttgaggacactacaagcaatttttgcacagttttgaaaatacagagagttaaaatttctcttaatgtatactgttttatcaataattatgttttctttacattaacttaaacttgtacttgttctnattgaagttttcctttaatttgcagttcattcacaaatatatctgttttcctgntcaaccagactatatttagaaattnatagagagaacctagatttttgttcagctttgaaatgtctacctttctatgccctat

SEQ ID NO: 1299 - DNA, 557 bp, Mus musculus
  misc_feature (68)..(68): n is a, c, g, or t
  misc_feature (71)..(71): n is a, c, g, or t
  misc_feature (80)..(80): n is a, c, g, or t
  misc_feature (134)..(134): n is a, c, g, or t
  misc_feature (226)..(226): n is a, c, g, or t
aacctggctgggtgcctggagaatatcctcgaggctctgagaaatcccgccccctcgtccacgacccngcncttcccgcngataaagccacacccacaaccttaggaagagggacttgaacttcaaggaccatnctgctagatgccctactccctgtgggtgaaaagtgggcaaaggtctctaagggggaaggctcgagctggtagccacttccttggtgctaccnacttggtgtacatagcttttctcagccgccgaggactgcctgagccagccacttgtgagtggcagggagatgtaccatcagctcctggccagctgagggtgccaaagacaggattgtagaggaaaggcacaatgtatctggtgcccacttgggatgcacagggcccaagccaagcttctcagggcctcctcagtgggtttctgggcctttttcacttttgataagcaatctttgtatcaattatatcacactaatggatgaactgtgtaaggtaaggacaagcatagaaaggcggggtctccagctggagccctcgactcttgtaaataca

SEQ ID NO: 1300 - DNA, 543 bp, Mus musculus
  misc_feature (359)..(359): n is a, c, g, or t
  misc_feature (369)..(369): n is a, c, g, or t
  misc_feature (381)..(381): n is a, c, g, or t
  misc_feature (493)..(493): n is a, c, g, or t
  misc_feature (503)..(503): n is a, c, g, or t
  misc_feature (512)..(512): n is a, c, g, or t
aggtgactaggctgacactgctgacggagcaggctccagggcctatcatcatggaccttacaggagacctagatgcactgaaaaaccaggtgtttgtcctgaaggagggcattgaatacaaggtgaagatcaccttcaaggtcaacaaggagattgtcagtggcctcaaatgtctgcatcacacctatcgtcggggactgcgtgtggacaaggccatcttcatggtgggaagctacggccccagagcccaggagtatgaatttgtgacttcagtggaggaagcaccaagaggagcattggcacgtggcctctacgtggtcaggtccctcttcactgatgacgacaggctgaaccacctntcctgggagntggcacctccantgtctgccaggactggaaggactgaaccccacttggggtctgtattcccaatttcttgtcagttgcagagacctgcaagcattccctagacctcccagttggtgaccagatntcccccactntctgctgtntcccccctgcctggtgcctattaaatgttac

SEQ ID NO: 1301 - DNA, 391 bp, Mus musculus
  misc_feature (127)..(127): n is a, c, g, or t
  misc_feature (130)..(132): n is a, c, g, or t
  misc_feature (316)..(316): n is a, c, g, or t
  misc_feature (322)..(322): n is a, c, g, or t
  misc_feature (335)..(335): n is a, c, g, or t
  misc_feature (337)..(337): n is a, c, g, or t
  misc_feature (354)..(354): n is a, c, g, or t
  misc_feature (357)..(357): n is a, c, g, or t
gatgagctgtattacctgcagatgtggggcaggggtaccccactgtgagcgggacgattgttcaccgccgctatcctgtggctcagggaaggagagtcgatgctgttcccactgcacagcccaaagntcnnnctctgagactagaacccttccagagctggagaaagaagcggagcactcctagggagcatccagaaggccatatgaccaagaggatgggcctgagctgggagaaggagtggtgctgaggaccccgactctcctgtgggaacccagtgcctttcgtgcctctgctctgcttcttctcctcccccantacctntgggaaccacaantntacaaggggaaagactnctngggtcagaccaaggccatatccatgcgaactcct

SEQ ID NO: 1302 - DNA, 505 bp, Mus musculus
  misc_feature (440)..(440): n is a, c, g, or t
  misc_feature (449)..(449): n is a, c, g, or t
tcacctcgcactacttgaccttgaggctctgagtatctcctgtgcacaggagaagctcctgcaccagaaagcaccaaagcccctggcaccccatcttactccactctccccagggactcccaggtgggaactgctgtggcagtgagctcagcccggacagacactgccaaccctgtctcctggcattgggctccggctctacctccccaagcagggcgaggccccgccttctcagcctagcaccacctgtccccgagtcttctccagcttgcccatcattctcggcgcccacacaggtgacagtcccaagtagataacctccatgggacaagttgggtgttgccttacccgcctgcccagcccctcctcccacaggaacacaggtaccacctgcacccacgacagcttcttttctcacacatggggagactggagccganccccttgtntcttttgaaataggaagaaaaatgagtgttcaggaacatgactcctggactgggct

SEQ ID NO: 1303 - DNA, 334 bp, Mus musculus
gggtcttggatagcctgcaactgctgtcatcaggctttttcccaggcttggatttagaacctgaaaagagccagggacctgaagaaagtgatgaattccagagctgatttgttcactctgacaaatccctcagactcagaggtcaaagttctcatgcttggaagttctcatagtgtgcaaactcctcagtagcccaaaggcatcaggtgtgggggctcactctggcaaaggagagagggcagtggaccctgctgttctcagaatgtgaacacagacagggccagccaaagaacttgatagaagctgataaggcaggcaatgtgaggccagcatt

SEQ ID NO: 1304 - DNA, 274 bp, Mus musculus
gagtccggaaggacaccacctttcttcctggttcatcacagaggccaacttcccagagtacaagcagcctgagctctcctgggagtctccattaaaagcctcgagttccactcagagattaactcaaagcagctgatctgctagactctttttctattccctactctgacttgcagtttacagagattgacaaggctcccattgtcttccaaggctcctctggcacaggagatgtctgtaaagaagacagcaacatttgagctcctgaagactt

SEQ ID NO: 1305 - DNA, 479 bp, Mus musculus
  misc_feature (162)..(162): n is a, c, g, or t
gcaggtgcctgtttactcagcaaatagggcaggaagtggctgctgggtactgccacaggccaccagcctcatcaattattaaccatgtgtgagctagaatagtcagggaaactggaaaaaaatggctgccagctccactccctttgtcctctgctgaagaanggaaaagacccggtgtgcttccacccagaggtcacatggacttggcaaacctgcggagctgggctgttctaagctacccaccctgggaatgaatgacagaactggttgagtgtgctttcaaggagaccctggtcccacttcttggcacagacagaaaccagctcaagcttgaagctctggttttgactaagccagcttaaaagacctgcctgctgccagaactcaagaagtagatctacctcaagacattataccagtacttcttgccaggagcttcccttggaaatcaagcagagagttcattctttccctccaga

SEQ ID NO: 1306 - DNA, 589 bp, Mus musculus
tgggagctctgacaatcctgaccaaaacacagaggattatctattccaagtcattttggaaaagcagatccgcatcccgcgttctctgtctgtaaaagcagcaagtgtactgaagagttttctcaacaaggacccaaaggaacgattgggttgtcaccctcaaactggatttgctgacattcaaggacatccattcttcagaaatgtggactgggacatgatggagcaaaagcaggtggttccaccctttaaaccaaacatttctggagaatttggtttggataatttcgattctcagtttactaatgaaccagtccagctcactccagatgatgatgacattgtgaggaagattgatcagtctgaatttgaaggttttgagtatatcaaccccctcttgatgtctgcagaagagtgtgtctgattctgcttgccgccattcagtgcatggatatccacccgtcagcctgctcacagttagcattttatgttgcccctgcagaagtcgctctcggtatcctgttggagactaggaatcatacagataaatagaactaagaaacagaagctagcttcctgacaatcatgt

SEQ ID NO: 1307 - DNA, 567 bp, Mus musculus
  misc_feature (311)..(311): n is a, c, g, or t
  misc_feature (315)..(315): n is a, c, g, or t
  misc_feature (317)..(320): n is a, c, g, or t
  misc_feature (323)..(326): n is a, c, g, or t
  misc_feature (328)..(328): n is a, c, g, or t
  misc_feature (402)..(402): n is a, c, g, or t
  misc_feature (409)..(409): n is a, c, g, or t
  misc_feature (430)..(430): n is a, c, g, or t
  misc_feature (432)..(432): n is a, c, g, or t
  misc_feature (435)..(435): n is a, c, g, or t
  misc_feature (437)..(437): n is a, c, g, or t
  misc_feature (440)..(440): n is a, c, g, or t
  misc_feature (442)..(442): n is a, c, g, or t
  misc_feature (463)..(463): n is a, c, g, or t
  misc_feature (542)..(542): n is a, c, g, or t
atttgggcactatggaaggttccagtttaatgcctttaaattcttgaaacatctcaactctgtgtatctcaagtgtaagattttgatatgtgataacaatgaccaaacatctcgctgcaatcaaggctgtgtcccaagaaggaaacgggatattccttcctacaaatggaagactgactctgttataggacccattcgcctgaagagggaccgaagtgcaagtagagattcaggacttctgcctcaaatacatgaagcagaaatttcaaaccagcccctcagtcgcctgtacctgttttccttcatggttnttgngnnnnaannnngntgattgtggcgataaccacagtgaagcatttcctaaatcggtggatggatcacagataccagaagctgcaggtntactagnctgtggaccccaagaaaggcntnttntnttntnctgggtgcctgatgaagcagntccctgtgcctacaagggttcagaataaaccaggaaggcctaaaaagcaacatgtgtaccatcatgttcaaatcacatngacagtgtgtttcattacggaatag

SEQ ID NO: 1308 - DNA, 531 bp, Mus musculus
  misc_feature (63)..(81): n is a, c, g, or t
  misc_feature (87)..(87): n is a, c, g, or t
  misc_feature (391)..(391): n is a, c, g, or t
acagcactgtgtacatcatggccatggccatgcagatggccaccttcgccatcaactacaagnnnnnnnnnnnnnnnnnnnggcccnacccttcatggagagcctgcctgagaacaagcccctggtgtggagtctggcagtgtcactgctggccatcattggcttgctccttggttcctcacctgacttcaacagccagtttggccttgtggacatccctgtagagttcaagctggtcatcggccaggtcctggccctggacttctgcctggcactcctggctgaccgtgtcctacagttctttttggggactccgaagctgagagtgccttcctgagaagatggtgctggtatccactgcctaccctggctgccactgaacaggaaaacngccgctgccccaggagggagcactgctcccatctccacagtgaggcagccctgccttgctcttggaagactgagttgggacccttgtgggcatccgctggccgggctagtagaagagtcctggctagcacctttggtaaa

SEQ ID NO: 1309 - DNA, 572 bp, Mus musculus
  misc_feature (469)..(469): n is a, c, g, or t
  misc_feature (518)..(518): n is a, c, g, or t
aattcggccaggaaccttgtggtcaaagatgacaacatctggacagggggtctggacgcctgcctgcgatgctgggacctgcggatggccaaggtgtcactggagcatctgttccagtcccagatcatgagcctggctcacagtccgaccgaagactggctgctgctgggcctggccaatggccagcactgcctgttcaacagcaggaagagggaccaggtgctcactgtggacaccaaggacaacaccatcttaggcctcaagttctccccaaatggcaagtggtgggcgagcgtcggtatgggcaacttcatcacggtccacagcatgcccaccggagcaaaactgttccaggtccccgaggttggccctgtcagatgcttcgacatgactgagaacggcaggctcatcatcacaggatccagggactgtgcctcggtgtaccacatcaagtactgacaacttcaantcccctcccctaactgcacagtggtggatggcaatgggtgtgatgggtntgcagtgcttctagaggcttccatggggtgtgcagatcccgagttgcgtgtaat

SEQ ID NO: 1310 - DNA, 589 bp, Mus musculus
  misc_feature (270)..(270): n is a, c, g, or t
  misc_feature (331)..(331): n is a, c, g, or t
  misc_feature (506)..(506): n is a, c, g, or t
aggagtcatacgagccctagggccacctccgggggtgcgtcgcaggccctgcgagcagatcagcccagaggaggaagagcgccgcagggtgagacgcgagcggaacaagctagcagctgctaagtgcagaaaccgaagaaaggagctgacagacttcctgcaggcggagaccgacaaattggaggatgagaaatcggggctgcagcgagagattgaagagctgcagaagcagaaggaacgccttgagctggtgctggaagcccatcgccncatctgcaaaatcccagaaggagacaagaaggacccaggtggttctggcagcaccagcggngctagcagcccaccagcccccggccgcccagtgccttgcatctccctttctccaggacccgtacttgaaccggaagcactgcatacccccacgctcatgaccacaccctctctgactccttttactccgagtctggttttcacctatcctagcacaccagaaccttgctcctccnctcaccgaaagagtagcagcagcagtggcgacccctcctccgaccccctgggctctcctacactcctggctttgtgaggcacc

SEQ ID NO: 1311 - DNA, 499 bp, Mus musculus
  misc_feature (47)..(48): n is a, c, g, or t
  misc_feature (79)..(79): n is a, c, g, or t
  misc_feature (304)..(304): n is a, c, g, or t
gcagttgtccagaagcgctttggcttcccgtgaaggcagcgtagagnnttatgcagagaaagtggccacaagaggtctntgtgccattgcccaggcagagtctctacgctacaaactccttggagggcttgcggttcgaagggcctgctatggtgtgcttcggttcattatggagagtggggccaagggctgcgaggttgtggtgtctgggaagctccgaggacagagggccaagtccatgaagtttgtggatggtctgatgattcacagtggagaccctgttaactactatgtcgacacagcngtgcgccatgtgctcctcagacagggtgtgctgggcatcaaagtgaagatcatgctgccctgggacccaagtggtaagattggtcccaagaagcctctgcctgatcatgtgagcatcgtggaacctaaagatgaaatcctgcccacgacccccatctccgaacagaagggtgggaagccagagccaccagccatg

SEQ ID NO: 1312 - DNA, 214 bp, Mus musculus
  misc_feature (31)..(31): n is a, c, g, or t
  misc_feature (74)..(74): n is a, c, g, or t
  misc_feature (180)..(180): n is a, c, g, or t
atatgctcatgtggtgttgaggaaagcaganatcgacctcaccaagagggctggagaactcacggaggatgagngtggagcgagtgatcaccatcatgcagaacccacgacagtacaagatcccagactggttcctgaacagacagaaggatgtgaaggatgggaagtacagccaggttnctggccaacggtctagacaacaagctgcgtgagg

SEQ ID NO: 1313 - DNA, 397 bp, Mus musculus
  misc_feature (292)..(294): n is a, c, g, or t
  misc_feature (338)..(338): n is a, c, g, or t
tagggaaccccaactgtgacggccaccagcagggctacgctcccaagtggaggacggacgatgccccactgtaggggccgtgccagagctcgcacagatagtccaggcttggccttcgctcccacctacatttaggcatttgtccggtgtcttcccacacccgcatgggaccttggaggtgagggcctctgtggcgactctgtggaggccccaggaccctctggtccccgccaagacttttgccttcagctctactccccacatgggggggcggggctcctggctacctgtnnnctcgctcgctcccatggagtcacctaagccagcacaaggccccntctcctcgaaaggctcaggccccatccctcttgtgtattatttattgctctcctcagga

SEQ ID NO: 1314 - DNA, 532 bp, Mus musculus
gagactatctagtttctgtaggttatttttcccaataatgtttccagatcgaatttcctcatagagaaaaaaaaaaaggtgtgccttgtgtctgtgcttctccgctctctgaaaggatggatggatctgaagttctcagccctcaccccacactgctggaatcttctgtagagctgcctgccaagccacctgaaacacagtggctccctgtgacactcaggcctcagatgagcctcgcttgccttcactgcttctgttttaaacagtagtaaaaaactggcgttcaaggcagagtccacaggtgcttaaaggacactttcagaagaagctgaaggccttgaggtctgcccacccagctgatctcggagtcctggccccagtccatgtgtagctctaagaacatgaagtagctggttgcaagatggaccaactcaccaagtgtcagcccaggtagtgagaaacttgcagtagacatggagctgggctcttttaaatttgttttgtgaagtttcagcctcttaatgcttttgta

SEQ ID NO: 1315 - DNA, 335 bp, Mus musculus
aactgcccagcagcccggaagataagcgggcaggcggtgaagagtcacaatttgagatggacatttaagggaccagccgtaggacgcaatgatgcttctatgtcccccaaggcccttgggaggagagctgcacagcattcaggcctcataccaggcagacactgggtgtgggtcggccacccagtcctgctcctcactcagggtgccagctctgccttgaattttgtgaacaccagcacatacctccttgtgcctctgtctataccgagctgctactgcaggggaatgactctcactcacaccctccctgcatggagctccagcgagtggactca

SEQ ID NO: 1316 - DNA, 559 bp, Mus musculus
agcacctagggtacaggtccaggctggagagggaggtctcgtgtacgtctgtctccagcgtcacactacccctccattccactttcctatccagtccatctctaggcttcccctctgcctaacccactgtgggctatttggcagagtcagtttctgtaccccttcagtgcaactgagaaagcaaggccctcagggaactggaggaggagccagcctgatccctggcctctggagtcttaaagcaagtgtgtttttgcaggtagtcctagttgggtgtagggggaggctgccaggcctggcatgaacataaagcaggaagccactctgggtgatggcagatgagaacctagtcagggagggagggttttaaggaggggacttggaacacaagtgagaagccagtcaagaaaagggagccaggacctcagaatttatactggcctaggggacaggaaggggtgattgtagttggtaactaggggtcattttagctctgtgagagaatcagtgttttgtgagggtgtgggggaagggttgcatctagtggaggctgatcctc

SEQ ID NO: 1317 - DNA, 402 bp, Mus musculus
  misc_feature (28)..(28): n is a, c, g, or t
  misc_feature (242)..(242): n is a, c, g, or t
  misc_feature (254)..(254): n is a, c, g, or t
  misc_feature (257)..(257): n is a, c, g, or t
  misc_feature (273)..(273): n is a, c, g, or t
  misc_feature (280)..(280): n is a, c, g, or t
  misc_feature (283)..(283): n is a, c, g, or t
  misc_feature (336)..(336): n is a, c, g, or t
taagttcaaggatcctcctggcctcgcnccccaacactgtggtcccagatcagctgctacgcccagattttacacagtgctggggacccaaactcaggtcttcctggacagcaggtactttaccaactttccccctttgtctctacatcaagtgtgtctgtggctgttgttccgttggtgtctgtccacctgccctttcttcccactctacgcgctgacactccacacactgtcctcacccntgtctctaaggnccngcccgtatgtgtaccngctgaangtntcctgaggaatttaagcattttaaggtgtgtgttagcagaggtctgaggctcncactcgatgggaacacagaccatcagtttcactttaagcaccgacactccaaacgcgcgtgtgcag

SEQ ID NO: 1318 - DNA, 566 bp, Mus musculus
gggcttcggcacatcccaaagtggggcaggcagtagtgacacaagtcacaccagcaaatactttggaagcattgactcttcagagaataatcacaaagcaaaaatgatcccagacacggaggaaagcgagcagttcattaagtacgtcttgcaggaccccatctggctgctgatggccaacacagacgacagcatcatgatgacataccagctgccctcccgggatctccaggcggtgttgaaggaggaccaggagaagctgaagctgctgcagaggtcccagccccggttcacagagggccagaggcgagagctccgagaggttcatccgtgggtccacactgggggcctgcctacggccatcgatgtgacaggctgtgtttactgcgagagtgaggagaaaggcaacatttgcctgccatatgaggaagacagtccttccccgggactctgtgatacctcagaagccaaagaggaggaaggtgaacagctgacaggccccaggatagaggcccagacgtaaccctgtcccccagccagaggtcgacattagacggtgctcggaa

SEQ ID NO: 1319 - DNA, 502 bp, Mus musculus
  misc_feature (454)..(454): n is a, c, g, or t
gtctctgaccctggatggactgacaggtgtttcccaggaccatatgcgggctcattaccaaacaggttccaaccacatgatgttgaacatcaacctttggtccacgttcttgcttggtgctgggatcctgtttactggggagctctgggagttcttgagcttcgccgagaggtacccgaccatcatctataacatcctgctctttggcctgaccagtgccttgggtcagagctttatcttcatgacagtcgtgtacttcggtcccctgacctgctccatcatcaccacaacccggaagttcttcaccatcttggcttctgtgatcctctttgccaaccccatcagctccatgcagtgggtgggcaccgtgctggttttcctgggtctcggtcttgatgccaagtttgggaaaggaacaaagaagacctcccactaggaagaaagaggcttcctntactccagaaacacttaaattattatctcgaacagtggcatcttggga

SEQ ID NO: 1320 - DNA, 501 bp, Mus musculus
tcaggacctgagctgtttgtagccttttgccttttagagaagaaaaacaaaaaacaaatctttccactatttagtttttgattctgatgacttttttctcttctacctggccctgattttttataaactgtgttttgagtgttctctggatcagggccaggggaggtcgacccccttctccaaaatcccaccccagccccatggttgccaaacactacgtctgccaatatctgcctgcccaccttggctgtgacaacgatgctccttacatgttcctggattggtggtaagaaggaggaaagttaaggagggtctcctaatttttcatgattttttttcttccccagaatttgttagctttttgtgtgtggggtgggggaggggagggttgtcctgtttttgataaattaggggaagctatgggcttaggcaagggaaagaggctggctgacccaggtggtgacccagactacactctaacaccatgtttttgtacagaat

SEQ ID NO: 1321 - DNA, 506 bp, Mus musculus
  misc_feature (97)..(100): n is a, c, g, or t
  misc_feature (179)..(179): n is a, c, g, or t
  misc_feature (273)..(274): n is a, c, g, or t
  misc_feature (327)..(328): n is a, c, g, or t
  misc_feature (331)..(331): n is a, c, g, or t
  misc_feature (333)..(334): n is a, c, g, or t
  misc_feature (342)..(342): n is a, c, g, or t
  misc_feature (344)..(344): n is a, c, g, or t
  misc_feature (357)..(358): n is a, c, g, or t
  misc_feature (364)..(365): n is a, c, g, or t
  misc_feature (373)..(373): n is a, c, g, or t
  misc_feature (382)..(382): n is a, c, g, or t
  misc_feature (416)..(416): n is a, c, g, or t
cctggtgtgttgtctgggtagctaatgacagttctgtccagctgaggtactagtcttgatgacttgaaggtcagtctgtaaagtgtgagtcttgtcnnnncactgttgagccaactctgagctggctgggtgactgttggttattctggcacaggtgctgggtaggccagggttcagcntcgcagacaagaagcgcagaacaggctgcattggggccaaacacagaatcagcaaggaggaggccatgcgctggttccagcagaaggtaaagcnnattgtcccacgtgagctggtgctctgtggtgctggggactggtgttgggatgnnagntnngcaggtanantgctgtttggtgnntagctnntataaagntggaatatntgggcattttggtaaatgcctcctagggttggtntttgaaaaggtcttgagtgtaggtatctggagtcagaattctcagacgttagtctttgttgcagttcttgctctgaccttgttctgaaaa

SEQ ID NO: 1322 - DNA, 452 bp, Mus musculus
  misc_feature (102)..(102): n is a, c, g, or t
  misc_feature (105)..(105): n is a, c, g, or t
  misc_feature (199)..(199): n is a, c, g, or t
  misc_feature (295)..(295): n is a, c, g, or t
  misc_feature (342)..(342): n is a, c, g, or t
  misc_feature (344)..(344): n is a, c, g, or t
  misc_feature (363)..(363): n is a, c, g, or t
  misc_feature (387)..(387): n is a, c, g, or t
gattaacttccccttgttcaatgcacatttgagtccgtgatgaaggtttcatagggtgctcagtattcgtaaagagcaccgtgtcagaggggtctgcggagnagncgtcccgtgaggccccaggctctggtggctgagtgtacctctgcctcccatgctgccctcccttggtgatgcagtatccaagcatgccagcggntccacagtcatttgctctgcaccagtctgcctcccacagtccacatagcctcctgctggaaactcccagctgcaaaccatccttatgtggctcagntcttccttcctcggcccttctggcttcacccatttgctccagacccntnttcagccctttcatcctgnttccctgactctcgtccccccaantccaagatggctgcccaccaccattgtggtctcggggaccaaccgtatttccacaccattagact

SEQ ID NO: 1323 - DNA, 462 bp, Mus musculus
  misc_feature (427)..(427): n is a, c, g, or t
aaggcagtgctgcagcgcgaacacatctctcacgtggagaatgcgatgcagaagctgagatctgagatgagcagcctacgccgtacacaggagcaggtggagggcaggctccttagtgcccgcagggatgggcaccgcctgctgcgccggcagcggaccctggagcagcagcacaggctactccggcgccacagccagaaactgcaggctctgtatttaaagaaggcgcgagagctccaagagctggctagagcctcaggaacccccctccccgagcacacatggctcaagatccttgtggccactatggagagggagctggaaggccaaggtggggctaaggaaccagcccctctgggaaaggctcgaccgaaccactccaagtccatgggtacaactcagttacctggtgacacccctccgcccntccaccaccagctccactttggcttcagagacgaa

SEQ ID NO: 1324 - DNA, 550 bp, Mus musculus
  misc_feature (226)..(226): n is a, c, g, or t
  misc_feature (247)..(247): n is a, c, g, or t
agggcagggaaccagatcagtcttccggtctgtaacacagagaagcacataatctttctttgccgtgaccgaaatgttcctcatttatcatcctcttccatgtttgggattgctgctaaagtcagtattatttctttttaaaaatatatttgcttatttaaaccatgttcttccagcaatcatagaacttcaaacttgcactgcaagcccgtagatattccccacngcggatatccacgcacttagnttttaatcctctccccgacagtctcaactgattttaagctgttactatgatgaaaacgttagagactggtgtctttgcatctctgtctgccgctgctgcctccacaaacccagggtagtcagactgctgtgtctgagaggaagccctgtgccctgctatgaggaatgctgcgccctctgccccagacatgaaggcacagccactggaaaataagctgtggagtcacgtaaaacagatttgcatatatgacatacaacattagtcaaccacaatcaccaaaattctctcataacttgtgcttgt

SEQ ID NO: 1325 - DNA, 578 bp, Mus musculus
gtttcctgacaaagactgggctcacatctccaacgaggccaaagacctcatctctaagctcctggttcgagatgcgaagcaaagactcagtgctgcccaggttctgcagcatccatgggtacaagggcaagctccagaaaggggactccccacgccgcaagtccttcagagaaacagcagcaccatggacttgactctcttcgcagctgaggccattgccctgaaccgccagctgtctcagcatgaggagaatgaactggccgaggaacaggaggccctagctgagggcctctgctccatgaagctgtcccctccatccaaatctcgcctggctcgaaggcgagccctggcccaggctggccgaagccgagatgcaaacccatgtttgacaccggcagggctctgaaccactgcaggcactccttgtaggcctgtcccagcggtgccccctgaaaacctgtaaggtcaaagtgtgaagtaggcagagggacctgccctgcagcccctgcaggcctttaccatccacaaaggctcccgggttcccacccatcccccatttccctggagtcttcaaagga

SEQ ID NO: 1326 - DNA, 512 bp, Mus musculus
  misc_feature (134)..(134): n is a, c, g, or t
actcagccctgtttatttgtgtaattattttttttttaaattgtattacctgtggttgccatcccctgccccagccttgggtccagtgtgtcttccaggcctgcctgcacctcacttggctgctccagggtctntatcctttgttccaaccctggttgtcaggcccagccagcaaaggcccacgacccagcagcctgcccaaagcacttgtttatggagggaaagaaggggacttctctgtaggaagcttgagcccagagccctggggaaggggaccctgttccacattcccttgcccaccctccaccaggtcggaggcccagtcttcccagacgtgctaaccccattcaatgtgccaaatggcctcagtccatgtgcccgtcccccctctgcagtcagagcaccttctcccaagacccgcagtccgtttgtccgtcctctgtgccctctgcagtgacagccctggccaagccacttctaatcctctgtagcaataacggtgtgccgcccgc

SEQ ID NO: 1327 - DNA, 474 bp, Mus musculus
  misc_feature (327)..(327): n is a, c, g, or t
gccagttattgagcggacattccctttctctgaagtcccagaagccttcctgaaggtggagagaggccacgcccgaggaaagactgtggttaatgtagtttaaatacatatatgggcaagctggcggcttgctgctctctcctcgccaagtgcctcggacccagacatctagccttcaccacacattctcccgagtcagattttaagtttcactatccatgtataaacctactcctggactggtgagagctcacaggtaaaagttgccgtggctgcctgagttcagttcctggagcccactcgagggagaactgattccagtacatngttctctctccccctcccccactatgcacacacctctacagagataaagaaatgcataatgcttgtgtgggcacatgcgccaagggcacgagaggacatcacagggaaccttcgggagccagtgctagcctttacccacggagtcat

SEQ ID NO: 1328 - DNA, 416 bp, Mus musculus
acctgaagcagcattacatcgacctgaaagaccgtcctttcttcccggggctggtgaagtacatgaactcggggcccgtggtggccatggtctgggaggggctcaatgtggtgaaaacgggccgagtgatgctgggggagaccaatccagctgattcaaaaccaggcaccatccgtggggatttctgcattcaagttggcaggaacatcattcatggcagtgattcagtggagagtgctgagaaagagatccatctgtggtttaagcccgaagaactgatcgactacaagtcttgtgcccatgactgggtgtacgagtagacatgaagaaaccagaatccttttcagcactactgatgggtttctggacagagctcttcatcccactgacaggatggatcatcttttctaaaacaa

SEQ ID NO: 1329 - DNA, 116 bp, Mus musculus
aagatcatccggcaccccaattataattcatggaccctggacaatgacatcatgctgatcaaactggcttcccctgtgaccctcaatgccagagtggcctctgtacctctgcccag

SEQ ID NO: 1330 - DNA, 362 bp, Mus musculus
gggcaacaccctcagcaatggtgtgaacaacccagacctgctccagtgtgttgatgccccagtgctgcctcaggctgactgtgaggcctcctaccctggggacatcaccaacaacatgatctgtgttggcttcctggagggaggcaaagattcctgccagggtgactctggtggccctgtggtctgcaatggagagctgcagggcattgtctcctggggctatggctgtgcccagccagatgctcctggtgtatacaccaaggtctgcaactacgtggactggattcagaacacaattgctgacaactagagaaccctagtctctcttcaatcagtattatcaataaagttcatttgtcatc

SEQ ID NO: 1331 - DNA, 350 bp, Mus musculus
actagactgccatacctgtgtgaaggcgacatgtacaatgactactatgttctggacgatgctgtctttgttctcagaccagtataaacacgtggaggcccaagtcctcagagtcacccctgcaaccgaccctccagaagaggagatgcatccagtgatgtgagggggacctctggggactgtcattctcagtatcatgtaggaatttaaaaagccaaaatactaattctttctttgtagtgtgtaagggagtgtttttaaaaacaaaacccaactctttgtgtatttttaatcaactctttactcagaatcacgctccaatgcaggtcactctccaattatgatggaag

SEQ ID NO: 1332 - DNA, 393 bp, Mus musculus
  misc_feature (281)..(281): n is a, c, g, or t
agcacttaggaagcttctccaacctgtgctctaggtcagtaaaacttcgtcctctgaaatgcttttctgtactaaactaacttgaacgtgacctagaaaccaagagatactgcttcatgtgtggtctttattgggccacaggagggtcaatcttgtgggtctgtgctgtaatctgccttacttgcacccaccaggataaggacataaacggtgctcaacttttctgccaccagactgttaactttgctaaatggctcaagaacagtcagttagccctgctntcttgactatgttgtttttaatcactgtgacctctgaattttcaagtataggccaaatgagccaagtaacttggctgtgaaatggcagaaggaaccttctctcaagcaggta

SEQ ID NO: 1333 - DNA, 416 bp, Mus musculus
  misc_feature (86)..(86): n is a, c, g, or t
gcacctatcggccataacagagactcttacatggttcctttcataccgctctatagaaatggtgatttcttcataacatccaaggnatctgggatatgactacagctacctccaagagtcagatccaggcttttacagaaattatattgagccttacttggaacaagccagtcgtatctggccatggcttcttggggcagcactggtgggagctgttattgctgcagctctctctgggcttagcagtaggctatgccttcagaagaagaagaagaagaagcaaccccaggaggaaaggcagccactcctcatggacaaagacgactaccacagcttgctgtatcagagccatctgtgaacatcctaggaaacagagtgggactgaaaggttttacctcactcgacctatttgttgg

SEQ ID NO: 1334 - DNA, 499 bp, Mus musculus
  misc_feature (138)..(138): n is a, c, g, or t
  misc_feature (234)..(234): n is a, c, g, or t
  misc_feature (426)..(426): n is a, c, g, or t
  misc_feature (460)..(460): n is a, c, g, or t
cgggaagccttaatccagttcttggaacaggtccaccagggcatcaagggaatggtgttggatgagaactctaacaacctcacgggggctgtcatttccgtcaccggcatcaaccacgacgtcacttcaggtgaacanggggattatttccggctgctgctgctcccgggtacttactctgtcactgccaaggcaccagggtacgaccccaaaacagtgactgtgacggtgggncctgcgggaccaacagtggttgacttccaactcaagcgaagctcatctcaggtgtaccctgtgcagagagctcccggccgagggcagggaggcagggcaaagcagccccggacatccagaaagaaagacccagcaacgaaacggcataggggtcctgcatgaagccagcacccaggaccacacacagcgagnccatccctgctctcaaaccccttgatcacgcttntctctttattatctgggacagatttagacacagacacat

SEQ ID NO: 1335 - DNA, 66 bp, Mus musculus
caggcaaggctctcgctcagcagctcctgttaccaagtttgtaaccagaactgacagcgaaaagca

SEQ ID NO: 1336 - DNA, 499 bp, Mus musculus
  misc_feature (45)..(45): n is a, c, g, or t
gttttgaatgctgacctacttttttgcctttattaatatgaaaanattcccaaacttcaagcacttaagatttcaagaccaaaattaagttgggtttgataagttgacttgagtcatccctgcctgacctagcgacttcacttggcattgttgtcacacttacaagaagttacagtaatgttgaatgggacttgtaagaggcttccttccctctgtctttgaagccatattctgcctgcgtgtattataaggaagtggtaatttcagtagcttttctattcctgacctttttcattcttgttttcttgtggtccaatcccttccacacacagctaaaggaaagctacaaaataaaacacacacagaaacaaacttataagctgtttaacgtgtaagccaaagccaataatgattgaaggttttctgtgtcttctgtaattgttaatcactttgcaaaagggggtgaaatgtcaaattgcctgtatttgcatttctggac

SEQ ID NO: 1337 - DNA, 548 bp, Mus musculus
  misc_feature (131)..(131): n is a, c, g, or t
  misc_feature (257)..(257): n is a, c, g, or t
  misc_feature (364)..(364): n is a, c, g, or t
gagtcttcaggtgccaggcgtctactatagcatcagtaagtatttagcagaaactaactccataatgaatggaattcaattccacacatggtttgttcaagcacacttaataagtagtctacttttaaatntctttttttaaaaatgtaaatacttggatgaagcttttctttgtttcaatatagtcatttacatcatgaacattgttttcagaatttatcttttgaacaagttggctttagaatctgtcaagtgantgtaaggatcacgagtatcaaactctgtcactggacattgagaagagtggactaaagcgcggacccgctagctcaggttgtatggcttcatcatttggatcatgtgntgtgtgtagtaagggagctgtccgccaaagcttggcctgagaggtttggaaaggagaagtgagtgaggctcagtataaaaggctacgggggaagaatcaggtagaaatgagacgtagcagtgacgtcagaaagtggaacttggtaggcatcagcctggcatcatcattagagcagtgagcacta

SEQ ID NO: 1338 - DNA, 534 bp, Mus musculus
gactctataaaatggctgttggctttatgttggctcatccttatggtttcacacgggtgatgtcaagttactattggccaagaaatttccagaatggaaaagatgtcaatgactgggttggaccaccaaataacaatggaaaaaccaaagaagtgagcattaacccagacagcacttgtggcaatgactggatctgtgaacatcgatggcgtcaaataaggaacatggttgccttcagaaatgtcgtcaatggtcagccttttgcaaactggtgggataatgacagcaaccaggtagcttttggcagaggaaacaaaggattcattgtctttaacaatgatgactgggctttgtcagaaactttacagactggtcttcctgctggcacatactgtgatgtcatttctggagataaagtcgatggcaattgcactggaataaaagtctatgttggcaatgatggcaaagctcacttttctattagtaactctgccgaagacccatttattgcaatccatgcagagtcaaaaatat

SEQ ID NO: 1339 - DNA, 303 bp, Mus musculus
tacgatgcctttttggcctctgagtctctgattaagcagatcccacgtatcctgggcccaggcctaaacaaggctggcaagttcccctccctgctgacacacaatgaaaacatggtggccaaagtggatgaggtgaaatcgacaatcaagttccagatgaagaaggtgctgtgtttggccgtcgctgttggccacgtgaagatgaccgatgatgagctagtctacaacattcatctggctgtcaatttcttggtgtccttgcttaagaaaaactggcaaaacgtgcgggctctgtacatcaag

SEQ ID NO: 1340 - DNA, 154 bp, Mus musculus
tcccatgacaccctaagcaattatggggactaagtaggttgggttggggacagcatggcctctgtgattctgtgggcagtgcccacttgctatattgataagcagttcatattgattattggctattctatactgttaacatgaccctagttgc

SEQ ID NO: 1341 - DNA, 418 bp, Mus musculus
  misc_feature (134)..(134): n is a, c, g, or t
  misc_feature (373)..(373): n is a, c, g, or t
agctgacagtccagatctcccaggagacaaccgcagatgccatcgccaggaaactgaggccgtatggagccccagggtacccagccagccaagactcatcattccagggcacggacacagactcttcaggggcnacccctgctgcaggtgtactgctaacccctactggcccagcagtcacggcctctcctggaagaagcatagccagcggaggagaggaaccaggacctctgtgtggggccgcctctgagcccagaagcagtgacctctctggcttctgcttttgttgaatccccttagaccacatacatttcacagggccatggtgcccatacccccttccagctggcctgactgctggctgggcctcttntgcggcctgaaagcaaagccttggaagtagcttcccagttccact

SEQ ID NO: 1342 - DNA, 257 bp, Mus musculus
taccttctcccagatgtacatactttatcatgaactcccacccctgggccctgggatatcagagcctgctacagtgagtccctctctcccaaagtaaaggaccctatagggcaacacccagagggctccatcctatccccacctgctggagaaggccagagcttttgccacccacactgactccagacttttaaaaggtgcctctggccactcttacccacaggcctacagtagcctgtctgctgtatttggagaag

SEQ ID NO: 1343 - DNA, 465 bp, Mus musculus
  misc_feature (354)..(354): n is a, c, g, or t
  misc_feature (371)..(371): n is a, c, g, or t
  misc_feature (373)..(373): n is a, c, g, or t
  misc_feature (377)..(377): n is a, c, g, or t
  misc_feature (383)..(383): n is a, c, g, or t
  misc_feature (438)..(438): n is a, c, g, or t
aagactgggtttctcagcttccgtgtcaagtcagccagaggaaagaggtcgagttgacagcagcaggcactgcccttcctagttggtggctgccatgttggactgtggatctaaaacacttctagagctttgtggtccaaactctggctctcccgtctgcaaaacaggagccagcctgggctctgtgcctacctcaaggggagctgggggttggggggactgaccctccccagggaggtcttacaagtagtgtgaccagtcttttgtttgtttgtttggttggttgttttttggagacagggtttctctgtgtagccctggctgtcctggaactcactctgtagaccaggctgnccttgaactcagaaatntncctncctttncctcccaagtgctgggactaaaggtgtgtgccaccactgtccagcttgtgaccanccttttaaaagtgccactcactccctg

SEQ ID NO: 1344 - DNA, 396 bp, Mus musculus
  misc_feature (342)..(342): n is a, c, g, or t
  misc_feature (344)..(347): n is a, c, g, or t
cctggcttccacaaacgaggcactgccttcggggctcacctgtgtcaccactggctggggccgaatcagtggtgtgggcaatgtgacaccagctcgcctgcagcaagttgttctacccctggtcactgtgaatcagtgtcggcagtactggggtgcacgcattaccgatgccatgatatgtgcaggtggctcaggcgcctcctcatgtcagggtgactcaggaggccctcttgtctgccagaagggaaacacctgggtgcttattgggattgtctcctggggcactaagaactgcaacatacaagcaccggccatgtacactcgggtcagcaagttcagtancnnnnggatcaaccaagtcatggcctacaactaaactgtccacagatccgttcc

SEQ ID NO: 1345 - DNA, 497 bp, Mus musculus
  misc_feature (419)..(419): n is a, c, g, or t
  misc_feature (460)..(460): n is a, c, g, or t
ctgtagtcggctgtgcttctaaggccctggacctgctcatggagagcaatgccatcatccagtctatggctgccaagacccggcggttccgcagtaagatggaagctgctggttttactgtctcaggagccgatcaccccatctgccctgtgatgctgggagatgcacggttgtcttctcaaatggcagatgacatgttaaagaaaggtatctttgtcatcggatttagctaccctgtggtccctaagggcaaggcccggatccgggtgcagatctcagctgtacacagtgaggaagacattgaccgctgtgtggaagccttcgtggaggtggggcggctgcatggagctctgccctaagctcttggtagggacctgcagagccaaagttcctccactgccgctgacatagggctcctntggtcagcccagatcagaggctgtgactcaacccagacttntagagcctggttgaaaatgggcctgtacttgtcatca

SEQ ID NO: 1346 - DNA, 457 bp, Mus musculus
  misc_feature (301)..(301): n is a, c, g, or t
  misc_feature (310)..(310): n is a, c, g, or t
gcagatcacccctgaaggacatcgaatccttgttttccagagctctttgtccttaaccccgtggccttaggcccctgtgcaggtcccagtttccccccactttagagagctgatgttccatagggacacctttctgtctctgattcaaaagccgatagtctgtctgatggttcagccgccagggggcgcagcgcgttcacgctgccgccgctggctacttgggggccttggatcaggctgttgggcagccctcaagccaggccagaagggctggtttgctgctacgaaggccctgtccttntaccctgtnttcctaccggcaaccatcacacctgctgctccattaccataggtgtggcctccttcccattttgctgaccttgctttactgtgggaaaggaggggtggaatctcgcaggctcagccccgcaggcttatgactgctgctgtaggctca

SEQ ID NO: 1347 - DNA, 252 bp, Mus musculus
gggccccacgcatttggtaggcaagcactcaccagtgagtcatgtggtgccctgtctgtccctagggtttgttccacctgtttttgagacaagctcttctcatggagctctgatcgacctccagctccagttttcctgcctcaacctgagtccaagctccacctctctctctgctgctggcatttctcacttttagctactgaggctgggaggatgggacacttgagtttctgcgtcattattcattctggg

SEQ ID NO: 1348 - DNA, 502 bp, Mus musculus
agagcttctggcctgtgctctacaggaaggtgacagtgtctgccttctcctggcagcctccacacctgctgtgcttaggacaggatcctttgatcacaaggcagaaccctaaccccggtccatctactcaaactggaatatgcagggacctttccctggcccctgccagcaggtctcccaacttcctacctagctcaccctacccctaactggtgagaggctgagtttgggctgaattatatgcccttaggaatacagtccaggcaggctgtggggcctctggggggccagggaccacccgctacccctcattcctctcattccttcagcctgtacctgcccctccttgaattattgtctctctctctctctctttttttttaagtggatgccttactttttggataactatttttgaagctggtatttctatttcttttggattttttaatgtatggcggtttgggggcagagctagaaccttaataatctgtcactgagt

SEQ ID NO: 1349 - DNA, 568 bp, Mus musculus
  misc_feature (38)..(38): n is a, c, g, or t
  misc_feature (60)..(60): n is a, c, g, or t
  misc_feature (81)..(81): n is a, c, g, or t
  misc_feature (102)..(102): n is a, c, g, or t
  misc_feature (285)..(286): n is a, c, g, or t
  misc_feature (288)..(289): n is a, c, g, or t
  misc_feature (292)..(293): n is a, c, g, or t
tttgctgtggcttgtgctccgtgccgcgcccccttttntccccagacgcgcagggtcttntgtggtccgggaccccgcggntggcgacgcggggcgcgcttncactgagcccggggcgagcgatgccgcttggcctggccaaccccgtcgagcgccgcgccggggacccagcccgcgtctgagcagcgccggctgcgcgccggctgcggagaaccccacagcaggaccctgagtcagcttctcttccaacagccaacttctgctgctgcagtgtcccctgactgnncnngcnnctgtaccacctctcagcagggagtgcaggaatgaaggaaggcatgtctaataacagcaccaccagcatctcccaggccaggaaagccgtggagcagctgaagatggaagcctgcatggacagggtgaaggtctcccaggctgcctcagacctcctggcctactgtgaagcccacgtgcgggaggaccccctcatcatcccagtgcctgcctcagaaaaccccttccgggagaagaagttcttctgcaccatcctctaacacccatggcgatgaag

SEQ ID NO: 1350 - DNA, 498 bp, Mus musculus
  misc_feature (332)..(332): n is a, c, g, or t
  misc_feature (356)..(356): n is a, c, g, or t
  misc_feature (459)..(459): n is a, c, g, or t
  misc_feature (465)..(465): n is a, c, g, or t
  misc_feature (473)..(473): n is a, c, g, or t
atgggccacctgctaaggacggcaaagagcctggaggtggagccgaggcagctgagcagtcggcctcgtctgggcaggggcagccgtttgtgcttcctgtgggtgtcagctcgaggaacgaggattacccccgcacttgccgcctatgtttctatggcacaggcctcatcgctggccacggctttaccagccctgagcgcacccccggagtcttcgtcctgtttgatgaggaccgctttggatttctgtggctggaattgaagtccttcagcttgtacagccgagtccaggccaccttccagaacgccgccgcgccgtcgccgcaggccttngacgagatgctcaggaacatccantctctcacctcctgacctccgcatcgtgggcggagaggctgcaccggggcccgggtgggggaagcatgcactttagaaatgaacgcacacctcctcactgggntcccgntcgccccngggacgcttcttgtatagtgtgtaa

SEQ ID NO: 1351 - DNA, 276 bp, Mus musculus
  misc_feature (47)..(47): n is a, c, g, or t
  misc_feature (184)..(184): n is a, c, g, or t
  misc_feature (214)..(214): n is a, c, g, or t
tttccggagggagcccactctgctacccaggcagtgggaccaggttncagacccaaagtcaccctgagcccagctctggaatcaaaactgcactgtcaagaaggaaaccacagaactctctacaacgtttgatccttgtgttgttcgtgaaggttcctagccttgtcccccaaactggcccacngggctcctgcactaaaggtgaccagtaccnacctcctccttcttttctcagcacctgtggaggaagtacggtggcctgggtgaccccagtat

SEQ ID NO: 1352 - DNA, 439 bp, Mus musculus
  misc_feature (68)..(68): n is a, c, g, or t
  misc_feature (301)..(301): n is a, c, g, or t
  misc_feature (315)..(315): n is a, c, g, or t
  misc_feature (318)..(318): n is a, c, g, or t
  misc_feature (339)..(339): n is a, c, g, or t
  misc_feature (377)..(377): n is a, c, g, or t
  misc_feature (407)..(408): n is a, c, g, or t
gaaaaggatcgtcaccctggaaacaaaactagagactttgattggtagcattcatgccctccctgggntaatcagccagaccatcagacagcagcaaagggacttcattgagacacagatggagaactacgacaagcatgtctcctacaatgctgagcgctcccggtcctcgtccaggaggcggcggtcctcctccacagcgccaccaacttcatcagagagtagctagaagagaataagttaaccacaaaataagactttttgccatcatatggtcaatattttagcttttattgtaaancccctatggttctnatnagcgttatccgggttctgatntcagaatcttgggaacctgaacactaagttttaggccnaaatatgagtgaaaactctttttttttttnnctttcagatgcacagggaatgcaccaattat

SEQ ID NO: 1353 - DNA, 542 bp, Mus musculus
  misc_feature (62)..(62): n is a, c, g, or t
  misc_feature (67)..(67): n is a, c, g, or t
  misc_feature (280)..(280): n is a, c, g, or t
  misc_feature (353)..(353): n is a, c, g, or t
  misc_feature (355)..(355): n is a, c, g, or t
  misc_feature (359)..(359): n is a, c, g, or t
  misc_feature (365)..(365): n is a, c, g, or t
  misc_feature (367)..(367): n is a, c, g, or t
  misc_feature (377)..(377): n is a, c, g, or t
  misc_feature (406)..(406): n is a, c, g, or t
  misc_feature (440)..(440): n is a, c, g, or t
  misc_feature (444)..(444): n is a, c, g, or t
  misc_feature (459)..(459): n is a, c, g, or t
  misc_feature (512)..(512): n is a, c, g, or t
gagatgtatgttaccccgaattccatgttccgttgcggaaacagtttcatgaagttttatanttttncggaacataaagtcctaagtccaggcaagtctaaaatacattggtggggacatcagaaaggtgggtacggcaagctggggaggactttcctataaggtctgagaggttgagagctttgggttggtagaagctatgttctgacaaaggtagtcaggaaatggctgtgtgaagctacagctagcccaagatctgctgattttggcctctgggccnatctccggaggcctggtttctttctaggactttttgctcatggtagagagctggctctccatcccattagaantntccncacctntncccttctccntgcatgtccagggtcaagagactccctgntcctggtgggatctagactactcctttctgagantcantcttcctgctttcanccataaggaaatgctgacccaacccttagacaaggcacacagagatgcttctntcctggcttctgggtgaggtgtttactgct

SEQ ID NO: 1354 - DNA, 415 bp, Mus musculus
  misc_feature (380)..(380): n is a, c, g, or t
  misc_feature (387)..(387): n is a, c, g, or t
gcccatcgcttcattaccgagaaggctgtgttctcccgctgggccaagaagcgacccatcgtgttcgcccacccgtcctggagggccaagtagttcctgttgccagtgactgccaggcctcagccaggcctgtgacccattccaggccaacacggctctaatgtgagcatttatgactcaccttctacctgacaccaggtagaacatgaagtctctattacccaacactgggtacactcggaggaacctcaggccttgtgacttgaagaggagtcgagaagatgccatttacaccacccctgcttccagaagaatccacatcttcatcttggggtttgtcccactgccaggttgtttaagtgacctttgccctgggtccntcgatgnccccacctcaccagcattatggctttat

SEQ ID NO: 1355 - DNA, 447 bp, Mus musculus
  misc_feature (325)..(325): n is a, c, g, or t
  misc_feature (331)..(331): n is a, c, g, or t
  misc_feature (355)..(355): n is a, c, g, or t
acagggacattcaaggtacagcagtgggacatagtcagacatgacttccttgaatctgctcctggcttaggaatgtttgtgactgttacaacttacaatgatgaggtattattatccaagttatatggtgcacaaggaacattctattttacttctcattcatctggtgaacacatcatttgcttagaatctaattctacacagtttgtgtcatttggaggaagtaagctgcgcatccacttagatattcgagttggagaacatgaccttgatgcagctattgttcaagcaaaggataaagttaatgaagtaaccttcaagcttnaacatntaattgaacaagtggagcaaatantcaaagaacaagactatcaaagggaccgtgaagaaaatttccgtataaccagtgaagataccaatagaaatgttttatggtgggcttttgca

SEQ ID NO: 1356 - DNA, 142 bp, Mus musculus
cactgtggtggtcttcgaacagtagagtatctctcacttgattcctgtgtaccctttggatccctgttctgaggcgttccactgctggtgtgcttgttgacagccttcctttagcttgactttaaagccctgcctatcacca

SEQ ID NO: 1357 - DNA, 386 bp, Mus musculus
  misc_feature (280)..(280): n is a, c, g, or t
  misc_feature (336)..(336): n is a, c, g, or t
  misc_feature (358)..(358): n is a, c, g, or t
tttcagctaggctccagtcagcaaaggtaaggatgtgggtttagatgcattgttatctgtttcccaggcaatgcttaacacactcttagtgctttgagtgatacaaaggcagtgtttcaacaagacactctcttctttggtttgctgttctctcttggactggaatgtttggcaaggcccatgtaaactggttagagcaggccctttatatctcctgtgaccgttaatctcccccaccataatttgatgagggctgtttggtttgaggacttcaaggatntctagagaagttcccccatgtgtgtgaggtgttgtgaactgtgaacactgtacatnttcagtgttcaatactgggcanccaaagagctgctcttgcaatctttttt

SEQ ID NO: 1358 - DNA, 305 bp, Mus musculus
  misc_feature (257)..(257): n is a, c, g, or t
  misc_feature (264)..(264): n is a, c, g, or t
taaatgatctgttcctttaaggtagagaagttttatttgcatatttatttcagatcttgatttttttttttccacaaaacttgaagagggtaggcacacagcggcgcctgccatccctaagtccccgaggaggctccgtgctgagaaactgttgagtgtacagattttatttatgcataatttaatgggatctgtaaatacttcttatgactttttgagaaatgggattcgattttaaaattaccttttaatggtgntgggtcntgtagcccctctagcttttatgcgagtgcacacagggtatt

SEQ ID NO: 1359 - DNA, 554 bp, Mus musculus
  misc_feature (114)..(114): n is a, c, g, or t
  misc_feature (184)..(186): n is a, c, g, or t
  misc_feature (302)..(302): n is a, c, g, or t
  misc_feature (351)..(351): n is a, c, g, or t
ggaggctctaatcgccatcgataagtcctacatgaacccgggggaccagagtccggctgattccagcaagacgatggagaaaatggaaaagcacaggaagtaaaatggctgcanggaggccagagagcagaaggagaggacccaggcccctccactggggcagcccgggaagtgtccagagcannngcagcagcagcagcagcagggaagcagttacaacccgcccgcccacaccgcacactctggacctgccctcttggagtctttgtgacttttccatttaaccctggacatgctatccngaagccacttggtttggttcttttattcattaaacatgtgtgttttttnttttttttttaaatccgttccctctcttgaaaggtgctacgagttttagaaccctttgtaagaactccctgggcagacaagaaactccacgcttagctgctaacacagcaggtgcatgggagtcgtcagataaagggatcgatcaatcataacttatttctttttcagtgttaagataatagctggcttttatgtccactaaa

SEQ ID NO: 1360 - DNA, 449 bp, Mus musculus
  misc_feature (351)..(351): n is a, c, g, or t
  misc_feature (404)..(404): n is a, c, g, or t
gggattcctttgagaccgttgactccttggagaccccactcaactcactgctcttcaatcagccactcactgctggactctgccggcttgtggccaggaaccgaaagccaattgaaaaggtgttggatgtagactttgcgataaaggcccgcacgatccgccagctggatgagcgctacacatctgtggcttttgggtataaagactgtgcggcttattaccaagccgcaagcccaagaaccaaggtagatgccatccacacccctgttctctgcctcaatgcagcagatgaccccttctccccagtccatgccttccctctgcaggctgcccagaagtctccctatgtgnccctgctcatcacagctcggggtggccacattggcttcctggaagggctgatnccctggcaacactgttacatgaaccgcgtactacatcagtatgcc

SEQ ID NO: 1361 - DNA, 391 bp, Mus musculus
gccacattttcctaggccaaggcgaccacactttgggtgccctggtagaccacctgcggatgctgcgcgccgatggctcaggagccgcctcttcccggttgacagcaggtctgggcttccaggagagtcgcttccggcgccagctggcgctgctcacctggacactgcagggggcagccaacgctctcagtggcgacgtttggaacattgacaataacttttgaagccaaaagccctccatgggccccacgtgattctcctttctccctctttgagtggtgcaggcaaaggaggtgcctgagattgtaacctattcttaacacccttggtcctgcaatgctggtgcgccatattttctcagtgtggttgtcatgccgttgcttacccagaa

SEQ ID NO: 1362 - DNA, 306 bp, Mus musculus
aaacccacgacaatgacatcatgatggtgcatctgaaaaatccagtcaaattctctaaaaagatccagcctctgcccttgaagaatgactgctctgaggagaatcccaactgccagatcctgggctggggcaagatggaaaatggtgacttcccagataccattcagtgtgctgatgtccatctggtgccccgggagcagtgtgagcgtgcctaccctggcaagatcacccagagcatggtgtgcgcaggcgacatgaaagaaggcaacgattcctgtcagggtgattctggaggtcccctagtat

SEQ ID NO: 1363 - DNA, 361 bp, Mus musculus
aaagaggacactcccgcaaggcatctgaaccccgaagaagtgataagaggcgtagatgagttggaaaggcttagggaagagataagaagagtaagaaacaagttcgtgttgatgcattggaagcaaagacattcccgaagccgtccttaccctgtgtgcttcaggccttgaaatcgtttttttttctctgatattgaaatgtggctgctgctttctttctcttagcattttctgatgtatctttgaacttcattttacttttaataataattacctggcggtattttctgttatgtagtttcgttgttaccagcatctcattggattttggatttttgacccattttccacgtttatcttt

SEQ ID NO: 1364 - DNA, 519 bp, Mus musculus
  misc_feature (310)..(310): n is a, c, g, or t
  misc_feature (409)..(409): n is a, c, g, or t
  misc_feature (420)..(420): n is a, c, g, or t
  misc_feature (488)..(488): n is a, c, g, or t
ggagtctctacagaagatgtccttctcccgcctggtctgtgacaacactggcatcgacaaggtcccactgaacccgttccaggctaatgcctacccccatggctttgtggactgctcttcaattgataagctggacctctcaccctgggcctcagtgaaggagtaggaacctgctgcccacagcttcctacatcgaacatgtccatggtccgagatgccatttcaaacagttccagtgacctactccttttaagttggacaccgaggccaaaggctgcctcagccttcccagcccatccactcagctgtnaccaccctctcagcctgacgagacttaggcttcttaagatgtccttccagcttgtcagacactgcctaccctctccctgaatgagcactggctgaggantgtggcctttngacctttatgtttcctcccgtcctctaagactagctcataagcatcctgagtcaaagacctctgcctnccttgtgagtacgacttgtggcacttagcat

SEQ ID NO: 1365 - DNA, 485 bp, Mus musculus
  misc_feature (349)..(349): n is a, c, g, or t
gactttggtcattactgtgcctacatccggaatcccgtggatggaaagtggttctgcttcaatgactcacatgtttgttgggtcacctggaaggatgtccagtgtacctatgggaaccacagataccgctggcgggaaacggcctatctcttggtttacacgaagactggatcctgacagatatactcacacctccagagagggatagactcttatctcctctcctgtacccttgtctgctgcatttcaacgagaataataatttaaaaacaattaagccctatttataagcaaaactattattgcaatggcttagatgtagtttgtctcctgaaagctcacacacggnaaggcttggtctttagatggcagtgcttaggtgacagaacttgtaagagacagggaccagtgggagatcatcggttcatgggatctctctcctgagcactaatagttcttcttcctgtttctctacacatgttgtg

SEQ ID NO: 1366 - DNA, 563 bp, Mus musculus
  misc_feature (260)..(260): n is a, c, g, or t
  misc_feature (278)..(278): n is a, c, g, or t
  misc_feature (366)..(366): n is a, c, g, or t
  misc_feature (382)..(382): n is a, c, g, or t
  misc_feature (391)..(391): n is a, c, g, or t
  misc_feature (432)..(433): n is a, c, g, or t
  misc_feature (498)..(498): n is a, c, g, or t
gagaggccagtgtccgcttccagcacgtgggcacctctgtgttcctgtcggtcactggtgaacagtatggtaaccccatccgtgggcagcatgaggttcatggcatgcctagtgccaatgctcacaacacgtggaaggcaatggaaggaatcttcatcaagcctggagcagatctctccacgggtcacgatgaactctgagaaccagatgagtgatgggagggtggctgagtggcaatctcggggtcactcttgtgtaangactttgtttgtaggggnccctcaagtgcctttatgattaaagaatgttggtctgggattatttttgctgtaaccctggggaagatctgaaggtgccagccatatntgtccaagttaccatntcacctgtntcaagcacctgctgaaatttttttttttttttttttttttnngagactgtctcactatgtatccttggcaggcctggaactcacagagagatccacctgcctctgtntcctgagtgctggtattaaaggtgtacaccaccacaactggccccaacctgttcaataaactcat

SEQ ID NO: 1367 - DNA, 493 bp, Mus musculus
attctgtttgttgggaaagctcctgaaatgtgcctttcttggctggttcttagtacccattatggtttagaaaggcttcgatgtggctgggcgtggcagcacatgcctgttatcccagctcctggaatatctcagcatcagaagctgaggatcaggagttcaaggccagcctgggctaaaggagacaaaggctgtagtatataaacagtccttcagctgtgatagttgatcaaatattaacaggctttttcgtcttctcaggtttccacttggtcgaggttcggtaccggtcttctgtgaagccaaagtagccattgaccgttcataggaaactgtcttagtcacaatcaacttcttcactagggtgtgactcagatgtgtataatcccagatggttgcacctgagaggtccagagagatctcacctggttgcaaagacacctaaccttggtccactgtaggtgcttcacctactcctcgatatgtcagcatt

SEQ ID NO: 1368 - DNA, 465 bp, Mus musculus
  misc_feature (131)..(131): n is a, c, g, or t
  misc_feature (336)..(337): n is a, c, g, or t
gaaaacacgggcacctctctgagggagctgatgtggagaggtgggggcttgtggtgttcggttaaagtgactttactgcttttatttttatctggggtgggaggaagtgagcacctcccatatggcagccngcgtggctttgtagactgctacaatactccctggtggcattggttgtctcagaaatttctggaactccaggactcagacactgcctgtcccatctcacttactcacccagtgtgactcccccccaagtgtggatgcccccttgcctcccctgggtggactccttgctcttccccacccccactgtgttttgttttgttttgtttnnaacttaggcccagatgcttctgggctacaccagttcctgtttcgatgtgagttttgaaatgctccgtgaagggctgagggacggcaggaagatggcgggagccaggcagtaccaacttcctggcgaag

SEQ ID NO: 1369 - DNA, 429 bp, Mus musculus
tgagcaggacataagcgggcctccagcatctaagaagctgaaaaaaagccagtgcactcctcttttcatgaatgcttataccatgagaggagctggcgcagtgattcatacccactctaaagctgctgtgatggctacccttctgtttccaggacaggagtttaaaattacacatcaagagatgatcaaaggaataaggaaatgtacctcaggaggctattacagatacgatgatatgttagtggtacctattattgagaacactcctgaagagaaggatctcaaagaaaggatggctcatgccatgaacgagtacccagactcctgtgcggttcttgtccggcgtcatggggtgtacgtgtggggagaaacatgggagaaagcaaaaaccatgtgtgagtgttatgactacctgtttgacattgctgt

SEQ ID NO: 1370 - DNA, 556 bp, Mus musculus
  misc_feature (287)..(287): n is a, c, g, or t
  misc_feature (314)..(314): n is a, c, g, or t
  misc_feature (322)..(322): n is a, c, g, or t
  misc_feature (334)..(334): n is a, c, g, or t
  misc_feature (354)..(354): n is a, c, g, or t
  misc_feature (363)..(363): n is a, c, g, or t
  misc_feature (365)..(365): n is a, c, g, or t
  misc_feature (369)..(369): n is a, c, g, or t
  misc_feature (378)..(378): n is a, c, g, or t
  misc_feature (381)..(381): n is a, c, g, or t
  misc_feature (384)..(384): n is a, c, g, or t
  misc_feature (387)..(387): n is a, c, g, or t
  misc_feature (393)..(393): n is a, c, g, or t
  misc_feature (410)..(410): n is a, c, g, or t
  misc_feature (421)..(421): n is a, c, g, or t
  misc_feature (431)..(431): n is a, c, g, or t
  misc_feature (438)..(438): n is a, c, g, or t
  misc_feature (463)..(463): n is a, c, g, or t
  misc_feature (476)..(476): n is a, c, g, or t
  misc_feature (481)..(481): n is a, c, g, or t
  misc_feature (503)..(503): n is a, c, g, or t
  misc_feature (520)..(520): n is a, c, g, or t
tgtaacagacaaaggtcccctccaaggtgatactacatatcaagatggcacggccctttcaggccttctattactacaaccccttgggtactacctaattcataaggaagagagaagagggtataagggtaacagattgtaaagttgactgtctggtggactggaccttgcttatgaccaagaagtcgggataggttaaaaggtagaagtgcacttattgatccaaatgggagatttcagagccagtctctttgcaaaggactagcaaagctaaatgaaaaagaagnattttttttttctatttggtttccccnataatcantctacctcacancggggaaaaatcagtatacnagaggtatnangccnaggtgttgncantgnacnccaaancaagctccataggtatntccaagctatnttcagaaatntccgtgnctgttttcagtattaaaatctgttntctaaaagggcancagtntccatcacagggttatagaaanccacttttctcaggctngccacctgctggggcggacccatttcaagtatttat

SEQ ID NO: 1371 - DNA, 511 bp, Mus musculus
  misc_feature (88)..(88): n is a, c, g, or t
  misc_feature (163)..(163): n is a, c, g, or t
  misc_feature (194)..(194): n is a, c, g, or t
  misc_feature (212)..(212): n is a, c, g, or t
  misc_feature (431)..(431): n is a, c, g, or t
gtcttagatgactgctgggcaacttcttctgaggacccggcctctgcgcctcagtggcagattgtcatggatggctgtgaatatgaanctggacaactaccgcactactttccacccagctggctcctctgcagcccattccggtcactaccagaggtttgantgtgaagacttttgcctttgtatcagaggcnacgggggctctccagccntgatctacttccactgcagtgccttgatctgtaaccaagtctctcttgactcccctctgtgctctgtgacttgccctgcatcactgaggagcaaacgagaggccaacaaagaagacacaatgacggttagccttccaggacctattctcttgctgtcagatgtctcttcatccaaaggtgttgaccccagcagctctgagattaccaaggatattattnccaaggatattgcttctaaaacattgggtgctgtggctgcactagtgggctcagctgtcattctaggcttcatctgttac

SEQ ID NO: 1372 - DNA, 467 bp, Mus musculus
  misc_feature (184)..(184): n is a, c, g, or t
  misc_feature (285)..(285): n is a, c, g, or t
  misc_feature (430)..(430): n is a, c, g, or t
  misc_feature (442)..(442): n is a, c, g, or t
agcccaggctgtcgtttcagtcaggccacagaagtctggtgttttcttaatgactgcctgaagaaatgctactccggtttcgtctttgtcccattatagaaatatttgacaactctctgcacattcccacttcctttataactataaccacataagaaatacaggtcaggaaattggccaatcntaatggacctatacatgtgaaacactttcagcactagtggtagcggcgtgcctggcatgtgcaggcccctgggtctggcctggcccctgggtctggcctancacctcccaggtactgagttgcttccgttcagtttgtttcccgtcacaccttttatgggtagagagctgtggcctggcctgtacaggtgactgtacaggtgaagactgaaggaccagagtcacaaatttaagtgtcacacagttntagttaggtccntcctgtacatggtagacgtctatct

SEQ ID NO: 1373 - DNA, 468 bp, Mus musculus
  misc_feature (296)..(296): n is a, c, g, or t
tactgcagccatctttggcggagtcttcctggccatggtcctggctgtggcagccttcacattgggaaggaggacacacattgaccgtggccaacctccaagtactaagttgtgaagtgaaacaacccagacattggctccacaagcacagattcccagaaaagatggaagacatgagagcctgacgcttggcacccagatacatggtgactaggattcccttagcacaaatgcttagccaagaacaatgagatggcaaagaagaaaggtgggggccaagttttcccaggatctancagactgaaggctaggaagaatgtcataggagaatgagaccagtgtctacaatcacaggcaactgtgagctgagcactggtggcagccatgctttctctcgctagactttcccttttccccatgtatagccaactttctccatctgtagtgtcgatgtcagctttttcttac

SEQ ID NO: 1374 - DNA, 458 bp, Mus musculus
  misc_feature (145)..(145): n is a, c, g, or t
  misc_feature (320)..(320): n is a, c, g, or t
  misc_feature (344)..(344): n is a, c, g, or t
  misc_feature (368)..(368): n is a, c, g, or t
  misc_feature (405)..(405): n is a, c, g, or t
  misc_feature (409)..(409): n is a, c, g, or t
ggtctcctgtgcatctaggcccaagccagccgctgaagttcactctgagtggggtagatggagactcctggtcctcaggggaagattagaaactgcccctctggcactgaggacttagtggggggtgggggggggaatgtccctncctgctctgggccagcactcttagctttgataacttgacctgtggtatctctcgtggagaggtgtggctggctgagacaggtgagatcctgcctggatcaccctgaaggctcaggtcagctgagcctatagttcaacgccccctttcttctgtggctcacctgctggaagaggcntgggcccagagctttcccacgagnctgctctggccagagcttgctagnccctgcctgtctacagtagcaccacctgcacagggtntggntgcatgcccagaggagcagcaatgatgagtgactctcatcatctcagcc

SEQ ID NO: 1375 - DNA, 410 bp, Mus musculus
ttctgggatgcgtaccactggactatttatgtcacaaatctagtgggttgacgctgccctgcaagttttcaatgtccctgcatcctatgaagtcataatgatctgactgtactggaggttttcctgcattttttacttttcgaaaatagaggtttgggctgagaattctaaacgcatgtgcctgggtgggacgtcaagtcagggttctcatcaaagctgagaagtggctggaatgttcagcttggtgtctggggaggatcctgtgagctatgtagagaggtggctcttcagcctgactcagtgtgggctgaacgaagtacctgcagaacacacggtagcaggctccaaaatcgtcacctcaagcatgcgtgcaagcaaacttccgagaactccgttttctgctcggcaga

SEQ ID NO: 1376 - DNA, 525 bp, Mus musculus
  misc_feature (88)..(88): n is a, c, g, or t
  misc_feature (95)..(95): n is a, c, g, or t
  misc_feature (100)..(101): n is a, c, g, or t
  misc_feature (107)..(107): n is a, c, g, or t
ttaagtccaccaaaatgcctgcctgtacacacacacacacacacacacacacacacacacacacacactggctggtttgctgatggancccttanaccannccctcnccacccccacccctccccaagcatggctgcaagtgtcagggcaccacaccttcctcttcttgacatttctttgaacagacatcattttgtaggatcttaatttatacatttttttcaggtcataaaatgtgggatgaacatactttgaaccccagtgccttcagggtccattgactagggaggcactgtcttaggggacaggtatgtgcaaggccttacccaccagtggcttctcgctgcaggtcatgtttgtggcacttgttctttaaggtgagggtcttatgaccgactgttctgagacagccctgtgtcaggcaagctctttcacagggttgtaggtatttccaagacgccataggaaccagacagtgaatcatagctatcagtttgctgtgggcaaggaacctctttttggcca

SEQ ID NO: 1377 - DNA, 544 bp, Mus musculus
  misc_feature (153)..(153): n is a, c, g, or t
  misc_feature (448)..(448): n is a, c, g, or t
  misc_feature (450)..(450): n is a, c, g, or t
  misc_feature (507)..(507): n is a, c, g, or t
aaaatgtcacacatcttctctcgaccttccaaaaccagggagtcaagccatgcagacacatcctgtaaccctactgaaattagcaagcaaattattgagagcctggcaagtccctctgaaccatctagtgaacaacctgccatccttgaaaancgtctctccttctatcctctctaaagccaaagagattgaggaaaagagcaatggactcctggagggagttaagagcattctcatccaaatgcaaaatggagatacagaagatgagaactaccctggctggtctggactggcatccttgaagtcagagactgaagatattcgcctctttgcatattataacatgatccgctgtgagggcagagacactcagaaggttgaaactgctctcaagatggtgaaatgcaaaatttcaaatgaaaacaactgctaagcccttttcatcatntnttcgtctgagccactgcttgatgatatattgctgtgaaacttccttgaatttttttntctgttaaatgcatgcccagtggtgtttatcttcttt

SEQ ID NO: 1378 - DNA, 573 bp, Mus musculus
  misc_feature (203)..(203): n is a, c, g, or t
  misc_feature (228)..(228): n is a, c, g, or t
  misc_feature (274)..(274): n is a, c, g, or t
  misc_feature (526)..(526): n is a, c, g, or t
gagtgttttggtggacagtttgcctgggaccaaagtgaatgccgagagtgtagagaggataaaacggagacacagctcacaagagcaaaccttccagctgctgaagctgtggaaacatcaaaacagagaccaggaaatggtgaagaagatcatccaagacattgacctctgtgaaagcagcgtgcagcggcatctcggccacncgaacctcaccacagagcagcttcntgccttgatggagagcctgcctgggaagaagatcagcccagaaganattgagagaacgagaaagacctgcaaatcgagcgagcagctcctgaagctactcagtttatggaggatcaaaaatggtgaccaagacaccttgaagggcctgatgtatgccctcaagcacttgaaaacatcccactttcccaaaactgtcacccacagtctgaggaagaccatgaggttcctgcacagcttcacaatgtacagactgtatcagaagctctttttagaaatgatagggaatcaggttcaatcngtgaaaataagctgcttataactaggaatggtccactgggctgtttc

SEQ ID NO: 1379 - DNA, 537 bp, Mus musculus
  misc_feature (464)..(464): n is a, c, g, or t
atcgcggaagctttcggcatcagtgcatccttgctgtacctgacgaagcccacatttttctcgcgaataaatagcacagaagcccggacagctcatgatgagtactggcacgcacacgtggacaaggtgacctacggctcttttgactacacttcgctgctttacctatcggattacttagaggacttcggtggagggcgctttgtgttcatggaagaagggtccaacaagacagtggagcccagagctggtcgagtctcattctttacctcaggctctgagaacctgcaccgagtggagaaagtcctctggggcacccgctacgccatcaccatcgctttcacctgcaacccggaccacggcatcgaggacccagtactcacgtgaccagctaggtcaggtcctgagtaccatgtcctgtcagagaaggcactcctaggccgggtggagggtgtgttcatctntcccacttcaggccattgctgctgctcaatgtgccttatgaattatcccgagtctcaacctgctgatgtttta

SEQ ID NO: 1380 - DNA, 185 bp, Mus musculus
cagaccctgacagggcagacaccttccactcctgtaataatgggaaagagcagggcttagagatgatgcagccgcgggagtcaggatgagtaaacagcctgccctcctttcctagactcatggcaatcctcctgcttcatgtgtaacctgggctggccgcagattcatggcaatcctgctttcag

SEQ ID NO: 1381 - DNA, 410 bp, Mus musculus
gaccgattggtgactctggaggaattcctgagagctacagagaagaaagaattcctggagcctgatagctgggagacactggaccagcaacagttattcaccgaggacgagcttaaagagtatgaaagcattattgctatccaagagaacgagcttaagaagagggcggaagagctgcagaaacagaaggaggatctgcagcggcagcacgaccacctcgaggcgcagaagcaggagtatcatcaggccgtccagcacctggaacagaagaaacttcaacaaggcattgctccatcagggccagcgggagagctgaagtttgagccacacacataaagtcctgatgtctgccagaacttggaagaaaaccgttgattcaacatctatttcatctttcaacatcctttctt

SEQ ID NO: 1382 - DNA, 312 bp, Mus musculus
  misc_feature (104)..(104): n is a, c, g, or t
  misc_feature (274)..(274): n is a, c, g, or t
  misc_feature (284)..(284): n is a, c, g, or t
aattcctgaccaacgaaggcctggagaagagcccagaggagatcaaacgcctgtttaaggagaagaaggtggacctgtctaagcccttggtagccacgtgtggnctccggtgtcacagcctgccacgtggtcctgggggccttcctctgtggcaagtcagacgtgcctgtctatgatggctcctgggtagagtggtacatgcgtgcccagccagagcatatcatctctgagggccgagggaagacccagtgaagccaggcaggacacagtgcancttgggtganatctgaccatcacagtaccagccactgg

SEQ ID NO: 1383 - DNA, 496 bp, Mus musculus
  misc_feature (29)..(29): n is a, c, g, or t
  misc_feature (94)..(94): n is a, c, g, or t
  misc_feature (182)..(185): n is a, c, g, or t
  misc_feature (270)..(270): n is a, c, g, or t
  misc_feature (371)..(371): n is a, c, g, or t
tgtcctcttgaactgcctgcataagtggntgccaggctttgggtcagagataaacaaaatcaacttcatttatttgcccaaaacttggataaanttttgcataagtctagaatataatctttcctgaaaaaaagaagtcatggtaatcaaggaaatctgtttttcctagttttttttttttnnnnaacatagtgtccctgttgccttaaatgtaaaaacctattttgagaaacaaccccagtctaaaagttatagcaataaaagaacccnaatctatttttgtttcaagtctttacctcatgacaaagtcagaaggataattggtaagttttgctctgggtactactgcaaaccgatgtatcctttctgtntcctcaatggagtattatttacagacctgaaggaaggtgggcttaaccccaaggctaagtgtaaatgtttcttgaattgattctttctgtggtacaagttaacacctgtgtatatcatatctgta

SEQ ID NO: 1384 - DNA, 503 bp, Mus musculus
  misc_feature (104)..(104): n is a, c, g, or t
  misc_feature (134)..(134): n is a, c, g, or t
  misc_feature (148)..(148): n is a, c, g, or t
  misc_feature (365)..(365): n is a, c, g, or t
  misc_feature (393)..(393): n is a, c, g, or t
  misc_feature (395)..(395): n is a, c, g, or t
  misc_feature (420)..(420): n is a, c, g, or t
  misc_feature (427)..(427): n is a, c, g, or t
  misc_feature (478)..(478): n is a, c, g, or t
gcaccaggctcccaatgatgtacatcagtgactgcctcagggccaccctggaggtcatggaagcccctgccgagcgcctgtccatgagaacctacaacatcagngccatgagcttcacccccgaagagctggcncaggcgctccgcangcacgcgcctgacttccagatcacctactgcgtggatcccctccgacaggccatagcggagagctggcccatgattctagatgacagcaatgctcggaaggactggggctggaagcatgactttgatcttccagagttggtggctacgatgctcaacttccacggcgtcagcaccagagttgcccaagtgaactaaagaagaggagcggcccctgtntcctcaaagtgcagggcgcacggcagtntntaagttggagagccagactgaattntagcctntcccaggggacagcttgcgtggggttggagttcctttacacactgcctttntcctgtgcctaaattggtccaagca

SEQ ID NO: 1385 - DNA, 457 bp, Mus musculus
  misc_feature (386)..(386): n is a, c, g, or t
  misc_feature (404)..(404): n is a, c, g, or t
  misc_feature (406)..(406): n is a, c, g, or t
catgaccttgtcttgatccggctaaagaagaagggagagcgctgtgctgtccgctcccagtttgttcaacccatctgcctgcctgaggcaggcagctccttccctactggacacaagtgtcagattgcaggctggggccacatggatgaaaatgtgagcagctactccaactccctgctggaggcactggtccctcttgttgctgaccacaagtgtagcagcccagaggtatatggtgctgacatcagccctaacatgctctgtgccggctacttcgactgcaagtccgatgcctgccagggggactcaggtgggcccttggtctgtgagaagaatggtgtggcttacctgtatggcatcatcagctggggtgatggctgtgggcngcctcaacaagccaggantntacacccgtgtggccaattatgtggactggatcaacgaccgtattcgaccg

SEQ ID NO: 1386 - DNA, 471 bp, Mus musculus
  misc_feature (282)..(282): n is a, c, g, or t
  misc_feature (314)..(314): n is a, c, g, or t
  misc_feature (330)..(330): n is a, c, g, or t
  misc_feature (340)..(340): n is a, c, g, or t
  misc_feature (386)..(386): n is a, c, g, or t
aaaaggccaccttgtgcctaggctagggctgtgtggtcaatactaagtaaggccagggtattctagccagctcagggtagggctgcctgaccctgctaccctcatgttctgctgcccacttcagctgctgtaggtgctacaggaaacagcgtcccatcagctcttgccctgtcttcccaaaggcaaaggcagcattacatatttgaatttatcttctaaatacccacagtgcatttttgttatatgcagtttcccaaacttcttagcagacctccaaagcanccccagcctcttctgcataatgtgtgtatctnccccaccagtgtgttntctccatttntcctggggcctggggatagagttaggtgggacaggagatcctcaantcttctgggggtaggccagggcgatcccttgggagtctcaaatgttggtgtatggcaccctttctgtactcttatcccatgtttc

SEQ ID NO: 1387 - DNA, 317 bp, Mus musculus
  misc_feature (41)..(44): n is a, c, g, or t
  misc_feature (78)..(78): n is a, c, g, or t
  misc_feature (86)..(86): n is a, c, g, or t
  misc_feature (165)..(165): n is a, c, g, or t
  misc_feature (243)..(245): n is a, c, g, or t
  misc_feature (249)..(249): n is a, c, g, or t
  misc_feature (253)..(253): n is a, c, g, or t
  misc_feature (292)..(292): n is a, c, g, or t
ccatttagattccttatgtgatttttatatgtacatagttnnnntctatatcagggtgaaagatcctgacagaatgtnaaaggttnacagaagccctgaaattggcaaaatagatttcattgttaacagaactagcttcactgatttagaaaaatagaggtgcanaatgctctggccgctccttgaacccgtgtgtctgccaatgttttgaccgttccttgaacccatgtgtgtgcccactgnnnaagnccantgccaggtgtttgtgatattggttgctggggaagagtcngaaaaatctccccagcaaccacagc

SEQ ID NO: 1388 - DNA, 549 bp, Mus musculus
  misc_feature (229)..(230): n is a, c, g, or t
tgagctgatgctcatgtctgtgcttgcctgcctgtttgactctctgagccacatcttaaggaagaacgtggagaaacgctggttgctggagaacatggacggagccttcttggtgctggatgaaactgtcgatggaggtgtgattctggagagcgacccccagcaagtgatccagaaagtgaattttaggactgatgacagtggcctaacagaacagagtgtggcccannggttcttcagtcagccaaggaacagattaaatggtcgctattgaaatgaagaccttggaatcaaggctccttccccagagaacttttgccagtccccgcgtaagccccaagatctcaagacgcaagagagaccactctgccttctcaggcctctctcagaactgatccctgaggtctcctgccagggattctgagacgcaaaagcttgaccccagctccctcacccctactcagcatcctaacctggccttggggccatgggaaccagcaaagttgcctcccctcggacctctgacatcctcagtcctaggccttaata

SEQ ID NO: 1389 - DNA, 415 bp, Mus musculus
  misc_feature (47)..(47): n is a, c, g, or t
  misc_feature (79)..(79): n is a, c, g, or t
  misc_feature (138)..(138): n is a, c, g, or t
  misc_feature (157)..(157): n is a, c, g, or t
  misc_feature (164)..(164): n is a, c, g, or t
  misc_feature (167)..(167): n is a, c, g, or t
  misc_feature (169)..(170): n is a, c, g, or t
  misc_feature (205)..(205): n is a, c, g, or t
  misc_feature (207)..(207): n is a, c, g, or t
  misc_feature (231)..(231): n is a, c, g, or t
  misc_feature (235)..(235): n is a, c, g, or t
  misc_feature (262)..(262): n is a, c, g, or t
  misc_feature (333)..(333): n is a, c, g, or t
  misc_feature (379)..(379): n is a, c, g, or t
ggctgtcctggagaacagaatcatctaagaactctggtggcctggcnacttcccacccaatgcacagttcttagtgtcntgggaatgccccctgtagctggagttagtctggttttgctgctttagcaagggaacctncggaggacggctgcaggtntccccanctntnnctggggctgggagcaggaggggacacatgcttgtntntgctgggagtgtgttatgatggtncctntgagcatgtgtgtgcctgatggtgatnatgtgtgtttcagagcaagggtgtgtgcacaggtgagaacgcagggaagaggtgtgtgagcgactgcgttngttatttttccaacctaaagcttaatatattcctgttttttttttncctccagttaattctttacccagtcagttctttact

SEQ ID NO: 1390 - DNA, 342 bp, Mus musculus
ctttttcatttctagcagaggcaagaatacatattcatatacgcttacttatgaattaccattttaacatttagataacatgaaatatggccctcttgaattcttgcttttaagttccttttgatatgtatataagcaaagaccagggataaatggaatttttaaaatacaggctgctgtgttggggccagaaatacaaggttgatgagtaagctatctgaagacttttataatgcctaccttcaaaaccagaatcggcagcactctacaaatgaaagtgcctgtgtctcacaccaagaatcttgcctaacctgtcagagtgcctaatcttgtggttataat

SEQ ID NO: 1391 - DNA, 326 bp, Mus musculus
  misc_feature (290)..(290): n is a, c, g, or t
gaggagctacattaggtcacatcattagggaagttgagaagcatagctctacttgggtatttaagcaaattatgcaaagggggttgtcgctctgtgttctgtgtatgcatatatttatattttgcttgtcttccagtttaggtcaatctgtttcttcctttaagcagtttatttaaaaggccattgcaccatcttggtgaacagcatgaggggtttcaataaaaaataggatcttacctttgtccacagggctctacctcttacttttcaattgtgaacaaaaaaggtcncacacccagaggcaacaaaacccacagaattcctga

SEQ ID NO: 1392 - DNA, 371 bp, Mus musculus
  misc_feature (106)..(106): n is a, c, g, or t
agagctgtgagcgagcttccgcattttgctgggaaatacttgactttgcaaactcattttgtgatataaaataccataagcatagcatcactgtctttttttcttnttaaatacttagagatttgttgccttttgatttcagtgaccttcagcgagacacgagaaaaggtcttggagtctgttctgtcctcccagccctcagtaggagcacgtattaataagaagagccacatgggaaattatgggcataaaattaatttatacagaaatgctactaatgatcatcttgaaaaaggtctactttaatcagatagcttcagggggattctaattcaaggctgagaaagcctttattccaagcacttgagaaa

SEQ ID NO: 1393 - DNA, 545 bp, Mus musculus
  misc_feature (506)..(506): n is a, c, g, or t
gtgaccactacctggccaaatgatacctatgaatttatctaccggacttactcctgcggcattgccaataaagttctttgtgatgtcactctgctgaagacgcaacttacatacatctcaaaaaatgcttctctacaagctgagatgagtttgtcctgtgttatgcacaatcagagtcctcatttctgtgaagcagaaagtagaggagatttcactggtgatcctcctggatggacagaagatatgagggcaagaagagatgagcaaactgttccgatggtgcaaccaaacctttcaacatcaagcgaagatcaccatgtctccacggagccttgggcctctgaaacgagcaggtctgaggctgctgaagtacctagcttcatggatcaaaacttctcggttttccatttctccagaatgtagatggtctggtgatttcttatctcctttttaaaaagatacaattttcaattttaaataaagtaaaatgcgaccttcatatattntcatttttaaaaaggagctgtccctgcttttaattgtat

SEQ ID NO: 1394 - DNA, 471 bp, Mus musculus
  misc_feature (315)..(315): n is a, c, g, or t
  misc_feature (330)..(330): n is a, c, g, or t
  misc_feature (334)..(334): n is a, c, g, or t
  misc_feature (338)..(338): n is a, c, g, or t
cagtagctttcttggcttacagagtaaacggacagtatatcatggaagggcttgcgtccagctttctctttacaatgggaggtttaggtttcataatcctggaccgatccaatgcaccaaacataccgaaactcaacaggtttcttcttctgttcatcggcttcgtctgtgttctcctgagtttcttcatggccagagtgttcatgagaatgaaattgccgggctacctgatgggctagtgtcttttgagaggaaatcagtggatcccggatttgctcctgttaatgaagttttaaaggctgacccactccctcntgcaatgtggaaaanaaangaangagcagtgtaaacgctgcactgagcgacaccctagcaagcacagcagagctaggaccggaagtcacgggatcagagacaagttcattacagtatttcccttgatgacctaccccagtgtaccagctatgttaa

SEQ ID NO: 1395 - DNA, 466 bp, Mus musculus
tgcagcgtctcttcgacaagacagaggacgtcggcttcatgaagaacaccaagtctgtgaaaatcctaatggacaggacccagacctgcacgggcagcagcctttctccccctaagatcggccacctgaactccaagctgttcctgaacgaggtggccaagaaggagaagcagttgcggaagatgctagaaggtcccttcagcacaccggtgcccttcctacagagcgtacccctgtacccttgtggtgtgaacagctctggggccgaaaagcgcaagcactcgacagccttccctgaggctagcttcctggagacttcgtcaggcccagtgggcggccagtacggggcagcgggcacagccagcagcgaggggcagtctgggcagcccctgggtccctgcagctccacgcagcacttggtggctctgccaggcggtacccagccagtacactcgagtcccgtgtt

SEQ ID NO: 1396 - DNA, 547 bp, Mus musculus
  misc_feature (29)..(29): n is a, c, g, or t
  misc_feature (40)..(40): n is a, c, g, or t
  misc_feature (47)..(47): n is a, c, g, or t
  misc_feature (294)..(294): n is a, c, g, or t
  misc_feature (345)..(345): n is a, c, g, or t
  misc_feature (442)..(442): n is a, c, g, or t
  misc_feature (447)..(447): n is a, c, g, or t
  misc_feature (451)..(451): n is a, c, g, or t
  misc_feature (495)..(495): n is a, c, g, or t
  misc_feature (502)..(502): n is a, c, g, or t
agctacctgacaaggtctgccgggacctntacagcctctngtccatngcaagcaccctcagaaagcatcgcagagcgtcagacagtggcaccagcaggagtgtggccagctccgccgctgtctgtcccctctgtgtccgtctctctgtgtccgtctgtctttctgcgtctgcctctctctgtgtgtctctccgtgtctttgtctcctgccgtttccctgactctccggcgtctctgtctttgtaaagtccacatgatctctctgtcatcagagaaacctagttggtagcttttnttttccatgaagaacttttggagattttgttttgttttgttggcaaacaangctacttagaaatggacaaagaagactgtggggttctccccattcctcatgagtaagggaagaaactgtgatttttctatccagagttgctgtatcncccanccanccccaggggcatcagcgagcacacagcaggaagataatgagagncaaactncaatttcccaactttaagaagcagcttttgtttcaggttttactc

SEQ ID NO: 1397 - DNA, 508 bp, Mus musculus
  misc_feature (77)..(77): n is a, c, g, or t
  misc_feature (80)..(80): n is a, c, g, or t
  misc_feature (357)..(357): n is a, c, g, or t
  misc_feature (360)..(360): n is a, c, g, or t
  misc_feature (374)..(374): n is a, c, g, or t
aacttggtgccttccgttcagtattcggacaaggcttccctgggatctgatgatagcacacaggctaaggaagctcnccntgtcctctaagaggtcctggagagagccagtcaaagcagaggaaaggtttccatttggcaaagccatagaaaaggacagctgtgaagacataggagtagaagaggccagtgaactcagcaagctcaatgtctcaaagagtgtgtgaggcagcgccgagagctgccaaggtgctctgcgtgtccaaacacagtaacatctgtgtcgataggctgttgtgctatctagcacctcagtttctgtccccagatgtggtgtcacgtggtcatttcagcccgnatnctctgtgtggagcnacagttattcagggttcatttccacccatttcggttttcctttacttgcgttcctggaagccttttcctggaagcctgcccccagcccagccaggggatccagtcagcagcgtggagggattcaagtgccttca

SEQ ID NO: 1398 - DNA, 396 bp, Mus musculus
  misc_feature (221)..(221): n is a, c, g, or t
ttggaactctgacctagcacctatgtccttcttccctaagccactcctatgagtgttatcattcctgagggctgataagacaaccctgtctcagggtcctgaggctggcacccagataggcaaggtcaccttgacactggtaccatggtaaccttggctctttagggctggtgcagcctcctctccacaccccaccactttcccagccctgtctacctgancctggcactggcctccacagaaagggtgggaagggagtccgcactgcagcctaagctggagagaggtgagattgcagcaggtttgatcctgagagcctcatcctacatccctagagaaggcacccttcctctgtactcctctcatggtgtagggtctctccaacatttggctgaa

SEQ ID NO: 1399 - DNA, 401 bp, Mus musculus
agttcttcttctgttgagttctttaaacgtaaggaattcatcagtattactgttaatcatagaaaagacgtagcttaatctggcagaatcagagtcttctaatccgtgaacccaattcatatcccagaacaaaaggatacattaaggtgcaagctctctgtaactctgtcatgataaggtgctttccattgtagctacttgtctagagtacacacttggcaaggaggaccagtcctgatttaagctctgtcccacactgattccttgaactacgtaccatgcatgataactgaaaagttagctgctctattcctcggggttattcctctgagtgttgtgaaatattttccagaatgccatgactgcttgtcaaatgaaatgcctccctgtaattcgaatgc

SEQ ID NO: 1400 - DNA, 290 bp, Mus musculus
tgacgggcatcttctaaccaggttgtcaagtggttgaacgtgtctctccttgtaatatcatacactagtaaagcccccgctgcacctctgtaatatgaccgtgtgatagaacgaaaggactcctgccctgctgtatcccagatctggagttttatctgtttcccatcaatcgttatcatccgagcaccaaactctacaccaattgtgaggtcatgcaccggctgaaacctcttgtctgtaaactgtagcaataagcacgatttaccaacacctgtgtcgccgatgatgat

SEQ ID NO: 1401 - DNA, 441 bp, Mus musculus
acaagctcatctttgaggctttttgtctaacaagtatataaaaagcagtcagcgaacctttttgtaaagggctgggtatcagatgtcttatgctcggtgaacagatgaattctgccatctgagtaggcaggcaggtgtatccgtggttgatggacctgcttgccaaggcccctaggctacacactaactctgctggaagacaccatttgctttaggattatcgaatttccatgatacttaatatagaaagttagttgaactaatcatggtcaactgcattctctttcctaggtgcttagtcaacaaagagaggcctgtgtaaaacaattcagccagagaaacatttcagttgttttcaaaattgttgtatggttgcatgtctgtcttagtgtacacataccaacacacgttaacagacactcgagagcaggccaggattga

SEQ ID NO: 1402 - DNA, 514 bp, Mus musculus
  misc_feature (425)..(425): n is a, c, g, or t
tcaaggactccccaacaggagcaaactcatatgtgatcatcaagtgtgagggcgaaaaggttcgctcagctgtgcagagagggacctcgacaccagagtacaatgtaaaaggcatcttctatcgcaagaagctggctcagcctatcaccgtgcaggtttggaatcaccgagtcctgaaggatgaattcctgggccaggtgcacctgaagactgccccggatgacctgcaggacctccacaccctccatctccaggaccgcagtagccggcagcccagtgacctgccaggcattgtagctgtgcgagtcctctgcagtgcctctctcacggctgtctgaccccagcctgcctgtcctgccccactagtcctcaccactactcgcatgtccccaccttgcctgggaccagcctgggaaccagacacnggggccctttcctcactcttccactgacccactgtgtgacctgaagagagccctgccctctctgagcctcagtgtttggagggccccaa

SEQ ID NO: 1403 - DNA, 323 bp, Mus musculus
attccccacccagcttatgatgataaggacaacaccagtgacatcatgctattaaagctggagagtaaggccaagagaactaaagctgtgaggcccctcaagttgcccagacccaatgcccgggtgaagccagggcatgtttgcagtgtggctggctgggggagaacatccatcaatgcaacacaaagatcttcctgcctacgagaggctcaactgatcatccagaaggataaggaatgcaaaaaatacttctataagtatttcaagaccatgcagatttgtgctggagacccaaagaaaatacagtctacttacagtggtga

SEQ ID NO: 1404 - DNA, 535 bp, Mus musculus
  misc_feature (26)..(26): n is a, c, g, or t
  misc_feature (122)..(122): n is a, c, g, or t
  misc_feature (130)..(130): n is a, c, g, or t
  misc_feature (193)..(193): n is a, c, g, or t
  misc_feature (209)..(209): n is a, c, g, or t
  misc_feature (411)..(411): n is a, c, g, or t
  misc_feature (415)..(415): n is a, c, g, or t
  misc_feature (490)..(490): n is a, c, g, or t
ttgattaaccgacagagttccccaanccaaaagaccacggcctctgatagagatctggtgggcgccatgctggagagttggtactagttcctccctggatttatactggaggtatttatccnagtgtggntatcaacccccacatcctcctctctagtaatgtacaagggcccctcctctctgaacagcctcntacctctctctcccanctgagcctggctctacaacccgtccatgcactggccaggggggaacagaggctgtgagcctcctcagctcaccttgcacgtgttagaacatgttcgtgcccaccaagctagctcactctgtgactctgtcgtctctctctccctcccaccgtggcctcttgtatttggggacctcaggaggaggaggaggaggaggaccctnccgncccctgccatggtccacactcaatcccagcccgttgctgtccctctgtctcccccactccccacccccagccatnctagtttttaagttttcttcttttcctttgattaaacgtgacagc

SEQ ID NO: 1405 - DNA, 400 bp, Mus musculus
  misc_feature (289)..(289): n is a, c, g, or t
tgtcattaaaaatgcaccccgaggggctggggagacagtggttcagcggttaagaactcttgttgcttttccagaggatccaggttcaattcccaggatccacatggtgactcccaaccttatctataactctgcttccaggggatctgatgtcttctctgaccaagacctccttgagcaccaggtacacacgtgaacacctccatagatgcaggcaaaacaatcatacacataaagaaatcttcctttttacatcagaagtgcaaacctaggactctagatggagtcngtggtagaaggcttgcttagcatacctgagggcttggattctacctccagcaccaccaaaacaaaggagaaaacacaaacctggcagctgctctgtatccagaaacaggta

SEQ ID NO: 1406 - DNA, 470 bp, Mus musculus
  misc_feature (29)..(29): n is a, c, g, or t
  misc_feature (55)..(55): n is a, c, g, or t
  misc_feature (71)..(71): n is a, c, g, or t
  misc_feature (78)..(78): n is a, c, g, or t
  misc_feature (101)..(101): n is a, c, g, or t
  misc_feature (197)..(197): n is a, c, g, or t
  misc_feature (209)..(209): n is a, c, g, or t
  misc_feature (227)..(227): n is a, c, g, or t
  misc_feature (315)..(315): n is a, c, g, or t
  misc_feature (318)..(318): n is a, c, g, or t
gcgcagcttctgatcaatttctatgagancttaatctaatcatgtctggctccgnccctcttccctgtganccgtccntcctctgttggttctctctcccnccatcttgtcctcccctctgtttttcatgacaagcatacagacttgaacacccctgggtgctgtcaagaactgtgaagtccatggtcatccaaatntaccaaaaaaangaagtcaccctccatgtntaaaaaaactgtcgcttctcctcggaaacttgagactccaccagcttccagatacagtagctgttttctttagtctttgatggaaatnttntgaaggaaccgccctcgctgggctcctggtacaccagaggtcaaggccggtggggttttctttttttaattggttgttgagaagtttcagaagttcgttttccagctgtggtcatttcagacacatctgcaccataactcacacatttcaat

SEQ ID NO: 1407 - DNA, 448 bp, Mus musculus
agaatgaacgcgcacaggccttccgccgtctagaccaagctcaccgtcagtacctgctcagtggtcagcactatgacttcccgagttaccggagtgtcgtgcacgaggtgacccaggccttcgccgctgcctcgcgggaggtattggcagtggaagcagagttggcagggcctcgagcgcaaccggtgctcgcccgccacgtgcgcagcctgcaggagctagaacagacgcgcctggccacggtggcactgttgcaggtgatggggacaccaggagtgtcagaacaggaccctgaaaagttgcaccagctgaaaataaaggtaattaaaaccatggaggcgatcggcgaggttctgcaggaactcaggtttgatgcggaatctgccgagtgagggcggctccccagggaccagaggaagccgggaaaagaggcccatggcgtcgagcc

SEQ ID NO: 1408 - DNA, 494 bp, Mus musculus
atatcaccttgagcacccatgaatgtgccggtctttcggaacgggatataaacctggccagcttcatcgaacaagtcgccgtgtctatgacatagatctaccctgactcttatttgcttgggggaaggagtgactggaggaggaacctaggaagggaaccaaggaggctggcccttgctccctgactctttcagtgaccaccacctccctatgcagaagggatgtcaatgtcaacagcagggactgagacctttctctgtgccactctcctcactggggctctgccatgttacactaatttgaataagctctccctttttctgtagagttcccagcctcagtaatgttccaggctgcttcttgttccttttctaccctttctagttcattttccaaggtagctgtgataaagcatgacataaaagcccaattcagatcctactaataaaacaagctccaatgtattatggaaacatgtgcttttacgcctccaa

SEQ ID NO: 1409 - DNA, 401 bp, Mus musculus
gatccaggataaggaaggaattcctcctgatcagcagaggctgatctttgctggtaagcagctggaagatggccggactttgtctgactacaacattcaaaaggagtccacccttcatctggtgttgagacttcggggtggtgctaagaaaaggaagaagaagtcttacaccactcccaagaagaacaagcataagaggaagaaggttaagttggctgtgctgaaatactataaggtggatgaaaatggcaaaattagccgacttcgtcgagagtgtccttctgatgaatgtggtgctggagttttcatgggaagccactttgacaggcattactgtggcaagtgttgtctgacttactgcttcaacaaaccagaagacaagtagttgtgtatgcgttaat

SEQ ID NO: 1410 - DNA, 280 bp, Mus musculus
gggattccccagtgaacaaactgctctatgcccgggagatccctcgctacaagcagatggtggagaagtactatgcggacattcgccagagctctccagcaagctatcaagagatgaactcagctctggctgaactctctgggaattattcctctgctccccactgcctggaggctcttcgagaactttacaaccacatccacaggtattatgaccagattatcagtgccctggaggaggaccctgtggcccagaagatgcagctggcttgccgcctgca

SEQ ID NO: 1411 - DNA, 421 bp, Mus musculus
  misc_feature (103)..(103): n is a, c, g, or t
caaaggcagttattcccagtggagctcaccctgttgcaagagcactggaagcctcccgaaattccagcaaaagcatggtgcctttaacccaaaggcctggaancccgacatcacagattctccctcttcgtgcctttcccgacctctttggaggcagaaatcgcctgtgggtccctagttccagatgtcgaaccacatcgaggactggtagggaaggagcttaaagtgagcggctgcatgctggaggtacgctggatcgcggaagattctcgcctcctccgactttccatcatcaactttcttgaccagctttccctagtggtgaacaccatacagctctttgggcccccagtttcctgttaagcctggctggggacccatgtctgaccttatctccgtctcctcctaagcaatacaattt

SEQ ID NO: 1412 - DNA, 239 bp, Mus musculus
agaaggcattggctcttgtggctgtggcagcgcccctgacgttggaaacacctgtatgaaggccttcgatatcattctccttggtgcaaggccacatgggacacaaatcctaatgagatgttgcagtagataatttctcattaaaattcttatttaatggccttttgaaattactgtaggggcataaaattgggtcttgatatattttattaaatgctgtatcccttattcccaaaaga

SEQ ID NO: 1413 - DNA, 380 bp, Mus musculus
  misc_feature (98)..(98): n is a, c, g, or t
  misc_feature (113)..(114): n is a, c, g, or t
  misc_feature (163)..(163): n is a, c, g, or t
  misc_feature (171)..(171): n is a, c, g, or t
  misc_feature (211)..(211): n is a, c, g, or t
  misc_feature (238)..(238): n is a, c, g, or t
  misc_feature (308)..(308): n is a, c, g, or t
  misc_feature (321)..(321): n is a, c, g, or t
  misc_feature (336)..(336): n is a, c, g, or t
  misc_feature (338)..(338): n is a, c, g, or t
  misc_feature (342)..(342): n is a, c, g, or t
atatggtacttaactagaccttggaaatcttaggcttattgatgccaaccgctgcagacatgcgtagtgctcagaaatgtagataaatagtgttttangatattggtggggcnnagttcccatgccgcggtcattcctgtactctgttatgcccagggtagcntcttcctnttggggatagctaatcagtgcacactgaccgaggcattgncttgtatgttagctaagggggaagcantcttttgaatcaaatgatctttgctcgtagtttgacaaagataacatttttactcatatgtaagaacgcncagtctcattatntctggttataccatntntttntggtatccctgggagacctgctcttttcggaaatgaaa

SEQ ID NO: 1414 - DNA, 554 bp, Mus musculus
cctcgatctcgtgtgctgggactgaggtatgtacctccacacccagtttagacagtgctgggaactgaacccggggcttagagcatcttcagcaagcctctaccgaccaatctatgtccccagtgtgctctcttctgtcctactgggtaatggggctgagtttattcaagcccctgggcaagagggctggagctgcccgggacacctaggctctggtgtggggaccaggcagagcctttatgaagaggacccctgagcctctgtacatggagagacttgccctgggcctccagatctcaccaacctcacgtcagcacaagcagagaaacctgacatgtgacgcctcaggaaaaagccatgagaaacagcagggcctgcgccttgcctgtcacctcagtgacaatgtcccttaagtgacctggacccgctatttttcccctagttccctgagtactagtaaaattgccatctgtacctgaaaatgaagacttcacagccattgtactctggtcctaggaatgggtgcccagagacctgtgcctctgtaacacaaa

SEQ ID NO: 1415 - DNA, 473 bp, Mus musculus
  misc_feature (213)..(213): n is a, c, g, or t
  misc_feature (250)..(250): n is a, c, g, or t
  misc_feature (427)..(427): n is a, c, g, or t
  misc_feature (432)..(432): n is a, c, g, or t
  misc_feature (435)..(435): n is a, c, g, or t
  misc_feature (439)..(439): n is a, c, g, or t
ctcacgctggccaagaactatatcaagtcgctgaccgccaccatacttactatgtccagcagccgcctcccggggctggaggcaccaggtcctgcgccaggccctaaattataccagcactaccatcaccagcagcagcaacagcagcagcagcagcaggtagtagctggggccatgcttggtgtcactgaggaccagccccaaggccacctngcaacgctactctacacagatccacagcttcagaganggggagctagcacgcgcttcgggctccggggcaggttggcagtgaggagcctgcctgctcttctcagctgttgtccctctgtgctgcaagctccagactggtaatgacactagtgaggtccctgagggggttttgttgttgacataagccctctcatggcccaagctggccttgaanctccntgnatcnctcctcaccgtccatcttctctagggcttgggat

SEQ ID NO: 1416 - DNA, 436 bp, Mus musculus
  misc_feature (28)..(28): n is a, c, g, or t
  misc_feature (64)..(64): n is a, c, g, or t
  misc_feature (80)..(81): n is a, c, g, or t
  misc_feature (96)..(96): n is a, c, g, or t
  misc_feature (195)..(195): n is a, c, g, or t
  misc_feature (260)..(260): n is a, c, g, or t
  misc_feature (341)..(341): n is a, c, g, or t
  misc_feature (403)..(403): n is a, c, g, or t
  misc_feature (411)..(411): n is a, c, g, or t
ggaagttcctgtctgagttcaatggaanactatgatcctcatacaaataagtggagcatgtgcncaccgatgtgtaagannagagggggtgttggngtggccacctgtgatggtttcctgtatgcagtgggtggccatgatgctcctgcttcaaaccactgttccaggctcctggactacgtggaaaggtatganccaaaaacagatacatggaccatggtggctcctttgagtatgcctagagatgctgttggtgtctntctccttggtgacaggctatatgctgttgggggctatgatgggcagacttacctcaacaccatggagtcctatgatccacnaactaatgagtggacacagatggcttcattgaatattgggagagcaggtgcctgtgtggttntcatcaancaaccttgactgatttatataatgt

SEQ ID NO: 1417 - DNA, 559 bp, Mus musculus
ggtcaacatcatagccgtgctcaacaacctggtggtagccagccccattgctgcccgggacctgctctactttgatggcctccgaaagctggtcttcatcaaaaagaagagggatagccccgacagtgagaagtcttcccgggcagcctccagcctcttggccaacctctggcagtacagcaagctccaccgtgacttccgggcgaaaggctaccggaaagaggacttcctgggtccataggtgaagcctcctggagatgaagtgattcagcttccaagagataggctcagctcctgctgtcccacagcacatagaagaggagctgatgccacaggacctctctctctctctctctctcctctctggagtcctgtgtgtgtgcccttgaggggccagggccaccagaaaagaacaggcgcttgcaactggggattgattggcttctgcagggcagggaaagggggtagagcttgagctgctctggtgtactgggtggcgattagtcacaatggcaagggcggggccaccctcggcctgacagctttgtgacggcaacat

SEQ ID NO: 1418 - DNA, 510 bp, Mus musculus
  misc_feature (80)..(80): n is a, c, g, or t
  misc_feature (86)..(87): n is a, c, g, or t
  misc_feature (103)..(104): n is a, c, g, or t
tgttttgggtacaaggcatttctaaaattttataaacttaagtttaatgggattttttgaaggattttctttctttttcnttttcnntctttttttttttttnnaggggaaattaatggagggacagaagaggaaccaccgaagtgtgggtgttctgataagctactttctaagtgccatgtttaggacctgatcattccaagtttcacgttcatgtatgactgccgctcctttctttcaaggacagtgttttttgtagtaaaatcactggtttattcaaagctttagttaggggtgagtgaagctactaaaccccatgttggctgctgctgtggaaatgctgtgctttgagagtaaacacacacacacacacacacacactttttgttttaaagaatttttaaaaaaacgagttagtcatgagactttttcatctttccagggaacatattgattggtcttaaatattagacagttaagtaaatggtggctggaacatctatttttcta

SEQ ID NO: 1419 - DNA, 419 bp, Mus musculus
aattcctcagtattatgtgtttccatttaggcaacccgtcagtaagttatggttacaaaagatttgttggagaccaacagtcattttctgatttttgtgaagattggtgtttatggagaccttgccagctaaatccatgacagtgtctatttaaatagtgcaatcaagaataccctgaaataaatgcaacccaaagttgaaatgtgccaggatgccccttttctacccaggagatatcttatatttggaaaatgtctgcctctccaaataaatatgtgattaataagccatatcacagtttaagaaattgtatatatgcccctccaaaaaccaagtattttgcatatgattgattttagaaagattttgaagctggggtttatctgtgtaatgaagaccagattctttgtatatgtact

SEQ ID NO: 1420 - DNA, 526 bp, Mus musculus
  misc_feature (101)..(101): n is a, c, g, or t
  misc_feature (108)..(109): n is a, c, g, or t
  misc_feature (153)..(153): n is a, c, g, or t
  misc_feature (159)..(159): n is a, c, g, or t
  misc_feature (169)..(169): n is a, c, g, or t
  misc_feature (180)..(180): n is a, c, g, or t
  misc_feature (270)..(270): n is a, c, g, or t
  misc_feature (299)..(299): n is a, c, g, or t
  misc_feature (364)..(364): n is a, c, g, or t
  misc_feature (382)..(382): n is a, c, g, or t
  misc_feature (393)..(393): n is a, c, g, or t
  misc_feature (399)..(399): n is a, c, g, or t
  misc_feature (408)..(408): n is a, c, g, or t
  misc_feature (441)..(441): n is a, c, g, or t
  misc_feature (467)..(467): n is a, c, g, or t
atttttgaaggtgtggtactgtgtaaattaaatatattcaatatatccttccaagtatatatatatatatatatatatatatatatatatatatatatatncaaaaanncacattatatgtaactccacaatgtcttctgtttagtgtatggnaaaagntgtccaaacntccacctgggnccagcacagtggccagcgtgttctcaggctgcctgctgaggaccgatggtggatttctctctttgccttaaacctctttatttcactgcnccaacactttctctttgtacatattcgtnccaaccttctgaaaaggaagctataaaaacagaagttgtaatttaagagtctgtgaataaccatnctgctgcttgggggtcgntggaacacatncctttnagcaggaancaaatctgtccttttttaagtttataaaatgtncattttacagtatcaaatatttatantcttatgagaaatgggtgaatgttccctacttaaaactgtggttatcaaaattgtgacc

SEQ ID NO: 1421 - DNA, 499 bp, Mus musculus
  misc_feature (354)..(354): n is a, c, g, or t
  misc_feature (443)..(443): n is a, c, g, or t
gtccttccgttagctctttaacaatggttccaacagaaagtgctcagtaacaccctccttcttaccttataaaggggataaaaactggctcaccacatgcctgaggtctggttccacttcacatacagtggaattgcctgcatttggcatcaacccattgtctgcagaggatatgttttgaagcaaagactgcctctgggctttgagaggttctgcattctaagtatgattaacactaaaccagaaacttggttctgaacttgtttgtgatactcaaagtaaaagaattttagattcagagtctcctgagagaaattacgtgtgaacaccaacccaaagaaaaattcagtctantctttcaaagtttactatattttatcaaaacatatttctttaatcacaaaatcatatgcaatatgagtgaacaatatggaagaaatttntcaatgctaatattttgtgtcatggcattttggaatgtccctgcatatagttttaa

SEQ ID NO: 1422 - DNA, 545 bp, Mus musculus
agtggactgccaactcacacagaactgctgcgaggacctggcctgtatgatcacaacaaccaagcacttaaaaagtttggatcttggtaacaacgccctgggtgacaaaggagtcataaccctgtgtgagggactgaagcaaagtagcagctccctgaggagacttgggttgggggcatgtaagttgacttccaattgctgtgaggcattgtcattggccatctcttgcaaccctcacctgaacagcctaaacctggtgaagaatgacttcagtacatcggggatgttgaagctgtgctctgcgttccaatgccctgtctctaacctggggataattggcctgtggaagcaggagtactatgcccgagtgagaagacagctggaggaagttgagtttgtcaagccccacgtggtgattgatggtgattggtatgctagtgatgaagatgaccgaaactggtggaaaaactgaagacatgagccccctctccttcacgtcctagcactgcagtatctgtgaaatgtttgtctcaccttggaggatg

SEQ ID NO: 1423 - DNA, 399 bp, Mus musculus
  misc_feature (50)..(50): n is a, c, g, or t
  misc_feature (144)..(144): n is a, c, g, or t
atgggttgggccacgagttcctgaatgatggccccaagcggggacaatcnagattctgaatatttagcagctcactgaagttcgtccctaaaggcaaagaagctgctgcctcccaggggcactaggacatggactgcgaatggncctgccccctgccccctgccccctgtcccctgccaaccgctccagcctcagtcaccgaatgatctgctctggtcaaatccttctatgccagccagggtggtgatgacccgtgaccttttgaggaggggagtaggctgataccgggaactctttggatccttgccttctggcagagaaaacaaaactccgtttcataatctgcaaactcatcttgcctcactctagcttggggaagtgacagttgttgccccatta

SEQ ID NO: 1424 - DNA, 508 bp, Mus musculus
tgaacaggagctggccgtctgtgcagatggccgagagggacgggagcctgatgggtttataaacagaagccatgggcatggggaatgcttctctgcaggagactcaggagtagttagcctccagagctttatccccctgtcctcccagggaggagtggccatggctttggttttgcttgttcttatttatgggtctcatgctgtagaccaggctggtcctgaactcacaaagatccacctgcctgtgcctcctagtgctggaattagaggcatacatcattatgtctggctgacgttcttgcctgctacatggtgcagttataggttgcaccaccatactctgatgcagtgctagggatggagcccaggacttcctgcatgctaggcaaacattctaccaactgggccttggccccgtcctggtctctgtttccgtgtgctgattctgctcctggctccacgctagcaattctgaagcaacagtgaatcaactctggtctggcactgc

SEQ ID NO: 1425 - DNA, 500 bp, Mus musculus
  misc_feature (149)..(155): n is a, c, g, or t
gcccttgctggtcagtttcttatgacaggatttgggcttctccacatgaggactcttgtgtagacccagtgtcagcatcatggccgttgcccagggacactggggctgtggggaaggactgggggaaggcactagtgggcaacccagtnnnnnnnccgtcatgggagcaggagtccttcctgtgaattagggatgggctgtgggttgtgactgctttctctacaaagcttgagacgtagcccctaggaccctgggttctatttctattcactgaccagactcccctaaacactatctgacatttcatggtccaggtgacagatgctctgtgtcacacacccctgactctgtatggggggtggagtgtactccttcagcccccacagccagaatcacttctgcagccttcctgagctcagcaccctccctgactgtgtatgacctacagtgcctggttcagatgtatttctagccctgccagtggctgtctttgtacagat

SEQ ID NO: 1426 - DNA, 491 bp, Mus musculus
gctagcatttgcctactgttttgcacagggtcctggcttgaagacccagcactgcacaaactaggcacgtgctccagggatgtcattctagtagaggcaggaggatcggaagtttggagtcacctttgagtactacctaggaagtttgaggctagcctggagctataagaggctgacacggggcgggggtgggaggaaggcctgtcaaagactctatggaccagtccattcccaagcagagtcgtggagatcctgcccgtagttagctaagaccggtcctgacgttttgtgtcaactaaatcgcgtctgactgtatcttggacttagtctcggcttcctgttgctagaagaggctccttcacttctactctgaacacccacagaggaagccaccctgtggttttcttacaactggggatttggctggtggaatggctcatctgaagacactgccaccaagcctgatgacctgagttagacctcgggatcca

SEQ ID NO: 1427 - DNA, 502 bp, Mus musculus
  misc_feature (231)..(231): n is a, c, g, or t
  misc_feature (233)..(233): n is a, c, g, or t
  misc_feature (235)..(236): n is a, c, g, or t
  misc_feature (239)..(244): n is a, c, g, or t
  misc_feature (247)..(253): n is a, c, g, or t
  misc_feature (255)..(255): n is a, c, g, or t
  misc_feature (257)..(281): n is a, c, g, or t
  misc_feature (283)..(284): n is a, c, g, or t
  misc_feature (286)..(286): n is a, c, g, or t
  misc_feature (288)..(288): n is a, c, g, or t
ggatgcaaagatagccaggcccttcccagaagagcagaggaagtgaggaggaacaggaggctggcagtgtccaaaggcagaggtcagagaacgaagccgcagcaggggtgggaaagtgtgaaagggaggagagtactgggcacagggtcagaaagcaatgcacaggcatcaaaactcaccgtagcaatctacaaggatttacataagatttcagggctggcaccctgtgcncngnnctnnnnnnctnnnnnnngnannnnnnnnnnnnnnnnnnnnnnnnntnncnanctccccagagtcatcctctaaccttactcagacacccagatgtgagccagtcccctcccaccatgactatttgcctttacacagaaagtccatgtctggcacatgtttcaggatgaattaaatgctgacagtgactgagtgagagccaggcagctctgctttagtgggttagctctttggaggtaaggggtctgtcacatgctccttagagtta

SEQ ID NO: 1428 - DNA, 379 bp, Mus musculus
ttttcctgaagcacggctcagaactgagaatcattcctagagaccgagttggaagctgctaatatatgcttgttggaacacacagcctttcagaataaatactggtatttgttgttgctgtacaattgaaatcaggcattcaccatacaatgaaagcaccaagaatcaacagaacagggaaagcggccgcttgtcccttcctgttcatttttttcatggaaagagagaatgcctttgagtggagggtacgacaccacaggtcacactgtggtgactgctgcctcaccgggagaagagagtacctctgagacaaatggactgtgctttaaaacaaaaacagcaaaatgggaggatgagtgctaactcttttcaggagcat

SEQ ID NO: 1429 - DNA, 531 bp, Mus musculus
  misc_feature (148)..(148): n is a, c, g, or t
  misc_feature (261)..(261): n is a, c, g, or t
  misc_feature (349)..(349): n is a, c, g, or t
  misc_feature (365)..(365): n is a, c, g, or t
  misc_feature (374)..(374): n is a, c, g, or t
  misc_feature (473)..(475): n is a, c, g, or t
  misc_feature (477)..(477): n is a, c, g, or t
  misc_feature (479)..(479): n is a, c, g, or t
  misc_feature (483)..(483): n is a, c, g, or t
agagccacggtgcagccaaggccaagggatgggagcctggagttactcagacacgtttacttcagcatggactgttgtctgaatcaggtccccaaagtacatggggtgcacagtcgctcggaatggagaacctcaggcgaggcggtcnaaaggccaggacttctcaccaagctgtgctctcagaagtgcacaggactgctagtgactgactggtgagatgaaagcctacaagacatggcctggggtcacgcactgccaagnaggctgacgggaggcccaggtagcccaaggatggcaaggatacagagtgacctagcacaggggagcttcagtccccaggaggtacagncaccgtgacaactccncaacccacngccacctcagaaggtgaagtttttgattcgatcacaactattagcaaaacaaaccctgtcagttttaaactgtttttctgacctaagactttactagannntnanacantggagattttaacaggtgtatttattactgttcagcactggatggcaa

SEQ ID NO: 1430 - DNA, 464 bp, Mus musculus
  misc_feature (47)..(47): n is a, c, g, or t
  misc_feature (234)..(234): n is a, c, g, or t
  misc_feature (241)..(241): n is a, c, g, or t
  misc_feature (268)..(268): n is a, c, g, or t
  misc_feature (310)..(310): n is a, c, g, or t
  misc_feature (347)..(347): n is a, c, g, or t
ttttccctggtgagccgtgacccatctgcactaatttgcaaggcacnatagcacaagctgggtcgccatttatgtcggtagtgtcatagtctgcagcagtgaatagcgtcattcttcaggtggtctagggagcgcgaagagcttttttgtactttttacctccaataatgggaaaatgaagcttttaggtattggtcaaaagatctgatttgagagttttgggttttttttttnaagtgcngtaggaaatggattatctattacaacntaacttcttcaattatggaatttttatcctagtagaattctntcttaaatgtaatactacaagtgggtacattcccccnaactgattatagataagtttaatcatctcaacttgctaacatgttttcatttttcctgtaaatacgtttattttttatttataaaaattctgaaatcaatccatttgggttggtggt

SEQ ID NO: 1431 - DNA, 575 bp, Mus musculus
  misc_feature (202)..(202): n is a, c, g, or t
  misc_feature (361)..(361): n is a, c, g, or t
  misc_feature (399)..(399): n is a, c, g, or t
  misc_feature (404)..(404): n is a, c, g, or t
  misc_feature (419)..(419): n is a, c, g, or t
  misc_feature (431)..(431): n is a, c, g, or t
ggatgaattcacaactgccgatgttcagccaattcctggcaattctccagatgagaagcagtccccttccttagcttttcggtcctcctcctccttaagaaagaagaataaccccggggagaaagagcttccaccttggcgatcgtcagataagcatcccactgacatcatccgctttaattatctagacaactgtgacccngagctcttcaggctaggaagaagaaaaagaagcgaagtgaccccagacttcaagcgccagctgcgagataagaaaaataagcttcaagacagagccaggctcaggaaagcacagtcattgatctccctgagttcccctccaaaagttccagttcgtctngcctggcctctgcatctgccagtggcaccctcagaccntgaancagcaacggaagcantcctggagcatnttcagaaacaccccgggcttcagtcaccctcaccgaggctccagagtcaaagctgattaaaggattggaaaaggactttttctagaaacgacaaggtgttcttcacagctgagagttggattctagctagtccctccattaaac

SEQ ID NO: 1432 - DNA, 447 bp, Mus musculus
  misc_feature (348)..(348): n is a, c, g, or t
gcggttcgtgcagatttttattccagatgaacatgttttaaaagtgcctgaaatcgcctgccacgggaatgtgattctgcggcagaaacaaaagacagagcatttcttgcagcaaatgagatcctctgtgaatctgaatgtcaaaaaaccaacactgcttttaatcctctctgactgtttaatgccagctttgtgttctgaaccgaggtttgcataagtagagtggaaatccttctgaagggcgggaactctgtcaggctgagctctgtaaagccctcaagaaaccctccagaacacttagcagttggggtgctgattttcttgtgcttttgaaaacttaagtcattnctccgtttcctgcatcacttcttgagtagtgaagtcacgtctccattcaaatccaccctcaagcatcggccatgggaacttctgattctggttgctttt

SEQ ID NO: 1433 - DNA, 489 bp, Mus musculus
  misc_feature (232)..(233): n is a, c, g, or t
  misc_feature (237)..(237): n is a, c, g, or t
  misc_feature (247)..(249): n is a, c, g, or t
  misc_feature (251)..(256): n is a, c, g, or t
  misc_feature (258)..(261): n is a, c, g, or t
  misc_feature (263)..(266): n is a, c, g, or t
  misc_feature (269)..(270): n is a, c, g, or t
  misc_feature (272)..(273): n is a, c, g, or t
  misc_feature (277)..(277): n is a, c, g, or t
  misc_feature (281)..(284): n is a, c, g, or t
  misc_feature (286)..(286): n is a, c, g, or t
  misc_feature (290)..(290): n is a, c, g, or t
  misc_feature (299)..(299): n is a, c, g, or t
  misc_feature (303)..(303): n is a, c, g, or t
  misc_feature (310)..(310): n is a, c, g, or t
  misc_feature (317)..(317): n is a, c, g, or t
  misc_feature (320)..(321): n is a, c, g, or t
  misc_feature (332)..(332): n is a, c, g, or t
  misc_feature (335)..(335): n is a, c, g, or t
  misc_feature (354)..(355): n is a, c, g, or t
  misc_feature (361)..(361): n is a, c, g, or t
  misc_feature (377)..(377): n is a, c, g, or t
  misc_feature (386)..(386): n is a, c, g, or t
  misc_feature (391)..(391): n is a, c, g, or t
  misc_feature (393)..(393): n is a, c, g, or t
  misc_feature (403)..(403): n is a, c, g, or t
  misc_feature (410)..(411): n is a, c, g, or t
  misc_feature (416)..(416): n is a, c, g, or t
  misc_feature (422)..(422): n is a, c, g, or t
  misc_feature (450)..(450): n is a, c, g, or t
taccatctctgctcagcggtaatgacaggacacagggcccagagaggtcccggactgcctgcagatgctgagcagagttctgaactaggtacccacaggcctcaccttcacattgcctatgcctccatggagacctcagcccagtcaacaggaatcccaccgtggtgcctctgggctgatgcacccccctagcctgtcttcatttaaagcaagcaagtcttcaccttctccnnctgntgacacacannncnnnnnntnnnngnnnnagnngnncaancctnnnncntctnccatgctantgancccaggnccttganctnnatttaagcagncanccgtgtacagtggaggtanntctggnacattccttccatttnccttgtagncggangncctgtgcagnccttccnnacctngctttntttgttgctctacatgtgccccacgggnttcactcagtacgggatttccccaaatctggcctgttat

SEQ ID NO: 1434 - DNA, 326 bp, Mus musculus
aacctcaccgacagcctgttggagaaggtgggctccatccaagtggagtctggaccgtggctggcgttcgagcgcagggcctttcgtggggagcagtttgttctggagaagggggactaccctcgctgggatgcctggtccagcagccgacgtagtgacattctcctgtccctccgtcctttgcacattgatggcccagaccacaagctgcacctgtttgagaacccagccttcagtgggcgcaagatggagatcgtagatgacgatgtgcccagcctgtgggcccatggtttccaggaccgtgtggccagcatccgtgtcatcaa

SEQ ID NO: 1435 - DNA, 324 bp, Mus musculus
  misc_feature (157)..(157): n is a, c, g, or t
  misc_feature (160)..(160): n is a, c, g, or t
  misc_feature (164)..(164): n is a, c, g, or t
  misc_feature (179)..(179): n is a, c, g, or t
  misc_feature (192)..(192): n is a, c, g, or t
  misc_feature (251)..(251): n is a, c, g, or t
  misc_feature (275)..(275): n is a, c, g, or t
  misc_feature (277)..(277): n is a, c, g, or t
attacacccgtcatatacgaacccgcagatgatctccagtgtgtgaacttcaagctcctgcctaatgaggactgtgtcaaagcccacatagagaaggtgacagatgttatgttgtgtgcaggagatatggatggaggcaaagacacttgtatgggtngantcanggaggcccactgatntgtgatggtgttntccacggtatcacatcatggggccctagcccttgcggtaaacccaatgtgccaggtatntacaccaaacttattaagtttaantnttggataaaagacactatagctaaaaatgcctgaatatcacattgtc

SEQ ID NO: 1436 - DNA, 327 bp, Mus musculus
  misc_feature (157)..(157): n is a, c, g, or t
  misc_feature (160)..(160): n is a, c, g, or t
  misc_feature (164)..(164): n is a, c, g, or t
  misc_feature (179)..(179): n is a, c, g, or t
  misc_feature (192)..(192): n is a, c, g, or t
  misc_feature (251)..(251): n is a, c, g, or t
  misc_feature (275)..(275): n is a, c, g, or t
  misc_feature (277)..(277): n is a, c, g, or t
attacacccgtcatatacgaacccgcagatgatctccagtgtgtgaacttcaagctcctgcctaatgaggactgtgtcaaagcccacatagagaaggtgacagatgttatgttgtgtgcaggagatatggatggaggcaaagacacttgtatgggtngantcanggaggcccactgatntgtgatggtgttntccacggtatcacatcatggggccctagcccttgcggtaaacccaatgtgccaggtatntacaccaaacttattaagtttaantnttggataaaagacactatagctaaaaatgcctgaatatcacattgtccca

SEQ ID NO: 1437 - DNA, 376 bp, Mus musculus
gattggtcaaggctacctcatcaaggatggcaaactgatcaagaacaatgcatctactgactatgacttgtctgacaagagcatcaacccactgggtggctttgtgcattatggtgaggtgaccaatgacttcatcatgctcaaaggctgtgtggtggggaccaagaagcgagtacttactcttcgtaagtccttgctggttcagaccaaacgtcgggccctggagaagattgacctgaagttcattgacaccacctccaaatttggccatggtcgcttccagaccatggaggagaagaaagcatttatgggaccactcaagaaagatcgcattgccaaggaggaaggagcttgattccaggaccactttgtgcag

SEQ ID NO: 1438 - DNA, 421 bp, Mus musculus
agagccttcctaagccatggtggtttgaacagtatatttgaaactatgtatcatggtgtccctgtagtgggaatcccactgtttggagaccattatgatactatgactagagtacaggcaaaaggcatggggatcttgttagaatggaatacagttactgaaggagagctgtatgatgccctggtgaaagttatcaataatcccagttatcggcagagggctcagaagttatcggaaattcacaaggatcaacccggccaccctgtcaatcggactacctattggatagactacattcttcgccatgacggagcccgtcacctccgttctgctgtccatcagatctctttctgccagtatttcctactggatattgcctttgtgcttctgcttggtgctgtcttgctctacttcatattgt

SEQ ID NO: 1439 - DNA, 336 bp, Mus musculus
  misc_feature (291)..(291): n is a, c, g, or t
gtctcactgttgacatatttaatgttttaaatgtacagatgtatttaactggtgcactttgtaattcccctgaaggtactcgtagctaagggggcagaatactgtttctggtgaccacatgtagtttatttctttattctttttaacttaatagagtcttcagacttgtcaaaactatgcaagcaaaataaataaataaaaataaaatgaataccttgaataataagtaggatgttggtcaccaggtgcctttcaaatttagaagctaattgactttaggagctgacatanccaaaaaggatacataataggctactgaaatctgtcaggagtatt

SEQ ID NO: 1440 - DNA, 497 bp, Mus musculus
  misc_feature (38)..(38): n is a, c, g, or t
  misc_feature (321)..(322): n is a, c, g, or t
  misc_feature (409)..(409): n is a, c, g, or t
taaatccctccgaaccagagaagttcgtggaaaaaaantgtatcttcccagaacatttcagaaaggggcttttccagtcgtttttatgggaatagtttgacagccaggggttagttttgaaagagaggcaaaccttgtgacatttcacttcaaaaaacagcccggtggcatttttccagtctcagtgtgaaattatccccctgaatgttgacctctctgggagtggaatgccagcaattcatggcagcagctaataggtaaagccggttatttatttgtcaatgttgttatttaatgagctcttgcatgtgattttttttnncaaaatgttaattttttttatgttttgaagctttttcatgtacctaaatatttcccaatacgatttgtggttggtctagaaatatgnaaatatctgttgtagatatgtaaaataaatgttttactctccgtatatattgcacggttcaccatcatcattagcgtggttttctgta

SEQ ID NO: 1441 - DNA, 456 bp, Mus musculus
  misc_feature (266)..(266): n is a, c, g, or t
  misc_feature (350)..(350): n is a, c, g, or t
ttcccactggttctccgaataaagccagatttggtgctgtgtaatggaccaggaacatgcgtccctatctgtgtgtccgccctgcttcttgggatacttggagtgaagaaagtgatcatcgtctatgtcgagagcatctgccgagtggagacgctatccctgtcagggaagatcctgaggcacctctccgactacttcattgttcagtggcccactctcaaggagaagtaccccaagtctgtgtacctggggcgaattgtttgacnaatggcaaccctaagtcttgagaacattacaagtaccgataatatttactatatactatctttactataaagtttttcaaaggncaaggaaatatcaatggtaaagaatttaaaatgtacaaataactcaatgaagaaagacaaactttagcatataatacccatcaagtagctatgtctgcacacgaaa

SEQ ID NO: 1442 - DNA, 142 bp, Mus musculus
cctttgacccctaacattatttgcattctcaaatgcagcaagaaccctctatgcactttggctgtttctgataggagttatttaatgatatttgattttcttagggctttttgtcgttatttggttatgtcttggttgtttt

SEQ ID NO: 1443 - DNA, 547 bp, Mus musculus
  misc_feature (296)..(296): n is a, c, g, or t
  misc_feature (320)..(320): n is a, c, g, or t
  misc_feature (372)..(372): n is a, c, g, or t
  misc_feature (375)..(375): n is a, c, g, or t
  misc_feature (378)..(378): n is a, c, g, or t
  misc_feature (417)..(417): n is a, c, g, or t
  misc_feature (447)..(447): n is a, c, g, or t
  misc_feature (487)..(487): n is a, c, g, or t
gtgaggatatcctaatggctgctgtagcaactattgggcccatcactgctggaattgatgcttcacatgagtctttcaagaactataagggaggtatttaccatgagccaaattgtagcagtgatactgtgactcatggagtcctcgtggttggttacggatttaagggaattgagaccgatggtaatcactactggctgatcaagaatagctggggtaaacgatggggcattagaggctacatgaagctcgccaaagacaagaacaaccactgtggaattgcttcatatgctcantaccctactatttgagcaacctgntggccacaaggaaggttttggcacaagacagcatttctaggggagggctatntgntantcagcgaccagcctttgcttggtatattcaagacttgtntccctgaagagcaaccttgtaatgtgattntgggacccttcaactattttgacatcatgaacactattgntctaactaacgtatgtttattattccttcaaaaaaatcagctttaccgattgtgcaaata

SEQ ID NO: 1444 - DNA, 513 bp, Mus musculus
  misc_feature (216)..(216): n is a, c, g, or t
  misc_feature (294)..(294): n is a, c, g, or t
  misc_feature (468)..(468): n is a, c, g, or t
  misc_feature (476)..(476): n is a, c, g, or t
tactctggtaagaattattgcctctattctagaaaaaaaaattttaaacattgtgagatattttaagcataaaggtctaatatattgcttttatgaaattaaacattttagttaattgtgggaaggaagcatgaatgtagcagccaagcacaaatcattttgttaacctatagtcatatcaacttgagcagatatagaaaaagattttgttaactncaagaacatgaattacataagttgagttgggcaaaacattttaagtgctttttgcctctacttaggagcctttttctnaccaaaacacttaacaatgcatttcaaaatacctttcagctttcattttgcttcagtgtctcacagttcaaggcaggcaagaaaactcacagcttttatcctagctgtagagacaggcagaggcaggtggattcctaagagtttgagccagcttggtttacatagtgagttccntgccaggncctccaccaaaatattaaatcagttcaagccagtgtg

SEQ ID NO: 1445 - DNA, 556 bp, Mus musculus
  misc_feature (381)..(381): n is a, c, g, or t
  misc_feature (478)..(478): n is a, c, g, or t
gctgtctctcagtgaagttcgtgaatgtctgaaacttgaccaggatcacaagcggtgttttgcacactataagcaagtgaagaaacttaacaagctgattgagtcagctgaagagctgatccgagatggcagatacacagatgcaaccagcaaatatgaatcagtcatgaaaacagagcccagtgttgctgagtacacagtgcgctcgaaggagaggatctgccactgcttctctaaggatgagaagcccgtggaagccattaggatatgttctgaagttttacagatggagcccgacaatgtgaatgctctgaaagaccgagccgaggcctacttaatagaggaaatgtacgatgaagccattcaggattatgaagctgntcaggagcacaatgaaaatgaccagcagattcgggaaggcttagagaaagcccagcggttactgaagcagtcacagaaacgagattattataaaatnttgggagtaaaaagaaatgccaaaaaacaagaaatcattaaagcataccgaaagttagcactgcagtggcatccagat

SEQ ID NO: 1446 - DNA, 200 bp, Mus musculus
  misc_feature (27)..(27): n is a, c, g, or t
  misc_feature (96)..(96): n is a, c, g, or t
  misc_feature (103)..(103): n is a, c, g, or t
cactccttttatttctcagctctaaanactttactctttcttactgtgaatagaagaaaacctgaaaaacatctcagtggtttattaatgtgaatntggatgntaacgtcttaagttaaaaatgtagtgagtgttaaaagtctgtttttaaatagcagtatgcagatttgtcactggagttctgataatgaatggaatta

SEQ ID NO: 1447 - DNA, 242 bp, Mus musculus
  misc_feature (71)..(71): n is a, c, g, or t
gctgcaatagcatgtcactgtgactttaggccccatttcaaaaataccaaacttaaacacatccccaaaancgagtgtgagagaggattacagataactaagtaaaaaatgtcagtggtcaccgttatctattcctgggtcagaagctggcatgtgccatgaaggcggcaagctgtactaggtaactgtgactccgcaggccctgtgggtgccgacctgccttacagatacgtcctgggtaa

SEQ ID NO: 1448 - DNA, 480 bp, Mus musculus
  misc_feature (252)..(252): n is a, c, g, or t
  misc_feature (312)..(312): n is a, c, g, or t
tgggacgtctctgtgaagagccaatatgcatactcccctgtttgaatggtgggcgctgtgtggccccttatcagtgtgactgccccacaggctggactgggtcccgctgtcatacagctacttgtcagtccccctgcttaaatggcgggaaatgcataagaccaaaccgatgccattgtctctcagcctggacaggacatgattgttccaggaaaaggagagccgggctttgatctcatgccccaccccctntccctaagcagcatcatctccttccggtagctcctgggactcccaccaagaaagaccaancgcggtgctggggcttgtttggttttataagcttgaggttgactttttaattttgtgatctattttgttaaatttttttgtgacgtcctttcttacatgtgtgcgttgtttaaatatgcttgcattttctatataaaatttatattaaacggacgcacttcatcctca

SEQ ID NO: 1449 - DNA, 573 bp, Mus musculus
tggcccctaaggagttcaccagaacccacgttgactctgaagccgatgaaatgagaagaaggaagggaggcacctgccactcacctttcatgactctctctgcttggtgctttccttgctatcgccagtgatgttggcccagctcaactgtgggagtggaaatctgtgactctatagcccttggcctaagggctccctcacatcccctggatagtggacaccccattcaccaagggtggggactggtctgaatgtccctggtcggccctctggcctcctgatgtcatgggaagaacaaggaagagccctaggccagggcgatacctttcccacctccctacccaccacggaagggagaaagcacacagctctgaagcaggtgtctctgtgtggaaggttctaggttcttattatgcagacctcggttgttgagcatttgtgaagctgggagcctttgtttaaaagtgtgtgggaggtggggggcgaaatgacggcatgggggaggaggaagaggaggaagccctcaccatataaaattcatgcagactaaacagtttctctgacggcataaat

SEQ ID NO: 1450 - DNA, 392 bp, Mus musculus
  misc_feature (309)..(309): n is a, c, g, or t
ccgagcggcaggattcgccttttctaccggacctcaatttcttcgctgcagactcctgtctccagatgtccggaggcctttcacccagcctgcagggttctctcgatagccccgtgcccttttccgaggaagagctggacttcttcaccagcacgctctgtgccatcgacttgcagtttccctaactgttttccatctttggtcctttccgtctggtcctccttggctgttgggggcggggggaatcgggccttctccactcgtggatacatttatgccgttttgttaaaatccagatagtaacgaatnagcgtttcattcactccttttcgctttttaaaaccacacacaaaaaattccacttggtaaaactccttccaacgaaatctcag

SEQ ID NO: 1451 - DNA, 514 bp, Mus musculus
gaagccattgggtgattgatccactgggtgcctgatggtcgtgatgttggatgacacatgtctggtcctttggatgatgtgttggacatcttgattgaccttttgagtatgtgacagaacacatcttctttggctcattttatcctgggatcgcctcttttttttcctcttctttttctttttctttttctttttttcttttccttttttcttttttttttcttttttggcagacttcttggttcagcagatgccaaattggccaccatatcacatggtgtcttttttgacattctggatgcatggaaggtcactgtattggcaaggtgacatctcagcatgctgctatgcaccaagatagatggttaccacaggcctgccatcaccatctccttggtggaggttgggtgaggggaagaggtgagcagaccctatgagttttctctgaagcccatccccaccctgtctgtgagaaagggctagtgtgggtgtcgggagttcctactgaggtcaa

SEQ ID NO: 1452 - DNA, 135 bp, Mus musculus
gatatgcctttctgagttgggagtaagtttagcatatatcccattgtagggaagactttctcttaaagcatattggtttttaaatatttattacctagtggtactgtggcttgatcgtgtcttcccaaacctgtg

SEQ ID NO: 1453 - DNA, 584 bp, Mus musculus
tatctcatcgatacactcccaaagagcagctgaagaagcacacgatccttgcagacattgtaatatctgccgctggcattccaaatctgatcacagctgacatgatcaaggaaggagcagcggtcatcgatgtgggaataaacagagttcaagatcctgtcactgcaaagcccaaattggttggagatgtggattttgaaggagtcaagaagaaagctggttatatcactcccgtccctggtggtgtgggtcccatgaccgtggccatgctcatgaagaacaccattattgccgcaaagaaagtgctaagaccagaggagctggaagtgttcaagtccaaacagcgcggagtcgccaccaactagcagcactctgagccagcccgagaggctaagcaggccaagaggaatgcagtgtttttaatttattctgtcgaaatggtttaaaatgtttgtatttattgaaagcttaaacgggtggctgtgtgcgcgcatggctctacagaacctcaccaggatgcccatcagttgtcctgcctttgacctggtgatgcacaggagacgtcctcacaccgagagtggatg

SEQ ID NO: 1454 - DNA, 555 bp, Mus musculus
  misc_feature (340)..(340): n is a, c, g, or t
atgatagactcaatgccctgtgcctggcagggagcgcttgcagaggtgtcctagccttagagggctacttcagtgtctctactgacagaaactcctgtatctcaaatggatctcgaagttctctagtaaggagtcctaaggatgacatgtattgggccactagcagggattgaaaacattttaaaagaaatcctttttcttaggagtaaaagctggtaaaaggggtgacttcctggttctgatcaaaaccagaccaaaccctcatttcagcaaagccttgcaagacactcccttgctcatttgccatatttagatgtcttagtggagtcagagccctgtnttggtatgtgtttttcatgctaagtctaaattgtcttttcatttcatgatgcattttttctcttttgtcaggataacatcatatagcatcttgtttgtttttcctaatctctatgtacatatctatctacctgtaaccgtagataggtatctagatagataccaagcttttaagctctgggctactatgcatcattattgggtctctgccttaaa

SEQ ID NO: 1455 - DNA, 494 bp, Mus musculus
  misc_feature (74)..(74): n is a, c, g, or t
  misc_feature (424)..(424): n is a, c, g, or t
  misc_feature (431)..(431): n is a, c, g, or t
  misc_feature (447)..(447): n is a, c, g, or t
gaggatgctgatctctcgaaacctgcttcagcgactagctcccaagctggagagcctcgcctggagtctgtgtngcagctggaatcagtcttgatgctcctatgggctgctcagttcaagtgaatcatgaagtagaccaaagggctgagctcttctaaacagactgagctgtcagccacgctgctggttctgagacaagaacagagttcttagcagaggctagaagggctgctctgaggagccatgcccaaagaagacctgcacactgccttcctcattctggaaagacaagcggtcaaagctgtggcttggatccacactatgggcattttggtgattcttgtccttagggtctgggtacttgaatgaagcttttcctgattaaacaggtaaagtctggggaggccagggcagtggacagatntgccccntttctggtttctgttntgcactaggggtatgtcaggacagtactcctgtactcagatcatgat

SEQ ID NO: 1456 - DNA, 348 bp, Mus musculus
cacttcactttgtaactgtcctgaactggagcccgggaatggactagaaccaaggacctttgcgtacagaaggcacggtatcagttggaacaaatcttcattttggtatccaaacttttattcattttggtgtattatttgtaaatgggcattggtatgttataatgaagaaaagaacaacacaggctgttggatcgcggatctgtgttgctcatgtggttgtttaaaggaaaccatgatcgacaagatttgccatggatttaagagttttatcaagatatatcaaatacttctccccatctgttcatagtttatggactgatgttccaagtttgtatcattcctttg

SEQ ID NO: 1457 - DNA, 519 bp, Mus musculus
  misc_feature (450)..(450): n is a, c, g, or t
aggtgcgccaagtggaaaccgcctgcgcccctgccatgcgtctgcttgcctaccctcgaagtggggacgaacgcgacaggaagaccgtcagggaaggggagacaccactggagaccaaggccaattgggctgtgtaataccctgatccctgaaccctgccccggggcgtattcaggtcagtggccataaaaaggtgaactcagcatgctgcccccgcactggagaggctgcacggtggaggcgatctatcacactgtgagacactgggactgatttggtatcaactgctgtgccattctcctggtcaggagcatcacaagctgttaagtaatgacagacaccttggctgagatgaagtttccagaaaggaagtaacagtgcaatgtggatatttgtgaccacaacataggaaaagctgtacttcccaggctgaacttggctcagcttganccatttcaacaaggcatcctcacaataatgaagagatgtgatctggtttcctttcacatcagccaagat

SEQ ID NO: 1458 - DNA, 562 bp, Mus musculus
tttaccttcggatcatactgggagccaacgccatctactgccttgtaaccttggtcttcttctattcctctgcctcattctgggcctggatggccctgggctttagcttggccgtgtacggggccagctaccactctatgagctcgatggctcgggcatccttctctgaggatgggtccttgatggatggtggcatggacctcaacatggagcagggcatggcagagcaccttaaggatgtgatcctactgacagccattgttcaggtgctcagctgtttctccctctacatctggtccttctggcttctggctccaggccgggccctttaccttttgtgggtaaacgtgctgggcccctggttcacagcagacagtggagcccctgcaccagagctcaatgagaaacgacaacgccgacaggagcggcggcagatgaaaaggttatagcatccttaactgaggctgtaggctgctgggcactggttggctctgttatgctgcgtggccccatgcctggagcagtgagggcctagtttaagggccaaagcagcctggattat

SEQ ID NO: 1459 - DNA, 565 bp, Mus musculus
  misc_feature (288)..(290): n is a, c, g, or t
  misc_feature (292)..(292): n is a, c, g, or t
  misc_feature (294)..(298): n is a, c, g, or t
  misc_feature (300)..(301): n is a, c, g, or t
  misc_feature (305)..(305): n is a, c, g, or t
  misc_feature (307)..(310): n is a, c, g, or t
  misc_feature (312)..(313): n is a, c, g, or t
  misc_feature (315)..(315): n is a, c, g, or t
  misc_feature (319)..(319): n is a, c, g, or t
  misc_feature (322)..(328): n is a, c, g, or t
  misc_feature (330)..(331): n is a, c, g, or t
  misc_feature (336)..(336): n is a, c, g, or t
  misc_feature (339)..(340): n is a, c, g, or t
  misc_feature (342)..(342): n is a, c, g, or t
  misc_feature (344)..(344): n is a, c, g, or t
  misc_feature (347)..(347): n is a, c, g, or t
  misc_feature (351)..(351): n is a, c, g, or t
  misc_feature (354)..(354): n is a, c, g, or t
  misc_feature (362)..(363): n is a, c, g, or t
  misc_feature (366)..(366): n is a, c, g, or t
  misc_feature (370)..(370): n is a, c, g, or t
  misc_feature (377)..(377): n is a, c, g, or t
  misc_feature (390)..(390): n is a, c, g, or t
  misc_feature (393)..(393): n is a, c, g, or t
  misc_feature (398)..(398): n is a, c, g, or t
  misc_feature (403)..(403): n is a, c, g, or t
  misc_feature (405)..(405): n is a, c, g, or t
  misc_feature (414)..(414): n is a, c, g, or t
  misc_feature (428)..(428): n is a, c, g, or t
  misc_feature (450)..(450): n is a, c, g, or t
  misc_feature (490)..(490): n is a, c, g, or t
  misc_feature (513)..(513): n is a, c, g, or t
cagttccagccaattgccttgaatggccgaatccaggtcctgagtaatggctcactcttgatcaagcatgttgtagaagaagacagtggctactacctctgcaaggtcagcaacgatgtgggcgcagacgtcagcaagtccatgtacctcacagtgaaaattcctgccatgataacctcttaccccaacaccaccctggccactcagggtcaaaggaaggaaatgagctgcacagcccatggggagaagcccatcattgtccgctgggagaaagaggacaggatcatnnncncnnnnntnncccncnnnntnntntccnccnnnnnnntnngaganganntnanatntacnctncagatttnnccnacantgagagnagattccggtttnttntcctnccatncnatcaattcntacggggaggaccntggaataattcaactcacagtncaagaacccccagatcctcccgagattgagatcaaagatntcaaagctcgcaccatcacgctnaggtggaccatggggtttgatggcaacagccccatcacaggctatgacattg

SEQ ID NO: 1460 - DNA, 563 bp, Mus musculus
  misc_feature (160)..(160): n is a, c, g, or t
  misc_feature (328)..(328): n is a, c, g, or t
aggctgaagcagacaagccctcggcctgctttccatggtgcggttgtagcttctcttctacttgaagctcacctgggcccagctcaggaaagagccagagaagtcgcctcttccaggctaacaagccagagcttgctgcctcattcctgtccatttctanttcccccaagtactgtatcacttgtggtaccctaagatgccccaccccgtgcctttctagtccctaaaagtcaaacagtggaagatgctaagatggtgttcctgcagactgcagtgttagagccttagttacaccacatgaagcctataattacactgagttcaccgnggtgattgctgacagctgccccttgtcaacatgcagtctttccctttttggggtgtaaatgattaaatacagtcttccctgtttatttggtgcaatgaagtatggcaggtgacatggggaaggggtaaattattacctttaacaagattgatttttaaatgtttttgtacatttggaattgttaccttggttttgctgcaacagaacttaccttgagactatctgatgttggctt

SEQ ID NO: 1461 - DNA, 542 bp, Mus musculus
  misc_feature (53)..(53): n is a, c, g, or t
  misc_feature (57)..(57): n is a, c, g, or t
  misc_feature (59)..(60): n is a, c, g, or t
  misc_feature (461)..(461): n is a, c, g, or t
gtggagccagctgaccctaaggataaggaggtgcagaaagtggtaaagtttgntgtntnngaacctacaatgatatggacaatgacctgtatcttagcaagccaatacgactgatgagcgccagccagcaggttgtggctgggaagaactactacttgaaaattgagctaggccgaaccacatgtaccaaaactgagtctaatttggttgattgtcccttcaatgaacagccagatcagcagaagagggtcatctgtaatttccagatcaacgttgcaccttggctgaacaagatgtccatgacaaacttcaactgttacaatttctgaggatatatgtcaggctacacttctgctgattgtctcttacttttactcaatcttatccttaagttctcctttcctcagacagagatcttagtcccaaaggttgtctcttgagaatgatagcaccaagagaanaagtagagataggccctgcacacctaagtgacagttcccttgttcctttcatctacttgtttttcaaaggcccactgttca

SEQ ID NO: 1462 - DNA, 229 bp, Mus musculus
gtttgctggaaattatgacttagttttcctgcattgtgaggtttacctgtgtgactccactactgaacagtgtcaaccatcttgctctacaaatcgacttcgcagtagtagaccagccattgactataatcgggttctggatttaggacccatcactaaaagaagtgctcagagttctgctacctcgaaggggactccccacactacagggttcttgttggcctggccc

SEQ ID NO: 1463 - DNA, 432 bp, Mus musculus
  misc_feature (208)..(208): n is a, c, g, or t
  misc_feature (320)..(320): n is a, c, g, or t
gtcatcggactggtggctttgtatctggtgttcggttatggagcctctctcctctgcaacctgataggtttcggatacccagcctacatctcaatgaaagccatcgagagtcccaacaaagatgatgacacccagtggctgacgtactgggtggtatatggtgtgttcagcattgccgaattcttctccgatctcttcctgtcctggntccccttctactacatgctgaagtgtggcttcctgctgtggtgcatggcccccagcccggctaatggggctgagatgctctacaggcgaatcatccgtcctatcttcctcangcacgagtcccaggtagacagtgtggtgaaggacgtgaaggacaaagccaaagagactgcagatgccatcagcaaagaagtcaagaaagctacagtgaacttgctgggcgat

SEQ ID NO: 1464 - DNA, 459 bp, Mus musculus
  misc_feature (130)..(130): n is a, c, g, or t
  misc_feature (164)..(164): n is a, c, g, or t
  misc_feature (214)..(214): n is a, c, g, or t
  misc_feature (341)..(341): n is a, c, g, or t
  misc_feature (406)..(406): n is a, c, g, or t
gaagcccatccaggtatgccaagtggcttcctaaagggaaacaggaagagtctggggtttccaccctcagccctgaatccagagaccatcagggaacgtgcagggcaagacaggcccggcccacactaantgcaggctgtagcccagtgggagctcagccaggntagagcctgactccttcattctctagtgatgtttgaccacaacaagatantagcgggattttcacaccccccccaaaggatatcccaagcaagggattgtccactgtccaccctagccaggtatggactgacaacttctcccctaaagtgaaaagcagggccctcaagccctatganccccacatgtgcagcctgcctccttcttgctggtcagaggtgctggaccaatgctcagactccancctctttcacgccacattgaagttaggggcatcaccgattcttccaggattgg

SEQ ID NO: 1465 - DNA, 502 bp, Mus musculus
  misc_feature (247)..(247): n is a, c, g, or t
  misc_feature (322)..(322): n is a, c, g, or t
  misc_feature (333)..(333): n is a, c, g, or t
  misc_feature (475)..(475): n is a, c, g, or t
gaaggttatcatctgccatcgaggcacccgttcaccctcccccagtgacccggattatggtctccctcctcttgcagggcactctctttcctggactgatgaaaaacagctcaaagaacaaaatatcatccgtacagctaaagtgtggaccccagaggaccccagaaaactcaacagtaaatctttcgacaacatagagaacgaaccaccctttgagtttgtgtcctgagacagctcacatcgggtnggccgcgtctttgtgcatattgtacgtgtaaataaatacctataatgtaaatgtaatttaaagaccacatttttntaatggcaatncaactgtttgttatttatctatttattattctgtcgagttaatgaaatagattgtcttttaaaatatataatttatataatttatcgtgatgttctataatatgatttcctgaagcacctttgacagaagaactggaagaantctgtccaggaaactccgtgcttattt

SEQ ID NO: 1466 - DNA, 341 bp, Mus musculus
aggtggccccacttttgttgagaatggctctatttttgtgcctctgagagagctgctggaaactagactgtatgttgctgctcacatctttcctcctattgtggttctccacagctggaaggtgtgttcttccctgtgaatggcactggagaaaacaatcaactatcatacttgatttgtgaacagagacttctggagtccacatctcatgctgagtcacttccctcttcctcccaacttcacactctgtggtctgtgctaatgggccctgtacaaggtctgaattctatgtctacagacttgcctagtatgtcaacatactaggtatgtttcaggtaaac

SEQ ID NO: 1467 - DNA, 328 bp, Mus musculus
aatactctgggtgtctgcaagtacacggtccaggatgagagtcattcagaatgggtgtcttgtgtccgcttctccccgaacagcagcaaccctatcatcgtctcctgcggatgggacaagctggtcaaggtgtggaatctggctaactgcaagctaaagaccaaccacattggccacactggctacctgaacacagtgactgtctctccagatggatccctctgtgcttctggaggcaaggatggccaggctatgctgtgggatctcaatgaaggcaagcacctctacactttagatggtggggacatcatcaatgccttgtgcttca

SEQ ID NO: 1468 - DNA, 432 bp, Mus musculus
  misc_feature (256)..(256): n is a, c, g, or t
  misc_feature (261)..(261): n is a, c, g, or t
  misc_feature (289)..(289): n is a, c, g, or t
  misc_feature (373)..(373): n is a, c, g, or t
gacacatgtcacttaacacgtccaataaaccaaacccatcaggggtcccctgggatgctcaccccctggaggggtctcattttgatttggcaaggactagtgagagtccaacagaactgaagatagacatttctcagcctcctgatgtcaactctgaactctggacaacggggccgggccatcagagacctgctctccaagaaaacagcaaggagtcttataaaaatgttgcagatttggactccttccagagtgnagtcntcatctccccaggactccaatcagcgtnggcccccagccacagacactcacaacagaagcaaaactaagtcttccgatggcggctggacacggtggcgatgctggagacggngctgaagaaaacattctttacctctgattgtgtggccatttgttttcccaagcaaacaa

SEQ ID NO: 1469 - DNA, 454 bp, Mus musculus
atgtgtgtgctttacagacctttcctcttgggcccaggtatcatatacactgtgtcatctgaaaatggaccgtgtcgcctttggaaagatacatgtcttcctgtgtctttccacctgaaatcagctacatatatgcctccttttacacattcagaagtacctctaactaaagactatgatttgtgcatgagtgtgctataactaccttgtacatggaaagatttctcattctgtttctagttttatttaaagtagcccttctctaacaataatagtttcttgctaaaaatcagtataacttataaatggtctcaaatgtttgtgtaagttacgcattgttattgatttcattcttatgtaacagaaaaataagctgagttgtgttcatggaaaggactcccttagaagaatgagaaaacacaatcatgaaatactgatttgttgcctaggtaca

SEQ ID NO: 1470 - DNA, 555 bp, Mus musculus
  misc_feature (485)..(485): n is a, c, g, or t
ttatcagttaggatcactggctgctcttccagagtatctgggttcaattcctaatacccacatagctgctcacaactgtatgtaacttcagtctcaggtgatccaacaccatcttctggcctgtgccgaaactacctgcacatggtacacagacatacatgcatacgtgcaagcaaaatacaaatacaataatagtaagataaaaatctttttaaattgggaagactatcttcatgttttactttcagaatttgaaacagttatatttgtatttgataacgtctacgtcagtgttgagggattttcttgctggatttataccaccatgtataccaagtgcagcaatgcaagtataactgcagcaatgcaagtagagccatctctgaacacctaattctgagaccctttctcagcggcttctgggctaggcttataattccttacaccaagatgtaatcttttgttgcatgtggtgccactggccntttagttcccacttaggaggcagaggcaggcagaatttaaagctaacctgtgtgcgtagcaagttctaga

SEQ ID NO: 1471 - DNA, 510 bp, Mus musculus
  misc_feature (439)..(439): n is a, c, g, or t
tatctgaagcatgacctgtgctccgcagcccaggagaacgtcggtgtgattgtggagatgattcatttcaaggatctcctgctgcatgagccctatgtggaccttgtgaacctgctgctgacctgcggggaagatgtgaaggaggcagtcacccgcagcgtccaggctcagtgtgaacagagctggggaggcctctgctccatcctgagtttctgcacctccaatcatacagagacctcccacggcagccccagagcatcagcccctggcagacagggctcagctctccaggcctcaccaccgggacacagaccatcacctaacagccaacagaggtgccaagggtgagcgagggagcaaaagccacccgaatgcccatgctcgaggcagaaccggtggccagagcgctcagggaccctctggaagcagtgagtgggangatgaacagtctgagtattccgacatccggaggtgaaatgaaaaccgggccatgaaagctttcctccaggc

SEQ ID NO: 1472 - DNA, 471 bp, Mus musculus
gtggacatagagatgccggagcccccacatacatgtatgagtttcaatatagtccaagcttctcgtcagaaatgaaaccagatacggtggtaggagaccatggagatgaaatctactctgtctttggggccccaattttaagaggtggtacctcagaagaggagatcaacctcagcaagatgatgatgaaattctgggccaactttgctaggaatgggaatcccaatggacaagggctgccccattggccagagtatgaccaaaaggaaggttatctgcagattggagccaccacccaacaagcccagaagctgaaagaaaaagaagtggctttctggactgaacttctggctaagaagcaactgccgacagaacacactgagctgtgaatgggagactctgtcagcctcaccctcaggggagcccaaatgagactactttacatggaagatgattgtggccaaggctttg

SEQ ID NO: 1473 - DNA, 536 bp, Mus musculus
  misc_feature (231)..(231): n is a, c, g, or t
  misc_feature (278)..(278): n is a, c, g, or t
  misc_feature (411)..(411): n is a, c, g, or t
  misc_feature (469)..(469): n is a, c, g, or t
  misc_feature (510)..(510): n is a, c, g, or t
caccctttcctaacacttgtatttgttgaatttggcctccttaagagcaatagcaaataagtagtcaagtggcctaccaagttttaacgtacctgactccatctgtggcatttgtaccaaatataagttgaatgcatttattttagacacaaagctttattttttttgacattgtgtttcaagaaaaaaaatagaataacaataactacaactttgaggccaatcattttnaggtgtgtgtttgaagcatagaacgtctcttaaactctcaatggttncttcaaatgataagttagtatgtaacctaagtatagcagtttctctcttttttatttttttccatatagagcactatgtaaagttagtatatcaataatacaggaaatatcaaacagtatgtaaaactctgtngttgttgttttttagtacaatggtgctattttgtagtttgttatatgaaagaatctantcaacacagtaaaaggagaaagcaaagcaaaaacaacaaangaaagcctggagcctaagatgacaaa

SEQ ID NO: 1474 - DNA, 355 bp, Mus musculus
gttatgacacctaaatcctggtttcaagcagatctggtctgccagaagagaccctcaggacatctcgtgtctattcttagtggaggtgaggcttcctttgtgtcctccttggtgaacggcagagtggacaactaccaagacatctggattgggctccatgatccaacaatgggtcaacaacccaatggaggtggatgggagtggagtaactccgatgtgctgaattatcttaactgggatggggatccttcctctactgtcaaccgtggtcactgtgggagtctgacagcaagttcagggtttctgaagtggggagactattactgcgatgggacattaccatttgtctgcaagt

SEQ ID NO: 1475 - DNA, 456 bp, Mus musculus
  misc_feature (110)..(110): n is a, c, g, or t
  misc_feature (146)..(158): n is a, c, g, or t
  misc_feature (245)..(245): n is a, c, g, or t
  misc_feature (250)..(250): n is a, c, g, or t
  misc_feature (269)..(269): n is a, c, g, or t
  misc_feature (290)..(290): n is a, c, g, or t
  misc_feature (305)..(305): n is a, c, g, or t
  misc_feature (310)..(310): n is a, c, g, or t
  misc_feature (332)..(332): n is a, c, g, or t
  misc_feature (342)..(342): n is a, c, g, or t
  misc_feature (362)..(362): n is a, c, g, or t
  misc_feature (369)..(369): n is a, c, g, or t
  misc_feature (389)..(389): n is a, c, g, or t
attccacttggccttatgctgttgaaatatttaagtaatttatgtatttattaatttatttctgcatttcacatttgtataccaagatgtattgaatatttcatgtgctngtggcctgatccactgggaccaggccctattatgcnnnnnnnnnnnnngttatcttcttcaacagctcttcaatcagggctgcgtaggtacattagcttttgtgacaaccaataagaacataatattctgacacnagcantgttacatatttgtgaccngtaaagacataggtggtattnggagacatgaagaanctgtnaagttgactctgaagagtttancactagtttnaacaccaagaaagacttttnagaagtnatattgataagaaaccaggnccttctttagaagggtacctaaatttaaaagaattttgaaaggctgggtatcggtggtatatgcttt

SEQ ID NO: 1476 - DNA, 390 bp, Mus musculus
atccagtgtatgctgtccagtggcatcctgagaaagcaccatttgagtggaagaatctgggcggcatttctcatgcaccaaatgctgtgaagacttcattctacttagcagaatttttagtttctgaagctcggaagaacagtcaccactttgagaacgtggttaaggagacggcatccttgatttacaaggtctatcccatttatactggaaatatttcttcatttcagcaagcttatatgtttgactgaaattcttcaatatggtaacccagcagctttgagtaattctgtgattgaattgctaacacagctcagggcagtgtgagaaagccacacagatatctttgctgtgtgcctggttctgattcctggcttaatacatgattgt

SEQ ID NO: 1477 - DNA, 494 bp, Mus musculus
tggtggatgagaagcccttcctgcagtgcacccgcagcattgagacagggaagaccaactacaacacttgctatactgcaggcgtgtgcctcctcaaggccaggcagaaaatcgccgtgaagatggtgcacgctgacatctctatcaatatgagcaagcacaccaccttcttcggggccatcaggctgggcgaagcccctgcatcctagattctcccattccatcctggcccatgcccctgccccaggtttgggagccaggactcccagaacctctaaggtgcttgctgtgtgtaggaattgaggtatactggcgttgcagccacaaagagaaatgccccatgctatttattccccagtgactccaggatgacaaggcctatgtgacttcccagaaagaccttgagttgccaggacagttgacggagccccagggttgtcaagaagcagaaccttcttaggctccctgctgactggcttatggtgactcctcaa

SEQ ID NO: 1478 - DNA, 462 bp, Mus musculus
  misc_feature (155)..(155): n is a, c, g, or t
  misc_feature (157)..(157): n is a, c, g, or t
  misc_feature (159)..(159): n is a, c, g, or t
  misc_feature (346)..(346): n is a, c, g, or t
aagtaccttcggcagctgtttcaaaggcatgtggctataccactggcaaaatggctgcccttcctctctgtggaccaactagaaaggaccagttctatatctccatccacaggagaacatgagctctctgctggcttctgattcagaccataggngncnaccaaggaaggtctaagaagagaatgaggagacagtatatagctctccaagactgatactgacagttcttacagtcaggattcccaatcttttagggtcaaaggaaacttagaggtagcttaggtataagtcacctctttaattgtttccttgaacttctctctgttagaaaggagatgaataaacnaaatggggcattccagaaactggaataaaggtgacaatgagtggcatgggcccaataagagataggatctgtggttattaatttaaaaacaaagccactacttttactgaattcaa

SEQ ID NO: 1479 - DNA, 173 bp, Mus musculus
gtcattttgtttataatcagtggcttttgttgaattggcttgggttttagattttagcccgtgctgtgctggaattcactatgaagcagaggctgaactggaatttgaggccttatggctctgtcccaagcgctcctccctcaatactggactttttactatgaattttcagg

SEQ ID NO: 1480 - DNA, 510 bp, Mus musculus
  misc_feature (120)..(121): n is a, c, g, or t
  misc_feature (382)..(382): n is a, c, g, or t
  misc_feature (392)..(394): n is a, c, g, or t
  misc_feature (396)..(396): n is a, c, g, or t
  misc_feature (399)..(401): n is a, c, g, or t
  misc_feature (418)..(418): n is a, c, g, or t
gagaggttcagatctctgctccctacccttggatgagggctcctgtactgcctataccctgcgctggtaccatcgagctgtgcctggtggcacagcctgtcatccctttgtctatggtgnntgcggagggaatgccaatcgttttggaacccgtgaggcgtgtgagcgccgctgcccaccccaaggggtccacagccagaaaacaggtgctgcctagggctgaggcccggatgatgcgcttggtggccagcagtccctggaggtggcagggtctcagccgggtcctgctgtgctccatttggtgctagagttgtgtgtgcacgtgagcatgtatattgtgtgtgcacatgagcatgtccactatttcagtgacttggtcctntgggtctaannngnggnnngggacccccatggacanatccccattgtggcgcccgctttcctggcagatgactcactgttgggggtggctgtgggcagtgaatggatgtgactggtgtccaacctgcc

SEQ ID NO: 1481 - DNA, 496 bp, Mus musculus
  misc_feature (35)..(35): n is a, c, g, or t
ccagcaccaggttctctttgaagaaactggagaanttgttctcataaatgtattcgttcccaccagcagggactgggagagggagctatgttgttaaaacgaatcagtgaacttaaagaaaagtcctcattatggtgcccccaccacagaatggcacccttagaggctggctcctcaagttttggtgccccagccctgaagcagggccagctacttggaattaggtgaactacccccacgtggcagaccaccagcagcagtgactttgacttctggtcttaaagcaacccccattcagctcaaaaagcgattggtggatttcagatcttttgtgtttttctcctctggttgttttgtttgtttttctttcactgtttgaagttctgtctgttgtttgttccattcccatagttctctctgcatttcctttttaaacatttgcatttgctgggcaattgcgtatttttttaattccctttcccctatgtaaagctga

SEQ ID NO: 1482 - DNA, 576 bp, Mus musculus
  misc_feature (185)..(185): n is a, c, g, or t
  misc_feature (311)..(311): n is a, c, g, or t
  misc_feature (424)..(424): n is a, c, g, or t
  misc_feature (431)..(431): n is a, c, g, or t
  misc_feature (446)..(446): n is a, c, g, or t
  misc_feature (494)..(494): n is a, c, g, or t
tagccgccttggagagccgactggatgtcctgggtgcctccctgcaggctctaccaggccttatagcccaagccatatgccctctaccaccgccctggcctgggcctggtcacctggccacagccacccacagcccacaaagccactggctgcccaccatgggatcagactgtgggtgatggctnctgaccgctagactgctccatctcagccatcgtgtggccacagctagctccttgccgttttggacctccggactactgcatttagaagcttgggtgaactgagccgactggactggcactcatccntctgaggctgggccacaggatccaggtccccttagctgtcccaggccccaggagggcaaggagtagtagcaggggcctcaacatttctaagtaaatcaggagcttccagcccnctttctnttgacatgcaggggnctgcaaacatctccccagaggaggtagatgaccccacctggggattcnttaatggacggggacagacgtggaaagtcactgcacatgcattgagtatctactgtatacagggactgaaacaatggctttt

SEQ ID NO: 1483 - DNA, 470 bp, Mus musculus
  misc_feature (122)..(122): n is a, c, g, or t
  misc_feature (336)..(336): n is a, c, g, or t
  misc_feature (378)..(378): n is a, c, g, or t
  misc_feature (382)..(383): n is a, c, g, or t
  misc_feature (388)..(388): n is a, c, g, or t
  misc_feature (391)..(391): n is a, c, g, or t
  misc_feature (397)..(397): n is a, c, g, or t
  misc_feature (400)..(400): n is a, c, g, or t
  misc_feature (410)..(410): n is a, c, g, or t
ggtataaaagtgtgtgtccccaagtcaaaacagcctctcacactcacgccaccttcctccagcagtcagatctggaggacaccaacgttcctggctcctcttccacagtatgcaatagtggnttctcaaagccaatgggaggaaagcacgctcttaccctcaatgccaaacagctggcactgggtacctaggttcaggccagaagccagccagggaaagctctggctacagaagtctgatgggaaagctggccagaaaagttggtctgtcccgcgctgtttctggaacaccgtggttataggcaaggctattgctgtgactttgaattaaagttgngtctctctctgtggagcctcgccaacactgccctcagctcantttnnttagntcntccccntcntgctgtggcntccaccttgccgtgccagcttcagtcactggagatgatgtttgtagacctggagaacctc

SEQ ID NO: 1484 - DNA, 189 bp, Mus musculus
gctgctgaccaagttccagaactctgaaaggaaaaaagcctggcgctgagacggagctggagataaggccagaccacagacaccacacccagcaatggatacaggacatcacacccagcaatggatacaggacatcacacccagcaatggatacaggaccttggagaaattaggagttgtaagcaggac

SEQ ID NO: 1485 - DNA, 478 bp, Mus musculus
actaggcataatggccaccttgccaccaacagccaacccttcccagcaacctctaaacctagaggatgaagatggaatcctggatgaatatgatcagtacagcctggcccatccctgtgtcgtcgggggaggtcggaaaggtcggaccaagagagaagctgctgccaataccaaccgccctagccctggcgggcatgagaggaagctgctgaccaagttccagaactctgaaaggaaaaaagcctggcgctgagacggagctggagataaggccagaccacagacaccacacccagcaatggatacaggacatcacacccagcaatggatacaggacatcacacccagcaatggatacaggaccttggagaaattaggagttgtaagcaggacctaggcctgcttgattctttcccacctaagtgaggttctggagagggagcccttccacccttccagacccagcaaaagggcaaga

SEQ ID NO: 1486 - DNA, 430 bp, Mus musculus
  misc_feature (389)..(389): n is a, c, g, or t
  misc_feature (400)..(400): n is a, c, g, or t
gttcctctcagtcccaagatttacagacctcatccatggctgagatcttccagcatctgaatgcctaccgccaggaggctcacaaccgcatctccagccacgttcccttgatcatccagtatttcatcctgaaaatgtttgctgagcggctgcagaagggcatgctccagctcctgcaggacaaggattcctgcagctggctcctgaaggagcagagtgacacaagcgagaagaggaagttcctgaaggagaggctggcaaggctggcccaggctcggcgccggctagccaaattccctggttaagctggctctgtccttccctgtgtttcctggattgtgattcagggacagaagggctcctgcctttcctggtagctataccaccancctttatgctnctgataagtgctagcactcagatttgaagg

SEQ ID NO: 1487 - DNA, 395 bp, Mus musculus
  misc_feature (333)..(333): n is a, c, g, or t
gtgcgtctgggtgatcatagcctccagagcagagatcagccggagcaggagatccaggtggctcagtctatccagcatccttgctacaacaacagcaacccagaagatcacagtcacgatataatgctcattcgactgcagaactcagcaaacctcggggacaaggtgaagccggtccaactggccaatctgtgtcccaaagttggccagaagtgcatcatatcaggctggggcactgtcaccagccctcaagagaactttccaaacaccctcaactgtgcggaagtgaaaatctattcccagaacaagtgtgagagagcctatccagggaanatcaccgagggcatggtctgtgctggcagcagcaatggagctgacacgtgccagggtgactc

SEQ ID NO: 1488 - DNA, 529 bp, Mus musculus
aagtcctctgtccagttttacagcaagctgatcagcagcagtggcctccccgctgagaacagaagtcctgcgtgtggtcagcctgcggaagacacagactgcaccatttgctcatttctcgtggagaagaaaccactcatcttcttcggttgctgcttcatctccactctggctgtactgctatccatcaccgtttttcatcatcaaaagagaagaaaattccagaaagcaaggaacttacaaaatataccattgaagaaaggccacagcagagttttcagctaaactgccatttctgtcatagtttcaagattcactccggctccatgtactggtaacttacgatgtgagagacagctgtaaccaaggtgaagacaatcgatgcctctgaagtgtggttcaaataattccttcaggtcccgacaatcagtgagtccgttctccgagctgaagacaccctgacagtaactctgggcgtgaccctaaacatcgcttcaggaagtgtgaatcacgacttcacatccttttt

SEQ ID NO: 1489 - DNA, 534 bp, Mus musculus
cacggacctgtgaatggaactcatgggctctttgctggaacctcacttcagaccctggaagcctcagacatctcgcccggagctttcaacaaaggctccctggcattcaacctccagggtggacttcctccttctccaagccttgctcctgatggacacacacccttccctccttcacctgccttgcccaccacccatggatctccaccccagctccaccccctgtttcctgacccttccaccaccatgcctaactctaccgcccctcatccagtcacaatgtaccctcatcccaggaatttgtctcaggaaacatagcgcgggcactggcccagtgagcgtctgcagcttctctcggggacaagcttccccaggaaggctgagaggcagctgcatctgctccagatgttctgctttcacctaaaaggccctggggaagggatacacagcactggagattgtaaaattttaggagctatttttttttaacctatcagcaatattcatcagagcagctagcgatctttggtctat

SEQ ID NO: 1490 - DNA, 441 bp, Mus musculus
gggaaacaccattgctttatcagattattttggtatgtatgggtctctggcaatacatgaatattccagcgtgtctgaggtgaagagccaaaataaggaagactcaagttcatcagatgaaagacccatagaacatcttaaaatttgtgatcttcacttgcaaacaaaagaaaggctggttgatggagagtttaaagtatacaggaaaagttccggaaataattgtatatgctatggaatttgggatgatacaggagcaatgaaagtggtggtatctggacaactgaccagtgtcaactgtgagattggtaatacaattagacttgtctgctttgaattgacctcaaatgcagatgagtggtttctgagagctacgaggtacagttacatggaggtcatcatgcctgaaaaatgaaaaacagtgagtgatgtaaccccaat

SEQ ID NO: 1491 - DNA, 400 bp, Mus musculus
tgcctgtgttcagtcgcccaggtgactgggtagccattcgctggcagctggcaccagctcaggctgctctgctacaggcagcaggactgggcctcctggtggcctgtgtcttcatgctgctgccagcactggtgctgtggggtgtacagggtgactgcagcctgctagaagccatctacttctgtttcggctcactcagcacgatcggcctaggagacttgctgcctgcccatggacgtggcctgcacccagccatttaccaccttgggcagtttgcacttcttggttacttgctcctggggctcctggccatgttgttagcagtagagaccttctcagagctgcctcaggtccgtgccatggtgaaattctttgggcccagtggctctagaaccgatga

SEQ ID NO: 1492 - DNA, 349 bp, Mus musculus
  misc_feature (124)..(124): n is a, c, g, or t
  misc_feature (262)..(262): n is a, c, g, or t
  misc_feature (271)..(271): n is a, c, g, or t
ggaccttcgcggcaaatatgtcaccctcatctacaccaactatgagaatggtaagaatgactacgtgaaggccctgcctgggcatctgaagccttttgagaccctgctgtcccagaaccagggnaggcaaagctttcatcgtgggtgaccagatctcctttgccgattacaacttgctggacctgctgctgatccaccaagtcctggcccctggctgcctggacaacttccccctgctctctgcctatgtggctcgcctcangtgcccggncccaagatcaaggcctttctgtcctccccggaacatgtgaaccgtcccatcaatggcaatggcaaacagtagtggact

SEQ ID NO: 1493 - DNA, 422 bp, Mus musculus
  misc_feature (301)..(301): n is a, c, g, or t
aaaagtgtttcaccagctggatgtagcgtacccctgggatcccagctctgggggatttgtcattgaatagtagctagggctacataaggcactggctcaaaaacaacaatagaaaccatttttgctcaatttgcatatatatagattactctatgagcagtgctttgcttctgcttaggtgatacagctcgagtcttgattttctattttctgtaacaaacaagatttgaaatgattttagaaattagacaatgaccccacttcctatctcttctggtggttttctcttttcttcttcttncttccctaaagcagcattattgagtgcttttgcatcctggaagatctggagacattgatttaaaatagttgaatgcagttgtattaatacagtatacaaatgctacctggaagagttcttt

SEQ ID NO: 1494 - DNA, 498 bp, Mus musculus
agagacaccacagcatgctccagttccaggtcccctcgtcctccctggccaggatcttccagctgctcatttcccacaaggacagcctgctcatcgaggagtactcagtcacccagaccacgctggaccaggtgtttgtaaacttcgctaaacagcagactgagacctatgacctccctctgcacccccgggctgctggagccagctggcaagccaagcttgaagagaaatccggacggctgcagacacaggagcctttgcccgcaggatctgaacaactggctaacggaagcaaccccacggcagcagaagataagcacaccaggagtccacagtgagctggaggagactctttcagaaagaaaccaaaattcactggctcaccggaactcctgatggcaaaactgacctatcagaatggtcacctgtttatccagaacccctgactggtggctttggccttagcgatactttcattctgagtggatctgcttttgt

SEQ ID NO: 1495 - DNA, 424 bp, Mus musculus
  misc_feature (356)..(356): n is a, c, g, or t
aactgacggccgacgacgggcagccgtgtttccgcgcggcgggcggtggcaagagcgcggtccccgccgccgacggccgtcagccgcgctccatctgcaccttctgtctcagcaaccagcgcaaggggggcagccgtcgtgacctggggggcagctgcttgaaagtgaggggtgtagccccgctccgagggcctcggcgatgaacctggatccctggttttctccaagaaggactccagagaaagaggccatgagccagcccctagctggacagaggagaagattccagaagcccaaaccactcctgcgttgtgtaaggaccggaggacaatggcctgggcacagggctcaccctnggagagccacaaggacccatctagccatccaggcctagctggccagggacaaggcagaaattttagaa

SEQ ID NO: 1496 - DNA, 510 bp, Mus musculus
  misc_feature (369)..(369): n is a, c, g, or t
  misc_feature (396)..(396): n is a, c, g, or t
  misc_feature (401)..(401): n is a, c, g, or t
  misc_feature (405)..(405): n is a, c, g, or t
  misc_feature (423)..(423): n is a, c, g, or t
ttgctgcccttgtgtatttctacattggccaggcaagtccaggcctttacctcggatcagcatcaaacttcagctttttccaatggatgaagtccttcttggtcccctcctgcaggagcctgaggtccgcccaggagcaaatcatcttggcgccatcaccagccaaggttgacatggcaatgactcagcttacccaggacaatgcagacttcgccacccgagatcgttaccaccactcctccttcctgagccgggagcagttgatgcctccctactaggacctcgctggaccccacctttctagaagccgctgtggagatgggggacccaagcctcagaacctttggaagttgcttctaccaataaganaacccaagactggtcttcccaccacanccttngacnctggaaatcacattccgntctgaaatggcatgtctagccagatactaggtatgactatggcttccacgtgtgcccaacctgaagagtccacaggcaccaggatga

SEQ ID NO: 1497 - DNA, 585 bp, Mus musculus
  misc_feature (363)..(363): n is a, c, g, or t
  misc_feature (365)..(365): n is a, c, g, or t
  misc_feature (383)..(383): n is a, c, g, or t
  misc_feature (395)..(396): n is a, c, g, or t
  misc_feature (435)..(435): n is a, c, g, or t
  misc_feature (439)..(439): n is a, c, g, or t
  misc_feature (496)..(496): n is a, c, g, or t
  misc_feature (544)..(544): n is a, c, g, or t
aatgtgtccgacttcccggagaggaactttgttggggcgacagccatgaataccgggtgtgccagctgccggactgccctccagggaccacaccattccgagacctgcagtgttctctctacaatggccaccctgtcctggacacccagaaaacctaccagtgggtgcccttccacggggcgcccaatgtgtgtgacctcaactgcctagctgaaggccacgccttctaccacagctttggccgcgtgctggatggcaccccctgcaccccgggtacccagggtctctgcgtggcaggccgctgtctgagcgcaggctgtgacgggatactgggctccggcaccctcgaggaccgctgcggcntntgtggtggcgctaacgantcttgcctgttnntgcagcgcgtgttccgcgacgccggtgactgtcccattntgantcaccaccagcgcttgagaaacacagtggagaggggtgtccctttaacaagtttggntcctgggagccaaggctcttgttgattgggcttcccctgattggcctntgacagagcgtcccaccctccctcgaatagatgcgctttta

SEQ ID NO: 1498 - DNA, 466 bp, Mus musculus
  misc_feature (188)..(188): n is a, c, g, or t
  misc_feature (190)..(197): n is a, c, g, or t
  misc_feature (199)..(200): n is a, c, g, or t
  misc_feature (278)..(278): n is a, c, g, or t
  misc_feature (281)..(281): n is a, c, g, or t
  misc_feature (302)..(302): n is a, c, g, or t
  misc_feature (309)..(309): n is a, c, g, or t
  misc_feature (375)..(375): n is a, c, g, or t
  misc_feature (384)..(384): n is a, c, g, or t
  misc_feature (406)..(406): n is a, c, g, or t
  misc_feature (419)..(419): n is a, c, g, or t
  misc_feature (421)..(421): n is a, c, g, or t
  misc_feature (431)..(431): n is a, c, g, or t
gagtgacatcaattccatctacataaaggagagcctagtgtgtgcagaaatctccaataccaccatcctactgggcgttatagtgggcgtcttgctggctgttatcttcctgctggtttactgtatggtttacctgaagggaacccagaaggctgccaagctccccagaaagggtggggttcaaagcncnnnnnnnnannagcctcatttccaagaaccccaccatgtggagccagtgtggaatcaagagagacagggtacccaatgaaggtgaggcnccnagaccaactggatgggaccancaaaccntgcttcctccaccctatgaccaatcaggacatgacttacactcaccacagaagcagcagcacaacnaaaggtgtnatagtatttctttccacaatgnccaacctgccagntnttctgtgganttctttctagggacagcatctctagggacagcatc

SEQ ID NO: 1499 - DNA, 472 bp, Mus musculus
  misc_feature (59)..(59): n is a, c, g, or t
  misc_feature (69)..(69): n is a, c, g, or t
  misc_feature (72)..(73): n is a, c, g, or t
  misc_feature (144)..(145): n is a, c, g, or t
  misc_feature (334)..(334): n is a, c, g, or t
  misc_feature (336)..(336): n is a, c, g, or t
  misc_feature (344)..(344): n is a, c, g, or t
  misc_feature (369)..(374): n is a, c, g, or t
  misc_feature (376)..(376): n is a, c, g, or t
  misc_feature (378)..(378): n is a, c, g, or t
  misc_feature (403)..(403): n is a, c, g, or t
ctgatgtgccaggtggatgaccactggctactgactggcataatcagctggggagaggnctgcgcggancgnnaccggcccggtgtgtacaccagcctcctagctcaccgctcctgggtgcaaaggatcgttcaaggggtgcanntgcgcgggtacttggcggacagtggggacacaggaagctcctaatctaggatctgaagatgagcagcctcctgcaattctctctgctgtaaatatgtcttctacctccggggggcgcccgcggcctgagcgagagaacaaggaagttctggaaccgcccacatagaggatccgcccctcaatcgaggantntgtgtgtntgtgtgtgtgtgtgtgtgtgtgtgnnnnnncntntgtgtgcgtgtgtatgcgcgcgcangtgcgcgcgagagcaatgatttttttttttacagttatacgtaaccatgcccacatatttattccagtt

SEQ ID NO: 1500 - DNA, 309 bp, Mus musculus
acagaaactttgtcttcctactcttacattctaaaccgatgaaatctttaacagattacactttaaatatctactcatcattttctctctcagagtcctagcttgagttgcactgcatgtatctgtgcatcttgttctcttcatttaatgctgtactgttctgctgagctctgagggactatcttgagagatgtaatggaaggaaagcgtggtgttaatctgcgtactgcttaagacagtatttccataatcaatgatggtttcatagagaaactaagtcctatgaacctgacctcttttatggctaat

SEQ ID NO: 1501 - DNA, 513 bp, Mus musculus
  misc_feature (130)..(130): n is a, c, g, or t
  misc_feature (138)..(138): n is a, c, g, or t
  misc_feature (244)..(244): n is a, c, g, or t
  misc_feature (258)..(258): n is a, c, g, or t
  misc_feature (275)..(275): n is a, c, g, or t
  misc_feature (289)..(289): n is a, c, g, or t
  misc_feature (294)..(294): n is a, c, g, or t
  misc_feature (297)..(297): n is a, c, g, or t
  misc_feature (299)..(299): n is a, c, g, or t
  misc_feature (304)..(304): n is a, c, g, or t
  misc_feature (311)..(311): n is a, c, g, or t
  misc_feature (314)..(314): n is a, c, g, or t
  misc_feature (328)..(328): n is a, c, g, or t
  misc_feature (334)..(334): n is a, c, g, or t
  misc_feature (337)..(337): n is a, c, g, or t
  misc_feature (353)..(353): n is a, c, g, or t
  misc_feature (362)..(362): n is a, c, g, or t
  misc_feature (427)..(427): n is a, c, g, or t
  misc_feature (476)..(476): n is a, c, g, or t
  misc_feature (478)..(478): n is a, c, g, or t
accaagaacagcagtgcaagcaaccctgccagcctcctcctgtgtgtccaccaccaaagtgcccagagccttgttctccctcggtgtgccctgagccttgtcctcctccaaagtgccctgagccttgtcntgagccangtccccctccctcattccagcagaaatgccctcctgtgcaacctcctccaccctgccagcagaagtgcccacccaagagcaagtgaagtcttcagcagtcttcagnacaggggaaagagnaaaagaatctatttcangtcattccatagcnacacnttntnttccntccaaantcngacatggatgcagnagaatnttntctacccttcacctanttccatatntcagtgatgacctctaataagtaatgaatttgcccgagactataatcttgctgctgtaaaggggntctagagaatgggtcttgttccattgttcagtatgacatttttcaaatntntctgtcacttgagcagggtagttgttactgttgtt

SEQ ID NO: 1502 - DNA, 560 bp, Mus musculus
  misc_feature (184)..(184): n is a, c, g, or t
  misc_feature (356)..(356): n is a, c, g, or t
  misc_feature (498)..(498): n is a, c, g, or t
gatcatcagactgtgccgcagggctgtgttgtgcaagacacttctggtccaagatctgtaaacctgtccttaaagaaggtcaggtgtgcaccaagcacaaacggaaaggctcccacgggctggagatattccagcgctgttactgcggggaaggcctggcttgcaggatacagaaagatcaccntcaagccagcaattcttctaggctccacacctgccagagacactaaaccgacagtctaaatatgatggactctttttatctaatatatgctacgaaaatcctttatgatttgtcagctcaatcccaaggatgtaggaatcttcagtgtgtaattaagcattccgacaatacnttccaaaagctctggagtgtaaggactttgtttcttgatggaactcccctgtgattgcagtaaattactgtgttgtaaatcctcagtgtggcacttacctgtaaatgcagcaaaacttttaattatttttctagaggtgtgntacattgccttgtttctcttgcatgtaaattttttttgtacacggttgattgtcttgactca

SEQ ID NO: 1503 - DNA, 272 bp, Mus musculus
aggtccctgtcatgcttctgggcctgctgttcacagttgccggctggagcatccacgtgttggctcagccagatgcagttaacgccccactcacctgctgctactcattcaccagcaagatgatcccaatgagtaggctggagagctacaagaggatcaccagcagcaggtgtcccaaagaagctgtagtttttgtcaccaagctcaagagagaggtctgtgctgaccccaagaaggaatgggtccagacatacattaaaaacctggatcgg

SEQ ID NO: 1504 - DNA, 403 bp, Mus musculus
  misc_feature (64)..(64): n is a, c, g, or t
ctcacatattcttttctggtctcagacatgctatgtggccaaggatgatgacactgggctttcnggttctcttgtattcatatacacaacctatttaaggcagttctcacactgttgccaactcctagcattaagaggtctccaagagtgtgattgcacattgatatttacaggttagtaatgcttggatggatgtgtcacaggatcagttatatgatgcttgggatgggtcccgggcgttgtgcatgttaggcaaatgttctgccgaccgagctatatcccaaaccaaagatttctttaaaaagcagttctttccatgtcaactttctaatccaaattaatattattcaaacattgatttttgccacaatctgataaaaccaactttagatactgcatgtgt

SEQ ID NO: 1505 - DNA, 515 bp, Mus musculus
gacattgccctggttagattgcaaggaccaggggagcaatgtgccagactaagcacccacgttttgccagcctgtttacctctatggagagagaggccacagaaaacagcctccaactgtcacataacaggatggggagacacaggtcgtgcctactcaagaactctacaacaagctgctgtgcctctgttacccaagaggttttgtaaagagaggtacaagggactatttactgggagaatgctctgtgctgggaacctccaagaagacaaccgtgtggacagctgccagggagacagtggaggaccactcatgtgtgaaaagcctgatgagtcctgggttgtgtatggggtgacttcctgggggtatggatgtggagtcaaagacactcctggagtttataccagagtccccgcctttgtaccttggataaaaagtgtcaccagtctgtaacttatggaaagctcaagaaaatagtaaaacagtaaccattcagtcttcatacttggcaccat

SEQ ID NO: 1506 - DNA, 240 bp, Mus musculus
agacagtgggacctaccagtgctgtgccagaagccagaaaccagaaatctacattcatggccactttctctccgttctagtcacagggaaccacacagagataagacagagacaaaggtcacaccctgacttcagccatatcaacggcactctcagttcaggcttcctgcaagtaaaggcttgggggatgttggtcaccagcctggtggcccttcaagctctatataccttgtgacagag

SEQ ID NO: 1507 - DNA, 532 bp, Mus musculus
  misc_feature (82)..(82): n is a, c, g, or t
  misc_feature (103)..(103): n is a, c, g, or t
  misc_feature (117)..(117): n is a, c, g, or t
  misc_feature (183)..(183): n is a, c, g, or t
  misc_feature (200)..(200): n is a, c, g, or t
  misc_feature (205)..(205): n is a, c, g, or t
  misc_feature (328)..(328): n is a, c, g, or t
  misc_feature (333)..(333): n is a, c, g, or t
  misc_feature (349)..(349): n is a, c, g, or t
  misc_feature (351)..(351): n is a, c, g, or t
  misc_feature (354)..(354): n is a, c, g, or t
  misc_feature (371)..(371): n is a, c, g, or t
  misc_feature (373)..(373): n is a, c, g, or t
  misc_feature (377)..(377): n is a, c, g, or t
  misc_feature (403)..(403): n is a, c, g, or t
  misc_feature (432)..(432): n is a, c, g, or t
  misc_feature (444)..(444): n is a, c, g, or t
  misc_feature (458)..(458): n is a, c, g, or t
acctgaagggcacgatcctcttcaacccagatgtgccaggcctccgtgcctcctgccacatcgcacacctgcaacaggaggnctcactgggcactgtgtgaangtcttggagccctnggtacccagccagccaaggccgcctggcccgaatcctcctcatggcctctaccctcaagaacattnccaggcacccttctggntagantctcttcttccgccctatcatgggagacgttgacatcactgaactccttgaagacatgcttttgctgaggtgacccgtggaatggagtctggtgcctccaaaggggagcctgaaaggcagccntcaantcccctggagctgccntnagntcagccacacccctagntngganttccttgctttggatacagtgtacantactaactgtccagcaagcccttgatgantccccaaacctncaggccaaaatgtntttccctgcctgggtagggatgggagcaggaagctgtactttcaagccagaatccctcctgactttgtacagaa

SEQ ID NO: 1508 - DNA, 291 bp, Mus musculus
  misc_feature (40)..(40): n is a, c, g, or t
  misc_feature (51)..(51): n is a, c, g, or t
  misc_feature (53)..(55): n is a, c, g, or t
  misc_feature (57)..(57): n is a, c, g, or t
gccggttctgagagtaacgcatccagagggtcaaggccgnggcctccaggncnnngncgcggcctccagtcaatctgactgttacagcgcaaatctctctgttctttctgggcccaggcccaatcactgagaagattctctgcacataaatgccttaaagtttctttgaccctgtcaactagggcaggttgtcctttaggccttgacgcctcatcatttcaacgggctccagggtctctgttctgggcctgctcctttccttctgagtgtgttttccctaggttctgaaat

SEQ ID NO: 1509 - DNA, 426 bp, Mus musculus
gaagtttgttttgtcgtgtgttcgtaattaaaaagaaaacgggcagtaaccctcttctatataagcattagttaatattaagggaaatcaaacaaatctaagccaatactcccaacaagcaagttagatcttacttctgctgctgttgctgaaatgtggctttggcatggttgggtttcataaaactttttggccaagaggcttgttagtatacatccatctgtttagtcatcaaggtttgtagttcacttaaaaaaaaataaaccactagacatcttttgctgaatgtcaaatagtcacagtctaagtagccaaaaagtcaaagcgtgttaaacattgccaaatgaaggaaagggtgagctgcaaaggggatggttcgaggttcattccagttgtgacccgagcgtccccaaaacctgggatgca

SEQ ID NO: 1510 - DNA, 411 bp, Mus musculus
tggtcctcagctgctaacacaatgagctactactacggcaactactatggtggccttggctatggccttggtggctttggtggctttggtggcctgggatatggctatggttccagctatggccttgggggctatggtggctatggctacttcagtccctctttctatggaggatatttgtcttctgggttttactgagaaaattattatcacttcagaactctgaacattttttgtcaatcatatgattttctgaagaaggtaccaccatgctatggtgctgtttgaatccatgggcacttaggtccctggatagggatcgcattactaaaatggtatcgtgtcagcaactcctgattatgatgtgttggcttctgacttttgtcttctgtgacatttccgcgttatttc

SEQ ID NO: 1511 - DNA, 450 bp, Mus musculus
  misc_feature (351)..(351): n is a, c, g, or t
  misc_feature (383)..(383): n is a, c, g, or t
  misc_feature (396)..(396): n is a, c, g, or t
  misc_feature (424)..(424): n is a, c, g, or t
ggacactgacgagatccagagctatcaatacctcagttacgcgaccttagaggtttcttcatttgtttgcggtgtgtcctgtttttccttcctttttctctttttaaagaccaacttccttttggtggctgtgtgaagagagtcccctaagaggtgaaagaaaagcctggctctgttattgtccccggagcggtccttgttgcatgccctttcacggtttcccccttaccccaagtggggccctctactgtcagacagttgaagcactaactgcttttcctgggttttggaccaacaacatggcaagcacattctgtttcttgactgtgaaggcaacatagtggccagcantgtgtgtgtgtgtgtgtgtgtgtgtgtgtgtntgtgtgtgtgtanacacctgtatgtgcccatccatccccanctgcctgttttgaacatctctcttca

SEQ ID NO: 1512 - DNA, 442 bp, Mus musculus
  misc_feature (113)..(113): n is a, c, g, or t
aacacctcctgccatggtctttttacatgatcttctttctgtgagcctggcctatctgtggcttgacggttctccctagctggaggcaaactgcatcttctcttgctcacttngtgcctttgacactgaccttatagatggctcttaagacccctcttctcttcaaaatcctacacctgggcttctagtgccttgtgtggcaggagatttgtccccatttaccttaggagttctagaggtgcccctaaaggaggtacagatagagactctatgccgtgtgggcctctgagccatcactggcaagaagttcgcctggtgctgggtagaggacactcagtgctcagtagcttgaaggcacagtgggagacttacagagaacatctggaggacttgtccaggtgctcagttccttggctccaggaagtgatgctgaccctagacc

SEQ ID NO: 1513 - DNA, 550 bp, Mus musculus
ttgaggcacctcatagagaccccagtgcgttatcaggaggagtttgaagctcgaggcttagaagactgcagactggatcatacactatacgcactgcccgggccaaccatcgaggacctgagtaaagccagaggcgcaggcacgccacaggctctggcagaggactcagcctccacggagaagccacccggagaaggcaaatcccgtttccagatcctgctggatgtggtccagttcctgcccgaggacatcatcatccagaccttcgagggctggctgctgatcaaggcacagcacggaaccagaatggacgaacacgggtttatatcgcggagtttcaccagacagtacaaactgccagatggagtcgaaaccaaagatttgtctgccatcctctgtcatgatggaatcttggtggtggaagtcaaagattcactagggaccaagtgaaagccttttggttgctcttcataccccaggaaggaagatgaaagccagggacaccccgggaatgcttaaacttttgagatggattgctgtcacttttatg

SEQ ID NO: 1514 - DNA, 400 bp, Mus musculus
  misc_feature (240)..(240): n is a, c, g, or t
  misc_feature (263)..(263): n is a, c, g, or t
  misc_feature (329)..(329): n is a, c, g, or t
gttgttgccaatccagctgttgcaagccctgctgctgccaatccagctgctgccagtccagctgctgcaagccctgctgctgccagtccagctgttgcaagccctgctgctgtcagtccagctgctgtgctcctgtatgctgccagtgtaagatctgacactttccaagaagtacctctactattcctttacttctgtagtctaccttctttggaagctgtgggattataatgactttcntactcaagttcaaggcttccttntccagcccttgatgggaaggagcaaatcactgccctgatgctttcctgacaggctcacattgtaanttagtccccagattctttaacctgtctttctcacattccctactatgtctaaccaggcttgccatcataaa

SEQ ID NO: 1515 - DNA, 457 bp, Mus musculus
  misc_feature (304)..(304): n is a, c, g, or t
cccatactttattgtcccagatcttgagaagtgttctgcccaggcagcccccccctcgaccttagggaccactgtggatgctgcccctggctccaggctctaggctccaggcacttactgcccatggtgacaactatagaatctctctgggccctgctgtctgcccaccttggtgaaaaggacacaagaacatcacagctttcaggacctcagccagttgatgagcaggcaagacatcagccacacatggtccacatatcctcttcctgcctatcactggttccttggtaactatcttcatggntaccttaaaataatctcatctctccattagaaagtaacaagctggagagatggcccagcagttaggagcaacggctactcctccagagaaccttggttcagcccacagctgtctgtaattccagttccaggacacctgacactttcacacata

SEQ ID NO: 1516 - DNA, 467 bp, Mus musculus
  misc_feature (95)..(95): n is a, c, g, or t
  misc_feature (123)..(123): n is a, c, g, or t
  misc_feature (401)..(401): n is a, c, g, or t
tgcttccctctaaaaacgcttatatccagaaatccctaccccgaggcacagtccagatacagatggatgggacatcagatctgccaccattaaanttgagtctaaaagccagatagtcaccangactgtctatcacattgacagtggacagaactgtacatttgcaagacatcaggcagacatgtcctctcctatttataaagaccttaagaagtgtggcctttttatcctccctgttgctgctactgtgtaacatctgttccatctgcatccttcctgtgacgtcatgcatggatgtatccagaacctgaaggcaatgccacatttagatcttaggatcataagtatcacctccaagcaccgggaaaggactgactcaacccaacgagctgtctctgtanctaatatcaatgtacatagcgtaatccttaagaaactgcttctgttgtaatagtccatgggcgatt

SEQ ID NO: 1517 - DNA, 476 bp, Mus musculus
  misc_feature (369)..(369): n is a, c, g, or t
gtaaggtgccatttacaggccttccttgtgtttccaggggagagtgtggtgccaaaaatatgaggtcctctgttggccagcgaaggagggaaaaacaggtgcaccaggtggaatttgagataaagcaaataagtttgattgtcaaatgagaaatttaagcctggaaggtggttcagtggataaaaccgctgactgctaagcctgccagtctgcactcactctccagcaagcacatgttcacaggagctgtcctctgacctctgcattcatattgtggtacagcacacacatccgagcccacatagacacatgcacatgaatacatggatctaaaatttttaaagaatttcttgcttttgtttgaaactngaaaacgctttgggcttgttcttcagtttgtggtgtttggagagaatgcttgcttggtgtatgtctgtgtaccagaagacgaaattggatcccatagatctgtgtat

SEQ ID NO: 1518 - DNA, 519 bp, Mus musculus
  misc_feature (26)..(26): n is a, c, g, or t
  misc_feature (33)..(33): n is a, c, g, or t
  misc_feature (38)..(38): n is a, c, g, or t
  misc_feature (305)..(305): n is a, c, g, or t
  misc_feature (309)..(309): n is a, c, g, or t
  misc_feature (342)..(342): n is a, c, g, or t
  misc_feature (346)..(346): n is a, c, g, or t
  misc_feature (394)..(394): n is a, c, g, or t
  misc_feature (426)..(426): n is a, c, g, or t
  misc_feature (475)..(475): n is a, c, g, or t
tgaaagtgggtactatcacgcgtccnttctccntttanatcctgtagtgccgtctgcattctttttttttttttttctcacatccatcagtgataagcattgctctagctgtggccacatacacttctctgtatttccctaggaaggtgcagagttagaacagcctgccttgcggtgagctggaggactgactccttgtttgatgacacttttaacagtattgacaccgcctcatacagggcttggtctcagctctgctcatccctgccacccttggtggccttgctccaacctgtgttcataancccntggcagctcctatccagcagcagtcacgggaanccancccttcccatctttaagtatacttctccacagggaactgggagagaancaacttacgatgtagaaaagctataaagggantcctctgcgtcactaaagtaatctgtaaattactttagggacaaagttnagggggaactaaaatttaaccttctttgctttctttacacacaa

SEQ ID NO: 1519 - DNA, 483 bp, Mus musculus
  misc_feature (173)..(173): n is a, c, g, or t
  misc_feature (356)..(356): n is a, c, g, or t
aaacaacgtgcccagccagctagtccagagcccggctgctaagcaagtactgtgagctaacggtatgtaaatctatcactaaagatgtccttctctggggtgttctgccatcacatttccaccgacagtgaagctgtggtcttctaaactgtaaataaagacaatgcttttgntatttatttttttttttttttcccttaagctgtctttcaatgagaatgtcttgggtacttcatctatcattcactactgcaaatgctaacaacatacgattcaaaatcttttctacttaagagcaaaaatccatgaagaagatgaactggtttataaaataaacatggagagcaaaataaatntacagagctacctaaagcaggggtaacagtgaatcaaaatgtgactgtaaaacacattcgagctactgatttgacttttaaaatagcaggcaccaaaagctttattatagctcctgtatttcatact

SEQ ID NO: 1520 - DNA, 470 bp, Mus musculus
  misc_feature (210)..(211): n is a, c, g, or t
gcttgctctaagctgggattggcatgttataaacatgataaaaatctgaacatatccatggaacacagctcctagggcctcatgctatctgcagacattggttcccagggtagacaatgggcagtgcccaatgtgggaaggctctgtggttgctggatgagcagagtatttcattggagaggagaagaaaattcccctccaggcagaatnnataggcgagtgggcgttgcacctcccccattgagagaacttcttgttttctttcatgctccagcctactgtgtttcctttctaatctctctttttatttttcaaaaacactttctccttctaagagttttagaatgacttctacacagaatggagaactcaaaataaatttcgttctattcctctgaggctcataatcacagtgccaactcttgtgaaaccaaccttcatttttatctttcttttgctgctatgacatg

SEQ ID NO: 1521 - DNA, 550 bp, Mus musculus
gaagctactcctcagtaatcgagaaggcgttgagaaactttgagtcctccagcgaatgggcagatctcatctcttcgctcggcaagctcaacaaggctctccagagcaacctgaagtattccctcctaccacggcggctcatcatcagcaagaggctagctcagtgcttgcatcctgccctgcccagtggcgttcacctaaaagccctagaaacctacgagatcatcttcaagattgtgggaaccaaatggctggccaaggacttgttcttgtacagctgtggcttattccccctactggcctatgccgccatgtcggtccggcccgtgctgcttggcctgtatgagaagtacttcctcccgctgcagaagctgctcctgcccagtcttcaggccttccttgtgggtctgctgcccggcctggaagaaggctctgagatctatgaaaggttggtggatatcatgtctgggctgcaggctcttatctgtcgggaacttgttctgtaggttggccttgaactcagagatctgcattgctctgtctcctgaat

SEQ ID NO: 1522 - DNA, 458 bp, Mus musculus
  misc_feature (223)..(223): n is a, c, g, or t
  misc_feature (227)..(227): n is a, c, g, or t
  misc_feature (230)..(231): n is a, c, g, or t
  misc_feature (235)..(235): n is a, c, g, or t
  misc_feature (249)..(251): n is a, c, g, or t
  misc_feature (253)..(253): n is a, c, g, or t
  misc_feature (257)..(257): n is a, c, g, or t
  misc_feature (265)..(265): n is a, c, g, or t
  misc_feature (352)..(352): n is a, c, g, or t
  misc_feature (354)..(354): n is a, c, g, or t
aatgctccgaattgcacatggacacagcagtagcaatgaactgttccaatccctggggaaactttagctatggatcaacctgcaccttccagtgcccagaggggcagtcactgaacggctctgtgagagcaacctgccgagaggacggtcactggtcagatgccatgccaacctgccaagcagggacactgacaatccaggaagctctgacgtacttgggtgntgcngtnncttntacaacaggcctgnnnantggncgggacantcctggctctgctaagaaagcgtctcagaaagaaagatgatggaaaatgccccttgaaccctcacagccacctaggaacatacggantnttcactaacgctgcatatgacccaaccccttaagaaacccggtctgccaatgtctcattcgatttctcaggattccacatgcaagtgtcaagtttcctgtcaca

SEQ ID NO: 1523 - DNA, 261 bp, Mus musculus
  misc_feature (182)..(182): n is a, c, g, or t
  misc_feature (184)..(184): n is a, c, g, or t
  misc_feature (186)..(186): n is a, c, g, or t
  misc_feature (188)..(189): n is a, c, g, or t
  misc_feature (191)..(194): n is a, c, g, or t
gaacctgtggtttcgtctttcttgctggttgagtgggacgcgacaaatggtgccaaagaaatccgggacctgaatcccccactgaagaggttcagaactttctgcagtcagggtctgtcgacagaatgagtacggtgtaccattcctaaggactgccatccaaattcatcataccctgtcgntnantnntnnnnagtgtcctatcgagcaaagaagcaactcatcagaatgatgcctggaggcttgtcacgggccagatct

SEQ ID NO: 1524 - DNA, 547 bp, Mus musculus
ttttaagtcacagtagttcctaagtaaataaaaggagacacagttgagagaaaccctatgaaagttatcaaatgaacaaagccttgaaagttaaaatcttcaaatgcataaaagaagaaatagaggtgagaaaccctatgtttgcaagccatgtggtattgctttcatttgtcagtcatattcaaagacacaaaagaaaacataatgtagacaaaatgttgagtgtatttaatatggtgaagatttttgaatatttctagagtcttcacaatcaaacaatccatactgcaaagaaatttagaaatataatatggtgaaaccttttcagatcccaaatcttcatcattatgaaaaagaaacctatgaatgcattcaatatggggaagcctttaaacatttctaattcttcatcatcatgaaaataatcatacaaaggagatcaaggggatacaaggcatgattcttattgtcttgcttgagttacagtcctgacatcctttggtgatgaatatcagtgtggaaagtgtgagctggattaaactctttc

SEQ ID NO: 1525 - DNA, 543 bp, Mus musculus
aggatccttgactgttgccgcagggagaaaccccacacgaatgctgatgcaaaacagttttgggataaacattgccagtactacaattgcatttgttgggactgttttcctttctgtgcatttggcattcaatacccaggctttcaagggttgccaatcttcaccgtcacctgatgtctgcatttccctgggttcctcatcagatggcctggtgtctttaatgctgattctcaccctgctggagctgtccgtgaccatttctatctctgccatgtggtgcttgggaaatgtttgtggtttaagagaggcaattacttcacctcctaattctgtggagtcaggaatacttcctgaaggaagtgattctgagaacctgaacactcagccccaagcttcagaagagtgagaacctcatttgaaaactcagcagaacatgaacagatgaaatgcaatccttctgtcatggaaatattcacaagaaagctggcatctgtcccaattctctctcctgtaaatccacgagcacggtctggatctggatga

SEQ ID NO: 1526 - DNA, 428 bp, Mus musculus
  misc_feature (241)..(241): n is a, c, g, or t
tacctgcctaaacgctgctatgtgagccacttaaaattctcgggtgcagagtggcaggccttcttagtctagtgtggtcagaaacgtatctctctgaagttgtttcagttttaatttcctggacagactacatatattcagcttcctgagatgatcaaagctagctagggtttcctctatgtagctaagctgcttcaatgatgatcttcatattgtgctccagtttgtttatttaaagtgncgctcctacctcttcgtgtgcctgggtgaagaaacacaatcactgtttagttagtagcggaacaaatccacagggtaggtaaggattagaatctgaattataccttggcatcagttactcaaacttgaagtgtaaatatatacagtatgtatattttttaaagatttgcttgcagtgaaccttatat

SEQ ID NO: 1527 - DNA, 515 bp, Mus musculus
  misc_feature (125)..(125): n is a, c, g, or t
tgggaaacaatgactgcctctgctgctgagggcacgtaccagacccctgtgcgttcctgtgtgccccatcaaaaccccaggaaggttgtatgtgtcgggggacatacttctgatgaggtgctgancattttgtctgaagattcagatgccagtactgttgaaatccatactgcaactgggtcctgcaacataaaggaagttgactccatttcccaagcccagggggaactctgaaggaatgggataggggtcagacacccctatttttcaggttctgtgtcttgttgttttggattgtgttcttgctgccacaatgtatgtatgatctttcaaattccactctggtcaccatagtggagttcactgaatatgtcctttatactgggagaaacaacacatcaggaaccttgaagatggaaagttccctctagaacagtcagtatcacctcttgactcttaattaccccttggactttttctaaggccagctgtaatgctaagtgccagatccaaat

SEQ ID NO: 1528 - DNA, 480 bp, Mus musculus
  misc_feature (190)..(191): n is a, c, g, or t
  misc_feature (309)..(309): n is a, c, g, or t
  misc_feature (323)..(323): n is a, c, g, or t
  misc_feature (326)..(326): n is a, c, g, or t
  misc_feature (383)..(383): n is a, c, g, or t
tatgtataccgggacccgtgtaactcgagcctggctagcctgcggctcaaagccaagcagcacgcctctttcagctatcccgccgtgcccgggccgccgccggccgctaaccttagcccctgccagtacgccgtggaacggccggtgtgagccgcaggtctgtggatccatccccgagggcggggcagtnnttcacagcctctccggacaggggtcgcctagactggcttgccctcgtcccagggtctgaaaggggtgccagagcacccgggaagaggccgcgggcttcgaagagggccttttccctcncagcccccgagcgntgntctgacccctatgcggagaccgcgcccctaggactaaggccaggaacagggaccagntcccccagggccaattcacccttggctcaccccgccttctccagactccccctatcccattttcaaagatcaatgaaataaacgtgcgcggactgtc

SEQ ID NO: 1529 - DNA, 573 bp, Mus musculus
tggccctttcttcaacacagatgagttggggactacagattctcccctgcctgagcctaatccttcttctttggaaccaagtgccagggcttgagggtcaagagttccgatttgggtcttgccaagtgacaggggtggttctcccagaactgtgggaggccttctggactgtgaagaacactgtgcaaactcaggatgacatcacaagcatccggctgttgaagccgcaggttctgcggaatgtctcgggtgctgagagctgttaccttgcccacagcctgctgaagttctacttgaacactgttttcaagaactaccacagcaaaatagccaaattcaaggtcttgaggtcattctccactctggccaacaacttcatagtcatcatgtcacaactacagcccagtaaggacaattccatgcttcccattagtgagagtgcacaccagcggtttttgctgttccgcagagcattcaaacagttggatacagaagtcgctttggtgaaagcctttggggaagtggacattctcctgacctggatgcagaaattctaccatctctgactgctga

SEQ ID NO: 1530 - DNA, 462 bp, Mus musculus
  misc_feature (376)..(376): n is a, c, g, or t
  misc_feature (386)..(386): n is a, c, g, or t
gaccgagaccgggacggctacatcggctaccgggagctgggtgcctgcatgcggacactgggctacatgcccacggagatggagctcattgagatatcacaacagatcagtggtgggaaggtggattttgaagattttgtggagctgatgggtcccaagctgctggcagagacggcagacatgattggcgtgagggagcttcgagacgccttccgggagttcgacaccaacggtgatggctgcatcagcgtaggggagctccgggcagccctcaaagctctgctgggggaacgcctcagccaacgggaagtagatgagatactccaagacattgacctcaatggagatggcctggttgactttgaagaatttgttnggatgatgtntcggtgagcctgtgtagaagctggagtggaccggcctggaggatcccagcctccgaattgcagaggatcctatatg

SEQ ID NO: 1531 - DNA, 280 bp, Mus musculus
cttcaagatgcagccctaggatggggtcggcggtgcccacaatgccctagatgcccgtcatgcccatcttgcccgagatgcccgaggtgcccgaggtgcaaatgcaatccaaaataagcctgcaattggcaccaaagatccaaataaacagcataaattctgctgcagctgagcatggaatctgggtcaagataaccatgttctttggaacctcactatctgtcaagacccttgttcttagccttgattgctcttgcttctccaataaactccttgcaga

SEQ ID NO: 1532 - DNA, 483 bp, Mus musculus
tgttggtttcattgtagcggactactcagtaagcagcaacagaggctgctggagcaccctgagccgcacacagctgagttacagctgaatctcacagttcctcggaaggaccccacactgcgctggggagcaggcccagccttgggaaggtccttcacacacggaccagagctggaggagggccatctgcgtatccatcaagatggcctctacaggctgcatatccaggtgacactggccaactgctcttccccaggcagcaccctgcagcacagggccaccctggctgtgggcatctgctcccccgctgcgcacggcatcagcttgctgcgtgggcgctttggacaggactgtacagtggcattacagcgcctgacatacctggtccacggagatgtcctctgtaccaacctcaccctgcctctgctgccgtcccgcaacgctgatgagaccttctttggagttcagtggatatgcccttga

SEQ ID NO: 1533 - DNA, 516 bp, Mus musculus
  misc_feature (97)..(97): n is a, c, g, or t
  misc_feature (101)..(102): n is a, c, g, or t
  misc_feature (226)..(226): n is a, c, g, or t
  misc_feature (229)..(229): n is a, c, g, or t
  misc_feature (280)..(280): n is a, c, g, or t
  misc_feature (284)..(284): n is a, c, g, or t
  misc_feature (290)..(290): n is a, c, g, or t
  misc_feature (306)..(306): n is a, c, g, or t
  misc_feature (321)..(321): n is a, c, g, or t
  misc_feature (330)..(330): n is a, c, g, or t
  misc_feature (350)..(350): n is a, c, g, or t
  misc_feature (390)..(390): n is a, c, g, or t
  misc_feature (460)..(460): n is a, c, g, or t
  misc_feature (462)..(465): n is a, c, g, or t
  misc_feature (468)..(468): n is a, c, g, or t
gaatcctcgctcagcgggagtttgacaggagattctccccccattttctggactgggcagcctttggggtcatgaccttgccctccataggcatccncccnngctcctgtggtattccagcaagaggaagtacgatactcccaaacccaagaagaactgaatgcagtttcctcggcccttctctcccaagaaaccaggttttttctagactccagagggtgtcaanaangtgttctcttggcccttggcccgtggctattttgtcctgaatcttaccccngaanctcaanccagaatgcgaggggncaggcctggaagttnggagagggncctccccgttgtcactgaangccatatagacaggacagcccttagccacagcttcagggncttgagggtcccaccaaggtgctgttggtatattattagcaatgtgaactctttggggtccaggaggggncnnnntgnatactgtctgacacccccatcccctggcagctcctctcaagagggtag

SEQ ID NO: 1534 - DNA, 519 bp, Mus musculus
  misc_feature (117)..(117): n is a, c, g, or t
  misc_feature (121)..(121): n is a, c, g, or t
  misc_feature (125)..(125): n is a, c, g, or t
  misc_feature (231)..(232): n is a, c, g, or t
  misc_feature (234)..(234): n is a, c, g, or t
  misc_feature (237)..(237): n is a, c, g, or t
  misc_feature (239)..(241): n is a, c, g, or t
  misc_feature (243)..(249): n is a, c, g, or t
  misc_feature (363)..(363): n is a, c, g, or t
  misc_feature (365)..(365): n is a, c, g, or t
cctgctgtcactctctgctctgggttctcagacccacctctccaaggaggacaagaacggacacgatggggacacccaccaggaggatgacggagagaagtcggattagctcttggnggangggnggaggggggagaccaggggagacaggcacagagagcgcagtgttctaagggccacacagcacacagctctgtcactacccaagcttacacctccagtcctggttcnngnctngnnncnnnnnnnggcctaggggacgccagagggacaccccaggctaagggttcttccccaccttcaacatttccctgggccacagccaccaatctcggcccagaatgtacacaacgctagctgccncnctttccaccctgtgcaccccgaatctgcccctatccccttctctgcttcctgcactgcacacctgctagtcccagacccctccccccagctcccccagctccggttccctcaaccacaaaagaaggggacagagagaaagcattggctcgggac

SEQ ID NO: 1535 - DNA, 496 bp, Mus musculus
  misc_feature (347)..(347): n is a, c, g, or t
  misc_feature (404)..(404): n is a, c, g, or t
aggatatgcagtaccttactcccaaagctgtccttaacaccttcaagcccattgtctccaaggatactgaaaaaaccaatgtgtggtgagatattaagacatctctcaggaactccacagttataacatttgatgtgactggaccctccattctccatccacctcatgtctctctattcattctatggagcctctgttttacctaaaggcttgactgctattttagagtagataaaacaccatatagaggccaatgattcatcttgagttgtctactgcatattagatagcatagcatccttccttaagctaacctttcctagacagattcttttttctaaattccnagttgcatcatctgagcggagagaatcaaggcctttaacaagtttctattatggaanaatttgttttaaaagtctttaaatggattcttctgaaaatgttatcattttgggtaattgtgtgtagtaactgagattgtctttttcctctt

SEQ ID NO: 1536 - DNA, 385 bp, Mus musculus
gacacctagcaacagcaggttccatttcacctcagatggcagcttgcctggcagtggacttagagtgttctagtctgatgtatgtggggtttcctgccctgttggaccaaagtttccatggtcctatgggatagccttcagcctctggagacccagagcttgcctgccagggcttggttctccatttccactgctgacatttgatttccagtgtatttaaattactccgtggtaaatttcattgtcttttcctgtgtaaatgttaaatgacaataccatcggtgaaggccctccacagtggacagagcaacttcctttccagcctctgctggtagcatgctgcagcttctgtgttaaaggtcctctggagctcgtgtaagacagg

SEQ ID NO: 1537 - DNA, 478 bp, Mus musculus
aaaccatttctgtttggctgcatccttaactccttcatctaggttcagcatcttaagctttcgagagggttttttgttttttgatcttaaattttggtttttggggtttttttatgtttttaaattttttaaggtattcataagaaaaattacttaacatgtatgtataatttaggagtcatttaaagaaaatactcttgttagtccttcaaagtcaaggaattctgagaagccccctaatgtgtcctcccctagctataacccctctagctccttttccagtcttttgcttttctctgcattccttgatctgttgtggtgggaacataactgtgaagccgcagctgctgcctgcccagagcagccgcgggcaagggctgcttcaaggtcctgagcacatagactgggctcctttctattgctgggcccaggggacaggcagttcttctgagaaggactgccctcatgagcaggacca

SEQ ID NO: 1538 - DNA, 527 bp, Mus musculus
  misc_feature (288)..(288): n is a, c, g, or t
  misc_feature (309)..(309): n is a, c, g, or t
  misc_feature (356)..(356): n is a, c, g, or t
  misc_feature (358)..(358): n is a, c, g, or t
  misc_feature (366)..(366): n is a, c, g, or t
tagccatttgttccatgactcctttgaggaatcatgtagacaggaagatctctgacacctctatggacctagctccttatctaggttatgtttccatttcatcagtccattttcctatatgtaccagtagacattgttttaattcaataatattgaatattagcccttggtcctctccaagagactggagtggaacttttgatggaccttacaggcaaggttagtagaccctgaggtcacttgtgacgtaagatgctatcctactgtgtgctcagcttttaagaaacnggtgttaacagtcacccttanttacccttgggtttccctgtgcctagctgtaatctcaagtcctgtantntccgtgtntctgaccaacagtaatgaatgggtgtcatttgctgaaaacagcacacacagaagttgaaagcaatctcctaaagcgaatatccaccacgaatgttgaacacaacatttaaatattgctcgataaacaatagtgtttgagatactgttttctgggtcggttg

SEQ ID NO: 1539 - DNA, 469 bp, Mus musculus
agaggtgttctccactggttctccaggtcctgattggtccatgacgtcagtgaatgctgatgaggtaggcaaaatcccaggcctgcccagatccgtggactcagcatcctgtgttcagaccccagtgtgagcagcagctccacagcatccactggcctcagggagtccacacagccctgttgccaccatccattgcatagatgtcacacaagagccacagggccctcatgcagagcagagtcaaaagcaccctccgattgcttctttcagtttggaagagctagctcttcagtgcccgctggctttatagggtagcttttaatttggatttatctgggggcatttctcagttaaatcctggctgggtcagaatatccaggaatgaaattggtttttccctagtgtgtcccatcaggcggcacacggttggctcccagttgctgcgtgctgttgactctgattgcctgac

SEQ ID NO: 1540 - DNA, 355 bp, Mus musculus
tgtgaaagagcttcactcaccccaggaagatttcttgtgtagaaagtcctcagagactgttggttatctcctatgtctttaaggcagcagtccaatgatggtgatagctagtgtagtgttcatgaaaagcctgctgtgtggtaggacctgtgtagacctgtgagggttaatgtatgtaatcctttcagcccgtggatgaggatagaggttaatcactagacctaaaggagttgcagaattcctgataaggacggtaggccagtcagattggtggatggcagaaagccacatggattatagacctccagtgcacgaggccaccagagacaaaaggcagtggcgtaaagccctaaag

SEQ ID NO: 1541 - DNA, 392 bp, Mus musculus
ctgtgcttattaatcacccttccttctttgcttttcttcttgtctggggaggtccctgcgaggctccttcccagggttgctgtcttgagaggattaagtagaacatgaatgtgaacgcaacacacaggcctatgttagctatcaggagaggacgccttccttgtgtgtgtgtgacagatctttgaggtttcttgtctgccccagtagcccagggtgacacactctgggctgcctgttcaagcttttgatggaggggggccttcagggctcaggacaggacagtagcagaaagtagggactaggcctttggacagctgggtggtttgtacattcaagtttgaggtgaaccctttggtgggagggggctgtgcccactctgaaggcttgacagg

SEQ ID NO: 1542 - DNA, 255 bp, Mus musculus
  misc_feature (115)..(115): n is a, c, g, or t
tgaaccatggaatgcacacaacggttttgccctttatattgatcgagatgagaacatcccaccatcagtatcccagcaggagcagtggactcgccgccatatgcaccttctccgngggctatatattatgggtgtgctggatacatcatgtcaccggcatgtgggtgtaccctttcctggaacatattggctcaggagccaggatcatcttctttgggtcaacaaccatcctaatgaatttcctgtacctgcttg

SEQ ID NO: 1543 - DNA, 466 bp, Mus musculus
gcaaatacaccatgatcttccacaccagagacaaaggcaacgaggtgaacatgggccgaatgaagctgttgcaacagatgtcccgggtctggaaaacagatggcttatcgagttgttcttacagattactctctgtggagcacaaccctttatatgccaacatcacagtggatttctggactgctgcgtgacccggagcttttgatgacactcaggactgatgatttgactgtaataattttggcctagagacttccatagtagcacaacgttaagaacttgttccaactaattattaggctgaaatttttccattttctcagcagagctcttggttatgtaaatgtagaaccatagtaacaagacagcttttcttggttgttttgaatcatggctgtgaagtgttgtaacacacgtacttgaaggactaaagatgaaggatgtgatgaagtcaccttgcggtctg

SEQ ID NO: 1544 - DNA, 376 bp, Mus musculus
  misc_feature (289)..(289): n is a, c, g, or t
  misc_feature (311)..(311): n is a, c, g, or t
  misc_feature (314)..(314): n is a, c, g, or t
  misc_feature (324)..(324): n is a, c, g, or t
  misc_feature (333)..(333): n is a, c, g, or t
  misc_feature (335)..(335): n is a, c, g, or t
  misc_feature (338)..(338): n is a, c, g, or t
  misc_feature (340)..(340): n is a, c, g, or t
  misc_feature (346)..(346): n is a, c, g, or t
gctctggactctgcgcaatttcaagaccagagacactgcccgggagcagaagcccgccgaggctgcagccgcactaagagggccggatcttcttaggtcctgaaaatctgtggccacaagaccaactcactgatcctccaaagggatcgcctccgcccatcaggccgggatgggcggaccgctactttccccggctgcggctctgcctcccgggcttctaaagatttttttccccttctgggttttgtttccggccagaagctcccttagctgggagtgaggagggagnctgctaaaactccggaggatgnttntcctacacanaagcaaaananagntnaaagtnaccgttattgtttacaaagcgcgcggttta

SEQ ID NO: 1545 - DNA, 372 bp, Mus musculus
gtgctgctggtcatgacagtacactaggcagcagtggaaaagagtgtgctctgtgtggagagtggcccacaatgcctcacactattggatgtgaacatgtattttgttactactgtgttaagagtagcttcctatttgacatatactttacgtgcccgaagtgtggcacagaagtgcacagtgtgcagcccttgaaatcaggaattgaaatgtcagaagtaaatgctctttagaaaccaagttgtttcctctgagaaaagtgtattgtatccagttccttggaattagtcatcctcagtgtcatctgtaggtggcttttaacaggagtgtgctgtacagccactctcttcctttacaagcacaactcagttc

SEQ ID NO: 1546 - DNA, 423 bp, Mus musculus
  misc_feature (178)..(181): n is a, c, g, or t
gatgctcagccctcatgaaaatgactatgacaacagccccactgcactgtctcggataagtagtcctagttctgatcgcattacaaagtctagtttaatcctggctaaagactatctacattcagatatgtctccccatcagacagcaggagaccatcctgccatctctccaaactgnnnnggctcccaccggcagtattttgataagcatgcctatacattgactggttatgccctggaacacttatatgacagtgagactattagaaactattccttgggctgcaatggctcacactttgatgtgacttcccatctaaggatgcaaccagacccagcacaaggacacaagggaacatctgttataataaccaatggaagttgatgtttttctaaaatattttgttcttcaagggtctctga

SEQ ID NO: 1547 - DNA, 481 bp, Mus musculus
tgcccgactcactgtcacaaaggtggtggctatgtaaccctggccggcctcacaagtgctgggattacgagctggagccatcccaaacagaactgccacccttccttttgaagcctcttcatgtcagtccctgcttagagaggggcacaacccccacacaggcactgggctggtgggcactgccagctccttggggcatgaacagagatgcagggagaagatgacaccagagtccttcttaaaaatattacatgttttattctcccatccccagagggtggtttatccagaaaccaagaaaataaaaatcaatcagaataaactcaagggggcgagtggagagaaacccattaacgaccaggcaggcaggccagcagcctgcctccacctcagaaggtccccagagacctctgcccaccgccacgaggggaaaatcaggagggactggggagggcattgaatcagctatgtcttcattatg

SEQ ID NO: 1548 - DNA, 474 bp, Mus musculus
  misc_feature (111)..(111): n is a, c, g, or t
  misc_feature (113)..(113): n is a, c, g, or t
gctactgcttggagcgcaggctctaccgagtctccttggcttgtgtgtgtgtgcggccccgggtcatggcttagtcatgctcaccacctgcctgaggctgatgcccggttngngagagagggccaggtgtacaatcaccttgccaatgcgggccgggttcaagccctccaaagccctacctgaagcagcaggctcccgggacaagatggaggacttggggagaaactctgacttttgcactttttggaagcacttttgggaaggagcaggttccgcttgtgctgctagaggatgctgttgtggcatttctactcaggaacggactccaaaggcctgctgaccctggaagccatactcctggctcctttcccctgaatcccccaactcctggcacaggcactttctccacctctccccctttgccttttgttgtgtttgtttgtgcatgccaactctgcgtgcagccaggtgtaa

SEQ ID NO: 1549 - DNA, 138 bp, Mus musculus
  misc_feature (29)..(29): n is a, c, g, or t
  misc_feature (74)..(74): n is a, c, g, or t
cagaagattctccattgcccaatgtcctntcctcctgcttccctccttgttctgccctctgatttgctgaaatntcctgggaaatgttctgcattgtcctcatgaaacgacaatgcccatttgcctctttgttataaa

SEQ ID NO: 1550 - DNA, 437 bp, Mus musculus
  misc_feature (202)..(202): n is a, c, g, or t
  misc_feature (222)..(222): n is a, c, g, or t
  misc_feature (231)..(232): n is a, c, g, or t
  misc_feature (236)..(237): n is a, c, g, or t
  misc_feature (242)..(242): n is a, c, g, or t
  misc_feature (246)..(246): n is a, c, g, or t
  misc_feature (251)..(251): n is a, c, g, or t
  misc_feature (260)..(260): n is a, c, g, or t
  misc_feature (283)..(283): n is a, c, g, or t
  misc_feature (331)..(331): n is a, c, g, or t
  misc_feature (404)..(404): n is a, c, g, or t
tttctttagctcctccactgtggaacctgtgctcagttcaatggatggctgtgagcctccatttctgtatttgccaggtactggcagagcctctcaggagacagctacatcaggctcctgtcagcaagcacttgttggcatccacaatagtgtctgggtttggaatcttcaggatttttaagatacacatggatgggctatnttctttgctctgagtccagnatttttttnntttnngtttngttnatttnattaatttngaagatttctcacaagtgcacancagggtttctgttggatcttttgaacctgtaagctccaacccattttntcgcctataatactgttattaaggggtggagagttaggaaatttaaggtttcaattggacaaggtggcatacntcttcccagcactctgatggtagaagcagaact

SEQ ID NO: 1551 - DNA, 521 bp, Mus musculus
gggcaaacttcatcgtcaaccatatgagagaccaaaacagttacaatgaggagaaggacaactggaaccaggtggcccgcacagtggaccgtctctgcctgtttgtggtgacacccgtcatggtggtgggcacagcctggatcttcctgcagggtgtctacaaccagcccccactccagcctttccctggggaccccttctcctatagcgaacaggacaagcgcttcatctagagcaggcatgagtagacagccaggcagagagcagtctgagaacggcacgtagttcctgcccttgagcttgtgcctagcgggtgctgtgtggctgggcagaggccatggtcgggagagctcccttccggaaacaattcctttctaaataaaggagggagacacttgagatgggctaagggtggacgtggtggagagggaggctccagggttgtgaagagaagcaggggccttgctcagggggccagagaggtgaccttgggactggcttcctgggaacagtcctgtgag

SEQ ID NO: 1552 - DNA, 465 bp, Mus musculus
ggatgttgctgaccccaacaaggtcagagtacagctccgtaagcagtacctctattaccatgaccacctgatgaatgtgagccagatcatcacacaccccgacttctacatcgtccaggatggggcagacattgccctgctgaaactcacaaaccctgtgaacatttctgactatgtccaccctgtccccctacctcctgcctcagagaccttcccctcaggaacgttgtgctgggtgacaggctggggtaacatcgacaatggtgtaaacctgccgccaccatttcctttgaaggaggtgcaagttcccattatagaaaaccacctttgtgacttgaagtatcacaaaggtctcatcacaggtgacaatgtccacattgtccgagatgacatgctgtgtgctgggaatgaaggacatgactcctgccagggcgactccggaggacctctggtctgcaaggtaga

SEQ ID NO: 1553 - DNA, 315 bp, Mus musculus
gatcacatcctacaggtcagctgagcccctcccaccatagatctttgcttgtcttgcctcccagtcctaccaaatatactcttcatactatggctatgctcgtctcttccgctaccttgagcatatgaggcttgtgggaccctttgaacttactattccttttgcctggaaatgcccttgcttttgaacctccatcagattcgttttcaccattcagtgaacagccctgtcattgtcacagtctcccctggccatccccactactctgtcatagaactaattttaattattttcggagttcgttcgtgctataaa

SEQ ID NO: 1554 - DNA, 228 bp, Mus musculus
  misc_feature (90)..(90): n is a, c, g, or t
  misc_feature (113)..(113): n is a, c, g, or t
  misc_feature (202)..(202): n is a, c, g, or t
ctgtaataattcctacttctgcatttgtgggaagaaactggatcatttccctggttaactttccaaagagagttaaagaacatagtctgntgtgaagagaaacaaagctgcangagcattgggactgttctctggtatctattttgacagaacagagttcatcttccttcctcttggagacagaacacatctactctggggnatgggcaccctttgccataaagcctt

SEQ ID NO: 1555 - DNA, 456 bp, Mus musculus
  misc_feature (276)..(276): n is a, c, g, or t
  misc_feature (335)..(335): n is a, c, g, or t
ggtgagccttagtccctgttagggaccaacccctgtcctgatttcacctcacccagaagtgaacccagcaggatcctggcactggcaatggctgtaccatgcttttccctgtatatggataggctgtagcctgtgtttggaaaaacaaagttgtgttcagcataagaaaagattatacatctgaggtgacacctagtgactcatggtactgctgctggatggacctattctcagtggtcacttggctcaggtcatactgtctcaggaaccatctangttattcccagtgtcctgtgaggtaagtgtctcatcacacctattctgcagctgtgtanacccacagcttagagaagttgagtctgatagcaagaggctcctgaggcacatctgtgacacttcggcatgagctgtggacattgtgccttcctgctttgcgcttgctcatgtggtcttttc

SEQ ID NO: 1556 - DNA, 418 bp, Mus musculus
atgcccacctcagctgtagttgtacctgccacggggccggcccctcacagtgcgggggcgggcctgctaaggatctcagtgaaggaggtggtgtttgggtctctcactgctgcgctggtcctggccacggtgctgctgaccctgagggcatggcgccgaggtatatgccccactggaccctgctgctacccagccccacactatgccccagctcggcaggatcaggagtgccaggttagcatgctgccagcggggttccctctgtccccagacctgccccctgagcctggtaagaccacagcgctgtgatgggaggagcctttctagctaccttcctgccctccttcacacctcagactgtcaccagccctcagctctggtacacccatccaggggatttctgcctcacaccagaaat

SEQ ID NO: 1557 - DNA, 540 bp, Mus musculus
ttcccgattgcccatgtacatagatgtgtctgctcacgccttcacagttgtcataactgcaggtccctgacagcagtgtctgtatcctgtatggattccgagacatgttgactagcgctctcttgagttcaccattggtcaccacttaataattctttaactgactagtactgacttttcatacatgaccgtctgcctaattcatgagtaattcctaaatagtgggtgacatacattgaagaagcctttgaaaatgaaatcttttctgttgggcattcacattgctgagcaggccttggggatagaactgacatctgcaacttgaatatacctgaggctttgtgtggcttgtaacagaaaattcaagtcctaacccacagggcaatgtgcaagatggggcttcacaagggaatctctgtatgttgtaggctcaaggctccagcttctttagcacaaatgttcatggctgtgctccagccaccaagaagtgaggaagttgtactgtgatgccacaaagctttcagaatggtgttccctgcc

SEQ ID NO: 1558 - DNA, 508 bp, Mus musculus
  misc_feature (416)..(416): n is a, c, g, or t
aggaggatgctgtccttactgagaaggtgaactgggtcggctgccagggcagtgagccacacttccgggggtttccctgctcactgtgggtcctcttccacttcctgacggtgcaggcaaaccgatatagtgaggcccacccacaggaaccagctgatggccaggaggtcctccaagccatgaggagctatgttcagttcttctttggctgtcgtgactgtgcggaccattttgagcagatggctgcagcgtccatgcaccaagtgagaagtcccagtaatgcgattctttggctctggactagccacaacagggttaacgctcgcctctcaggtgctctgagtgaggacccccacttccccaaggtgcagtggcctccccgtgagctgtgttctgcctgccataatgaactcaancggacaggtgcctttgtgggaccttggtgccaccctcaactttctcaaggctcacttctccccagcaaacatcgtcatagactcttctgcat

SEQ ID NO: 1559 - DNA, 247 bp, Mus musculus
  misc_feature (40)..(40): n is a, c, g, or t
  misc_feature (116)..(118): n is a, c, g, or t
  misc_feature (160)..(160): n is a, c, g, or t
  misc_feature (212)..(212): n is a, c, g, or t
gggctggagtggacctcctcactgcattctgagactgtcnactcccctccctcacgacatgaagaaaaagcatccctccggccttctctggcctggccagcttcagcacctcaggnnntgggtggggcttagcttcaagaatgggtctgggagcctcagnaaatgattctggtcacccaggttcaaactggggtttctgctgcaagagtgtngtttggcaggctgggagggtgacagttgctgcact

SEQ ID NO: 1560 - DNA, 536 bp, Mus musculus
  misc_feature (164)..(164): n is a, c, g, or t
  misc_feature (169)..(169): n is a, c, g, or t
  misc_feature (310)..(310): n is a, c, g, or t
  misc_feature (312)..(312): n is a, c, g, or t
  misc_feature (332)..(332): n is a, c, g, or t
  misc_feature (342)..(342): n is a, c, g, or t
  misc_feature (344)..(344): n is a, c, g, or t
  misc_feature (346)..(346): n is a, c, g, or t
  misc_feature (349)..(349): n is a, c, g, or t
  misc_feature (360)..(360): n is a, c, g, or t
  misc_feature (364)..(364): n is a, c, g, or t
  misc_feature (416)..(416): n is a, c, g, or t
  misc_feature (485)..(485): n is a, c, g, or t
  misc_feature (498)..(498): n is a, c, g, or t
aagtaatgaaatcccctccacggatgttgctgaccaaagcaatcgggagcatctctcggtctatgccgtggtggtgattgcatctgtggtgggattctgcctgctggtgatgttgctcctgctcaagttggcgagacattccaagtttggcatgaaaggttttnttttntttcataagatcccactggatgggtagctgagataaaggaaagacaaaggctggggctgtggtgcttgttgcctgacgccctgtgagctgaactctgggactgctgttgcctatcccaggaagtgctgcttatttgagggntntctggtggaaatgggtaatntccgaggatntntncancctgcttgttntganctgtgactggggaaccccaaggcagaggcaggggtcaggcagctgagaagcnagcagaagaacacacttagattcaccttctgttcttacaatagttcaaatatagaatcgaagtgaaatntcattggattatncctctctaatgaaaagcgagctgtttgactatacggaa

SEQ ID NO: 1561 - DNA, 467 bp, Mus musculus
  misc_feature (348)..(348): n is a, c, g, or t
aaagtttgttccatgtttggctgaagtattttttaaaagaacctactgatgggagcacaaaagtccttgagcccacagatcaccaaggaaaccaggaatgttaatcacatagggttgactccccaaagaaggaaatccatacctgtttcccacccagaggactgggcgtggatgttgttaatgacctggtgacctttgctatttgtagagccagacctcacccaaatgccccctaaatgtttgtcttggactcttccttcctagacctttatttttaacttagtttctccaccaataaaatccatgcttaggggagatgtcacaagtattttataacctgctgacctntacattatcttggtcagagaccataccagatcctaggcccttaagctataggacccatctttgtggtcggtgtactttgagctgagtttcaatgtaattatgcctcttatacccgggat

SEQ ID NO: 1562 - DNA, 391 bp, Mus musculus
tcgggctactttgtcagcatcgacgcgcacgccgaggagtgcttcttcgagcgggtcacctccggcaccaagatgggcctcatcttcgaggtggcggagggcggcttcctggacatcgacgtggagatcacaggaccagataataaaggaatctataaaggagaccgggagtccagcgggaagtacacatttgcagcccacatggatgggacatacaagttctgctttagcaataggatgtccactatgactccaaagatagtaatgttcaccattgacattggggaggctcccaaaggacaagacatggagacagaagctcatcagaacaagctagaagaaatgattaatgagctggcagtggcaatgacagccgtaaagcacgaacagg

SEQ ID NO: 1563 - DNA, 107 bp, Mus musculus
atttgattggcctataattcttacttgaaaggagccccattatataggcccttccaagaatccagaggctgttaatgctgtatgggactatggtctttattatgttt

SEQ ID NO: 1564 - DNA, 55 bp, Mus musculus
atagcataggcctgtctctttcgttaaaagccaaagtagaggctgtctggcctta

SEQ ID NO: 1565 - DNA, 419 bp, Mus musculus
ctgtctaaggtattcaaaggtattccagtactacagcttttgagattctagtttatcttaaaggtggtagtatactctaaatcgcagggagggtcatttgacagttttttcccagcctggcttcaaactatgtagccgaggctaggcagaaacttctgaccctcttgaccccacctcccaagtgctgggcttcaccaggtgtgcacctccacacctgcccccccgacatgtcaggtggacatgggattcatgaatggcccttagcatttctttctccactctctgcttcccaggtttcgtaacctgagggggcttgttttcccttatgtgcattttaaatgaagatcaagaatctttgtaaaatgatgaaaatttactatgtaaatgcttgatggatcttcttgctagtgtagcttcta

SEQ ID NO: 1566 - DNA, 569 bp, Mus musculus
agctgctgctgtgatctcttgtgtagttgctctttgtgtcttagggttcagtctgactctgcaaaggtctggccccgccagcacagatctcagtttttggttacagaaattttggattctggactgaatagatgacttagaagttaagggccactgcctgcacttccagatgacccaggttcaagtctcagcaaccatatggtggctcacagctgtctgtgactacagttgcccgggttctaacacccttacacagacatgaatacagacaaagcacataaagtaaatttttaaaaaaaattttgggtgcatggccatgggtccgtgtccgtgagtctcagttatcctgcaccaacagacatctttaatcttttcttgatgctcttaagacatacactattaaagaaaaaaaaaagaatgtacactattatttatttttactatttatgtattggttctttttattcttgtttttctgagacagggtttcattatgtagccctggctagtctggaactcactgtatatacctggttgtccttgaacttacagagattggcccctcgtgc

SEQ ID NO: 1567 - DNA, 504 bp, Mus musculus
  misc_feature (447)..(447): n is a, c, g, or t
  misc_feature (463)..(463): n is a, c, g, or t
gaaagcggaaccttgcgccaggagctggcagcggtgtgctatgagacaaatgtcctaggcttcaagggacctcggaagatgagtgtgatcgtcccaggcatgaacatggttcatgagagagtctgtatccgcccccgcaatgaacatgagaccctgttagcacgctggcagaacaagaacacggagagcatcattgagctgcagaacaagacgccagtctggaatgatgacacacagtcctatgtacttaacttccacggccgtgtcacacaggcttctgtgaagaacttccagatcatccacggcaatgacccggactacatcgtcatgcagtttggccgggtagcagaagatgtgttcaccatggattacaactacccactgtgtgcactgcaggcctttgccattgctctgtccagctttgacagcaagctggcctgcgagtanaggccccccactgccnttaggtggcccagtccggagtggagcttgcctgcctgccaa

SEQ ID NO: 1568 - DNA, 546 bp, Mus musculus
  misc_feature (57)..(60): n is a, c, g, or t
  misc_feature (84)..(84): n is a, c, g, or t
tttgccatgccctgcagaaaataaagtcatgaacagaaagtgacgtcatagacagannnnacttaggaggtcaaccaaaaaaantctgctgatagaagtatagtaactgcttcttttccctgaagaagaaaagttttatttgcaatgtcagcttttaatatattttcctaacatagtggaggatcaccaaataaatcaatttctctgaaatgaaagtatattaaaacccatcagtggtagatccttcagagtcacatttgatttagatatctcagaccttcaatttggtttaaaatgtaatttctcagttctcatcaacattcatcaaatttgggactcatatcatttgggctctgtctgttcatttttaacctctcaggtaagctctgatggaatacatattgcttagtgtaaaatgtgagactgtcatcgggaacaaattattccattcagtacagattgtaatctacaaagcttagtttctacattcattcattatggctctgagaactactttgttagcctgcttacataaatgtcctctga

SEQ ID NO: 1569 - DNA, 321 bp, Mus musculus
tgtttacacagtcgcaacgctacctctcacagacactgagttctgcaagtctgtgaactggaggagtctgaacacttatgctgaactgaactgaggtgcctcaaagatgatggagcagaggagtggctcagcaatcctcagactagagtccaggaatggacctgctggattttaaaaatctccctctagagggcgcgcaagacccacggttttgtgcctcatttccgtttgccttcatccttcatcttacgcatgtgcagagtttatttccgggctgctcgcaagggcccctttggatggcgtgtagggttcatccactgc

SEQ ID NO: 1570 - DNA, 485 bp, Mus musculus
atgccagtccatatccacatattttatagacgccaaaaataggtgatatttcctcacctatggtaactgctacctgatttttttaaagcgtgatttatacctatccatcctcaatgacatggttagttctggggtaataggaaaaactacagaacctaccacaaagtatacctcaataagtcctctagctctgcttctcaaatctgaagagtgtgctagcaggataataatttttaaactacctggttaaccaaaacaaaaagcagctgactatgtgtgatttcctgatagtacatcatttcctggtacctttgtgccagaaatgaatgaagatttggattttcctaatgactcctatcaagagtgtagtaactcagtgttcagattataggagaacctgaatccacaagttaactgtgattcgcatttctgttactgtgacacactaatgtgacccaaaaactggcttatccttgagtgtttac

SEQ ID NO: 1571 - DNA, 567 bp, Mus musculus
  misc_feature (170)..(170): n is a, c, g, or t
  misc_feature (515)..(515): n is a, c, g, or t
  misc_feature (518)..(518): n is a, c, g, or t
  misc_feature (520)..(520): n is a, c, g, or t
  misc_feature (525)..(525): n is a, c, g, or t
tgcaaatgttgggttcctcctacttcctcattgacaactggacagaacaagctgcctttccagaagttagaaacagggcacccagggtctgaaccatctttccccaaggaaggtaattgcttttaggggaagtgtcaaaatatccaggaatcctttccagaatagtctgnctgtgtatacacgcatggtctcactcttgtaaagacgcattgaccagaccctggaacacagatctgactccagaagatgaccagctctgctgtggatacagaagcacgcttgcctctgtgtcctggatatgatggcctcagatgctggtgtgcaaaactgaaagaacaggaggttggctctgcttagggtggaaagtagtgtgatcagcagctcatagggggagccctttgacagggaggggccgaggaatggtcttccagaggtgcatctgatgccccttgcgctctctgagggttgggtaccattttcaatttcagaagaggacagagattatagaaagacancanangcaantcaaaagattgtcacagctgtgcttttgggatagctcacctt

SEQ ID NO: 1572 - DNA, 343 bp, Mus musculus
  misc_feature (181)..(181): n is a, c, g, or t
aaaccttgcacctcgggccgcagttgctgccgccgctcccagggctgtggctccatacaagtacgcctccagtgtccgcagcccacaccctgccatccagccgctgcaggccccccagcctgcagtccacgtccagggtcaggagcccctgactgcctccatgcttgctgcagcgcccccncaggagcagaagcagatgctgggggagcgtctgttcccgcttatccaaacaatgcattcaaacctggctgggaaaatcaccgggatgctgctggaaatcgacaactctgagctgctgcacatgctggagtcccccgagtccctccgctccaaggtagatgaa

SEQ ID NO: 1573 - DNA, 366 bp, Mus musculus
  misc_feature (203)..(203): n is a, c, g, or t
  misc_feature (238)..(238): n is a, c, g, or t
  misc_feature (240)..(240): n is a, c, g, or t
  misc_feature (253)..(253): n is a, c, g, or t
  misc_feature (265)..(265): n is a, c, g, or t
  misc_feature (280)..(281): n is a, c, g, or t
  misc_feature (326)..(326): n is a, c, g, or t
aaaagagcttcctggttgccttggaagacatcagaacccaggccacacactggaagctggctggtttctgctccagtatgccctcaggaaaggtgaccccaaacttcgaatgcacatcattgacaagtttctcttattgcctttccactctggatgggaccctgaacatggaggcctcttctacttccaggatgcggatggtntctgccctacccagctggaatggaacatgaagctntngtggccacacagngaagccatgatngccttcctcatgggnnatagtgacagtggggaccctgccttgctgcatctcttctacaagntggctgagtacaccttccgccagtttcgtgatcctgagta

SEQ ID NO: 1574 - DNA, 421 bp, Mus musculus
aaggcatggcgcagactagaggtacgttttcccacttgaagatcagaattaaaggaagacctgccaacttcaagttaagcaaaaatccctcccaggtgtgccctccattgttagattttagttcaatccagatggagtcaagttgacaaccaagaatggccaccaccggggacactccgcatctgaactatatactaagcttcatatttcagacgtgtttcttaatgttgttggtgtctccagccctcgtagtgtttgtatcgtattctctgcagtttagcatgccagtgtttcctgtccttcacgtaaatgcctttgtgtgaagcttgcttgacaccccgcccccaccccacctctcaactcccctatccctgtgacactgcacagtaataactgttcgttgttgtttacctgttgcttg

SEQ ID NO: 1575 - DNA, 437 bp, Mus musculus
gactacaccaagctgaccatggacctcggtagcacggggatcatggccaccgccactacatccctgcccagcttcagtaccttcatggagggctaccccagcagctgcgaactcaagccctcctgcctgtaccaaatgccgccttctgggcctcggcctttgatcaagatggaagagggtcgcgagcatggctaccaccaccaccatcaccatcaccatcatcaccaccaccaccagcaacagcagccgtccattcctcctccctccggccccgaggacgaggtactgcccagcacctccatgtacttcaagcagtctccgccttctacaccgaccactccaggcttccccccgcaggcgggggcgctgtgggacgacgagctgccctctgcgcctggctgcatcgctccgggaccgctgctggacccgcagatgaa

SEQ ID NO: 1576 - DNA, 467 bp, Mus musculus
  misc_feature (33)..(33): n is a, c, g, or t
  misc_feature (91)..(91): n is a, c, g, or t
  misc_feature (330)..(330): n is a, c, g, or t
  misc_feature (392)..(392): n is a, c, g, or t
  misc_feature (442)..(442): n is a, c, g, or t
gaggccacaggatagacagagagacgaagcccntcccggggcggctgaagagtccatctggagaatgatagagcggacaccagagtgtgtnctcatgacataccaggtgcccgagaggggtcgagaggaggtgctgaagcaggacctggagaagctccagagcatggaacagcagcagcccctgttctctcccgcgcagagggaggagctggccaaggtgcgctcctggatccacagccacacagcccctcaggagggacacctccagagctgtgtcgcctgtgaagacagaggttcagtgggtgacactgcagaggtcctggaacagcncccagcagaagacaccagttgagcagctgtaaagatgtcacaccccctccaggtcacgtggnacacagagccgtgcgttacctcaccacagtctaactctgaaacgccagtnattgacattaaggtcttccctggct

SEQ ID NO: 1577 - DNA, 384 bp, Mus musculus
  misc_feature (44)..(44): n is a, c, g, or t
gtgcagctttgcttctttgcctctctctccctgaggggaccaanccatcccaacgttaacgttgtcacttgaaaagagaaaggaccaaccggcccccaccccaccccaccccccgcactgctttcgtgaattttgtaaactatgtttgtgtgagtagcgatattgtcagccttctaaaagcaagtggagaacactttaaaatatagaggatttctttttttataagaaaatgctaaatatttatggccatgtacacgttctgacaactggtggcaaatttcgctccttcgttgtaaatatcgctagtgatcgttgccaaatgacgttctggatgggcctgtatccccaccgggcctgcctctctttgtcgtttgttttcggtgg

SEQ ID NO: 1578 - DNA, 420 bp, Mus musculus
ctgtgaagagactgtggctggccctggtgagaggattgtgtccccaacagttgcactgcctgcacagcctgaaagcgctgggcaggaacgggcaccaggcaggtctgggaaacaagaggacaaggggctgcctgcacaccaccgccctcgccgctgcacgtgcttcacttacaaggacaaggagtgtgtctactattgccacctggacatcatctggattaacactcctgaacagactgtgccctatggactgtccaactacagagaaagccttcggggaaagaggtccttggggccagttccagaaagctcccagccttctccgtggacacgcttgcgttgtacttgtatgggggcggatgacaaggcctgtgcacacttctgtgcacgcaccagagatgtcaccagttattccgggag

SEQ ID NO: 1579 - DNA, 421 bp, Mus musculus
  misc_feature (101)..(101): n is a, c, g, or t
  misc_feature (231)..(231): n is a, c, g, or t
agctgacagcatgaaggtcctcctgctgctagcagcctcgatcatggcctttggctcaatacaggtccaagggaacattgcgcagtttggggaaatgattnggcttaagacaggaaagagagctgagcttagctatgccttctatggatgccactgtggcctgggtggcaaaggattcccccaaggatgccacagaccggtgctgtgttactcatgactgttgctacaagngcctggagaaaagtggatgtggtactaagttactgaaatacaagtactcccaccaagggggccaaatcacctgttctgcaaaccagaactcctgtcagaaacggctgtgtcagtgcgataaagccgccgctgaatgtttcgcccggaacaagaaaacctacagtttaaagtaccagttctaccccaacat

SEQ ID NO: 1580 - DNA, 590 bp, Mus musculus
  misc_feature (81)..(81): n is a, c, g, or t
  misc_feature (274)..(274): n is a, c, g, or t
  misc_feature (277)..(277): n is a, c, g, or t
  misc_feature (281)..(281): n is a, c, g, or t
  misc_feature (370)..(370): n is a, c, g, or t
actcgcacctggaaaacctgcagaggctgccgtctggtgctattttgcagcaggttaccttgagctatgggggtcctgagnacccacataatgtggtgaatgtagctggcagtttcaacatacagcaggaccctacacggtttcagtctgtgcactgccttctctacccagacacccactggtgtcctatgaagaacagggttgagggagctttccagtaactgccgactcctggtggctgctctacccggctccctcgggccttagatcatgncgntcancagaagctgcttgaaggcctcccacgacctcggtcccagttggacaccaggtacctctggaaaatgagacaaccgggctgtgcgtgccngagaccgtccaggaagagagaaaggcaaagatgctgagtgcctgatgcctttagcccagccacaggtccttccctggacaaagtctaccaccccagctaccccagagacagtggttcccagcccagccacaggtccttccctggacaaagtctaccaccccaactaccccagagacagtggttcccagcccagccacaggtccttccctggacaaagtct

SEQ ID NO: 1581 - DNA, 539 bp, Mus musculus
  misc_feature (48)..(48): n is a, c, g, or t
  misc_feature (73)..(73): n is a, c, g, or t
tatgtgggcattcatctgcgcattggctccgactggaagaatgcctgngccatgctgaaggatggaactgcanggtcacacttcatggcttcccctcagtgtgtgggctatagccgcagcacagcgacccctctcaccatgaccatgtgcctccctgacctgaaggaaatccagcgggctgtgacgctttgggtgagagcactgaatgccagatcggtctacatcgccacagactctgagagctacgtgtcagagatccagcagctcttcaaagacaaggtgagggtggtgagcctgaaacccgaggtggcccagatcgacctgtacatcctcggccaggctgaccacttcattggaaactgtgtctcctcgttcactgccttcgtgaagcgggagcgggacctccatgggaggcagtcgtccttctttggcatggacagaccctcccagcttcgggatgaattttgatcccatctgaagcccccacctcccaccctcaaccaggcttggctgctaaggatgctcctgggattacacat

SEQ ID NO: 1582 - DNA, 528 bp, Mus musculus
ggaaccaaagatctgctccatgcacccgaagaaggatctttcattttccaaaacggagagattgtggaccacagtgaggagagcaaggataggaccatcatgctcctcggagtgtcctcccagaaaatttcagttcggctgaagaggactgttgcccacaagagcacccaaacagaatcgttcccgtgggttggtggcgagacgacccctggtcactttgtgctgtcttctccaaggaagtcggcgcagggcgctctttatgtgcacagtccagcatctccatgccccagcccagcactggtccgaaagcgggcattcgtcaagtgggagaacaaagagtcccttataaaaccaaaaccagaacttcacctccggctccggacctaccaagaactggaacaggaaataaataccctgaaagcagataacgatgctctgaagatccaactgaagtacgcacagaagaaaatagaatccctgcagcttgggaaaagcaatcatgtcttagcccagatggaccacggtgat

SEQ ID NO: 1583 - DNA, 437 bp, Mus musculus
  misc_feature (30)..(30): n is a, c, g, or t
  misc_feature (36)..(37): n is a, c, g, or t
  misc_feature (52)..(52): n is a, c, g, or t
  misc_feature (55)..(55): n is a, c, g, or t
  misc_feature (61)..(62): n is a, c, g, or t
  misc_feature (72)..(72): n is a, c, g, or t
  misc_feature (91)..(91): n is a, c, g, or t
  misc_feature (101)..(101): n is a, c, g, or t
  misc_feature (103)..(104): n is a, c, g, or t
  misc_feature (148)..(148): n is a, c, g, or t
ataaagatcagacgctccttctctatcttnctgggnnactcacaggggctgnggngtcatnnctcccactgnccctgccttgccctccctnctctcaccantnnctctgtgtgttgtggtttgaatgttggtttcatgtcggttcaangcctcacctcagtttccaggatgttccttccccagcccctaccctaacagctagggaccaaaaccctggaggccaaagggctgtaatcaccccctgtacccactggcaactttgcccaccagcagggttgtccaccccaccccctccatgcctgagacaggacctgctgggtcactctagcctgtcctgagaacatctaaaacagaggcacaatgaatgaggggatgcttcccaggcagagcctggtggcttagccaccatatcacctctttctgcatggccctggaaa

SEQ ID NO: 1584 - DNA, 443 bp, Mus musculus
  misc_feature (92)..(92): n is a, c, g, or t
  misc_feature (120)..(120): n is a, c, g, or t
  misc_feature (188)..(188): n is a, c, g, or t
acagggtatgcgaggccagtagctagaactgttttctgtcagcaatgtcaagctgcagaaggatgatctctacagtataatctctcctctgnaagctaatccccacaacctttttttttnctttaacctcaactcactttcttctgttcacctgtatttcctcctttccagaaatgcctccgggtaanaagggagaggtccttacctgggcaagggtggtaacatatgtaatcagtccccaaggaaaactagcatgtgggactcacttaataagtagctttgaatgccaaaactatgtatgcttttaaataccatcgatgtagctcttgatagttggctcgttgtgtgtgtgagtgtgtgtgtgtgtgtgtgtgtgtgtgtctgtgtgtctgtgtgtacgtgtgcgtaaactaaacatatggctacattatctgtgtgttaac

SEQ ID NO: 1585 - DNA, 124 bp, Mus musculus
tgccttcagccacctatcctgggaacaggaatactgtgtgtacatctgtggtgagttgggaagaacactggatgggtgtccgtaaaattctggaatttgggaattaacatcctcccacaccaga

SEQ ID NO: 1586 - DNA, 502 bp, Mus musculus
tcggcgcttcccttgtgaattttaaccttaccttctcatggcccatgagtaaagtgagtgctgtggagtcactcagtgcttatcccctgagcagcagctgtgtcatcctttcctggacactgtcacctgatgattatagtctgttatatctggttattgaatggaagatccttaatgaagatgatggaatgaagtggcttagaattccctcgaatgttaaaaagttttatatccacgataattttattcccatcgagaaatatcagtttagtctttacccagtatttatggaaggagttggaaaaccaaagataattaatggtttcaccaaagatgctatcgacaagcagcagaatgacgcagggctgtatgtcattgtacccataattatttcctcttgtgtcctactgctcggaacactgttaatttcacaccagagaatgaaaaagttgttttgggacgatgttccaaaccccaagaattgttcctgggcacaaggact

SEQ ID NO: 1587 - DNA, 474 bp, Mus musculus
  misc_feature (57)..(59): n is a, c, g, or t
acacacctgcttttgatgctaaggattaattaagcccagggtcttgcatatgctggnnnaatactctgtcacctccccacccgatggtccctttaaaaaccacacgacaccagcacttcactgactctcatgaagaaaactcctgataattctggaagcatggagtgatatgctgcgtctgggaaagtctgtgtagctctgactgtcccagaattcacaatgtagaccaggctggcctcaaattaagagacggctgcctctattgcatcttgggcagtctgtgtcttaagcgcctggcttggtaacacagaggacactggctaaataatagaacaaatgcctaaaattctaagattccatcttagagatgcaagtgaggcctcctaggcagtgcttgaaagcgctttgaaaagcaatctagggaataaagctttcatttcaaaatctaaggctaaatgttctccttgcaaatca

SEQ ID NO: 1588 - DNA, 536 bp, Mus musculus
tgaggcacttctgcaaatctctcttccccgtggtggactacgcctactgtagcattcctacctatcccagcggccagatcggcttcatgctgtgtagcaaaaacccgagcaccaacttccgggagccagtgcagcagttgacacaggcccaggtggagcagatgcagctgaaatactataactcggacatgcaccgtgccgccttcgtactgcctgagttcacccggaaggccctcaatgacataagctgaatccaggtgccactgtgacaccacccgagacctcaatcggattggaccaaggatcttccaagttgtctggggaccaccagtcctggaccagactcccagatgactcttgcccaccaaccaagtgttacaggccccatgatgctgcctggcctggcctggcctggcctggcctggcctgccctgctgggtggactcagtctctgtctgtctatctctgtggcgttcagccccacgcctataccagctctgtacagcaccgcctatgccctgtgacccaacaaaata

SEQ ID NO: 1589 - DNA, 594 bp, Mus musculus
  misc_feature (123)..(123): n is a, c, g, or t
  misc_feature (180)..(180): n is a, c, g, or t
  misc_feature (183)..(183): n is a, c, g, or t
  misc_feature (260)..(260): n is a, c, g, or t
  misc_feature (277)..(277): n is a, c, g, or t
  misc_feature (286)..(286): n is a, c, g, or t
  misc_feature (324)..(324): n is a, c, g, or t
  misc_feature (391)..(414): n is a, c, g, or t
gagaaacggtttcttaccagcaattagcagccctggcaggcaaccccaaagcggctcgtgcagtaggaggagcaatgagaagcaatccggtccccatcctcatcccctgccacagggtggttngcagtgacggtgccatcggccattactccggaggagggcaggctgtgaaggagtggnttntggcccatgagggcatcccgaccggacagccagcctccaagggcttgggtctgactgggacctggctcaagtcatcnttcgagtcgaccagctntgagccgtntggccgaaattgagtaaccgtttgaatgacacatagangtaacgcgtgtcggaagcggatgtgtggtggcaccactatattaaaagagctgcaagtgtcctgggnnnnnnnnnnnnnnnnnnnnnnnntgtttctacattttacagcagaatgagttcagacgacccacctcgagtgtgtcatcagttccctcctctgacatggttattgttctatttttaatgcccattaaaatgggggtgagcgaggaaggcctgatgagccttagggcccctttgtatgaagggagacacatctgacacctgcag

SEQ ID NO: 1590 - DNA, 144 bp, Mus musculus
cctcccaagaagatcgagatatcccactgatgaggactttaggcgggtgtctgttggaagacctcagggaagttccagagaaggaccttcgacttcctaaaaattttagatcttctggagaaggagttgtggaccccacctgat

SEQ ID NO: 1591 - DNA, 404 bp, Mus musculus
  misc_feature (112)..(112): n is a, c, g, or t
  misc_feature (121)..(121): n is a, c, g, or t
  misc_feature (126)..(126): n is a, c, g, or t
  misc_feature (135)..(135): n is a, c, g, or t
  misc_feature (206)..(206): n is a, c, g, or t
  misc_feature (213)..(213): n is a, c, g, or t
  misc_feature (267)..(267): n is a, c, g, or t
  misc_feature (274)..(274): n is a, c, g, or t
  misc_feature (292)..(292): n is a, c, g, or t
  misc_feature (313)..(313): n is a, c, g, or t
  misc_feature (323)..(323): n is a, c, g, or t
  misc_feature (330)..(330): n is a, c, g, or t
  misc_feature (342)..(342): n is a, c, g, or t
  misc_feature (357)..(357): n is a, c, g, or t
ctgctgaacctgaagtccatggtggaggccatcacacacagaaactccatcctgtcctttgtgggctacggctgctactgcgggctggggggacgcggccatcccatggatngaggtaganctggntgctgccangcccacgactgttgctatgagaagctctttgagcagggctgccgcccctacgtggaccactatgaccacangatcganaatggcaccatgattgtctgcactgagctcaatgagacggagtgtgacaagcanacatgcnagtgtgacaagagcctgnctctgtgcctcaaggatcacncatacaggancaagtancgaggctacttnaacgtctactgccanggccccacacccaactgcagcatctacgacccgtacccagaggaagt

SEQ ID NO: 1592 - DNA, 368 bp, Mus musculus
actttttcctgcgtgtggaccttggtggtcgggtgcaggggacgcgttggcggcacggccaggacagtatagtggagatccgttctgtccgtgtgggcactgtggtgatcaaagctgtgtactcaggcttctatgtggccatgaatcgcaggggccgcctctatgggtcgcgggtctactctgtggactgtaggttccgggagcgcatcgaggagaacggctacaacacatacgcctcgcgacgttggaggcaccgcggccgacccatgttcctggcacttgacagccaaggcattcccaggcaaggcagacggacacgacggcaccaactgtccacacacttcctgccagtcttggtctcgtcttga

SEQ ID NO: 1593 - DNA, 549 bp, Mus musculus
  misc_feature (30)..(30): n is a, c, g, or t
  misc_feature (53)..(53): n is a, c, g, or t
  misc_feature (61)..(63): n is a, c, g, or t
  misc_feature (75)..(76): n is a, c, g, or t
  misc_feature (105)..(105): n is a, c, g, or t
  misc_feature (109)..(109): n is a, c, g, or t
  misc_feature (138)..(139): n is a, c, g, or t
  misc_feature (144)..(144): n is a, c, g, or t
  misc_feature (156)..(156): n is a, c, g, or t
  misc_feature (159)..(159): n is a, c, g, or t
  misc_feature (161)..(161): n is a, c, g, or t
  misc_feature (176)..(176): n is a, c, g, or t
  misc_feature (181)..(181): n is a, c, g, or t
  misc_feature (195)..(195): n is a, c, g, or t
  misc_feature (211)..(211): n is a, c, g, or t
  misc_feature (213)..(214): n is a, c, g, or t
  misc_feature (216)..(217): n is a, c, g, or t
  misc_feature (219)..(221): n is a, c, g, or t
  misc_feature (238)..(239): n is a, c, g, or t
tgtgcaggcgtgacgagtactcctagcaanctgtgctaccttccaagctcaantcattttnnntttcaatcagtnnttaatgagcacaaagggacagtatgagtngccnatcagcctgggacctaatctctccatacnnccatntgtgctttctgnttncngtgcgggctcctccntctcntgtgtgtgggtgtnctccaagggtctccantnntnntnnngggccagttctttcacnntgagttctggaacctacttctctaagttcctggctctcgctcggccctagtgatctgcttctgttcatgatgccaccattctgctgaccttctagactggaaatctcagagctgtctggtgggctctgtgcacttgaccctgccctctccctcatctcctgtaatctggcctgtcttacatttccagagcctccagcctagcccatgcctcttaacgtcccattcccaatgtgacttctcagcacttctctctggcaggctactgtgctctggccttcctctgctaaaagccttcagagagtctggctgc

SEQ ID NO: 1594 - DNA, 596 bp, Mus musculus
  misc_feature (84)..(85): n is a, c, g, or t
  misc_feature (338)..(338): n is a, c, g, or t
  misc_feature (353)..(353): n is a, c, g, or t
  misc_feature (527)..(527): n is a, c, g, or t
acctgtattcttatgtgatgccccaggccatccgggacatggtggacgagtacatcaactgtgaggatatcgccatgaacttcnntgtctcccacatcacacggaaaccccccatcaaggtgacatcaaggtggacttttcgatgcccagggtgccctcaggccctgtcccatgatgactctcattttcacgagcggcacaagtgtatcaacttttttgtcaaggtgtacggctatatgcctctcttgtacacacagttcagggtggactccgtgctcttcaagacccgcctgccccatgacaagaccaagtgcttcaagttcatctagggccttgcnagttctgaggagacnatgagcagagcgagggggagtcaccctcaaggttcccaaggtgtcgaaggtccttggggacatctgtcgggcagggccaagaccctttgctgggagaggcagcaggaagagtggaaagggatagctgtctttcattttgaagtcagccacactgggcctgggatcctggtcagnagactcagggcgtctgcacagggcactgactgatagcgaacactgaggactgttcataagcccaggaca

SEQ ID NO: 1595 - DNA, 565 bp, Mus musculus
aataatttccccagttgctgagcgtcctggggaaagatctgaggtggaccctgagaaccatgtggtcgtgtcttactgcccacccatcatcgaggaggaaataacgaaccccgccgccgatgaagtgggaggggcttcccaggtggtgtacatcgatgtgcagtccatgtatcagccgcaagccaaagcagaggaagagcaggacgtggatcctgtggtggtggcaggctataagccacagatgcgccttcccatcagccccgctgtggaagacacagcagcagaagatgaagagggtaagaccgccggttacagacctcaggccaatgtaaacacttggaatttggtctctccagattccccgaggtccacagacagcaacaacgaagttgtctcttttggaagtccgtgctccatcaattccaggcaattcttgattcctcctaaagacgaagactctcctaaatctaatggaggagggtggtcctttacaaacttcttccagaacaaaccaaatgactaaccaggtcaccctttgtcacttcagtctgccatctcagtaagt

SEQ ID NO: 1596 - DNA, 496 bp, Mus musculus
  misc_feature (30)..(30): n is a, c, g, or t
gaatcttcttttctcatgcggagtgtccgncaagcatgcagcattgaatctgatgcctcttgtccttctcaggaacatgatgggtctgtaaataaccagtgttccctccatccttacaaggtcagcttccaccaactaggctgggatcactggatcattgctcctcgtctctataccccaaattactgtaaaggaatctgtactcgggtattaccctatggtctcaattcacccaaccatgccatcattcagagccttgtcaatgaactagtgaatcacagtgtacctcagccttcctgtgtcccttataattttcttcctatgagcatcctcctgattgagaccaacgggagtatcttgtacaaggagtatgagggtatgattgcccagtcctgtacatgtagataatagtgaagttgttgctatctcaggtttcccaagaagctatagatgtttaaagaaaactgtgttaaagctggcagtgatctacccaacc

SEQ ID NO: 1597 - DNA, 534 bp, Mus musculus
agaaacatctgttccctttgggtgtcaatgtacactgctgattctggtctccatgcactcacggctggtctgggaaagttggaactactttgggttatggtgccctggaattgtttgccttgctgaatagcaaaagatccctttccccaatgcacagcacccactttctgtattttgtttgtttgtttgttttaactcaaaatcaagtgacaaagatgtctgctggagtggacttataagcaagaagccaggcccaaaaggaagagccaagaaggcctgcggatgttttcctgtcctggtgtcagcactcaccaaagaaattgacaatcagactatttggaaggaagagttttattcctgtagtttgttggcttttctgtaagttctggaaaggccttgtggactgcagaaggcgcccactgctggccagggagggctcattgagggtgctgagatgcccgggatggctcacctcaccctcagtttcttttctaggagtgagctatgccagagcagctcaccttgagtttgcag

SEQ ID NO: 1598 - DNA, 360 bp, Mus musculus
  misc_feature (95)..(95): n is a, c, g, or t
  misc_feature (97)..(97): n is a, c, g, or t
gggcagcactacacccatcaagttcaaatatccagatgatctccagtgtgtgaacctcaagctcctgcctaatgaggactgtgacaaagcacatnanatgaaggtgacagatgccatgctgtgtgcaggagagatggatggtggctcatacacttgtgagcatgactcaggaggcccactgatctgtgatggtattctccaaggtatcacatcatggggccctgaaccatgtggtgagcccactgagccaagtgtctacaccaaacttattaagttcagctcctggataagagaaactatggcgaataacccctgagtgtcacattgttcccttttctcaataaagtccaccatgttgtg

SEQ ID NO: 1599 - DNA, 588 bp, Mus musculus
  misc_feature (40)..(40): n is a, c, g, or t
  misc_feature (130)..(130): n is a, c, g, or t
  misc_feature (217)..(217): n is a, c, g, or t
  misc_feature (323)..(323): n is a, c, g, or t
  misc_feature (325)..(325): n is a, c, g, or t
ggaggatgaaccttctgaccaacaccggcttgtcagcaangccatccctcaccctgacttcaacatgagcctcctgaatgagcacaccccacaacctgaggacgactacagcaatgacctgatgctgctncgcctcagcaagcctgctgacatcacagatgttgtgaagcccatcaccctgcccactgaggagcccaagctggggagcacatgcctngcctcaggctggggcagcactacacccatcaagttcaaatatccagatgatctccagtgtgtgaacctcaagctcctgcctaatgaggactgtgacaaagcacatnanatgaaggtgacagatgccatgctgtgtgcaggagagatggatggtggctcatacacttgtgagcatgactcaggaggcccactgatctgtgatggtattctccaaggtatcacatcatggggccctgaaccatgtggtgagcccactgagccaagtgtctacaccaaacttattaagttcagctcctggataagagaaactatggcgaataacccctgagtgtcacattgttcccttttctcaataaagtccaccatgttgtg

SEQ ID NO: 1600 - DNA, 289 bp, Mus musculus
  misc_feature (87)..(87): n is a, c, g, or t
gtattgtccactgaacaccaagcatcccccactactttcctgttttgaaatatgctccaggcggcctcttcccagtctgtaagaccncggtcatgtgcttgccaactgctgagtgttactgccatggaacctttcttgtctgtcccgtgcagcttggtttccacagccggttgcatatcttctgttgcttgcaaacacaaaatcaccagcccaaacgagtgatttagctcactagccattaaatggcatctcgtggatgatgacagcaactcttacagccaggaaactt

SEQ ID NO: 1601 - DNA, 404 bp, Mus musculus
agagaaggttgagactccgtccccgcccacggcctcagctctggattaccccagtgagaatctggccttcatcgacgagtcctcagacacgcagagtgagcgtggctgtgccctgcctcgggctcctcggggtcgccgccgacccaacccatccaaaaagccttccagaccccggggtcctgggcgactccgagacaaggccgtgccggtgtaggggcaggatctctggacccggatcccacgccagggctttcgctcttgctgatgctcaggcatgcttggcttatttgaccaaagagccgtccctcttttgttccacgtggttgcaaccctgacaggagtccagtggttgccaaatgccaccgctcttccctggctggttcttcacatccaatcatttccaa

SEQ ID NO: 1602 - DNA, 553 bp, Mus musculus
agctttgtcttcactgttttccaaatggaaagtaagaggtccagaaagctgcctctaagggctctcacctgccattgatgtcctttcaggcccaatgacatggtttccctccatcctattgcgtactgtctgctacccaggtggcaagagcaccttgggagaagttacaggcagcttcatgctttctgtgctgttcagttcaaaagcaggtgccttgagaatcctgaattcaagcactctgtagaacatggacagacaagatgggtccttctctggccataggcatgagggccagttgctgaggactgctctcactacacctaagtgcacaagtgataagaagttggacagatagacagatagcagcagtcccattgctgtagccagaatgcacttatttcctgttctgaccctgcaggcccagcttttggggaccacagccatgttctgcacgggacctctcaacctggcattcatgccctttcacgacttagcaccggcctgcccttctttcttccccacaactatacaagagctgttgcaaccactgaaa

SEQ ID NO: 1603 - DNA, 445 bp, Mus musculus
agcggataactcagccacaggctttggcaccggcactcgggctctggagcaagccctggagaagacgagagccaacatcgactgggtgaaggagaacaaagatgcggtattcaagtggttcacagagaacagcagttagttcctggttctgagaaccacttgtcccagtatgacacctcttactatctcagcagcctgtgcagggtctctgtcctcagagctccagacaccagcatcctactctcaaggatgaagtctccagcctgtggagccagcctagctcctaactgtcaggctgacggacacctcccaggtcttgcaccctcatgccaactctgccccaggtccaggcctctggggctgatctcagggaagcccagctctgaagctagatttactggacaaagggcagcctggaaagagactccctgaatgctttactatc

SEQ ID NO: 1604 - DNA, 489 bp, Mus musculus
gagccaaatgttactcctctgtgacatcatgtcactggcaggcctcagctaagcagtgaccttcctaaacaccaaagatactccagtcacacccaaggggtctcggagtggtagaggtctgtagtaggcaggttggcaatcattttctgattactttgtatcatagcagcgtctaactttgtctccttctccgcgggagctttgatcttctgagccaagacaggcaaatcaaggtttttggatctgtgcctcttaaggaagggcataggaaggagaaaccagaccctaatacctggttctcaaataggcagggttcagaacatctgccagatgcgttctctgataagtaaaccgtcaccggctccagcccaacccaccaaagctctgaaactggtgctaagaggatgtccagagccgttaacctattgaatttcatggcagtctgaaactatgtcccttctcccaggtcctgacctcgatgatggctga

SEQ ID NO: 1605 - DNA, 547 bp, Mus musculus
aagaggtggcgcagcgtatcaccaccgagctcaaacgttacagcatcccacaggccatcttcgcgcagagggtgctctgccgttcccaggggaccctttcggacctgctgcgaaaccccaagccctggagcaaactcaagtcgggtcgggagaccttccggaggatgtggaagtggctgcaggagccggagttccagcgcatgtcggcgctccgcttagcagcctgcaaacggaaagagcaagaacatgggaaggacagaggcaacacccccaaaaagcccaggctggtcttcacagacgtccaacgtcgaactctacatgcaatattcaaggaaaataagcgtccgtccaaagaattacaaatcaccatctcccagcagctggggttggagctgagcactgtcagcaacttcttcatgaatgccagaaggaggagtctggacaagtggcaggacgagggcggctccaactcaggcagttcatcgtcctcatcgagcacttgtaccaaagcatgagggaggaagaaccacggactagtacctcggtg

SEQ ID NO: 1606 - DNA, 568 bp, Mus musculus
  misc_feature (58)..(58): n is a, c, g, or t
  misc_feature (71)..(71): n is a, c, g, or t
  misc_feature (191)..(195): n is a, c, g, or t
aacccctccttacagcgtgaaagagcaggaggaaatgcttctcatgtcctcccctttnatagcaccagccntaaccaacagcaaagaaagacacaattctgtggagtgtttagatggactagatgacattagcacaaaacttccatcgaagctgcagaaaattacggggagagaagactttcccaaaaaannnnncttctgagaatgagttctacaacctcagaaaaagcctatagtttgggtgatttgcccatgaaactccaacgaataagttcagttcctggcaactcggaagaaaaactggtttctaaaaccaccaagatgttatctgatcccatgagccagtctgtggccgatttgccaccaaagcttcaaaagatggctggaggacctaccaggatggaaggaaatcttccagccaaactaagaaaaatgaactctgaccgtttcacatagcaaaacacccctttaggcattatttaatgttttgatttagtattagtccaatatttggctgataagataatcctccctatgaaatctgagaggtctatcctagcctggcaaa

SEQ ID NO: 1607 - DNA, 521 bp, Mus musculus
aacagaagctggttgcttgcaaaacatggcttggctccttttttttccagaaatatctataatatgtaaaccaagggacaacttgtatttacattcctaaaatgaaaagccaactctaaaaaagagtcccatgtgtgaggaatggactccatttataacattggaagccagtgtaatataaaacaaactgctaaatattgactttttcagagatgttgctgaggacacagaagaaacactcaatagaaaatgttaaggcgaaaagcaaccaaatgtagacccatgtatggctatggagcaatggcttatgcccagatttcccatttcatagaaattctgattcttgttaatccaattttggtcattatagtgtcattctaccatagaagagagatcttttttgtgggaaaaatgctcattttattaaagtattaactattacaaatgtataaaggatggcatttattcttgatatacatgttttgaatcaagtgtatttgcttagggttaactgtctttgt

SEQ ID NO: 1608 - DNA, 549 bp, Mus musculus
ggagtaagactcctggcctttctctcagccgtgggccctgctcagcagcagacaccttcctgaatctccagacttctgtccacttttgtttcacaaaaacctaatcaatgattttagcttcagagacaggaagattgttatgctacacagtgagttcaagaccaacctgggatatacaaaaagactctgtctcaatcaaaagaaaacactctccaaggctctatgagcagctggtggctgctaggaaagaaacatttttttaaacatttatttacttattgtatgtgcacgtgtgtgaccgtgagttagtgtacatgcatgccagggtgtgcatgtggagggcagaaaataacttctgggaattaattttctccttctaccgtgtggtggttacagattggactgacgtcatccgacttggcagcaagtgcctttacccactgattcatcttggtgacccatgggggaaaaccattttctttagtggatgagccattgttaagttattctgcaaataactctctcttggtcctgtgtgaaccttaataa

SEQ ID NO: 1609 - DNA, 514 bp, Mus musculus
  misc_feature (344)..(344): n is a, c, g, or t
  misc_feature (348)..(348): n is a, c, g, or t
  misc_feature (350)..(350): n is a, c, g, or t
  misc_feature (355)..(355): n is a, c, g, or t
  misc_feature (357)..(357): n is a, c, g, or t
  misc_feature (384)..(384): n is a, c, g, or t
  misc_feature (459)..(459): n is a, c, g, or t
  misc_feature (464)..(464): n is a, c, g, or t
  misc_feature (469)..(469): n is a, c, g, or t
  misc_feature (486)..(486): n is a, c, g, or t
  misc_feature (489)..(489): n is a, c, g, or t
ggatctatgactctctgtggctgacttctgctgagctgagctgacctctggatattactctagtccctcatggtctgagctggctgtcttgtaagctgggaacacagcatggaaggtggatgggagcagagtcactctcctgtctgcaggtcttgcagaaccctctgttctcagcccagcatggaaggagccataaggagaaaggtgttgctgctttctccagccaggtctacacaacttagacctgttctgagatgtctaagagcagggcactgggagaaggttaggggtctcagccgagggaaggagatgcccaccggtgctcactgagaacacaccacaantctntncatgncnggggcatttctacctgggtcagtgaanacgcctccaccaggcacctcctctctgctgataggtcacagaccaggtgtccctgctcctgtctcagccaagggngaggngacangtagctgctgtctgtgnacngctggcccaggcaaggactgactgt

SEQ ID NO: 1610 - DNA, 522 bp, Mus musculus
cctcagaaggttttgtggcgatacaaaggaaagataccagacacattaggatccaatacaagactgtttgattggattcctcagaatgatcttcttggacatcccaaaaccagagcttttatcacccatggtggaacaaatggaatctatgaggctatttaccatgggatccctatggtgggagtgcccatgttcgctgaccagcctgacaacattgctcacatgaaggccaaaggagcagcagtggaggtgaacatgaacacgatgacaagctcagatctgctcaatgctctgagaacagtcatcaatgagccatcttataaagagaatgccatgagactatcaagaatccaccatgaccagccagtgaagcccctggaccgagcagtcttctggattgagtttgtcatgcgtcacaaaggagccaagcaccttcgtgtggcagcccatgacctcagctggtttcagtaccactctctggatgtaattgggtttctgctggcctgtgtggcatctgctata

SEQ ID NO: 1611 - DNA, 461 bp, Mus musculus
  misc_feature (327)..(327): n is a, c, g, or t
  misc_feature (329)..(330): n is a, c, g, or t
  misc_feature (334)..(334): n is a, c, g, or t
  misc_feature (336)..(336): n is a, c, g, or t
  misc_feature (338)..(343): n is a, c, g, or t
  misc_feature (347)..(349): n is a, c, g, or t
  misc_feature (351)..(352): n is a, c, g, or t
  misc_feature (354)..(363): n is a, c, g, or t
  misc_feature (368)..(370): n is a, c, g, or t
  misc_feature (373)..(373): n is a, c, g, or t
  misc_feature (375)..(377): n is a, c, g, or t
  misc_feature (379)..(380): n is a, c, g, or t
gcccacatatagcttcagttacattagctgcttatgaatgcaattcggtgaatttccctgagccaccctatcctgaccagattatctgcccagaggaagaaggcgctgagggagccatttctttgtggagtatcatctcaaaagttagaattgaagcctgcatgtggggcattggaacagccattggagagctgcctccatatttcatggccagggcagctcgcctctcaggtgctgaaccagatgatgaagagtatcaggaatttgaagaaatgctggaacatgcagaggctgcacaagactttgcatcacgggctaaactggcantnnaaanantnnnnnngaannntnnannnnnnnnnnttttnnnctntnnntnnattccaaaccccctgtttgacctggctggaataacgtgtgggcacttccttgtacctttctggaccttctttggtgcaacc

SEQ ID NO: 1612 - DNA, 534 bp, Mus musculus
aaggacttacaatccaccagagcctcgcaatagcaagatatttgaccaaaaacacagatttggctgggaagacagcgttggagcaatgtcaagctgatgcagtggtggacacgctggatgacttcatgtctctcttcccatgggcagagaaagatcaagatctaaaagagcggatgttcaatgaattgctcacacatcaagcacctcgccttctgaaagatttggacacatacttaggagacaaagagtggtttataggcaattatgtaacctgggcagacttctactgggatatctgcagcaccacacttttggttttaaagcctggcttgttggatatctaccccaaactggtgtcattacggaacaaagtccaagctatccctgccatttctgcctggatactaaagaggccacagacaaaactctagatgaatcaggacccatcatcagatgagaactccattagctggctagaggatccacatacttctcaccaataggactgtaactttgtagtactctgcttgctgt

SEQ ID NO: 1613 - DNA, 562 bp, Mus musculus
  misc_feature (430)..(430): n is a, c, g, or t
  misc_feature (509)..(509): n is a, c, g, or t
actccaccagcttcttataatgcagatggtgagcaggcagcttgggagaatgagctgcagcagatgactcaggagcagcttcagaacgagttggagaaagttgaaggggacaacgccgagctgcaggagtttgccaacaccattctccagcagatagccgatcactgccctgacatcctcgaacaagtggtcaatgccctggaagagtcctcctgatgtgctcctgacaaggagggtgaccaaggagccagagagggaacctgaggaacaggtgtctgagccgccaccacaccagactctgccagctggatgtgccagtccggccgtcggtgtctgtcatcgtactctgccttctgctttgaatgttgcctgctcaagtctccctggtctccatgaagaactgcccttggcatcagcagtggagtgctgngagctgcactctgcccttccagaaacaggaagccagaagccactcagctcatctggagcccactcagattccgtgctcngggagcttggagctgaagctttagcacgagtgctttctcctcagagggttaca

SEQ ID NO: 1614 - DNA, 559 bp, Mus musculus
  misc_feature (141)..(141): n is a, c, g, or t
  misc_feature (151)..(151): n is a, c, g, or t
  misc_feature (158)..(158): n is a, c, g, or t
  misc_feature (161)..(161): n is a, c, g, or t
  misc_feature (178)..(178): n is a, c, g, or t
  misc_feature (187)..(187): n is a, c, g, or t
  misc_feature (193)..(193): n is a, c, g, or t
  misc_feature (197)..(198): n is a, c, g, or t
  misc_feature (229)..(229): n is a, c, g, or t
  misc_feature (249)..(249): n is a, c, g, or t
  misc_feature (267)..(267): n is a, c, g, or t
  misc_feature (273)..(273): n is a, c, g, or t
  misc_feature (277)..(277): n is a, c, g, or t
  misc_feature (279)..(279): n is a, c, g, or t
  misc_feature (282)..(282): n is a, c, g, or t
  misc_feature (289)..(289): n is a, c, g, or t
  misc_feature (307)..(307): n is a, c, g, or t
  misc_feature (385)..(385): n is a, c, g, or t
  misc_feature (517)..(517): n is a, c, g, or t
tgtcaagcacgctcacagtcaatgccatcatctttagcttatgcaaaccttaagatcatttacccaaaatgtgcttctctgtctgtcattcctttctggttgggactcagtgaaaaagtttctctttcaaaacagctcagnaaacagcttnccctttntgnaagcctgaacttttcgnaagtaatcntaattnttgnncctgttacttggaccaccatttttcttagcncttgttattatgtttcctgngcaacattagtgggttantgtttntcantnctnttcatanataaatcccattgaagtnagctctgttttgaattgaaccctgttgtcccagacctcagtgctgggaaagttggggagtacacaatgaatgagaaancattccgaagtaagcttacttgctgggctgctaagatggctcagtggaggcagacacatgaccaccaggcctgacaacctgagtttgatccccaagacccacatggtggatgggagaacgggtttctttaanttgtctttttgacttccatatgtgtggtatggtgtgcaccca

SEQ ID NO: 1615 - DNA, 591 bp, Mus musculus
aaacagtgcctgagtgtaccattcactttcatggctttcttactaatgacagtattatccccatcaaaatccacagccgatctgatgcctgtgatgatgaagactccgaagaaagcctaagctctgaggagagccatggccatggaagcagccacactggaaggctcaagctccagattagccagaggtgtgtgcaagaagcaagttgggaccttgataaaattgagatcttacaggatgacatcagtatcacgagcagctggcttggccttgatgaacaatgcaagggggatgctgacagtatctggagccttactgatgaggagctcatggcctgtgaccaagagaaggacagtagctcagagtctgaggagaattgctccccaagccctgggtgctccttcaatgaagggttctcttttcagctctttaaacctaaccgggtccccaaggttgatagatggtcccgtttcctctttcctctttcctttgggctgttcaatgtggtttactggttataccatgtctattagtttctcatacaccacagccgcggagatactatgatatgtttcctttatggtttcttcg

SEQ ID NO: 1616 - DNA, 528 bp, Mus musculus
aaatgctgtgcgttaggagccgctctgcttttgaacaacagcatcaccatctgctgcattgtctggagaagactacgtgtcacgagttcacagacgagctaactttcagtgaggcccttggagcagtctcactgggtggtcgcaccagccgcagtacctcagtatcatcccaaccaatggggcctgggagcctgttctcatcctgctgctctcgaagggtcaatcgcagagccatccgccttgccaactctactgcctctgtcagccgtggcagcatgcaggagctagacacactagcaggtcttcggaggagccctgcccctcaaacccgctcaagcctcaatgccaagccccacgacagccttgacctgaactgtgacagccgggacttcgtggccgccatcatcagtatccccaccccccctgccaacacgccagatgaaagtcaaccttcctcccctagtggtggtggcggcagtggtggcacacccaacaccactctcaggaactccagcttgggtactccgt

SEQ ID NO: 1617 - DNA, 533 bp, Mus musculus
tgagtagctactgggctctttctattcaaaaacccattgtagcttagctgactatctagggttggccctgggagtaccaagaaagggtaccttggttatccttggtcctccctaggtgacattgtccccaggtatacaagaaggaagggtgtaaagaaaccttaacattggctcctttgttgccagacatgggaagcaactgggacagatgcctcaaggtctaggaggagaataggcaacagaggcacttgggcttcccattctggcaagtactctgcaggtgaggaagactcccagggagctggaagaaggaccaggataggaccaatagaccttcctgtcattcctccctctgtctgtctccctaataaaagttgcagttcattttccacatggaaaaaatttccttggaccaggtatatggtgggcacagaagctgaaatacaaagattcgcacacccatagacatacctatgttcaggaatctgtgatataagcaaccaagactgtatttttgagagcaggtccccagg

SEQ ID NO: 1618 - DNA, 545 bp, Mus musculus
agagtctctaatgttgcctactcccacggacaagaacaggcaaagaaggagaaagtatacaaggagatgacccagctgaagtctcaaataaaccgcctgtgccgcccttgcccctgggactggacagtcttccaaggaaactgttacttcttctccaagttccaacagaactggaatgactctgtcaatgcctgcagaaaattggatgcccaactagtggttatcaaaagtgatgatgaacagagcttcctgcagcagacttctaaagagaaaggctatgcctggatgggcctgtcagacctgaagcatgaaggcagatggcactgggtggatggctcacatctgctgttcagtttcatgaaatattggaacaagggagagcccaacaatgaatgggaagaagactgtgctgaattcagaggcgatggctggaacgatgccccatgtacaattaagaaatactggatctgcaagaagtctgctatgtcctgcactgaaaaatgatatgtcatctatctgtaacacctgttggcaaaatgaccctg

SEQ ID NO: 1619 - DNA, 467 bp, Mus musculus
cttcctaggcgcagagctgggttgcgccaaggctttctaccccgcgtccttgagtccccccgcagctggcacagcggctagcctgtccactgcactcctgcgtcagggcctcaagacggacgccggcggtggtgcgggtggcgggggcgcggggacaggccagaggccttccttttctatagaccacatcatgggccacggtggtggcggggccgcacccccgggcagcggcgacggttctccgggatcgccattcgccgcagccgcaggtcctgggggtcaagcccaagtcttggccatgctgactgccccggccctgactccggtggctggccatatccgcctctcgcacccaggggactcactcctgtcttcagggccctcgtttgccagcaaagtcgcgggcctcagtggctgccacttttgaccgcaccgggctccgggccagttaggccttcactccttaa

SEQ ID NO: 1620 - DNA, 499 bp, Mus musculus
  misc_feature (364)..(365): n is a, c, g, or t
  misc_feature (368)..(368): n is a, c, g, or t
  misc_feature (371)..(371): n is a, c, g, or t
  misc_feature (375)..(375): n is a, c, g, or t
  misc_feature (380)..(380): n is a, c, g, or t
  misc_feature (397)..(397): n is a, c, g, or t
  misc_feature (411)..(411): n is a, c, g, or t
  misc_feature (424)..(424): n is a, c, g, or t
aacacctataccacttaattctcaaggttgttgagaagtacctcccctatattcatcaatatgggagactataagaagaatggttgttttattatatatttgaatatttccatatgaaattgtgaatactacttaatgacaggttgtctcttcactggaatgatgatgctctttgttacacagagctttttagtttcatgaggtcccatttatttttgtgtgagggtacagtatttcaatgaaggtgatgtgatcactcctgtttggaagctgaatcaatgaaaacacaagtgcctgtaatagaatatcattgccttcaactactgactaaaacctttggggggttttgatttgagctcagacnntanagnattntattntttatgtgaaagaaatntacaatccttgttntgacaaactagtncacccagagaacaagacaggatctgtcatgtttgccaatcaatgctggtggtgtaaatcacacctgctgatgtca

SEQ ID NO: 1621 - DNA, 497 bp, Mus musculus
aacaccatgaagctctgcgtgtctgccctctctctcctcttgctcgtggctgccttctgtgctccagggttctcagcaccaatgggctctgaccctcccacttcctgctgtttctcttacacctcccggcagcttcacagaagctttgtgatggattactatgagaccagcagtctttgctccaagccagctgtggtattcctgaccaaaagaggcagacagatctgtgctaaccccagtgagccctgggtcactgagtacatgagtgacttggagttgaactgagcagctccagcggcagggcaggaggagccacttcaggagaggcctcctcagccctgatgcttctcactgagaagcgtccttgctcctcacgttcagatttcctgcccctcttcttaatttaaatctctgtgtagactttgttttgtttttttgggggagtattatttctattatttatgttttagttataggacgcgtgtctcccatggaga

SEQ ID NO: 1622 - DNA, 567 bp, Mus musculus
  misc_feature (112)..(115): n is a, c, g, or t
  misc_feature (118)..(118): n is a, c, g, or t
  misc_feature (214)..(214): n is a, c, g, or t
  misc_feature (415)..(415): n is a, c, g, or t
  misc_feature (436)..(436): n is a, c, g, or t
  misc_feature (472)..(472): n is a, c, g, or t
gggtgactgtcccacgcttgacactcacactttgtccctgactgactatgcttgtggttctcctccagttgatagagaaaaacaacccagcgaaggcgccttctccgaaaannnngcngagaatgagagcggcggagacaagccccccatcgatcccaataacccggctgccaactggctacatgctcgctccactcggaagaagcgatgcccntacacaaaacaccagacgctggaactggagaaggagtttctgtttaacatgtacctcacacgggaccgcaggtacgaggtggcccggctgctcaacctcaccgaaaggcaggtcaagatctggttccagaaccgcaggatgaaaatgaagaaaatcaacaaggaccgagcaaaagacgagtgagccttttaggggctcatntaaaaagagagcaagctaganaagaaaaagaaaggactgtccgtctccctctgtctncctctcccccaaacccagcctccacccgcacaaaggggctctaaatcccaggcctcatctccccactggcagtccgtgctcaggctggctcttag

SEQ ID NO: 1623 - DNA, 483 bp, Mus musculus
  misc_feature (208)..(208): n is a, c, g, or t
  misc_feature (263)..(263): n is a, c, g, or t
  misc_feature (425)..(425): n is a, c, g, or t
  misc_feature (457)..(457): n is a, c, g, or t
gtcactggagggtcttagatccccaaagcccctagagctgagttctcagaacttgaagagctggggaggaggccttcttggctcttggctgccctctggcctcaagaccctcaaacccaggtgcctccaacctcagaacatttggaaccccacctatggctcctggaccccaaggggcccccagggtgaagatacaggcattgaacantgcaatggctcctcctcaagttccattccaggcatccagtaggctctgcccctgnccctgtgctgcatgttcaggcatgtttcagggatgtgcgggcaacctggcctcccacactggaaactagcccagaccctcttggggaaggtcctaggctactttcagtctttggtctttgaaaccagaggccatccacccactgcaggagtcagttgggaancctggattgtccactcctcataagtatctttnctctgctcattccagggctacaaatg

SEQ ID NO: 1624 - DNA, 466 bp, Mus musculus
aatttccaatgctctcctaacagataagctggagtcacagaaggagtggctaaggaccaagaccatccaattcatcttgaaatcacttgaagaatttctaaaagtcactttgagatctactcggcaaacctagtgcgttatgcctaagcatatcagtttgtggacattcctcactgtggtcagaaaatatatcctgttgtcaggtatctgacttatgttgttctctacgaagaactgacaatatgaatgttgggacactattttaattatttttaatttattgataatttaaataagtaaactttaagttaatttatgattgatatttattatttttatgaagtgtcacttgaaatgttatatgttatagttttgaaatgataacctaaaaatctatttgatataaatattctgttacctagccagatggtttcttggaatgtataagtttacctcaatgaattgc

SEQ ID NO: 1625 - DNA, 499 bp, Mus musculus
  misc_feature (128)..(129): n is a, c, g, or t
  misc_feature (132)..(133): n is a, c, g, or t
  misc_feature (143)..(143): n is a, c, g, or t
  misc_feature (157)..(157): n is a, c, g, or t
  misc_feature (241)..(241): n is a, c, g, or t
  misc_feature (363)..(363): n is a, c, g, or t
acagccacattgactggctcacacacacctgtaagtcaggctccagagaacaaacaccctcctctggcctttgtacccacgtgcacataaccgcaaacagacacacccacgctatttttttagaagtnnttnntttttttaantaggggtggaaaancaggctggagagatgactccgtggttaagaacagttgttgttcttccagaggacccaggttcagttcccagaacccacaaggcnagtctcccaactattcataattctagttcaagtggatccagcaccctcttctaactgatactgccagtaccaggcagccatgtggtgcatatgcatttgggcaggtaaaacactcagacacncaaaaaattttaaatctaaattttgaaaatattttagttttaaggatgatcactgtgtgagggtcaggtctcttatgtatgaatgtagtaccaagaactgtgatgagtatatgtatgctccattctatagtctcct

SEQ ID NO: 1626 - DNA, 515 bp, Mus musculus
aggcagaggctccttctgctacctgctcccggtaccctgccctcctcctccccatcagcacagggaccaaagttctagtccattgccctcattccacctggaaaagaaactctgaaaagtccggggaattcaatgccgggcccgactttgaagctagctcctctttatctgggattccactcagttacggattggttttttgtttgcttttttgttgtttttaatgtaaatatctagaattctaaccagtctcatatatcaggaaaaaccagggttgattaaagtttaacactgtatggggggaggggttggttgaagacgcatgccatttgcccccctgtcttttcagaacttgatgagaagaggggtttctttattgtttttgttgttgttttaaaatgaaatcattgaagttgccattaatatagagagttaaactccgtaggtcttgttttctgaaaattttcatgggggagaattttaaatccaggtctctggaagtccctttgtatgtg

SEQ ID NO: 1627 - DNA, 551 bp, Mus musculus
gaggcatctctcttcttggacaattgcacagccagcagcatctcctgaaaatggtgccagaagcagcagcttggatgaatatggtcttaaggctatggatcagcactcactgtccatgcccaagaccccctctgcacttcctctggagccgtggcacttctcctccctagcgaggccaggcttcatagcgcctgcctacttccctgtctttcccgacaggcatctgactccagaggtctaccgtgtctttcccgacaggcatctgactccagaggtctaccatgtctttcctgacaggcatctgactccagaggtctaccctgatgggagatgtgggccccttcaacatttagtccagcaagatagataccaaaaccatcctctggaacctgctgccagggagaactgcagccctgccaagatagctggaagcacaggatcgctcatgaacctgcctccctaccctgtccactacaagaagaaaatctgtgctcgtggagctgccagtgccagtcttgatgatgaaagaagcccatctccaaagcgaagaa

SEQ ID NO: 1628 - DNA, 139 bp, Mus musculus
gaagtctgccaggttcaaatgttgcatagttttattcctggaaccaacatagatttctatagacaaggctgtcattgagtttgagacactactgcctcagcttcccaagtaacgtggattaccaccctaagccaccatg

SEQ ID NO: 1629 - DNA, 530 bp, Mus musculus
  misc_feature (26)..(26): n is a, c, g, or t
  misc_feature (52)..(52): n is a, c, g, or t
  misc_feature (150)..(150): n is a, c, g, or t
  misc_feature (408)..(409): n is a, c, g, or t
  misc_feature (500)..(500): n is a, c, g, or t
gagaactgatcccagtctggttctgntgctacaccagtgctgggccacgccnaccaccagcccctttgagcagccccaatggcctattctgtcagatgggtgtcctttcaagggtgacaactacagaacacaagtagtggccgcagacanggaggcgcttcccttctggtcccactatcagcgcttcaccatcaccaccttcatgctccttgactccagctcccagaatgcccttaggggacaggtctatttcttctgtagtgcctctgcctgccaccctctggggtctgatacatgctctactacgtgtgactctgggatagcaaggcgtcgacgatcctctggtcaccacaacatcactctccgggccctggacattgtaagctctccaggggcagtgggctttgnngatgctgctaaacttgagccctcaggttccagcaggaactccagctcaagaatgctgctcctgctgctggccatcaccctagccctggcgnccgggatctttgtgggtctgatctgggcct

SEQ ID NO: 1630 - DNA, 352 bp, Mus musculus
caatctggagctgggatggagttacgggtgcagccaaggcttacttagcagaagtggtttttaaaagctggaccacagggcctccagaaggcagagcctgccttgacaactgcccttgacagggaagccccacactagtagtttagatgttttgggggctgcctctggtttcttggggcttgatactcagatctgctccggcgtcacactccagccttccgcatgtccttgccaggtgccctcagctcagacctaggacccttagtcatttcttcacaagtatttctggtctgtcctccgtgctgacagattgagtcagaatgactttaaattcaaaatcaactcaggctac

SEQ ID NO: 1631 - DNA, 526 bp, Mus musculus
  misc_feature (256)..(256): n is a, c, g, or t
gctcacggacctgcagtacattaagatcacaaggcagcagtaccagaatgggctgatggcctcccgcatggacaacagcccccagcctaccttcgatggctgtgccacctgctcagagaactttatggagaggcctgagctgcccccggtggacgagaccacgactcttctcaatgaacgcaactcgttgctgcacagagcctccgaagaggaaaccatctgacaggagggcccggggactcccgcccaccctgcnggggtctccccagtgggcccacatgaagtcaggagcctgttaggctagaaggggtgcaggtagatatcctgcatgactgagcaaccagacatccctgtccaggggctctggctgcagatagggacctctgaacagctctgacatgatgcctgccctgcccagctagtgagcaaaggctgttgggttgttgttggttttttttttttttttttttttttttaaacactgagagaagttttaagctaggctcattgctcctcttttaaaata

SEQ ID NO: 1632 - DNA, 513 bp, Mus musculus
  misc_feature (281)..(281): n is a, c, g, or t
  misc_feature (294)..(294): n is a, c, g, or t
  misc_feature (298)..(298): n is a, c, g, or t
  misc_feature (301)..(301): n is a, c, g, or t
  misc_feature (303)..(303): n is a, c, g, or t
  misc_feature (325)..(325): n is a, c, g, or t
  misc_feature (390)..(390): n is a, c, g, or t
  misc_feature (425)..(425): n is a, c, g, or t
  misc_feature (474)..(474): n is a, c, g, or t
ttttcctgttctaagtgtactgcattttataatcaaataccattttaatttcactattttattccaggagccttctggcccaggccagtgtaatggtggagtctatatagaatcactacaagatagttcatctttgtggatctgcagagatctgcttcaaagggggagtgtttctactcagcaattgttatatatgtttaacaataacagtaaaagcacattaatagcaggaatctctcctaaaacgagtcactcatagccttgcttaatgagggctcacntgtcacagattanatantantntgaggcaggccacttcaggatnatcacctgctagttattagcttgtctcattatgggtcctgaccatttttttggatttatttcacntcaaatgtgagttaaactccttaggcatttaatanttaattttacactagcatgtgcattactgagcctttaaaaaaatattgnaaatcttatagattgagctaccatgtactgatgagtccc

SEQ ID NO: 1633 - DNA, 531 bp, Mus musculus
atggaggtggctggaccctcatccagcaccgggaggatggaagcgtaaatttccagaggacctgggaagaatacaaagagggttttggtaatgtggccagagagcactggctgggcaatgaggctgtgcaccgcctcaccagcagaacggcctacttgctacgcgtggaactgcatgactgggaaggccgccagacctccatccagtatgagaacttccagctgggcagcgagaggcagcggtacagcctctctgtgaatgacagcagcagttcagcagggcgcaagaacagcctggctcctcagggcaccaagttcagcaccaaagacatggacaatgataactgcatgtgtaaatgtgctcagatgctgtctggagggtggtggtttgatgcctgtggcctctccaacctcaatggcatctactattcagttcatcagcacttgcacaagatcaatggcatccgctggcactacttccgaggccccagctactcactgcacggcacacgcatgatgctgaggccaatgg

SEQ ID NO: 1634 - DNA, 588 bp, Mus musculus
  misc_feature (406)..(406): n is a, c, g, or t
  misc_feature (414)..(414): n is a, c, g, or t
  misc_feature (424)..(424): n is a, c, g, or t
  misc_feature (428)..(428): n is a, c, g, or t
  misc_feature (448)..(448): n is a, c, g, or t
  misc_feature (455)..(455): n is a, c, g, or t
  misc_feature (471)..(471): n is a, c, g, or t
  misc_feature (550)..(550): n is a, c, g, or t
aagctgtgttgcttcggcctgtcacagaagctgttagcttctgtagtccactctctcacctgctcagactagtctcggagggatccaggaaccaagatgtctcccccaggtgctcctgcagagccctcctgggcagagtggacacctctcctctggcagggaaggtgcccagatgtctggagcccgaaaagggagctgcctcagaagctatgtggctccagcctgtcccagaagctgttagcttctgtagtccatctgtgcagactagtctcggtggagtcccggaaccaagatgtctcccaccgatctaatctttactttagattgaaaagttgttccttagagggtcttgagacagagtttttttatgtagcatggggtggcattgaactcacagtcattctcntgcctcanttcccaaaanccangagttcccaaatcatttttnatatttntgagtatgagtacctnatcagttatgtcttttacagatattgtccccctttgatgggaaaagataagctttgaagaaatcaatttaccttgattntttcatgctttttttgtggtttttgtaccattcaataa

SEQ ID NO: 1635 - DNA, 559 bp, Mus musculus
atttcctttctattcttctgtccattctttctaaccctgggctgacaccgcagcagcagcagcagttctgaaaagccaagttcatccatgtggccacattcatctgccacactctgccttctcttttgagtattgatggagctttcatgaaccatggtcagccccaaaccaaagtcatcccataacaggtgaccaacgaggccaacctaaggcctgccaaccctcagatcctccccttccacctccattgtcctctccctgtgtgctcaggggcagctaagaatacaagcatgatcctaagggaacgtatgtgattgtttcataagacggatgctaggacttgtgttgtttttaaggttttctctgctcagcctcattccatgccaaagtgctgctgctataggcctctttgtgttgcacaaaattgctttccactatattggacatgcagctttccttaggggaagcctgcaacaggatggccattctgagccagcaaacctgttggatggtggtttgtgaaagtcaattgcagagatatagcactaccatccctata

SEQ ID NO: 1636 - DNA, 539 bp, Mus musculus
gaatcttcccaaactcaatccaaggatatggaaatgtcctcatcaaaggagaacgttttgggacagtgttggaagagatttctatatttattggaagtcagcaattcagagtaatagatgttaatgaaaataatattactgtcctcatgactccactagaagctggacttcattctctcagtgttgttgttgggtctaagggcttggctctaggaaatctaaccatcagcagccctgcagtagcttctgtctcaccaacctctggaagcattgctggtggaacgactttgatgataacaggcaatggattttctcctggaaacaccacagttactgttggggatcagccttgtcaaattacgttcatcagctccagtgaggtctactgtagcaccccagctgggagagctggtacagccaatctgaagattagtgtcaatgcgatcatctacccacctttgtcatttacatatgccatggaagatactccatttctcaaaagaatcatccctaatagaggtactccagcatctacatgc

SEQ ID NO: 1637 - DNA, 484 bp, Mus musculus
tctgcgattccgtgggctgtgtaaccagtgctttgggatcaggacaaaccttagcagcaggtaagtaagtatgtttcaatgaatatgaagaaaaacattcacattgagagtaaatgcctccaggtctgctgtactttggacttcatatatgtcgttgctgttctctgctgcttcccagcaatcccgaatgtggtttgtcttgagatttttaaacaaaactaaaagcactagccaagggttatgggcccatcagaagaagagccctggatcagatagggaaagcgaatggttcctctgctcagcagctaactagggcctctgaatttcctggcattgtgagatgcacttaggagccatcctatgaggtcacatgacatttcttctttaaatcataacttccctcctcctattggatctgtagactcctgtctcatgagactccctggcaacatctgagttgcctgtcactagatgtttcctgttt

SEQ ID NO: 1638 - DNA, 541 bp, Mus musculus
gaattgtggccttttctgaagccagctcttctcagccaaaaaacacgccctgtcttaaaagtgaccttggaggagatcggagggatgttctgaaacaattttttgaaggcagccagctgagtgaaagaactgctggccttactcctgagcagctcgtcattggtattcctgataaaggctctggcccagatagcatacaaagtgaagtccaaggaaaagagggtgagatgcagcaacaaaggccacctaccatcatgaagttgccatgctttggctccaattcaaaatttcactcttctaccactggacctccaattaacaacagaagaccaaccctacttaatggtgctctctccacacccactgaaagtcctaacacattggttgggttagctactagggaacaacttaaaagtataaacgtagataaacttaatgcagatgaacacactacactcgaatcttttcaaggaaccagtccacaggaccaaggctgcttactgcttcaggcttagggatcgcttcaactgaacatccttgg

SEQ ID NO: 1639 - DNA, 440 bp, Mus musculus
gaatttcatgcctatatataatgcctttcattactctagtttctctctgtttttgttgctcccacacccatcaacaactgttcttctcaaaaaaatcctgtattcctataggaaattttgtttttaagatgggaatcttgctatatatcctagctgacctagaacttactatgtagaccaagctgggcccaaaatcacagtggtcctcctgcctctgtttccctatggctgggactccaaatcattggtcctgatctgtaatctttaaattcagttcttagaatttgatgttgactaatccattgtcattgtgtctcccagcctccaatgtgctcacaccttaagttttactaatcccaaactcagaatgtcagactttcaagttcactgtttataactctttttcacttgttaaatgctatcattgcactcgaacctac

SEQ ID NO: 1640 - DNA, 323 bp, Mus musculus
gggatccatcccattattagctccaaacgctgaaaccattgcatacactagcaagattttgctgaaaggacccagatatagctgtctcttgtgagactatgctggggcctagcaaacacataagtggatgctcacagtcagctattggatggatcacggggcccccaatggaggagctagagaaagtacccaaggagctaaaggggtctgcaatcctataggtggaacaacagtatgaactaaccactaccctccccgccccacagagctcatgtttatagctgcatatgtatcagaagatggcctggtcggccatgattgga

SEQ ID NO: 1641 - DNA, 394 bp, Mus musculus
tctgcgctctgctagtgtcatgctgcaggtgctagtggtggatggcttctctcagccctacctgcctctgccagaggtggcgctcaaccccacacaggaagaagacatgctcactctctatctggttattgccttggcttctgtgtcttcacttttcctcttgtctgtgctgctgtttgtgggggtgaagttgtgcaagaaggccagggaggcttctctggctgactgctctattcctgagggacactttcctagccacttggtggatgtcagtggtgcggggaccttatcccagagttaccattatgaggtctgtctgactgaggactctgggacctcagatttcaagttcatgaaccccattattcctagtagtctccttcaggactcttag

SEQ ID NO: 1642 - DNA, 458 bp, Mus musculus
acgtggccaatgctactgttgtcaaagtggatgcagaagtagacggagaaaatgctacaaaacctgaagaagaggatgatgaagtcaaatttcccccaatagtcatcaaaacaacatttcctgaagagctgcagagatttttgccccagggggaaaatgtccacactgtcattctagactttacgcaggtcaattttgtggattctgttggagtgaaaactctggccgggattgtgaaagaatatggagatgttggaatttatgtatatttagcaggatgcagcccacaagttgtgaatgacctcacccgcaacaacttttttgaaaatcctgccttgaaagagcttctgttccacagtatccacgatgcagtcctgggcagccaagttcgggaggcaatggctgaacaagaagccacagcgtcacttccccaggaggatatggagcccaatgccaca

SEQ ID NO: 1643 - DNA, 554 bp, Mus musculus
gaacctttgtggacatggacaccttcatgtattgatagtctgactcttctaaataggtctgaaaaagcagcataagtttttaaacagtgaagcatcaatgtgttgagagcaaatgttcatctaataagccatgagccaaacaagacaaaaagtctacatgagaggcaagagagattctgcaaagggtatttgtgccaagaaggtatacagtaccacagagttgtgtcctcagtgagagtgggaaataagtttctaatttaattctaattactggctcctcagtaattcaggaatcgtgccatcatttccctgcttttaaagggagaagtttagctaaagacacattccaggtgtcactaacagttccaaagctaggtgactaaatgttcagctagagctgttaaaaggaaaaccagctaattatcattccagtccaatgctatttttgaattactatctacttaagatttctcataatttgtgctcaggcagcacaataaaaaggggggggcaaaattactaagtgacagttattctgcatctaagtctgtgac

SEQ ID NO: 1644 - DNA, 364 bp, Mus musculus
tggcttcattctcagtgggctatctgaaggtcaactgggatcttctcggagagctgggtctggctgtcttctcagctgtcatcgcaggatctctgtttctcaaaaattactcacgcagcatctgggtgtgctatgctgggtatctactggtcaagtcgagctattcgtttcttataaccatcgcagtctttcagattgcagttaacctgagcttagaacgttatgccctggtgttcggcatagacacctttatcgccttggtgattcagaccatcatgactatgattgtggtagatcaaagagggctccaactgccagtcactactcagtttttagtttatgggagttacttcgctgtcattgc

SEQ ID NO: 1645 - DNA, 460 bp, Mus musculus
tatatttacacaactaggccacctagcaatcaccaactcagagacagtaaaagtcctacaaaggccagacgaatacaattaactaggggtgagggcagcatttggggggagagggagacaagaaaccaagatcagacacacacacacaccacccaatgtgttctattgcatttgtcccgtttcaacacagtgaggtaggtttgtggcgatctcaaagcatgtaaacgaaactccccaccccctctttcctttagctatcaaccatcacgctacagcagggcaggacacttgccactgaggcccatactcatgagtctctcagaaagccaagattgtgaaaggctaaggagttgagtccctgcctcatgttcccatgcctggacagcacagtgtgggaataagggtactggtcttaagttgcattcttactgggataactcagtggcagtgtacttcctag

SEQ ID NO: 1646 - DNA, 525 bp, Mus musculus
  misc_feature (55)..(55): n is a, c, g, or t
  misc_feature (73)..(74): n is a, c, g, or t
  misc_feature (83)..(83): n is a, c, g, or t
  misc_feature (322)..(322): n is a, c, g, or t
  misc_feature (493)..(493): n is a, c, g, or t
ggaattcactctgcataaccatctacgggaaggtgcccagtacctgttgagcggnctccgtataggcccggcnngcatccgcnctcatacctttgtgggtgtccatgtgcgtcgtggagactatctggaggtgatgcccaatcgctggaagggtgtggtgggtgaccgagcttacctccagcaagccatggactggttccgggcccgacacaaagaccccatctttgtggtcaccagcaatggcatgaaatggtgtttggagaacattgacacatcccatggtgatgtggtcttcgctggcaatggacaggagggtacaccngggaaggactttgcacttctcacacagtgtaaccacaccatcatgactattggcacctttggcttctgggctgcctacttagctggtggagacacggtctaccttgcaaacttcaccctgccagattcggagtttctgaagatcttcaggcctgaggctgccttcctgccngagtgggtgggcatcaatgcagacttgtcccc

SEQ ID NO: 1647 - DNA, 309 bp, Mus musculus
gagttactccagagaaagcaggttttccactcttatggccatcagggaaacctttcttatcagtctcatggccctgtccagtgggtacatggtagctctcctatggaggcacaagaagcaggcccagcatcttcgcagcaccagcctttcttcaaaggcatccccagagcaaagggccaccaggaccatcatgctgctcacgagcctctttgtggttctctacattttggaaagagttgtcttccaatcaaggctgaagttcaaggattgctcagtattctactttgtccatattattatgtcccatag

SEQ ID NO: 1648 - DNA, 502 bp, Mus musculus
tgagaacgatgggttacatgcctacagagatggagttgactgagttgggccagcaaatccgaatgaaccttggtggccgtgtagactttgaagactttgtggaactgatgacccccaaattgcttgcagagacagcagggatgattggtgtccaggagatgcgagatgccttcaaggagtttgatgccaatggagatggggagatcacactggcagaactgcagcaggccatgcagaggctgctgggggagaagctcacaccccgggagattgctgaggtggtacaggaggctgatatcaatggagatggcactgttgactttgaagagtttgtgaagatgatgtctcgttgaagaggtaatagaagctccagacacctgctgccttgtcaacatggctgagcacttgtagagcactggatacccagaataccttaaaggatggagggtgggagtaggcttgccccagtatggactggggtgcaactgcaaacacttgcttt

SEQ ID NO: 1649 - DNA, 505 bp, Mus musculus
ttggtctttttgctgagtctggatgtgatccctcccactctggctcaggataactacaggtacataaaattcctgactcagcactatgatgccaagccaactggccgggattacagatactgcgaaagtatgatgaagaaaagaaagctaacctcgccttgcaaagaagtcaacacctttattcatgacaccaagaacaacatcaaggccatctgtggagagaatggaaggccttatggagtaaactttagaataagcaattctcgattccaggtcaccacttgcacgcacaaaggagggtctcccaggcctccatgccagtacaatgcctttaaagatttcagatatattgttattgcctgtgaagatggctggcctgtccacttcgatgagtcttttatcagtccgtagacagcaggcccctggcacagacctaggtctgttttctttttatctcccctcacagccatgatcactggttcagcattcactgtcagtggccaga

SEQ ID NO: 1650 - DNA, 524 bp, Mus musculus
aagtcactttgccagaaacagctcctcatcctgctgtccaaggtgcgactgtgcggggggcgtcccacgcgacaggaccgcggcccagagcctcagctcaaaggcatcgtcaccaaactgttctgccgccagggtttctacctccaggcgaatcccgatgggagtatccagggcaccccagaggacaccagctccttcacccacttcaatctgattcctgtgggactccgtgtggtcaccatccagagtgccaagctgggtcactacatggccatgaacgctgaggggctattgtacagctcgccacatttcacagcagagtgtcgctttaaggagtgcgtctttgagaattactatgtcctgtatgcctctgctctctaccgtcagcgtcgttctggccgggcctggtacctaggcctggacaaggaaggccgggtcatgaagggaaaccgagtcaagaagaccaaggcagctgcccactttgtgcccaagctcctggaggtggccatgtaccgggagccttc

SEQ ID NO: 1651 - DNA, 532 bp, Mus musculus
ggatggcctggactcttctgacaccgctggtctgctggcctcctgggactggaaaagcagagccaggcccttggagctggtccaggagtcccccactcaaagcctctccccagctccttctctggagtcctactctgaggtcgcactgccctgcgggcacagtggggccagcacaggaggcagcgatggctacggcagtcacgaggctgccggcttagtcgagctggattacagcatgttggcttttcaacctccctatctacacactgctggtggcctcaaaggccagaaaggcagcaaagtcaagatgtctgtccagcggagacggaaggccagcgagagagagaaactcaggatgcggaccttagccgatgccctccacacgctccggaattacctgccgcctgtctacagccagagaggccaaccgctcaccaagatccagacactcaagtacaccatcaagtacatcggggaactcacagacctcctcaacagcagcgggagagagcccaggccacagagtgtgtga

SEQ ID NO: 1652 - DNA, 472 bp, Mus musculus
  misc_feature (105)..(105): n is a, c, g, or t
  misc_feature (173)..(173): n is a, c, g, or t
  misc_feature (206)..(207): n is a, c, g, or t
  misc_feature (433)..(433): n is a, c, g, or t
  misc_feature (435)..(435): n is a, c, g, or t
aagtggttaatcctcactccttcacacacctcttcattatgaagtggaggtgagaggtactgagtttccttttggcattactattccaaaaggaatgattattcntggtaattaattgtgcagtgcctgtagtaccttgctccaaatggatcaccctgcaaatcattaataantgaagtggttttattagtttcaagcagaatttnncactatttctcagacttgcaaaagtgaaaggcaagtataacattcacatttagagaggccaatttctatttcatatctaacatgtatatatatgtatatacatatatacatatatatatgatctctgtacacataaattttatatgtctatgtatatagaagtatccacaaatgacatgtgtgtgtgtatatccacctgcctataaattatctctgtgtattattntngggctatacataatcacacacatacatctttcagtag

SEQ ID NO: 1653 - DNA, 451 bp, Mus musculus
  misc_feature (58)..(58): n is a, c, g, or t
  misc_feature (71)..(71): n is a, c, g, or t
  misc_feature (97)..(97): n is a, c, g, or t
  misc_feature (125)..(127): n is a, c, g, or t
  misc_feature (129)..(133): n is a, c, g, or t
gaaaaataatgttaccctgtagactttggtttagtggtaattcacttactgtttatancctgttagaccgngatacaaaagctgctttatcctctcnctctgctctctgtgcacaatggtttgtnnngnnnnntgctagactactgtaaggtttccttggggaaaggcatggtaagggaaaacacactggtttatattttgaaagccaatcctaatcccaaagcaatactgttgtcgaggagtcaacgttctaggaagctgacttttctagaacaaatgtatttattaggatgaattttggaattttagtttaaatattatacattttaatcctaagcagtcaattgcttatttcattcttagaaattcaaagaatatatacaattttagccaaatgtgagtccctggaattccttacttgtggatgtcaagggtcacattaaaaggctct

SEQ ID NO: 1654 - DNA, 401 bp, Mus musculus
  misc_feature (262)..(262): n is a, c, g, or t
  misc_feature (282)..(282): n is a, c, g, or t
  misc_feature (289)..(289): n is a, c, g, or t
  misc_feature (315)..(315): n is a, c, g, or t
  misc_feature (325)..(325): n is a, c, g, or t
  misc_feature (327)..(327): n is a, c, g, or t
  misc_feature (342)..(342): n is a, c, g, or t
gaatcattttctgtcactcatttaaaaatatattgtagactttgataatctctaatctgtttattgaaatagtccttagccttaacaattcactgatatatgctgatgttcattaatgtacactatttgccaatatgtatttttagagtcttggcttcatttgggtggctagcactgatcttaatgatcactttattgctgaacatcattattctttaaaaatgccaagtggaactaatttcttaggaatccagttgatttncctgtcacgaaacgagaaanccatctntctgaaaagtagtaacgcagcaaatntcctcagttntntggtggacagagctngtgtgcgaggctcaaggagcattagaatcccaggatgggctggacctggatttttcagt

SEQ ID NO: 1655 - DNA, 396 bp, Mus musculus
gacaaactcggctgcttcagtgatgatgccccctggtcaggaactctagacagacccctgaaagcactgccctggagcccagcacagatcaacacccgctttctcctctacaccaacgagaatccagacaactaccagctaattacttcagatgcatcaaacatcagaaactccaatttccgaacaaacagaaaaacccgtatcattatccacggcttcatcgacaagggagaagaaaactggctatctgacatgtgcaagaacatgttccgagtggagagtgtgaactgcatctgtgtggactggaaaggcggttcccgaacgacatatacccaggctacccagaacgtccgggtcgtgggggcagaagtggcattgttggttaacgttctgcag

SEQ ID NO: 1656 - DNA, 357 bp, Mus musculus
  misc_feature (86)..(86): n is a, c, g, or t
tccagctagtactccaggtctctgtctcccacccccttccattttgatagtataatctatttttaaatggggcttttcaatagggnagagggaaacatctcttcctatatcagatgggtgggtaggcgggtgggtgggaagtaagggatttggaggcggtcttcctgccacccccaagtgtttattttttataccaaacatgtatttttggctccctcccagccccccaatttcctgcaggcgggtacaaaggacccttttaagtgtccctggagttgggagggaggaatgggggacatggagcctgtcttatatcaatctaggctggaggaggtggatcaaaagactcccaggctc

SEQ ID NO: 1657 - DNA, 488 bp, Mus musculus
tcggtgaccggttctgaggatccaagcctattggggatttgctctccagacatctgtgtccccacttgaaaacaagttgcatgaagtaagactagaatgtctagggccctgatcccatgaggtccctcttagagctaggcgtctatctgcctgtggtgacactctctatggcaccctcgcctgggtttggtctctgatcactatcccatgacattaatgtcaggcagaggcctaggacggctctcttcactgtcccaaggccacttctccttcaggacccagaggaagagcctaaggctaaagatcctcctgtatccaggtacaggtgactgggaaacactgtgctggggacagggatggcaaggtgcaaggctgagtgctccccggattccatccaaaccagagtctgatggagctggcacctttatgactctctgcggagaagaaatggggttctaaggcagcagataccctaagcctagaggcta

SEQ ID NO: 1658 - DNA, 523 bp, Mus musculus
  misc_feature (294)..(294): n is a, c, g, or t
  misc_feature (297)..(297): n is a, c, g, or t
  misc_feature (299)..(299): n is a, c, g, or t
  misc_feature (414)..(414): n is a, c, g, or t
  misc_feature (421)..(421): n is a, c, g, or t
  misc_feature (423)..(423): n is a, c, g, or t
  misc_feature (426)..(426): n is a, c, g, or t
  misc_feature (458)..(458): n is a, c, g, or t
accagcctggcctgtactcgggagcccgtcactccggtgcctctcatcagcactctggagctgagcggtggaggtgatgtggccacgctggagctgcacggagaaaatttccacgctgggctcaaggtgtggttcggagacgtggaggcagaaaccatgtacaggagccctcgttccttggtgtgcgtagtgccagacgtggcggccttcggcagcgactggcgttggctccgcacccccatcaccgtgcccgtgagcttgctgcgcgcggatgcgctcttctaccccagcccnttntntttcacctacaccccggaatacagcgcgctgccacggctgcccaacgcgcaagagcctgcccccgacgcggacacgctcctggagagcatccaccacgagttcacacgcaccaanttccatntnttntgccccacctaggcagtgccactgaggctgantccaggcccgcagctgtccctcagggaaaaagagcaggaaggagagagatagctcacctgacctc

SEQ ID NO: 1659 - DNA, 553 bp, Mus musculus
gtggatttcaagatgtctcctggctttcccatgaaattcaacagagtagagcccaacctggatgcagctctctactggcctgttaatcaaaaggtgttcctgtttaagggctcaggatactggcaatgggatgaactggccagaactgaccttagccgctaccctaaaccaatcaaggaactgtttactggagtgccagaccgaccctcggcagctatgagctggcaagatggccaagtctactttttcaagggcaaagagtattggcgccttaaccagcaacttcgagtggcaaagggctatcccagaaatacgacacactggatgcactgtggttctcagactccagacactaactcatcaaccggggacgttactccttcaaccacagacacagtcttgggtaccactccatcaaccatgggctcaaccttggacattccctcagctacagactctgcctccctctcattctctgctaatgtcaccctgctaggggcctgagaactattcagtggacactaggcctaatgtccctagatactccacttct

SEQ ID NO: 1660 - DNA, 460 bp, Mus musculus
gagccttctacctgggaggaacagctaatgggaggcaagatacctcgaggaagaccctccgagccttgacttctatctttgccgcctccgtccatgcctgttggccttggcctcttgggaaggtgcaccgtagccattcctgctgtatgcacttgatgtccgagaacaaaatcgccggtaagctgctgcctcccgtgagtagcaggatggagaaggaaccacctggcagtgtgttcctcctagctttcaatcactaacttgggggttgtccgctcatcacgccatcctccagttcacagactggcctgcctgctatgcgtcctgagcactctttctactcggattctttgtagaaactcgctgggttaagaaggccaggatgacacaagcaagaccaaatatcattttgccaatgagtctgaggctgtggtctctggatccagccatgatgtttttatat

SEQ ID NO: 1661 - DNA, 567 bp, Mus musculus
acactcatacttggtctgctggttcactagggcttctaggagctgggggcgccccaggcttctgtagcccaggagtactagaataatgtcacactcagccggccggcccggaagctccctgtccactgattcttccaggggtactgaataatccagtgggggacaaagggcctggagacgtctagccgcaggcggctgctggggcccaggtggggtagggacagtgagggactatagaaggaaggcgccgactgtgaagctgggccatcagcaactcaagactttatcttctcgagaatattttttcgaaatctcacacttgacttcatgcagtgatgcacctggcctgagagcccatcagcctggcagtgggctttgggaaggggagctgggaccccccatctctggaccttggggctgagtcctttgcgtccttccctgttccactgctgggtggccagtgtccctgcagacccgggctgctcctctgtacctccctcacagcctgggtcccaccggacagcgccttgcatgtttattgaaggatgtttgctttccggacggaag

SEQ ID NO: 1662 - DNA, 509 bp, Mus musculus
  misc_feature (318)..(318): n is a, c, g, or t
  misc_feature (324)..(324): n is a, c, g, or t
  misc_feature (328)..(328): n is a, c, g, or t
  misc_feature (342)..(342): n is a, c, g, or t
  misc_feature (346)..(346): n is a, c, g, or t
  misc_feature (375)..(375): n is a, c, g, or t
ttctgggccttccaagtcattctgatggctgtacccagtgccatttatgtggctttcactctgtatcatgtgattggatactgggaggtaccaggaaaggaaaacaaggagcaagagacccagattagcaaaggggatcatagcaaggatgtctcaggggctaaaagcctcaagcttctctgggcctatgtggcacaccttggggtacggctggcccttgagggagcagctctaggtgttcagtacaatctgtatggtttcaagatgtccagcacttttatatgtcgtgaggatccttgtattggcagcacaacctgnttccantctnacccctctgagaanaccnatcttcctcaacatcatgtttgggatcancggggcctgtttcttatttattttcttggagcttgcgcttttgggtttagggaggttttggaggatatacaagcacaaactttccttcttaaagaagttgccaacttcagagagctctgtaagatccaaggaca

SEQ ID NO: 1663 - DNA, 459 bp, Mus musculus
tatgctccacacctatgaatccggtactgctgctcagtcagaattcacgagtgatcagtatgatgacgcgggtccccgcttcacagaggggcactgaccgccccctcctggtgtgccccttccctccgactgctggtgacgccaccagagggcgaggagaagtcacctgcagactacaaccacacaagccactgaggggtcgaggcgatgtccgtccagaccaggctgttttaaacgtttccagcttctggacctcattcttccctttgatttacttcgagggctctgttctttaccgtgtctggctaataagggttcccaggatggagaccagagggagccaagatgccctgggcaccagttgctagcaccaaggactgaatctttaaaggtggcaggacttatgaagaggaagaaacttttcttcctggcgttggaagtggctcagcacggaactcc

SEQ ID NO: 1664 - DNA, 596 bp, Mus musculus
  misc_feature (311)..(311): n is a, c, g, or t
tggcaccttgcgttaagactcctgtccctggacccaccgaagaaagcagtcctgtggagccacaggactgtgagtcacattgcagacctgcgcgtggcagttaccgaatcagcctgaagaagttctgccggaaggactatgcggtgcaggtggcagtgggtgcacgcggtgaggcccgcggctcgtggacacgctttccggtagcggtgcttgctgtgttccgcagcggcgaggaacgcgctcgacgcgggagcagcgcgctgtgggtaccaaccctagacgcggcctgcggttgcccgcgcctcctgccnggccggcgttacttgctgctgggaggtgggccgggggctgcagctgggagcacagcgggccggggacaggggctcagtgctgcccgtggaagcctcgtgctgccttggagagacgcctggacccggcgcctgcggaggctgcagaggagagagcggcgggggcgctgcgggaccgcctgaatctgcaagctgggcgtggactgggcgggctcagctctcttatcactgggcgcggcgcgttcatcagagcactaggctggaagtgtcacgtgcatcgccatctaa

SEQ ID NO: 1665 - DNA, 38 bp, Mus musculus
aaaggccaggatctagtgtctcctggtccaagggatgc

SEQ ID NO: 1666 - DNA, 589 bp, Mus musculus
  misc_feature (32)..(32): n is a, c, g, or t
  misc_feature (42)..(42): n is a, c, g, or t
  misc_feature (51)..(51): n is a, c, g, or t
  misc_feature (55)..(56): n is a, c, g, or t
  misc_feature (63)..(63): n is a, c, g, or t
  misc_feature (70)..(70): n is a, c, g, or t
  misc_feature (76)..(76): n is a, c, g, or t
  misc_feature (79)..(79): n is a, c, g, or t
  misc_feature (91)..(91): n is a, c, g, or t
  misc_feature (94)..(94): n is a, c, g, or t
  misc_feature (99)..(100): n is a, c, g, or t
  misc_feature (109)..(109): n is a, c, g, or t
  misc_feature (114)..(115): n is a, c, g, or t
  misc_feature (128)..(128): n is a, c, g, or t
  misc_feature (131)..(131): n is a, c, g, or t
  misc_feature (133)..(133): n is a, c, g, or t
  misc_feature (141)..(141): n is a, c, g, or t
  misc_feature (157)..(157): n is a, c, g, or t
  misc_feature (164)..(164): n is a, c, g, or t
  misc_feature (182)..(182): n is a, c, g, or t
  misc_feature (185)..(188): n is a, c, g, or t
gtgcaagcgtcgtggaggcctatcctcttgtntctgcccggncctctggcnaganncctggcnctgcaangagggnacnagagcctgggangangcgcnnactcccgtngggtnntgagacagacacnttntntatatttnacctcctgatggcatnggagacnctgagcaaatcatgtagncannnnatgccacaactcaaactgcttcagtgggaagtacagagacccagtgcattgcgtgtgcaggagcgtgaggtgctgggctcgccaggagcggcccccataccttgtggtccactgggctgcaggttttcctccagggaccagtcaactggcatcaagatattgagaggaaccggaagtttctccctccttcccgtagcagtcctgagccacaccatccttctcatggacatccggaggactgcccctagagacacaacctgctgcctgtctgtccagccaagtgcgcatgtgccgaggtgtgtcccacattgtgcctggtctgtgccacgcccgtgtgtgtgtgtgtgtgtgtgagtgagtgtgtgtgtgtacacttaacctgcttgagcttctgtgcatgt

SEQ ID NO: 1667 - DNA, 517 bp, Mus musculus
ctgaatctgttcttgccggtaatatttgctatgcctgaatcatactccttcaactgtcccgatggtgaataccagtctaatgatgtctgttgcaagacctgtccctcaggtacatttgtcaaggcgccctgcaaaatcccccatactcaaggacaatgtgagaagtgtcacccaggaacattcacagggaaagataatggcctgcatgattgtgaactttgctccacctgtgataaagaccagaatatggtggctgactgttctgccaccagtgaccggaaatgcgagtgccaaataggtctttactactatgacccaaaatttccggaatcatgccgcccatgtaccaagtgtccccaaggaatccctgtcctccaggaatgcaactccacagctaacactgtgtgcagttcatctgtttcaaatcccagaaactggctgttcctactgatgctaattgtcttctgtatctgaagaagataaaggttctacagatggtgtctgtagcttcctttta

SEQ ID NO: 1668 - DNA, 503 bp, Mus musculus
  misc_feature (183)..(183): n is a, c, g, or t
  misc_feature (203)..(203): n is a, c, g, or t
  misc_feature (209)..(209): n is a, c, g, or t
  misc_feature (241)..(241): n is a, c, g, or t
  misc_feature (381)..(381): n is a, c, g, or t
aaatctaatccgcatatttcccatcgactccgtaatctgatgatgttccctcttgcactgaataatacatgcctctctcaggtaagccattttataaaataagagataaaacgactgtcgagacagtgtttgcttctgccgatggtgtccgacagcaccctgggcattagggtggtagagctnccacggaggctcccaggccntagggnctgagagctcacttgaattgtaagccttcttncttttgataacacagtattatttctcttactgtagaagaaaaagtttattaccaaacaagagtatttttatgaaagaataggacaaacctataaattatctcaacctatatctcccttgaaaatactttcaggctccgcnaaaacctaggactgaaagcaagtattttggaagaaagagatacatttttgtatgctttcttttccttttgtagacgcccgacttattttctaagactgcaaagatcactttgtcaccagccc

SEQ ID NO: 1669 - DNA, 534 bp, Mus musculus
  misc_feature (157)..(157): n is a, c, g, or t
  misc_feature (307)..(307): n is a, c, g, or t
  misc_feature (310)..(310): n is a, c, g, or t
aaactacgttgtctacctgggtcagtcgaaggagagctcctataatcctggagagatgaagtttgaggtggagcagctcatcttgcacgaatactacagggaagacagcctggcctaccataatgatattgccttgctgaagatacgtaccagcacnggccaatgtgcacagccatccaggtccatacagaccatctgcctgcccccaaggtttactgatgctccgtttggttcagactgtgagatcactggctttggaaaagagtctgaaagtgactatctctatccaaagaacctgaaaatgtcngtngtaaagcttgtttctcatgaacagtgtatgcagccccactactatggctctgaaattaattataaaatgctgtgtgctgcggacccagagtggaaaacagattcctgcaagggcgattctggaggaccgcttatctgtaacatcgaaggccgcccaactctgagtgggattgtgagctggggccgaggatgtgcagagaaaaacaagcccggtgtctacacgag

SEQ ID NO: 1670 - DNA, 521 bp, Mus musculus
gaagctcgagttccggatccatactgacacccaacaagctgtgtagcagtatgcctgggtttgacccctatggaacttaaatgggcgttttcttgtcccagattctggcctatttcaggctgtttcaaatgtggacagatgggtaaagccgttgcctttcaagggactgcctggccagcaccattttctacatcaagccctgttccaggacagcagggatgccgtgggagggaaggaagaacacagggagaaactatttagtctctcccgagaaagaagttcctcaagtaatgaaggcggaagtagaagggtgggcagattaggaaaagacaaacatacaggctaagaacagggtgcattgcctgctttgacaaggtcaagaggaagaggagcaggcggccgaggaaggaggggtgtcgggggtccctggaatcgagaatcagtaaaaaggggtgctgaactcgtaagttcttaggcttccccctcgaggacaggacccacgcgggtgacatacattttat

SEQ ID NO: 1671 - DNA, 196 bp, Mus musculus
ccaggttcaaggctttcgtcgctattggggactacaatggtcacgttggtcttggtgttaagtgctccaaggaggttgccactgccatccgaggggccatcatcttggccaagctttccatcgtccctgtgcggagaggctactgggggaacaagattggcaagccccacactgttccatgcaaggtgacaggccg

SEQ ID NO: 1672 - DNA, 535 bp, Mus musculus
  misc_feature (337)..(339): n is a, c, g, or t
  misc_feature (351)..(352): n is a, c, g, or t
  misc_feature (357)..(357): n is a, c, g, or t
  misc_feature (362)..(362): n is a, c, g, or t
  misc_feature (364)..(364): n is a, c, g, or t
  misc_feature (366)..(366): n is a, c, g, or t
  misc_feature (372)..(372): n is a, c, g, or t
  misc_feature (375)..(375): n is a, c, g, or t
  misc_feature (378)..(378): n is a, c, g, or t
  misc_feature (474)..(474): n is a, c, g, or t
tatcgaaaccgatccaacttggagaccatttttaggatcatagacagcgatcattcaggattcatctccctggatgagttcaggcagacttggaagctcttcagctcacatatgagcatcgacatcacagatgacggcatctgtgacctcgccagaagcatcgacttcaacaaggatggccacatcgacatcaatgagttcctggaggccttccgcctcgtggagcagtcctgcttagagggccacgcctctgcttgcctgcagtccacagacactgctgagagtggccatagcagtccaggcccatgctgaggatagactggtctattactcaaannncctaaggcgatnntgagnttatnantncacatnganttngactttatcctgaaaatttgccaccacaaagcattcaaatcaagagttacctgtttggactggagagatggttcagtggttaagagcactgactgntcttccagaggtcctgagttcaattcccggcaaccacattgtggttcatagtggatctgtc

SEQ ID NO: 1673 - DNA, 523 bp, Mus musculus
  misc_feature (80)..(80): n is a, c, g, or t
tctgggagacatgcacctcagcactctctactccgcctttgtggaactggagtccacgccctcctcagcagctgccggcnctgccgtgtacctcagtcccggctcaaagccattggctctggcttgagctatgcccaacatcagctgcggcctttgcctagctggctgccccatattgggctcaccttaaaggtcaaagaaggaaaacactacctgtctcctatgccactcagccaacttatttgttagccagaagttgggggcatccatctaggatgctacctggtggacccgcatctcacacggggcccccagcaaggaaagtgtcggaaaagaagcaacagcgcgccccctagcgccagctcactcgaacttcagctctcgagcgtgaactcaagctctacacacctgctcatcatgtgccttacactcagaggaagccttgggtcacagagtctgatttgatttctggggcagctgagagctaaaagctttagttagcaaagctcagggccagtgtgac

SEQ ID NO: 1674 - DNA, 550 bp, Mus musculus
  misc_feature (214)..(214): n is a, c, g, or t
  misc_feature (219)..(219): n is a, c, g, or t
  misc_feature (223)..(224): n is a, c, g, or t
  misc_feature (226)..(227): n is a, c, g, or t
ttctctctttccacatctcttatatggatgaatatacacatgtgtgtgccaaggcccttgcccatgagtaagtacatgtatgaaggctagaggtcaaagttcagtgccttcctcttttttctcatcattatcactcttcatcatcactatcgtcatcattattattattctgacacagggtatggtggtttgaataaaaatggcccccataggncacanttannanntgtggccttgttgaataggtgtggcctagttggagaaagtgtgccactggggctgggctttggggttttaaatgctcaagccaggcccagtgtcactttatttcctgatgtctgccaatccagaaattgaactctcagctacctatctatctagcaccatgtctatctgcatgttgctgtgcttcccgctatgaagataaaggactaaacctctgaacctgtaagccatctccaattaaacgttttcctttataagagttgctgttgtcacagtatatctacacagcaattgaaccctaactaaagcacaagctctccctgag

SEQ ID NO: 1675 - DNA, 469 bp, Mus musculus
  misc_feature (292)..(292): n is a, c, g, or t
  misc_feature (304)..(304): n is a, c, g, or t
  misc_feature (319)..(319): n is a, c, g, or t
  misc_feature (328)..(328): n is a, c, g, or t
  misc_feature (334)..(334): n is a, c, g, or t
  misc_feature (342)..(342): n is a, c, g, or t
  misc_feature (345)..(345): n is a, c, g, or t
  misc_feature (429)..(429): n is a, c, g, or t
cccctcttcagccaaatatttcattaatctctatccttcaacctataccatttcctttgaaaatcagaaattcttcacacccggacctcctcgtgcccctaatgggacctccagggtcctgagggacaaagatgcagaaggacatttgaagtttctgttttagagcgcgaatatcctcctgaaaggaaggcaggtgccctggtacaccttggaaaactagtcacaacgccctgaattagaagatgggagagaggagcagggcaaaagctggttgttttcatttaaagcattnaattaaccattntttgccaacaggtcnacaatttgnagtcantcagttgntcntttcaaggtctgagccttgtctttaggctgtttgtggaaaatgcttaataaatatgaatagcaagagaggggttgaaggcaacntggctgatttcaaaccttcctagaggtcgatgtttccatt

SEQ ID NO: 1676 - DNA, 478 bp, Mus musculus
ttcatgccagaacctgagctcaatttaataggtattctctggccaaatcttccagttaaacttgacgctgcttatgaagctagtatgatagatcaagtccgctatttcaaaggcagcaaagtatgggctgttcaagagcagagtgtactgagaggattccccagagacatccacagtttctttggcttccctagcaatgtgacacacattgatgctgctgtttgtgaggaagagactggaaaaacatacttctttgttgaccacatgtactggaggtatgatgaaaatacacagtctatggatccaggttatcccagattaacagcagaagacttccctggaattgatgataaagttgatgatgttttccaaaaaggagaaaatttctatttctttcaccaatcagttcaacacagatttaacctccaaataagaagagttgatgattcccgtgattctagtacatggttcaactgct

SEQ ID NO: 1677 - DNA, 441 bp, Mus musculus
  misc_feature (265)..(265): n is a, c, g, or t
  misc_feature (343)..(343): n is a, c, g, or t
  misc_feature (355)..(355): n is a, c, g, or t
  misc_feature (364)..(364): n is a, c, g, or t
gttttggctacatcttggagtccccttccaagtccagctaacagccaagcttgtggataatggagatcatgtgggttgaatttctaagagcgtgacctcctaagtctcacaaggaatcagagaatagctaaattgtccttcctgaggcttttctgggactagataactagacagtgttctctgaagaacactgtgcaccacaatgcctgcctgactccttttagcttctttatatcgagtcactccctactgcattctgccccanatacctttttaatgtgttctctgaacagcctgtttccatgcacttgtacacatttaagaattggctgcagacactggnccccctaccctncctcccaangcatgcaaggtctgtgaggggagtgggaaggtgggtttgagtgttggtgctcagggtcatacttccttgtcagacaa

SEQ ID NO: 1678 - DNA, 565 bp, Mus musculus
aagcccaaagccaagtcgagtgccaagaggggcagcaagaagaagtgaagactttgcttggggacactccttcctccctcctgttttctgtaaatacatttcctcacttgattccatctgcaaccctttgcccattctattctgatcttattaaagtggaacagtgtttgaattcctcatacaagcattgttgaaatgactcctttttccttaacctattgtgcaaggacgcaaacagacctcatctttgtaatgatggagacgtacttttttcttagatttgatattaaccttcttacggggttagggatgggaggggggagatgtgtgtttcagtcggtggtttgtttactatgaagaactggcaagttctggctaggtgaggggacccaggaactaaggtttgtcttccgagctttcttggactgcttgtccctcgtgagcttttcaaacctttgatggggagcaggtgacaccccacctagctggccaaggagggagggaaaattccctggggctgccctaccaaaccgtggtaagttggagacctggttgctttttctct

SEQ ID NO: 1679 - DNA, 543 bp, Mus musculus
  misc_feature (45)..(45): n is a, c, g, or t
agtggcctgggtcttagcattgctcctcaccattccatccttcgngtaccgggaggcatataaggacttctactcagagcacactgtatgtggtattaactatggtgggggtagcttccccaaagagaaggctgtggccatcctgcggctgatggtgggttttgtgttgcctctgctcactctaaacatctgctacaccttcctcctgctccggacctggagtcgcaaggccacgcgctccaccaagacgctcaaagtggtgatggctgtggtcatctgtttctttatcttctggctgccctatcaggtgaccggggtgatgatagcgtggctgcccccgtcctcgcccaccttgaagagggtggagaagctgaactccctgtgcgtgtccctggcctacatcaactgctgtgttaaccctatcatctacgtcatggctggccagggtttccatggacgactcctaaggtctctccccagcatcatacgaaacgctctctctgaggattcagtgggcagggatagcaagactttcactccgtc

SEQ ID NO: 1680 - DNA, 351 bp, Mus musculus
acgggcgcccagtgcaccacgtgtgtggaggacgaaggtgccaaggcccgtatcgtactcaccgcaggggtcctcctcctcctctcgggcattttggtgctcatccctgtctgctggacagcccatgccatcatccaggatttttataacccactggttgcggaagccctcaagagagaactgggggcttccctctacctgggctgggctgccgctgccctgctcatgctagggggagggctcctctgctgtacgtgtcccccgtcacactttgagcgtccccgcggccccaggctgggctactccatcccttcccgttcaggtgcttcgggactggataagagggactat

SEQ ID NO: 1681 - DNA, 398 bp, Mus musculus
  misc_feature (223)..(223): n is a, c, g, or t
  misc_feature (262)..(262): n is a, c, g, or t
  misc_feature (265)..(265): n is a, c, g, or t
  misc_feature (268)..(268): n is a, c, g, or t
  misc_feature (272)..(274): n is a, c, g, or t
  misc_feature (286)..(286): n is a, c, g, or t
  misc_feature (293)..(293): n is a, c, g, or t
  misc_feature (295)..(295): n is a, c, g, or t
  misc_feature (299)..(299): n is a, c, g, or t
ctggagaccaagctgtgtgaccagctgttgccagccctgctgccagcccagctgctgtggctccagctgctgccagccttgctgtcaaaccacctgctgcaggacctgcttccagccatgctgtgtgagcagctgctgccgcacaccctgctgccagccctgctgctgtgtgtccagctgctgccagccctgctgccagcccagctgttgtcagtccagctgntgccagcccagctgctgtcagtccagctgctgccagccnagntgntgtnnntccagctgctgncagcccngntgcnggcctagctgctgtcagtctagctgctgcaggccctgctgccagcccttctgcctcaacctgtgctgccagccagcctgctctggacctgtgacctgca

SEQ ID NO: 1682 - DNA, 491 bp, Mus musculus
  misc_feature (193)..(193): n is a, c, g, or t
ccgcgtgtcattttctggagtggatcctgagtccaagtatatagtcctgatggacatcgtcccggtggacaacaagagataccgctatgcctaccaccggtcatcctggctggtggctggcaaagctgatcccccgctgccagccaggctctacgtgcacccagactccccctttactggcgagcagctcctnaaacagatggtgtcttttgaaaaggtgaagctcaccaacaatgaactggatcaacacggccatataattttgaattcaatgcataagtaccagccacgggtgcacatcataaagaagaaagaccacacggcctccttgctcaatctgaagtcagaagaattcaggacgttcatctttccagagacagttttcacagcagtcacagcctaccagaaccaactgataaccaagctgaaaatagacagcaatccgtttgccaaaggattccgggactcctccaggctcactgacattgaga

SEQ ID NO: 1683 - DNA, 501 bp, Mus musculus
agaacagccgtgaggctctctctgcctagcgtttttttcacatggtagggcaggcctgtctcctgatttgcacagcagctgagaccttctgggccactgtctacctggcaaaggatgtggctgtgaagagaacagaccaaaatccctgtcctgggctgcaattagagagcatgagacttccacgggaacagaagtgaggcggaacaaacgctagagctggggtaggcctgttcctgctgcaggcttagcctggcccctgcccagaagtaggagcttaaaagctgagaaaataggaacagtatgggcaaagccttcagggtcaccatagcacattccagaaactaaacagaagtcagaatggctggagaggtacagctggaaacaagagagaaagggccaggcatctagagcctggaaggtagcatagcctttatctaatccttagagaacagaaaaccatggaaacgttctgagacaggcgacccaagcagattgcatttc

SEQ ID NO: 1684 - DNA, 499 bp, Mus musculus
  misc_feature (60)..(60): n is a, c, g, or t
  misc_feature (201)..(201): n is a, c, g, or t
tatccattctggctaccacctttaaccccactcctccggttccatccacaccccttcctntaaaggagcctcccaggacaccttctccaccactgagttctaacccagacattgacacagacattgagtcagtggcttctcagccaatggaacttccagagaacttatcactggagcctaaaaatgaggattcagctttgncagaaaaggacaaaacaaataactcatcaagatctaagaagcccaaagggttagaactgacacccgcccttgtggtcacaggcagtgaccccagcccctcggggatcctaagcccatctctcccgacagcgtctcttacaccagcactcttttcacagactcccatcttgctgactccgagccccttgctctccagcatccacttttggagcactctcagtccgtttgctcccttgagcccagccagactgcaaggtgctaatatgcttttccagtttccctctgtactcaacagtca

SEQ ID NO: 1685 - DNA, 597 bp, Mus musculus
atgctcctactgtatcatctggtggtgtttgtcctcatctacttcctgcctctagtggtgatgtttgcagcttacagtgtcattggcctcacactgtggaaacgcgccgtacccagacaccaggctcatggagctaacctgcgccatctacaggccaagaagaagtttgtgaaggccatggtactggtggtggtgacatttgccatctgctggctgccctaccacctctacttcatcctggggaccttccaagaggacatctactaccgcaagtttatccagcaggtctacctggcactcttctggctggccatgagttccaccatgtacaaccccatcatttattgctgccttaaccacaggtttcgctctggattccggcttgctttccggtgctgcccctgggggacaccaaccgaggaagacaggctggagctgacccacactccgtccatctccaggagagtcaaccggtgtcacaccaaggagactttgttcatgacaggggatatgacccactctgaggctaccaatgggcaggttgggggcccccaggatggggagcctgctggaccctgaagtcttgagcttgtctgc

SEQ ID NO: 1686 - DNA, 524 bp, Mus musculus
attgccatcgacaggtacgtcaccatcttctatgcccttcggtaccacagcatcatgacagttaggaaagccctcaccttgatcggggtcatctgggtctgctgcggcatctgcggcgtgatgttcatcatctactccgagagcaagatggtcatcgtgtgtctcatcaccatgttcttcgccatggtgctcctcatgggcaccctatatatccacatgttcctcttcgccaggctccacgtccagcgcatcgcagtgctgccccctgctggcgtggtggccccacagcagcactcctgcatgaagggggctgtcaccatcactatcctgctgggtgttttcatcttctgctgggcgcctttcttcctccacctggtcctcatcatcacctgccccaccaatccctactgcatctgctacacggcccatttcaacacctacctggttctcatcatgtgcaactccgtcatcgaccccctcatctacgccttccgcagcctggagctgcgcaacacgttcaagga

SEQ ID NO: 1687 - DNA, 102 bp, Mus musculus
ctcattgactctctgacaagtgttaaaggtaaaaaaatgaatttttctgactctcatttgtttcctgtgataattcatgactccttacaagcaagtgttttg

SEQ ID NO: 1688 - DNA, 373 bp, Mus musculus
  misc_feature (148)..(148): n is a, c, g, or t
  misc_feature (175)..(175): n is a, c, g, or t
  misc_feature (196)..(196): n is a, c, g, or t
  misc_feature (207)..(207): n is a, c, g, or t
  misc_feature (215)..(215): n is a, c, g, or t
aagaaacttgttcttctctctgccttcgttctgctggccttccaggtccaggctgattctatccaaaacacagatgaagagactaaaactgaggaacagccaggagaagagaaccaggctatgtctgtttcctttggagacccggaangttctgctcttcaagatgcagccgtangaatggctcggccgtgcccanccatgccccangttgcccngtcatgtccatggtgcccaatgtgcccgaggtgcccgagctgcaaatgcaatccaaaataaacctgcacttggcaccaaagatccaaataaacagcataaattctgctgcagctgagcatggaatctgggtcaagataataatcatgttctctggaac

SEQ ID NO: 1689 - DNA, 404 bp, Mus musculus
atttccccacataggcagttatgccaaatttgggttaaatagaaactattaaatacattataatgataatctactctattctcattttaggcttattttacccagagtttcagaagagtttcttttctcaggtgctcacctccttttgtgagagtttctgagttaaggaatattgctgaggctttcacacgctgctatctgtaaacgcgttgtaacgcccacactgtaaagctccaggcttctgtgagctgccacagctgtgacgtgactccagacccctcaccagaaagtaaaggttcagtctttgccttctactagaccccaaactctcctttgtttgctgtaacttatgaagcacctgcctctagtaacccgccacacccactcatcgaggttgtgatcac

SEQ ID NO: 1690 - DNA, 464 bp, Mus musculus
atgatgccaactcctcttgctgtatcctgcttggctgctctgtgtcttggtttcacacacacacacatacacacacacactgcccgaggctggtcacagcaagcatgtatgccacccttgcaccaggcaggaactgggtgtgttacactagtgagccactggtactcagccttgttggtgagggggacacaaaacaacgtgtccaggtgaccaggtacccatgggggccacacgggctgtgcctgtgaactggtggtataaggtttgaaggcagttggggtgtcttccaaatccccttgaccagcagactggctcatacagcccacctgactccctctgtaccccctactcctctactccacccctcccactgctgctcaaagtctgagggccctggattaggtagggtcagggaaggactgctgtttgacctaggcctataactggaccagcctgggacttga

SEQ ID NO: 1691 - DNA, 490 bp, Mus musculus
acaggccctgggtatggtaaggcacatgctgatggaggtataatggtccccgagggccacctctgtacttgaaggagccattagtgtagaaatgtgacctgtctccacacccctcttcacgtgcactgttcagctcctttgcccataggtgctggcactgccaggagcttttgcgcagggcggggctttggggggaatgtcactactactgccattgtgactgatgacactccttgttgggagtgaagaagcaggccaggacatgcctagggctctggcttaaccctgtgtaggagggaagaaggctgattttctcagagcctttagtccgagaggagatagagggcagaggaaccaactggtatagccagtgacttgtggctcccacacggaccccgccctccagacgagcctgaggttctgggttctagtgtctgacttgggagctcaaaagaaggttgttctagacaagttgttcctgtttctcggc

SEQ ID NO: 1692 - DNA, 586 bp, Mus musculus
agtaattcctgcgtgaacccctttgctctctattggctgagcaagaccttccagcagcattttaaagctcagctctgctgcctcaaggcagagcagcctgagcctcctcttggtgacatcccccttaacaacctcactgtgatggggcgggtcccagctactgggagtgcacatgtctctgaaattagtgtgaccctgttcagtggcagtagtgccaagaagggagaggacaaagtttagatgttacattaaaaatgatgatttttagtcccactgtgtgtatccagctttaagctgtgcatagtacagtgtctgggttttctgttgttcatgaattgtgttgaagttttcagaaagaattatccttgtaagtaatagacaaaccatcattttcttcaaggtgcaaacagtaatgccatttgggctttctaaatacaacaaagcccaccaagtagagaagaagaggtttggaaataccagtcaactgtgaagaaggctgtatagaagggatggtaaagaaaccagataaaggtttaaatatcgaattggatcccatctctctgatattcctcatctcttgagcact

SEQ ID NO: 1693 - DNA, 464 bp, Mus musculus
aacagatgcaacactggatccatgtaatagtggtctaacctttgatgctataattacatatcggggggaggtgatattctttaaagacaggttctacattcgggtaattagcttcctgccagaacctttgatcgatgtgatagaccttacctggccaaatctgccaggtaaatttgatgcagcttatgaagttagtggggtagatgaactccgctttttcaaaggcagcaaagtatgggctgttcaggaacagaatgtactggaaggatttcccatggacatccagagtttctttggcttccctagcaatgtgacaaacattgatgctgctgtttgtgaagaagagactggaaaaacatacttctttgttgaccacatgtactggagatatgatgaaaatacacggtccatggatccaggttaccccagattaatagcagaagactttcctggaatcgactata

SEQ ID NO: 1694 - DNA, 523 bp, Mus musculus
tggttttttaccaagtggcctctgaagacggcatgctacaatgtttccagttttatgaagagcagtctttgaggtggaagctctttacccactttgaaatcaacgccttgggtctgctgctcccctttgccatcctcctgttctgctatgtcaggatcctgcagcagctgcggggctgcctgaaccacaacaggaccagagccatcaagctggtgctcaccgtagtcattgtgtctttactcttctgggtcccattcaacgtggcccttttcctcacgtccctgcacgacctgcacatcttggatggatgtgccacgaggcagaggctggctctggccatccatgtcacagaggtcatctcttttacccactgctgcgtgaaccccgtcatctacgcgttcataggagagaagtttaagaaacacctcatggatgtgtttcaaaagagctgcagccacatcttcctctacttagggagacaaatgcccgtgggggcgttggaaaggcagctgtcctcgaacca

SEQ ID NO: 1695 - DNA, 475 bp, Mus musculus
tcccagtgcatgctgagactacagacatatgctatcaagcctggcttacttctatagtttgaaaaatgtcgtgactaaatcaaaccatcataatttctggataatctggtctacagcagagcagcttgtaggccacctcggcataggtaagaggaggtcatggagctgtgagagagctttccctttataatatttcagctggatggaaatcagataagcaggatcattttgctatactctcttaatatttatgaccattaatagaatatctgcttagctttatgtagaagtgaatatgcagtacctgcaggatgtaattatttcatctttttgtccccttgtaaaatgtactcgaaattctataatggaaacagcctcactcaaatctgaaatgacagaggctaagttcttgattggacatgattgcacatgagcgtgccttctgtagttttgtccctggacacatccttgggaa

SEQ ID NO: 1696 - DNA, 549 bp, Mus musculus
atgtggagttgttactgcccgaaaaggaaaacatttccctgaagatttagcgcacgaaaatttaattatatcaaataccgaagcacctggggatgacagagtgtgttctgcatggattcaccacccacactgccaacaactccagccaaggcttctgtggtacaatgggtcaggaatgaggaatggtgggcaggagacgattgagatgatgaaaggacaccagaccttggactcctgccgtgtggccgggcatcaccataccctggattccggcaggggaggacacatggatactgataactgcagatacacatactcagagtggcacagtttcactcaaccccgacttggtgaagactccattagaggacacactggttaaaaattaaacataaaagaaattgcatgtgtgtaatcagaatgaaaaccacatcccatcccaagactatgtcctcacctataactacgaaggcagagggtctccggccggctctgtaggttgctgcagtgaaaagcaggaagaagagggacttgacttcttaaacaact

SEQ ID NO: 1697 - DNA, 552 bp, Mus musculus
ggcggaggacccttgcagctctcgcccgcctctccactcacggaccagcgggccagcagccaggactgctcagaggatgaggaagatgaagagatcgacgtggacgattgagctgtgccctggacctcctgccgcccgggcccccagtgcccgcatgcccgccgcctcccggatcggaccgctaaggggagctgggacctcctctgcacctcccgcctccacccttgtcccggggccgggcttggcccctgctagccgtctcttccttttcgaagcaataaatccgggccggccggcggggccggccgccacacgaggcctccgccgccccggaagccctcgccgtgcaattctgtatggcttctgtataaatatttaagcctatatagtgggttcctcccaccacaggttgattattttcttccttttattatgattattatttttttttaatctcagagatttcgatgttttcaaagcccgggtgctgccgggtcggctgacggtgaggcggactcgagagcggcgaacactactaactcctgcggtcta

SEQ ID NO: 1698 - DNA, 529 bp, Mus musculus
gcaacagcagttccatgaccaccagcagcagcagcagcagcagcagcagcagcagttccatgaccaccaccagcagaagcagcagttccatgaccaccaccaccaccaacagcagcagcagttccatgaccaccagcagcagcagcagcagttccatgaccaccagcagcagcagcatcagttccatgaccacccccagcagaagcagcagttccatgaccacccccagcagcaacagcagttccatgaccaccaccaccagcagcagcagaagcagcagttccatgaccaccaccagcagaagcagcagttccatgaccaccaccagcagaagcagcagttccatgaccaccaccagcagcaacagcagttccatgaccaccaccagcagcagcagcagcagcagcagcagcagcagcagcagttccacgaccagcagcttacctacttactaacagctgacatcactggtgagcatacaccataccaggagcacctcagcacagccctgtggttggcagtctcatga

SEQ ID NO: 1699 - DNA, 536 bp, Mus musculus
gcacaagcattgttgctccagtggtggtgctggcctcgcgggttcgcttctgtcgctcagatgtgatccgccactttgcctgtgagcacatggccctgatgaagctttcctgtggggacatctcgctgaataagacggtgggactcactgttcgcatcttcaaccgagtcctggatatgctcctgttaggtgcctcctactcccgcatcatccatgctgccttcaggatctcatcaggtggagcacggtccaaagccctgaacacctgtggctcccacctgctggtcatcttcaccgtctactcctccaccatgtcctcatccattgtctaccgtgtggcacgcactgcctcccaagatgtgcacaacttgcttagtgctttctatctgttgctcccctgtctggtcaaccccatcatctacggggccagaaccaaggaaatcaggcagcacctggtagctctgttccaaaggactcagcaacaggtcttcactgagaagccccagtccctgccctcgaatagagagcttcctgga

SEQ ID NO: 1700 - DNA, 533 bp, Mus musculus
gatgatcctcgttagttggagccttcctgctgtttatgcatttgggatgatcttcctggaactgaacttaaaaggagtggaagagctgtatcgcagtcaggtcagcgacctgggcggctgttctcccttctttagtaaagtatctggggtactggcgttcatgacttccttctatatacctggatctgttatgttatttgtttactataggatatatttcatagctaaaggacaagcaaggtcaatcaatcgtacgaatgttcaagttggattggaagggaaaagccaagcaccacaaagcaaggaaacaaaagccgcgaagaccttagggatcatggtgggcgttttcctcgtatgctggtgcccgttctttctctgcacggtcctggaccctttcctgggctatgttatcccaccctctctgaatgacgcactgtattggtttgggtacttgaattctgccctcaatccgatggtttatgcctttttctatccctggttcagaagagccttgaagatggttctccttggta

SEQ ID NO: 1701 - DNA, 481 bp, Mus musculus
tggccatctgttacccactgagatacaccaccatccttacttcctcagtcattggcaagattggcacagcagctgtggtcagaagctttctcatctgttttccattcatcttcctggtatatcgacttctgtattgtgggaaacacataattccccattcatactgtgagcacatgggcattgccagattggcatgcgacaatatcactgtcaacatcatatatgggctgacaatggccctcctgtctactgggctagatatactactcatcattatttcctacaccatgattcttcgcactgtttttcaaatcccttcctgggctgccagatacaaggccctcaacacatgtggctcccacatctgtgttattcttttattctacactcctgcattcttttcattttttgcccatcgctttggaggcaaaaccgttcctcgccacatccacatcctagtggccaacctctacgtggtggt

SEQ ID NO: 1702 - DNA, 524 bp, Mus musculus
agacatgctactatcttctctccacaactcaccacttgccttggagctggtgcattactgaggtctctcattaccacatttccattgatattgctcatcaaattttgccttaagtactttagaactaccattatctcccactcgtactgtgaacacatggccattgtgaaactggcagctcaagatatcagaatcaacaagatatgtggcctccttgttgcctttgccatcttagggtttgacatagtcttcattaccttctcctatgtgcgaatcttcatcacggtcttccagctgccccagaaggaggctcgattcaaagccttcaatacctgcattgctcacatctgtgtcttcctgcagttctaccttctggccttcttctctttcttcacacacaggtttggggctcacatacccccctatgtgcacatcctcctgtcagacctttacctgttagtcccaccttttctgaaccccattgtttatggtattaaaactaaacaaatccgtgaccaagtcct

SEQ ID NO: 1703 - DNA, 382 bp, Mus musculus
aggtagagatacaggcacttcccctgacccaggaagactccctgctggctgtgaggacatacttccacaggatcactgtgttcctgagagagaagaaacacagcccctgtgcctgggaggtggtcagagcagaagtctggagagccctgtcttcctcagccaagttgctggcaagactgaatgaggacgagtgagtcctgagaccaagtgtggagagacctccctggactagaacactgcacctgcactttataagctccctttacaactctcattaccttcagtgtgaacacaatcaacctgccaagacgctgcagcaatattgagcaattattttcagcatgtatagccacttttgtatctgcaccatttgtctctattt

SEQ ID NO: 1704 - DNA, 511 bp, Mus musculus
gagtgctttaagctggtctctggcattggcatgatagaagtggacccatttgtccaatcctatatccttgtccctgccctggggctcacctatgatgggatgctgactgatgttcagagtaagcccaagacaggtatcctaatagttgttcttggtgctattttcacgcaaggaaactgtgtcagtgaggagattatctggaaaatgctgaataacatagggttgtatggtgggaggcatctttacatacatcaagaccccaggaagttcatctctgaggagtttgtgcacgaagggtacctggaatacaggcaggtgcccaatagtgatcctccgagctatgagtttctgtgggacccaagggcctttgcagaaaccaccaaaatgaaagtcttggagatttttgccagcattactatgaccgatcccagagcttacactgaaaaatatgcagaggctttgagagatgagacagagagggcccaggccaggatcatccagcagatagttc

SEQ ID NO: 1705 - DNA, 547 bp, Mus musculus
gctttctgctcacagcaatgggttatgatcgttatgtggctatttgtaatcctctgagatatacaatcatcatgagcaagggaatgtgtgccttgttggtctgtgggtctttaggcactggcctggttatggcagttcttcatgtgccagccatgttccatttgcccttttgtggcacggtggtggagcactttttctgtgacatatacccagtaatgaagctttcttgtgttgataccactgtcaatgagataatcaattatggtgtaagttcatttgtaattcttgtgcccatagggctgatatttatctcctatgtgctcattgtctcttccatccttaaaattgtgtccactgaaggccagaagaaagcctttgccacctgtgcctctcatctcactgtggtcattgtccactatggctgtgcctccattgcctacctcaaacccaaatcagaaagttcagtagaaaaagaccttcttctctctgtgacctacactatcatcactcccttgctgaaccctgttgtctacagcctcaggaacaa

SEQ ID NO: 1706 - DNA, 541 bp, Mus musculus
ttctgagatctttctgctgacgattatggcgtatgatcgttatgtggctatctgcatcccattgcattactccaatgtgatgaacatgaaggtctgtgtacagcttgtctttgcactctggctggggggcactattcattcacttgtgcagaccttcttgactattcgtctaccctactgtggcccaaacattatcgatagctacttctgtgacgtacctcctgtcatcaagctggcctgcacagatacataccttacagggattctgatcgtgtccaatagtggaaccatctccctcgtatgttttctagccttggtcacttcttacacagtcatcctgttttctcttcgaaaaaagtctgcagaaggtcgtcggaaagccctgtccacctgctcagcccacttcatggtggtcaccctgttctttgggccatgtatcttcctctacactcggccagatagcagcttctccatcgacaaggtggtatcggttttctacacagtggtcacccctttgttgaatcctctcatttacactttg

SEQ ID NO: 1707 - DNA, 437 bp, Mus musculus
gcatgtctgtattgtgctggtggcagtggcttggctgggtggcatcctgcattcaacagctcagctctttctggtccttcagttgcccttctgtggtcccaatgtgataaaccactttgtgtgtgacttgtatcctttactggagctggcctgcactgacacatatgtcattggcctgctggtggtggccaacagtggtgtgatttgcctgttgaacttcctcatgctggctgcctcgtacattgtcatcctgcgcactttgaggtcccacagtgcagagggaagacggaaagctctgtctacctgtggagcccacttcactgttgttgctttgttctttgtgccctgtatatttatttacatgagaccatcatctactctgtccatagacaaaatagtagctgtgttttattgtattttgacacccatgttcaacc

SEQ ID NO: 1708 - DNA, 372 bp, Mus musculus
tgctctcacagatatcacgttttcctgaacacataattgggagaaatgacacgtcatttgacctcagtgatggtatcttgacgttagtagcctctttggtcctgaactcacttctacagtttatgctcaatgtgacttttgcttccttgttaatacattccttgagaagacatatacagaagatgcagagaaacaggaccagcttttggaatccccagacggaggctcacatgggtgctatgaggctgatgatctgtttcctcgtgctctacattccatattcaattgctaccctgctctatcttccttcctatatgaggaagaatctgagagcccaggccatttgcatgattattactgctgcttaccctc

SEQ ID NO: 1709 - DNA, 491 bp, Mus musculus
ggaacatccaccctgattgagtgtgtgatcaacaagaacacaaatgttgcccactggacaactcccagcctcaagtgcatcagagacccctccctagctcactacagtccagtgccaacagtagtgacaccaaaggtgacctcacagccagagagcccctccccctctgcaaaagagccagaagctttctctcccaaatcagataccgcaatgaccacagagacagctattatgcctggctccaggctgacaccatcccaaacaacttctgcaggaactacagggacaggcagtcacaagtcctcccgagccccatctcttgcagcaacaatgaccttggagcctacagcctccacctccctcaggataacagagatttctccccacagttccaaaatgacgaaagtggccatctctacatcggtcctcttggttggtgcaggggttgtgatggctttcctggcctggtacatcaaatcaaggcagccttc

SEQ ID NO: 1710 - DNA, 426 bp, Mus musculus
gcaagggtaccctggtgcagaccaagggcaccggcgcctccggctccttcaaactcaacaagaaggcggcttccggtgaggctaagcccaaagcaaaaagggcaggcgcggccaaggcgaagaagcctgcgggcgcagccaagaagcccaagaaggctgcggggacagccaccgccaagaagagcaccaagaagactccaaagaaagcgaagaagccagctgcagctgcaggagccaaaaaagctaagagcccgaagaaggcaaaggcaactaaggctaagaaggcgcccaagagccctgccaaggcgaaaacggtaaagcctaaagcggccaaaccaaaaacctccaagcctaaggcagctaagccaaagaaaaccgcagccaagaaaaagtaaattttctttggccaactgcttagaagcccaa

SEQ ID NO: 1711 - DNA, 242 bp, Mus musculus
caatgaagtccatcagcagctcaatgacctcaaagcctgtgtgatgcaacaggtcggggtgcaggaatctcccctgacccaggaagactccctgctggctgtgaggaaatacttccacaggatcactgtgtacctgagagagaagaaacacagcccctgtgcctgggaggtggtcagagcagaagtctggagagccctgtcttcctcagttaacttgctggcaagattgagcaaggaggagt

SEQ ID NO: 1712 - DNA, 277 bp, Mus musculus
gatgagctactactggtcagcctgttctctaggatgtgacctgcctcacacttataacctcgggaacaagagggccttgacagtcctggaagaaatgagaagactcccccctctttcctgcctgaaggacaggaaggattttggattccccttggagaaggtggataaccaacagatccagaaggctcaagccatccttgtgctaagagatcttacccagcagattttgaacctcttcacatcaaaagacttgtctgctacttggaatgcaactctc

SEQ ID NO: 1713 - DNA, 455 bp, Mus musculus
gctgaggtctcttctggagagacactactcacatcagatacggaaacgaaagctggagaaggccgatatcctggagctgagtgttaagtacatgagaagcctccagaactcactgcaaggactctggccagtacccagtggggtggactacccgtccggcttccatggcggcttgcgtggcgtgagccagaggcttcggcccggagagggagacagcggcctgcgctgccccttgctgctccagcgcagggaaggcagcaccacggacagcgccaacccacaggcgacctctgttctcaacccttgcctcccggccatctgggcccccagtcgcgctgcaggtggctcccactccccgcagtccccgctccctctccctggaggtctccttgagtcttccaccgatgttgtggcaccacaacctgcatcaaactgccaggccgagagtacgagac

SEQ ID NO: 1714 - DNA, 349 bp, Mus musculus
aggcacaaatcctttcccagaagttttacacccagcatatctataatagcacctacccccgatgtgatgctgtaatgagggttgttaacaggtatagaccaagatgtaaggacataaatacttttcttcacacaagttttgctgatgttgttgctgtgtgtggccatccaaatatcacctgcaacaacttgacaagaaaaaattgtcatgctagttcatttcaggtatttataactttttgtaacctcactatgccgacaagaatatgcacacaatgcagataccaaacgacaggttcagtgaagtactacagagtagcctgtgagaacagaactccacaagacactcc

SEQ ID NO: 1715 - DNA, 254 bp, Mus musculus
agtccgggagtattggctgccatcaccctgctggaagtgccacatgctgcaccaagggaagtggtggggtaggagatcacaaggaatgggaggagctgagggtttcatggagcatgggagcacaaccttgcagagaaagccaggagcaagctcagagctgggcattcttcaagtcagagacttgtcttggttggttcagccacaagcacagacctgttgtggctcctttgtaccactttcagctgggcttaggg

SEQ ID NO: 1716 - DNA, 110 bp, Mus musculus
caagatgcagcagccataagaagggctcgccggtgcccaccatgccccagttgcctgtcatgtccatggtgcccaaggtgcctgagatgcccaatgtgcaaatgcaatcc

SEQ ID NO: 1717 - DNA, 277 bp, Mus musculus
catggtgaactttactgctgaggaaaagaccctcatcaatggcctgtggagtaaggtcaatgttgaagaggttggtggtgaagccttgggaaggcttcttgttgtgtacccatggacccatagattttttgacagctttgggaacttgtcctctgcttctgccataatgggcaacccaagggtcaaagcccatggcaagaaggtgctgactgcttttggagagtccattaagaatctagacaacctcaagtctgccttggccaagctcagtgaactg

SEQ ID NO: 1718 - DNA, 442 bp, Mus musculus
  misc_feature (166)..(166): n is a, c, g, or t
gacgacgatcagaaatggcgccacgcaaggggaaggaaaagaaggaagagcaggtcatcagcctgggacctcaggtggctgagggagagaatgtgtttggtgtctgccacatctttgcatccttcaatgacacctttgtccatgttaccgatctttctggcaaggnaaaccatctgccgagtgactggtgggatgaaggtgaaggctgaccgagatgagtcctctccatatgcagccatgttggctgcccaggatgtggcccagaggtgcaaggagttgggcatcactgccctgcacatcaaactccgggccacaggaggaaacaggaccaagacccctggacctggagcccagtcagccctcagagctcttgctcgctctgggatgaagattgggcggattgaggatgtcacccccattccctctgatagcactcgaagaa

SEQ ID NO: 1719 - DNA, 152 bp, Mus musculus
tggtgtctacaccaaggtgtgcaagtatgtgaactggattcagcagaccatcgctgccaactaaatgcctttagctcttcataagccctctctttgttgtcaaatccaccttccttctatgccctaaaccactatcaagagaaaaacatttt

SEQ ID NO: 1720 - DNA, 440 bp, Mus musculus
ttaagctgaagacagctgccaccctcaactctcgagtgtccactgtcgctctgccaagatcttgtccatcagctggtactaggtgtcttgtgtctggctggggcaacaccctgagctctggcaccaactacccttcactccttcagtgtcttgatgctcctgtcctctctgacagttcttgcacaagttcttacccaggcaagatcactagcaacatgttctgtctgggcttcctggagggcggaaaggactcctgccagggtgactctggtggccccgtagtctgcaatggacaactccagggtgttgtttcctggggttatggctgtgctcagagaggaaaacctggtgtctacaccaaggtgtgcaagtatgtgaactggattcagcagaccatcgctgccaactaaatgcctttagctcttcataagccctctctt

SEQ ID NO: 1721 - DNA, 388 bp, Mus musculus
  misc_feature (114)..(116): n is a, c, g, or t
  misc_feature (143)..(143): n is a, c, g, or t
  misc_feature (328)..(328): n is a, c, g, or t
gggaactcaatcactgcgtacaactaacataatttacaagccattctaagttaaatcctctggaagcagatccaaatggatccaccacctgaaacgaggtcccctctatctatnnntttgcctcatctccagccctcccactnactctcttctcctccactgtccctctgcccaccccggaagtcccacctacttgcccagtgattggtttctttattcattagaagggtcacatgacatcccaagtatttgattcactcctctttccagtcagttcctcttggggaagttgaattagcatcaaaatacagacagcaccagggctatncacaacactactacacctacctttccaaggattcacactctaatatttcctcttgttttt

SEQ ID NO: 1722 - DNA, 360 bp, Mus musculus
ggttattgtttcaacatggccctgtggatgcgcttcctgcccctgctggccctgctcttcctctgggagtcccaccccacccaggcttttgtcaagcagcacctttgtggttcccacctggtggaggctctctacctggtgtgtggggagcgtggcttcttctacacacccatgtcccgccgtgaagtggaggacccacaagtggcacaactggagctgggtggaggcccgggagcaggtgaccttcagaccttggcactggaggtggcccagcagaagcgtggcattgtagatcagtgctgcaccagcatctgctccctctaccagctggagaactactgcaactagacccaccactac

SEQ ID NO: 1723 - DNA, 139 bp, Mus musculus
gaccatcagcaagcaggtcattgtttcaacatggccctgttggtgcacttcctacccctgctggccctgcttgccctctgggagcccaaacccacccaggcttttgtcaaacagcatctttgtggtccccacctggtag

SEQ ID NO: 1724 - DNA, 289 bp, Mus musculus
  misc_feature (240)..(240): n is a, c, g, or t
  misc_feature (242)..(242): n is a, c, g, or t
  misc_feature (262)..(262): n is a, c, g, or t
cctgctggcagtggtcctggttttgggactgcatgctctggtagagggcgagaaaccttccccctgtcggtgctccaggctgacaccccacaacagaaagaactgtggcttcccgggcatcaccagtgagcagtgctttgatcttggatgctgctttgactctagcgtcgctggggtcccttggtgtttccacccacttccaaaccaagaatcggagcagtgtgtcatggaagtgtcagntngcaagaattgtgggtacccngggcatcagtcccgaggactgtgccag

SEQ ID NO: 1725 - DNA, 279 bp, Mus musculus
  misc_feature (190)..(190): n is a, c, g, or t
  misc_feature (222)..(222): n is a, c, g, or t
tctgcgggacactgttacactcgaccccaaagccaacgcccaccttctatggagctgacttgtaatgccttctaggtaacagcgactcacatccagactgacatctctgctctaggaaataacactgtttatgagactgtacctgccacccactggacagggtgacagttctcagtgtagggtaagtcangtgcagagtggtgcgctccgagctcctgctgntcacaccatgggctcctgtttaaccctctagctcttgcctgtggagacatgagggct

SEQ ID NO: 1726 - DNA, 511 bp, Mus musculus
  misc_feature (114)..(114): n is a, c, g, or t
  misc_feature (283)..(283): n is a, c, g, or t
  misc_feature (321)..(321): n is a, c, g, or t
  misc_feature (327)..(327): n is a, c, g, or t
  misc_feature (344)..(344): n is a, c, g, or t
  misc_feature (346)..(346): n is a, c, g, or t
  misc_feature (350)..(350): n is a, c, g, or t
  misc_feature (400)..(400): n is a, c, g, or t
  misc_feature (484)..(484): n is a, c, g, or t
gacgttctagctgatagtcgccatctctggagcccttttgggttgcgctctctttcagcctctagcctcttttataaacagcgtaacactgagcacgatccaccctactggcgnaggtgccgtgtggctgaatattaactacctagctttgggggcactacatcactatgggcatgtggagggtcctcacaaggttcaggctgccaaactctaccatgaactgcgggccaatgtagtgagaaacgtccgccagcaataccaggctaccggatttctgtgggancagtacagtgaccaggatgggcggggcatgggctgccngccccnttccaaggatggaccantncttntcttactgatcatggctgaagagtactaatgggacagaaggaaagctagnccatttgtgtcacttggaatatgcagacaagggcttgggtttctggtctcattgtttcagatctttgtaagctcatctcaggtntctccttattgtcatcccatatagctc

SEQ ID NO: 1727 - DNA, 298 bp, Mus musculus
tgggtttacaactgtgcactgcgtctggcttctacttccatgtgtgttgttggtgacttgcactgcaagaacctgggacttggtaaagttatctataagctgggtctttgcaccagtgcaagcccttacttgacagatggagacactcatgaaacaagcttgctttgtagccatgagtgacgttgaattgattttcttgccttacatgctgaggtcataggtatgtaccaccaggcctggctaatgttctgggtcattgtgcatcctaggggaaatgttagattcatgtccctgggaa

SEQ ID NO: 1728 - DNA, 515 bp, Mus musculus
atactttcagcatatgtccggcctgagtactggatttcatgatgttctggctatgacgaagcagatggaatccctgaaatactgcaaagatggcacttacatcatgtgagacgcagccctgcggcatgaacagtgaacagcggaggtcggatgaggtgataatgtcagagcagagtgaaaggttgcacataattgtacgaaaactttttaagctccctactgttagattaaggagtctgttttaaaagaaaattgagatgcagaatgaagcattcattgaataagaaaattgtcgctctgtttgaattatgtgcttgaaaggaatcttgcattggaatgaacatgatgtaaccgtacacatcatcttcaggaatggacgcataatgatggattctggtgaagaccaaaatttcttctgtgcatttactctcagtcaggaagcatccccactgtaaatatgtatttacatgtttattacaaagactcagatgaagtttttagtcgattttttgcat

SEQ ID NO: 1729 - DNA, 549 bp, Mus musculus
  misc_feature (250)..(253): n is a, c, g, or t
  misc_feature (306)..(306): n is a, c, g, or t
  misc_feature (329)..(329): n is a, c, g, or t
  misc_feature (352)..(352): n is a, c, g, or t
  misc_feature (355)..(355): n is a, c, g, or t
  misc_feature (357)..(357): n is a, c, g, or t
  misc_feature (376)..(376): n is a, c, g, or t
  misc_feature (384)..(384): n is a, c, g, or t
  misc_feature (486)..(486): n is a, c, g, or t
  misc_feature (499)..(499): n is a, c, g, or t
  misc_feature (506)..(506): n is a, c, g, or t
gatgatgcagaggttgaggctattctcaattcgggtgctaggggttattctgctccatagagagatcctaggcaaacccttaggagtggaaaagagaatccaaagtatctgctccatggagtagataggcagggtcctgaattcaaaaggttgtggagggtggggagggcactgtatttggtatttgtgaccagtgctaattgttaaactgcaaagtagtgtttgctatagatattgttatcttgtattnnnntttataacactgttgactaagaatcacaatatgtttaaatatatacttgaggnaaagtttatgttatttttttctntcgttggcatttgatattaacanctntnctaaccttattaaatgaantctttgtntcatgttgtgtgatggatagaaagtaccactgagaggctgttctttgaaagtttggaataaccagtaaagtgtgagtggaagaagattacagatttgttctntctttcccttgtntctgatntcttgtaatggaacacatttgtaaatatgctcactgtgcaaat

SEQ ID NO: 1730 - DNA, 566 bp, Mus musculus
  misc_feature (362)..(362): n is a, c, g, or t
  misc_feature (364)..(364): n is a, c, g, or t
  misc_feature (366)..(368): n is a, c, g, or t
  misc_feature (370)..(372): n is a, c, g, or t
  misc_feature (375)..(375): n is a, c, g, or t
  misc_feature (377)..(379): n is a, c, g, or t
  misc_feature (436)..(437): n is a, c, g, or t
  misc_feature (441)..(442): n is a, c, g, or t
  misc_feature (445)..(447): n is a, c, g, or t
  misc_feature (451)..(452): n is a, c, g, or t
  misc_feature (456)..(456): n is a, c, g, or t
aagcagaccatccactactatgaacagatcacacttaagtctatggcgggatcaggccataatgtctcccaagaggctatcgccatcaagcggatgctagagatgggagctgtcaagaacctcacatacttctgacttggatgggagctgtaacaccttggttccctactttgccatctgagtaggccctgtctacagcttagaggttcctggtgccagtacaatccaattgaactcaccctcaatggagagggtgttctggggctgtccaggtctccagagaggctatgcccctgcctactttggtggatttcaaatccagacagggtagtcacaccgaggctacaggagcctggctaaangngnnngnnnggngnnnctgttactgtggcatcccctctctcagccagcacaaagagctgttttgttttgtttnntttnnttnnntttnntttngtcttgtattgttggtggtggttggttgggttttgtttgtttgtttgtttttgtttgctttgttttgttcttgagacagggtctgactgtgaaaccctggctaatctgga

SEQ ID NO: 1731 - DNA, 289 bp, Mus musculus
  misc_feature (203)..(203): n is a, c, g, or t
agcttcaccagatctcggaatggaccccaactgctcctgctccaccggcggctcctgcacttgcaccagctcctgcgcctgcaagaactgcaagtgcacctcctgcaagaagagctgctgctcctgctgtcccgtgggctgctccaaatgtgcccagggctgtgtctgcaaaggcgccgcggacaagtgcacgtgctgtgccntgatgtgacgaacagcgctgccaccacgtgtaaatagtatcggaccaacccagcgtcttcctatacagttccaccctgtttactaa

SEQ ID NO: 1732 - DNA, 469 bp, Mus musculus
  misc_feature (309)..(309): n is a, c, g, or t
  misc_feature (311)..(311): n is a, c, g, or t
  misc_feature (362)..(362): n is a, c, g, or t
  misc_feature (422)..(422): n is a, c, g, or t
  misc_feature (425)..(425): n is a, c, g, or t
  misc_feature (430)..(430): n is a, c, g, or t
  misc_feature (437)..(437): n is a, c, g, or t
ctgcggcagccacataaggttgttcccttgaaaggcctgtgggaggaggtggcacctaccctgcctgacggtcactttgatgggattctatatgacacgtacccgctgtctgaagaggcctggcacactcaccagttcaactttattaagaatcatgccttccgcttgctgaagaccgggggcgtcctcacctactgcaacctcacgtcctggggggagctcatgaagtccaaatacacagacatcaccaccatgtttgaggagacgcaggtgcctgcactgcaggaagctggcttcctgaaagaaaanantctgcacagaggtgatggcactggtgcccccagccgactgccgctactatngccttccctcagatgatcacacccctggtcaccaagcactgagcagccggcccaggtctnacnaaggnaggcctngtgttcctcctcagtacctttgtggctggatt

SEQ ID NO: 1733 - DNA, 402 bp, Mus musculus
  misc_feature (165)..(165): n is a, c, g, or t
aggaggcatctcatccccggtgaagaagacagagatggacaaatctccattcaacagcccgtccccccaggactccccccggctctccagcttcacacaacaccacaggccggtcatcgcggtacacagtggcatcgcgcggagcccccacccgacctcggctcntgcacttccctgccacgcccatcctgccacagacagcctccacctacttcccccatacggccatccggtacccgccacatctcaacccccaggacccgctcaaggatctggtgtccctggcctgtgacccggccacccagcagcctggaccgcctgctctccgcccgacacgtcccctgcaaacagtccctttgtgggattaggacggagggatcctcttgcgggacagtcctggta

SEQ ID NO: 1734 - DNA, 254 bp, Mus musculus
  misc_feature (57)..(57): n is a, c, g, or t
cctatctccatgcattgcaacaagacttctgctgtccgcttcccgggtgagtggaanctgcagcctttgcctaagatcacctccacgctggaagaacccaccccacgctgccccatccgacagactcagagccccgctaaccccactgtgcccatcacaacaggaggcagatgctgaatagacccaccttgtgagaagctattcttcaagaccctcctcctcctgtccacctgggctcacaccagctctgtgta

SEQ ID NO: 1735 - DNA, 382 bp, Mus musculus
gcaaaggcgacgtcccaactaagagaccacctgtcctccgagcaggagtcaatacagtcaccaccttggtggagaacaagaaggctcagctggtggtgattgcccatgacgtagaccccattgagctggtggttttcctacctgctctgtgtcgaaagatgggggtgccctactgcatcatcaagggaaaggccaggctggggcacctggtccacaggaagacatgcaccaccgttgccttcacacaggttaactcggaagacaagggtgctctggctaagctggtggaagctattaggaccaattataatgacagatatgacgagatccgtcgccactggggaggcaacgtcctgggtcctaagtctgtggctcgaattgc

SEQ ID NO: 1736 - DNA, 484 bp, Mus musculus
taggaagacactgaacaacgacattatgttgctcaagctctcttcccctgtgaccctcaatgccagagtggccactgtggctctgcccagctcctgtgcacctgctggcactcagtgtctcatctctggctggggcaacactcttagctttggtgtcagtgaaccagacctgctccagtgcctggatgccccactgctgcctcaggctgactgtgaagcctcctatcctgggaagatcactggtaacatggtctgtgctggcttcctagagggaggcaaggattcctgccagggtgactccggtggccctgtggtctgcaatagagaactccagggtatagtctcctggggctatggctgtgccctgccagacaatcctggtgtgtacaccaaggtctgcaactatgtggactggattcaggacacaattgctgccaactagaaattcccattccctctgcagtcaccataccaataaagtgaa

SEQ ID NO: 1737 - DNA, 423 bp, Mus musculus
  misc_feature (244)..(244): n is a, c, g, or t
ggctgagctggatcctgacaatactgtccatttgcctgagtgccctggcagcagccacgggggccgaaggcaaacggaagctgcagattggagtgaagaaacgtgtggaccactgtcctatcaagtctagaaagggagatgtcttacacatgcactacacgggaaagctagaagatgggacggagtttgacagcagcctaccacagaaccagccctttgttttctcccttggcactggccaggnttatcaagggctgggaccaggggctgctggggatgtgtgaaggggaaaagcggaagttggtgatcccatccgagctggggtatggagagcggggagcccccccaaagatcccaggtggagcaaccctggtgtttgaggtggagctgctcaagattgagagacgctcagaactgtagcag

SEQ ID NO: 1738 - DNA, 381 bp, Mus musculus
agacacgaccactacaactcagaagcaccaaggacgcaggtagagtcagccgcgtgttcgagcggtgtcacagccggatcctgcccagactgctgcctgtgtgctttcccttcaagccattctgactgctgagggttctgggttccttctagggtattgggttatctttccccgctgagggttcttgctgatcacactcaccccatccttatcatcccacccagccagtgagaaattcagactggaggccttcaaccttctgaatgtcttcactaaagctgctggaaaccactgcttttattcccataaaaccagtgttgtttttacaaaaagaagtctgttttctatgtaatgtcacagttgttgacgttcttcagtgta

SEQ ID NO: 1739 - DNA, 272 bp, Mus musculus
  misc_feature (96)..(96): n is a, c, g, or t
acagctctggctttgactgactcctgggggaagctgctgtggcccagctcctccctcctcatcttgccgtcccactggggtgctaggaaatccagngatgacggctgctctgatatggtgctcttctgaggtgggcataagggctggcccttatttgctctccctccttcgacttgcagaaattaatttaattaattaatttactatattaaagcccttggtcacccaagggctcagaaaacaagctgtgacaagcagaaaccatgtctagg

SEQ ID NO: 1740 - DNA, 336 bp, Mus musculus
  misc_feature (120)..(120): n is a, c, g, or t
  misc_feature (151)..(151): n is a, c, g, or t
  misc_feature (156)..(156): n is a, c, g, or t
  misc_feature (179)..(179): n is a, c, g, or t
  misc_feature (182)..(182): n is a, c, g, or t
  misc_feature (232)..(232): n is a, c, g, or t
  misc_feature (254)..(254): n is a, c, g, or t
  misc_feature (265)..(265): n is a, c, g, or t
  misc_feature (283)..(283): n is a, c, g, or t
attccatacaccagctctcacaggataaggctttatgagagagatgactaccggggccttgtgtctgagctcatggacgactgttcctgcatccacgatcgcttccgcctccatgagatntactccatgcacgtgctggagggctgctggntcctntatgagatgcccaactaccgagnccnccaatacctgctcaggcctggagactacaggcgctaccacgactggggcnccatggatgccaaggtcggctntctgagacggntcatggatttgtactaancctccttttgcttgttacagcccatatatgcaataaataatcaacctgtgttc

SEQ ID NO: 1741 - DNA, 403 bp, Mus musculus
actcctacagctccgtgagaatgggcaaacagagggaatccatgttctaagatgaaggcactttctccctgtcagcctgatcttatgatgcctgctttcacctttccctgtcctgaatgcacctgtgccctctgcacagttatgtctaaccatgccatataccctctgctatgccactgatacccataacttaaagtcaattatgtagaaccagttagaagtgatttcaccgtacaagtcttgttactcttgcagaggaccaaggaatatttcccaccactcacctgactgctcacaagccctgaaattctagtttcccatctattacttgattttttattttattttatttttttttgcttctactggctcttgtatgcatatgtgcacttatccagactga

SEQ ID NO: 1742 - DNA, 143 bp, Mus musculus
  misc_feature (85)..(85): n is a, c, g, or t
  misc_feature (88)..(88): n is a, c, g, or t
gggcaacactcttagctttggtgtcagtgaaccagacctgctccagtgcctggatgccccactgctgcctcaggctgactgtgangcntcctatcctgggaagatcactggtaacatggtctgtgctggcttcctagagggag

SEQ ID NO: 1743 - DNA, 382 bp, Mus musculus
taaatttcttagtcccttcttccagcccaaccaaagactatgtactatctcaaaattcgtaggttccttctgattgaacactgtctacttcaaactataagaaggctggagtggggccagaagacttagctccatgggagagttcttgcctgccaaacacaggccctgggtttgatcctcagctggggaaggaagcttggctaagtggcagggcagttgcctctaatcgctgggaagaggcggcccagaggcagcacagcgccttaggtgctggccaccatctctgttggtgtactcccccagcttcccatgaaaccatcccatgtccttcaccatggagcccacacagaaccaacatgaagttcaagcctcaggatccctg

SEQ ID NO: 1744 - DNA, 372 bp, Mus musculus
  misc_feature (341)..(341): n is a, c, g, or t
ccgttgttcttgatcttcgtgctgggtctggttgtgatccctcccactctggctcaggatgactccaggtacacaaaattcctgactcagcaccatgacgccaagccaaagggccgggacgacagatactgtgaacgtatgatgaagagaagaagcctaacctcaccctgcaaagatgtcaacacctttatccatggcaacaagagcaacatcaaggccatctgtggagcgaatggaagcccttacagagaaaacttaagaatgagcaagtctcccttccaggtcaccacttgcaagcacacaggagggtctccccgacctccatgccagtaccgagcctntgcagggttcagacatgttgttattgcctgt

SEQ ID NO: 1745 - DNA, 394 bp, Mus musculus
agggccgtggttagagcttagcaaaacctttatttacagaacagaaggcatactagatatgaaccatgagccgcaagccctcgctcaccctgtgagggattgtcatggagaagccctgtctgtgtccggaccacgttccccaaagagttcctctacctcccatgtctcccagatcgtgaccccaaggactgctttctgactcagtccctccccagcttccttctgtcttaccttgctgtcaggtgactcgttttcctagctcacctgtacagattcgggacatttcttttatcgctttttggagcgaatggattccaagtgtcctttctggagactaagaaaagggtgggcttgcttctctaagagtcctgggagcctgagtccttagaacata

SEQ ID NO: 1746 - DNA, 521 bp, Mus musculus
  misc_feature (391)..(391): n is a, c, g, or t
caaaaccattttctattacctgatttggagaaaggtctacagtagagcttgtgccccatttgaaccccatccaaaaatctattttaacctcaataaatttagaaaagttacatattaaggctatgtgaagaatgagcttatatatggaccaacttcagatgagagtgtctgagagtatctcagagagctcacaagcacgaattcctctaacaaacaagagtaacagaaaagttgcatatttgttgaaaccactaatggtattgctctgtaaggtggacatatttgtatgtgggaagtcctggtctgttctgtgtaactggacagttctacacatgataagaaatgtagctagtaaggaaatctaaaataacagattcctcccatgagtatntgatgttttcaaaatccttaaatagtgatatagatgaataattcataaaccaaagctgactttgaaatttttgatctctggttgctttcaagcctttggaactttgttgcttatctcctttaaataactc

SEQ ID NO: 1747 - DNA, 187 bp, Mus musculus
agatctgacactctccggagacacccacaaaaaggatggtgttgtgtttaaacaaacacagcccagacccaagctgaggaagcccacatattctattatagatatataatataaataaccacacaggcacttgctgtcaacgttttgagtcagtgcatttcaaggaacagccctcaactcacacgtg

SEQ ID NO: 1748 - DNA, 326 bp, Mus musculus
  misc_feature (89)..(89): n is a, c, g, or t
ttctgaaatgtgtcttgccttgggtataagcttttaattctagaggtaagatagctatgcatccatctttggctgagcttagacagagnctgagaaatgattcccaccgtcttaaataggactaatcttttaaaatccctcacttttctcaagctaactaatctggctctccccttcctctatcctcctttctccttctcccttccttcctccctctttttcctcttcctccctccttttggtttttaagacagagcttttagtattgttgtcctgattggcctcatatttgtcacagtccttcttcctcattctcttgaaagatt

SEQ ID NO: 1749 - DNA, 325 bp, Mus musculus
  misc_feature (257)..(257): n is a, c, g, or t
  misc_feature (269)..(269): n is a, c, g, or t
aagatccctggctttgctgacctgcccaaagccgaccaggacctgctttttgaatcagctttcttagaattatttgttctgcgcttagcatacaggtccaacccagtggagggtaaactcatcttttgcaatggggtggtcttgcacaggttgcaatgcgtgcgtggctttggggaatggattgattccattgttgaattctcctccaacttgcagaatatgaacatcgacatttctgccttctcctgcattgctgnccctggctatgntcacagagagacacgggctcaaggaacccaagagagtggaagagctacaaaacaaa

SEQ ID NO: 1750 - DNA, 390 bp, Mus musculus
aggcatgctgcgtcccaaggctttgacgcaggtgctaagccaagccaacactggaggagtccagagcaccctgctgctgaataatgagggatcgctgctggcctactccggttatggggacacagatgcccgggtcactgcggccatcgccagtaacatctgggccgcgtatgataggaacgggaaccaagcgtttaatgaagacagtctcaaatttatcctgatggactgcatggagggccgtgtagccattacgagggtggccaaccttctgctatgtatgtatgccaaggagaccgtaggcttcggaatgctcaaggctaaggcccaggccctggtgcagtacctggaggaacccctcacccaagtagcagcatcataacagcgtga

SEQ ID NO: 1751 - DNA, 522 bp, Mus musculus
  misc_feature (267)..(267): n is a, c, g, or t
  misc_feature (368)..(368): n is a, c, g, or t
  misc_feature (461)..(461): n is a, c, g, or t
ggaaaagtagccaccacacttcaggcctcaagggagcagtctcacctgtctgtgtccctaaatagatgggccacagtgatctgtcattctaaatagggaagggaatggaaatatatatgtatacatataaacttgttttaaaggagcctttggtctcctctatgtagactactgcttctcaagacatctgcagagtttgatttttgttgttgttctctattgctgttgttgcagaaaagtctgactttaaaaacaaacaaacaaacnaaaaacttttgtgagtgacttggtgtaaaaccatgtagttttaacagaaaaccagagggttgtactgatgttgaaaagaggaaagaaaaataatgtaagantctggtgtaccggaccaggagaaaggagaaaaacacatcccattctggacatggtgaaatccaggtctcgggtctgatttaatttatggtttntgcgtgctttatttatggcttataaatgtgtgttctggctagaatggccagaattccacaa

SEQ ID NO: 1752 - DNA, 430 bp, Mus musculus
gaattgtgaggccatccgatctacaacagagtgagttccaggacagccagggctatggagagagaacctgtctccaaaaaccaaaaagagcgattaccccagagccttcttcctgatggtagcggggaggggcaggactggacccatcttgctcagtgcctcctgacctcaatgcctttcctccaaggggtctgtatacatttctcaagcctgctcctcccatgtttgcatgtgtgttatagtctacagccaaagtatagccctcactgtaaccccatcctgcctccctcctttgggataggtgtgtgcgtctgacttgggcctccagggtgtgtacagtcagtgtgggttttgtggaggcaataagactgaagcagtagacaatccccaataccatttgcaggtctggaactgcactctcttttttaaa

SEQ ID NO: 1753 - DNA, 508 bp, Mus musculus
  misc_feature (36)..(37): n is a, c, g, or t
  misc_feature (40)..(40): n is a, c, g, or t
  misc_feature (111)..(111): n is a, c, g, or t
  misc_feature (124)..(124): n is a, c, g, or t
  misc_feature (132)..(132): n is a, c, g, or t
  misc_feature (218)..(218): n is a, c, g, or t
  misc_feature (251)..(251): n is a, c, g, or t
  misc_feature (302)..(302): n is a, c, g, or t
  misc_feature (304)..(304): n is a, c, g, or t
  misc_feature (307)..(307): n is a, c, g, or t
  misc_feature (309)..(310): n is a, c, g, or t
  misc_feature (315)..(315): n is a, c, g, or t
  misc_feature (319)..(319): n is a, c, g, or t
  misc_feature (321)..(321): n is a, c, g, or t
  misc_feature (326)..(326): n is a, c, g, or t
  misc_feature (337)..(337): n is a, c, g, or t
  misc_feature (374)..(374): n is a, c, g, or t
  misc_feature (378)..(378): n is a, c, g, or t
  misc_feature (389)..(389): n is a, c, g, or t
  misc_feature (432)..(432): n is a, c, g, or t
atggattgttttttctatgtgggtaatttgaatgcnnacnttaaaagaaaaaagtcaggaatgtcaacagatgagctcatctgcccgagctttgcaagtttctaagaaccnacctcagcttctnaaacacanagccagaaccacataaataaatggcagagctactcggaaacttctccttttcatggttaggctgggaaagtctgtctttggtttanatggcagtggtagtataaggtctctcttctgtntgctgagacacaagggaggaagtgtgggagaagtttgcgggtagatggccntnagntnntcacntgangnatagnatactttaaantcagatggaaattcttagtagcctgagttcaagcttntccnagaatagcttnttagtgtattatgacacttcactctgaccctgttactctgggncagtttcgcctaagaaagttctgaatttccgagatgcctttttgttgtagcttctgtgttcccttttgaatgactg

SEQ ID NO: 1754 - DNA, 389 bp, Mus musculus
  misc_feature (312)..(312): n is a, c, g, or t
  misc_feature (324)..(324): n is a, c, g, or t
tttaatagaaagcatggcaccaatgacattatgttattaaaactggagagtaaggccaagagaactaaagctgtgaggcccctcaagttgcccagacccaatgccagggtgaagccaggggatgtgtgcagtgtggctggctgggggaaaacatccatcaatgccactaaagcatctgcccgcctgcgagaggctcaactgatcatccaggaggacgaggaatgcaaaaaactctggtacacctattccaagaccacgcagatctgtgctggagacccaaaaaaagtacaggctccttacgagggtgaatcngggggacccctngtgtgtgacaacctagcttatggagttgtatcctatggaataaacaggacaatcactccaggagt

SEQ ID NO: 1755 - DNA, 101 bp, Mus musculus
gaggtaactttgcacttgtgctgcatgggtatatccattatttctggtggtttcttaggcttgcaaagagcacggttcccaagacgggtttatacacgtag

SEQ ID NO: 1756 - DNA, 270 bp, Mus musculus
  misc_feature (214)..(214): n is a, c, g, or t
ctcctgagtttaacattgatattgtgaaaataaatgcagttcagatttatttcttaagattcattcttcacaaaagggtgattaaggaattatgctcataaaggaacctaagcaagctgtattgtgtgtgtgctgtgtgtacacacatttgtgtgtgctcagaatacatgctttctgctcctgactttttgttgtacaggattcagattcctantcctacaagatgatgtttgtgtgtaaggcacaccttttttgttgctttattcatga

SEQ ID NO: 1757 - DNA, 331 bp, Mus musculus
ccagcacctgtcttcctgattgtaattctgccactgccatccatacttgttatatcatgactggttaaattatgactagtaagccacggagtagtgctgaagactgttccctgggagtaagtcccgtgtgcggccacctgctggtatcttgacttttatcttggctttagtccctgtatatccctggatcaaagacttggagcctgttgctatttatctgttctttatctgtagtctgaactggtttaccctgctgttgtcaccccaagttcttgccatccccttcctcagctcaactcctgttttcagtgtaggttctttctgtttggtt

SEQ ID NO: 1758 - DNA, 89 bp, Mus musculus
ttcggaccctgtaattcctaccagtaccgcctggttggacctgggcagtgggaaggagccaggaacgccatcctcacccagaagcagag

SEQ ID NO: 1759 - DNA, 468 bp, Mus musculus
  misc_feature (380)..(380): n is a, c, g, or t
  misc_feature (422)..(422): n is a, c, g, or t
agttcgcatgtaccagaatgtgtcaaatcagcccatcctgttggtgatagagaaggcatgctcaggactgttagcagtgtggccagttcactgtaacgaaggcatggccagcgaccctaacgcccaggttccaaggctggttctgtttagtataagaacagaaaagcttcatttctccgatgcagaagtcccagtctgtatgatgaaggtaacttccctgcctacttcacagggtcactctgaagagcacagacctaactgaaggggaggcccagggtagctggctgctgtggttggccacagaaagcggccatgacagctgcctgatggactaccatacttggttattagaagaaaccaccccaaagcctaacagcaanccttccttacgttgagcgataaagtattaaaaattaaacctncccctgtggttttactggtcctatgtgtgtgcctcagctcagagac

SEQ ID NO: 1760 - DNA, 417 bp, Mus musculus
  misc_feature (275)..(275): n is a, c, g, or t
  misc_feature (295)..(295): n is a, c, g, or t
  misc_feature (313)..(313): n is a, c, g, or t
  misc_feature (315)..(315): n is a, c, g, or t
  misc_feature (318)..(318): n is a, c, g, or t
  misc_feature (370)..(370): n is a, c, g, or t
  misc_feature (373)..(373): n is a, c, g, or t
  misc_feature (375)..(375): n is a, c, g, or t
ggaacagtggtaggcgcagcacaccgcagtccagaaagtctcctggagctcaaagccttgaagccaggggtcattcaaatcctgggtgtcaaagcctctaggtttctttgccaacagccagatggagctctctatggatcgcctcactttgatcctgaggcctgcagcttcagagaactgctgctggaggacggttacaatgtgtaccagtctgaagcccatggcctgcccctgcgtctgcctcagaaggactccccaaaccaggatgcaacatnctggggacctgtgcgcttcntgcccatgccaggcctgntncancgagccccaagaccaagcaggattcctgcccccagagcccccagatgtgggntcntntgaccccctgagcatggtagagcctttacagggccgaagccc

SEQ ID NO: 1761 - DNA, 261 bp, Mus musculus
ggcacatctggaacagttgcttactgacccccattccctaaggacaattgccaactttgaccctagggtgaccttacgcctgcccagcctgagtggctctgatgggatcccttatcgaagtgtctctgagtggcttgaatccatacgcatgaagcgctacatcctgcacttccgttcggctgggctggacaccatggagtgtgtgctggagctgacggctgaggacctgacgcagatgggaataacgttgccagggcacca

SEQ ID NO: 1762 - DNA, 487 bp, Mus musculus
  misc_feature (82)..(82): n is a, c, g, or t
  misc_feature (337)..(337): n is a, c, g, or t
  misc_feature (339)..(339): n is a, c, g, or t
  misc_feature (369)..(369): n is a, c, g, or t
agatcattcgacacccagactataacaaggacactgtggataatgacatcatgctgattaaattgaagtcacctgccatccnttaactcccaagtatccacagtctctctgcccagatcctgtgcatctacaaatgctcagtgccttgtttctggctggggaaatactgtgagcattggtggaaaatacccagcactccttcaatgtctggaagctcctgtcctctcggccagttcttgcaaaaaatcctacccaggccagattaccagcaatatgttctgcctgggattcctggagggtggaaaggactcctgtgatggtgattctggtggacctntngtctgcaatggagagatccagggtattgtntcctggggttcagtctgtgcaatgagagggaagcctggtgtttacaccaaagtctgcaactacctaagctggattcaggagaccatggcgaacaactgatttctcttgccttccataa

SEQ ID NO: 1763 - DNA, 332 bp, Mus musculus
tgcagatggcgctcagctacatcatcgcgctcacccgcatcctagccgaagccgagcgggactgggtcgggctgcgctgcgagcagcggggccgcgatcacccctacctccctttcccgggtgctaggctccaggtagaccctgagccctatgggcagaggctcttcggcttccagccggagcccttccccatggccagctaagcctcggggccatttgggtcttaggggagaaaactcaatcaccttttctgcttaatttccttcccgtttcaaacaggtagatgaaatgagttcattgcctccctatctccacttctcttgtgttttgta

SEQ ID NO: 1764 - DNA, 419 bp, Mus musculus
  misc_feature (53)..(53): n is a, c, g, or t
  misc_feature (283)..(283): n is a, c, g, or t
  misc_feature (308)..(308): n is a, c, g, or t
tgctgtacgttcataagtctcccaactactgcgtggagaacaagaaactgggnattcctgggacccagggcagagagtgcaaccggacatcaggaggcgcagatggctgtaacctcctctgctgtggccgaggctacaacacccatgtagtcaggcacgtggagaggtgtgagtgtaagtttatctggtgctgctacgtccgctgcaggaggtgtgaaagtatgaccgatgtccacacgtgtaagtaacctctccgtccagcctagcatgagacgcctctgtngtaaccaaggtgtggtgttggcatntggagggcgcccctactgtgcactgatggggaagtcgctgcctgtaagagtgttcccagacccctgggctagtctacgatttctttctttctggcaggcttcaaatcacaa

SEQ ID NO: 1765 - DNA, 468 bp, Mus musculus
  misc_feature (30)..(30): n is a, c, g, or t
  misc_feature (42)..(42): n is a, c, g, or t
  misc_feature (104)..(104): n is a, c, g, or t
  misc_feature (109)..(109): n is a, c, g, or t
  misc_feature (127)..(127): n is a, c, g, or t
  misc_feature (165)..(165): n is a, c, g, or t
cgcgttttggagaccttggccctgagcttntgggggctgggncggggattgggggtggtgtagagactccagtcagagggcaggagagggatccgggcgagganggcancggggcgcgcgggctcancgcgcgggtgagatgtggtctatattagagtatctatntaaatatatattttcccatcccttttccctgtcccacttccctgtgtgtagcattgtactctctctaccctagtccagtcccagtcccttcccgagtccctagtgcatggaataaaatcgttattaaatcccggtgtgtcccctagccaggggcctgcctttatattggcgccacgcctacttgcccatacccttctcccacctttaggcctgctctccacggcccaagccctgggggagacaggtaagtaaagagcggagcgacagactgaggttggagctgaactttatttgtgggtcttt

SEQ ID NO: 1766 - DNA, 468 bp, Mus musculus
tttactcttgaaccacgaacgattgaagatttctggagtataagtacatactaccaggtatctcgaacatctgtgatgacaaacacatcactttgttccctacataccaaagacggagtccatggcttaatgggcaccattcttgcctataagaagttcaattataaggacaatatagatctggtagagtttaagactctgaaggaagaagaaatagaagaagtcctgaagagtgtttttggaattcacttggagacaaagcttgtgcccaaatgtggcaatgtcttttttactatttagagtaataaggggaaatgatctttaatgtttctatatgcacttattctttcatgaaaaacaatcaaattatgcaaaattaggtgacagactgagaagccttgagatatcatcacaaagttcatcaatgattgactggtatatcaacatctgtcccctacattatggtaa

SEQ ID NO: 1767 - DNA, 552 bp, Mus musculus
  misc_feature (302)..(302): n is a, c, g, or t
  misc_feature (324)..(324): n is a, c, g, or t
  misc_feature (326)..(326): n is a, c, g, or t
  misc_feature (359)..(359): n is a, c, g, or t
  misc_feature (409)..(409): n is a, c, g, or t
  misc_feature (413)..(413): n is a, c, g, or t
  misc_feature (422)..(422): n is a, c, g, or t
  misc_feature (428)..(428): n is a, c, g, or t
  misc_feature (431)..(433): n is a, c, g, or t
  misc_feature (435)..(436): n is a, c, g, or t
  misc_feature (438)..(440): n is a, c, g, or t
  misc_feature (442)..(447): n is a, c, g, or t
  misc_feature (449)..(450): n is a, c, g, or t
  misc_feature (452)..(459): n is a, c, g, or t
  misc_feature (462)..(467): n is a, c, g, or t
  misc_feature (472)..(472): n is a, c, g, or t
  misc_feature (474)..(477): n is a, c, g, or t
tcccggtggagagcgtccctggcattcgagagacaggctggaagccactgggaaaggagaagggcaaggagcttaaggatcctgatcagctatatacgaccctcaaaaacctgctggctcagatcaagtcacaccccagtgcctggcccttcatggaacctgtgaagaagtcagaggctcctgactactacgaggttatccgtttccccattgacctgaagaccatgacagaacggttgcgcagtcgctactatgtgacccggaagctcttcgtagctgacctgcagcgggtcatcgccaanctgccgggagtacaatcccccnanacagcgaatactgtcgctgcgccagtgccctgnagaagttcttctacttcaagctcaaagagggagggctcatcgacaagtangccnccagctggnatccgnaannncnnannncnnnnnntnngnnnnnnnnggnnnnnnccgancnnnnctcccggactcagctggagaaaactccagccgaggaccccagatcttacagactttcttggcccgcaggcactca

SEQ ID NO: 1768 - DNA, 482 bp, Mus musculus
  misc_feature (89)..(89): n is a, c, g, or t
  misc_feature (111)..(111): n is a, c, g, or t
  misc_feature (117)..(117): n is a, c, g, or t
  misc_feature (176)..(176): n is a, c, g, or t
  misc_feature (256)..(256): n is a, c, g, or t
  misc_feature (286)..(286): n is a, c, g, or t
  misc_feature (288)..(288): n is a, c, g, or t
  misc_feature (298)..(298): n is a, c, g, or t
  misc_feature (304)..(304): n is a, c, g, or t
  misc_feature (322)..(322): n is a, c, g, or t
  misc_feature (331)..(331): n is a, c, g, or t
  misc_feature (342)..(342): n is a, c, g, or t
  misc_feature (358)..(359): n is a, c, g, or t
  misc_feature (367)..(368): n is a, c, g, or t
gttatccgtaactttctatccatgtgtacatattacatgccccagtgggatcttctttccccgttcagaacctccactgaggatggggncctttgtcaaacactgttgaanggaganggcagctgtgtctgctggtagagttcctaaggctctgaagatgaccagttggtgatgtnctccaggaagtggactgagacttgctaccggagctggttaagtcaggttaggctcccagtaccatcaaacatgtcagccnttccttcgtgcctgatggatcatggctttnanccaccaggancctgtnctgggagcctcctggctnaagatcaantgtgccttggntagcccgattcacgtnngggttccnncttggcacagcagcgcccacgatgggctcaggattcttactcagacgctgtcaacttccggaagactcaggagggtcggacttctccaagaaccctcaaaggtgcacaaatgat

SEQ ID NO: 1769 - DNA, 381 bp, Mus musculus
  misc_feature (106)..(106): n is a, c, g, or t
  misc_feature (172)..(172): n is a, c, g, or t
  misc_feature (238)..(238): n is a, c, g, or t
gtggtggatcataaagggccccatcctcatctccatcttggtgaacttcatcctgtttatctgcatcatccgaatcctggttcagaagctacggccacccgacatngggaagaatgatagcagcccatactcgaggctggccaagtccacacttctgctcatccctctgttnggagttcactatgtcatgtttgccttcttccccgacaactttaaggcccaggtgaaaatggtcttngaactcgtcgtagggtctttccagggttttgtggtggccatcctctactgcttcctcaatggcgaggtgcaggcagagctgcgacggaagtggcggcgttggcatctgcagggcgtcctgggctggagctccaaatccacaac

SEQ ID NO: 1770 - DNA, 537 bp, Mus musculus
  misc_feature (135)..(135): n is a, c, g, or t
  misc_feature (183)..(183): n is a, c, g, or t
  misc_feature (267)..(267): n is a, c, g, or t
  misc_feature (278)..(278): n is a, c, g, or t
  misc_feature (308)..(308): n is a, c, g, or t
tgattagtcataactgcccaactcccccctgatctgccccacctccctacccataatattatccctcttttttgatgtttttaattcaaaatattttacctgtccttcacttaaatccagacaactctgagattncaccttacacccatcagaatggctaagatcaaaaacccaagtgacagncacgtgctggagtggatgtggggcaagggaaacagtcctccattgctggtgaacttacacaaccactttcagtgcaagtcatgncaggacaagcntttaggaagtttcttctgattgctgacagngtattggttgaaaggaatgccgccgaaattgtagccaaaggtggcattatgcttccagaaaagtctcaaggaaaagtattgcaaggaacggtcgtggctgtggggtcaggcaggaaaggaaagagtggagagattgagcctgtcagtgtgaaagttggagataaagttcttctcccagaatatggaggcaacgaagtagttctagacgacaaggattagttctttctat

SEQ ID NO: 1771 - DNA, 491 bp, Mus musculus
  misc_feature (83)..(83): n is a, c, g, or t
  misc_feature (85)..(85): n is a, c, g, or t
  misc_feature (87)..(87): n is a, c, g, or t
  misc_feature (92)..(92): n is a, c, g, or t
  misc_feature (148)..(148): n is a, c, g, or t
  misc_feature (156)..(156): n is a, c, g, or t
gacgcggacctcacagtccagggcgcaggggcagtggcaagcggccagctccagcggtccggcacaccacctggggtcccctntntnccccncccccagcggctccccaaaaggttccaagtcaaagagtttcagcatcgacagcatnttggccgngagaccgacgccagcctcaggggccgaagcaccggggatccctaagcccgtgcctggcgcgctgggctcctctctgctggctgcctcctccggcctagcgcctcccttcaacgcttcgctggtcttcgacgcgcacgtccagggcggcttttcccagctggggattcccttcctttcttattttcctctgcaggttcccgaggccacagtgcttcgtttccactaaggcggattagcggctgcttccctgcctcgcgatccccccacctccagtgagccaatgcctgtgggcgaaggagtcgccccggtctctgccctggcagagactgagggtt

SEQ ID NO: 1772 - DNA, 327 bp, Mus musculus
  misc_feature (154)..(164): n is a, c, g, or t
  misc_feature (167)..(176): n is a, c, g, or t
  misc_feature (178)..(180): n is a, c, g, or t
  misc_feature (187)..(187): n is a, c, g, or t
  misc_feature (245)..(245): n is a, c, g, or t
agatgtacaaccaaagtgctccccagagcaccaagtacatctgcagatagagggcagcaccaacattcctagacatggcaggaggacatcatccttagcttaggctaaggattcctgtcctgaggcatcaaagagaggtaactcaatggtcagnnnnnnnnnnnttnnnnnnnnnncnnnctttctnttctccattcctccgccatcgtgcgcgctattcttgattcggcttctcgccatgtctntctcacaagactttccgaatcaagcgattcctggccaagaaacaaaagcaaaatcgccctattcctcagtggatccggatga

SEQ ID NO: 1773 - DNA, 393 bp, Mus musculus
  misc_feature (292)..(292): n is a, c, g, or t
  misc_feature (358)..(358): n is a, c, g, or t
  misc_feature (363)..(363): n is a, c, g, or t
ggtacggcaacaattccatgatgctaaattcatggcggacactgacctggatccaggctgtaccttgaataagaagatcagaaacgcacagttagcacagtataacttcatccttgttgttggtgaaaaagagaaagccagtggcacggtgaacatccgcacgagagacaataaggtccacggagagcggacagtggaggagacggtgcggcggctgcagcagctcaagcagacgcgcagcaagcaggcagaggaggagttctagcaggcacacgctgtgcccgagctggcnccgtgtcagggaagaccttgtacaccgggaagcaagcgtggcttcaggccgagcgtggagtagctntgcantctgcatgaatcggcctttgatctggccaa

SEQ ID NO: 1774 - DNA, 385 bp, Mus musculus
  misc_feature (130)..(131): n is a, c, g, or t
  misc_feature (135)..(136): n is a, c, g, or t
acagatctgagtggtttttgagcccaaaacaataatgttttaaagttattcccttgatactttactgagacctttatcattcctcagacagtctgctgatttaaaaatgtagcattccatttgtatttanntttnntaccctttgccaaaaagatttttctaataatgcttgtacaggccaaggccgtggtccaaaacactattcagttttcttgtactgaggatccccccacccccaccaccctcacattattgactcctggcttctatcagccaaactttgatgtggtttggatttgatagccaattctgtgctggttgcaaagagttcatattgagataacttttaatactcagcagattgtcttcctttatattgttatct

SEQ ID NO: 1775 - DNA, 285 bp, Mus musculus
tacaatgtcacccagcatgccgtgggcatcattgtcaacaagcaggttaagggcaaaattctggccaagaggatcaatgtgcggattgagcacatcaagcactcaaagagcagagacagcttcctgaagcgggtgaaggagaatgaccagaagaaaaaggaagccaaagagaagggcacctgggtgcagctgaagcgccagcctgcgccacccagagaagcacactttgtgaggactaatggaaaagagcctgagctgttggagcccattccatacgaattcatg

SEQ ID NO: 1776 - DNA, 316 bp, Mus musculus
  misc_feature (215)..(215): n is a, c, g, or t
  misc_feature (258)..(258): n is a, c, g, or t
atcgcacaccgaaagggctggctgtcgctgcacacaggtaacctggatggagaagatcatgctgcagagagaaccctggaggatgttttccttcgaaagtttatgatgggcacctttcccggctgcctggctgaccagattgttctgaagcgccgggccaaccaagtggacatctgtgccctggtcctcaggcagctgccagcacacaaattctnacttcctcgtgggctacagtgagactctgttgtcacacttttnacaagtgtcctgtgcgactccacctgcaaactgtgccctccaaggtcgtgtacaagta

SEQ ID NO: 1777 - DNA, 386 bp, Mus musculus
  misc_feature (45)..(45): n is a, c, g, or t
  misc_feature (319)..(320): n is a, c, g, or t
  misc_feature (322)..(322): n is a, c, g, or t
  misc_feature (328)..(328): n is a, c, g, or t
  misc_feature (342)..(343): n is a, c, g, or t
gatcagtggctattgctgaagtacatttgcttatttttttttttnaggattgaaactagcaaactgtcgtatactaaaaagtcatgggaggaagtattaaaacaagcatgacttctgtaacagaccacgcccagaaccaccagattgcaaatggacatcaaagcaaaagctgctctcttcaaatagttacatgagtagtattagtacaaattccttatttacatcaaaatctgtttcagtttgctggtgtgaccacagcttaggtaattccaaaggagaagcaacttcagagatgtttagttggtagaagggcttaaanntntactanaagtcacaaaccanntaggtaacactacactggtcacctgttcaaagtagaccattag

SEQ ID NO: 1778 - DNA, 458 bp, Mus musculus
accaggccaggagccaagctgtggaagaaaggggaagggctgcccaactttgataacaataacatcaagggctctttgataatcacttttgatgtggactttccaaaagaacagctgacagaggaagcaaaagaaggtatcaagcagcttctcaaacaaggccccgtgcagaaggtgtacaacgggctgcagggctattaggagcgaagagaactggactttgaaagaggtggatcagcgatatttattatctgcagtgggtttttgtgtgtgtgtttcattattttcaatatgcaagtttggcttagtccttttttccctgatgaccgtcctgacaagaactagaggtttgaggctctgtctattgcattcagacaacaatggccatgcagaaggttacctaatacctccccctctggggatttaacgtctggtgctgcccgaggttcaaggagtaa

SEQ ID NO: 1779 - DNA, 371 bp, Mus musculus
ctatagttagtgatggcgcttccctatttatatttgtattaattgcttacaaagcatacctcatactagcagtgatgttacactacaggaaaactgtactgtacaggaaaactgtactgcctacctttgatttttgaaattgttgtaactacttagaaaatagtccttaatatagtttgacttttccttttagtaatattaatcttttcacctaaccctaggcagcattaaatagatatgaaaaaagatagtgtattaattttattttccctccttaaaagcttattatttgaattatatgcacatgtaagactatttacaataattcacaggttaagtggtgttgataagtggtcatactttgatttctt

SEQ ID NO: 1780 - DNA, 577 bp, Mus musculus
  misc_feature (137)..(137): n is a, c, g, or t
  misc_feature (237)..(237): n is a, c, g, or t
atgctggcactgtcctgggcgctcgccttgggtctggtgctgctgctcccgccctgggctcctaagcccggagccgagccaccgcaagtccactaccccgcgctcctggcggcgggagcgctgcttgcgcagacggngctgctgttgcactgctacctgggcatcgtgcgccgcgtgcgcgtcagcgtcaagcgggtcagcgtgctcaacttccacctgctgcaccagctacccggntgcgccgccgccgccgccgccttccccgccgccccgcacgcgccgggtccgggaggcgccgcgcatcccgcgcagcctcaacccctgccggccgctctgcagcctcgccgggcgcagcggcgtctcagcggcttgtcggtgctgctgctctgctgcgtcttcctgctggccacgcagccgctggtgtgggtgagcctggccagtggcttctccctcccggtgccctggggcgtgcaggcggccagctggctcctgtgctgcgccctgtcggcgctcaacccgctgctctacacgtggaggaacgaggagttccgcagatccgtgcgatctgtcctgccgg

SEQ ID NO: 1781 - DNA, 451 bp, Mus musculus
  misc_feature (255)..(255): n is a, c, g, or t
  misc_feature (257)..(257): n is a, c, g, or t
  misc_feature (276)..(276): n is a, c, g, or t
  misc_feature (368)..(368): n is a, c, g, or t
gtatactttcagatatggcctcttacagtatttaagatatagcaaggacatggctgaattttttttttataaaaaattggcactaataagtgggtttattggtcttttctaattgtataatttaatttagtacaaagtttgtaaaatatcagaggatatatatatattgtttctacgacatggtattgcatttctatctttttactacagtgatctgtgacagcttcatgttgtattttttttactgaaattgtnanaatatccatcttaaagacntcagctattctgaaaattgtgtacaggatattcctttagtggtggaattaaaatgtacgaatatttgctttttcaaaaaaatgtattttctnttaaaggtttaaagatttttgctatatattatggaagaaaatgtaatcgtaaatattaattttgtacctatattgtgcaatac

SEQ ID NO: 1782 - DNA, 234 bp, Mus musculus
aacgcaagagtccttatgtcgccatatgctgtatagtgatggccttcagcatcctcttcatacagtagctttggaaactaccagcatgtgcttgctatcagactgtaaacaaggacttgcctccagaaaataatgggaagaatggttaagccatttgtctctgaacatggaatgagataaacttcaagatgctgttctctatttttatgctattggaccaatgagctgaatgaa

SEQ ID NO: 1783 - DNA, 516 bp, Mus musculus
agttcagatatgcagttgtccctttgatggctgtagcctccctggtctgctgagtggttttctgttgctttccttaagaagcgtttttgtaagagctaagcatatttttcctttgtgcttaatagtactttatgcagtctagctttgtgccatgcagcgtttgaatgctcagttcttaagaactactaaccttgctggggcacagtagtgttcacccagaatcccagcacttcccaggctgaggaagggggaatgatgtgaggccatcctgggctgtagagccaggccctggcttggggagtgggcattgttaacttgttgctgactttgtgttgacccctgcatcagcaactatttccttaaatccaggatacaacttgttaagtgtgacagctttcctttacacaccatttttgtgggtgtatatatatatttgacttggggagaattattttttacaaaaatacaaaatagctttttaatttgtttaaaatagacctgcctgttactttttgt

SEQ ID NO: 1784 - DNA, 438 bp, Mus musculus
  misc_feature (251)..(251): n is a, c, g, or t
  misc_feature (406)..(406): n is a, c, g, or t
cagcaagttccatcgtgtcatcaaggacttcatgatccagggtggagacttcaccaggggagatggcacaggaggaaagagcatctatggtgagcgcttcccagatcgagaacttcaagctgaagcactacgggcctggctgggtgagcatggccaatgcaggcaaagacaccaatggctcacagttcttcataaccacagtcaagacctcctggctggatggcaagcatgtggttttcggcaaagttctngagggcatggatgtggtacggaaggtggagagcaccaagacagacagccgggacaagccactgaaggatgtcatcattgtcgactccggcaagatcgaagtggagaaacccttcgccattgccaaggagtagagagcctgggggacctcatcccntctaagcagctgtctgtgtgggtcctgtcaat

SEQ ID NO: 1785 - DNA, 497 bp, Mus musculus
  misc_feature (49)..(49): n is a, c, g, or t
  misc_feature (84)..(84): n is a, c, g, or t
  misc_feature (237)..(237): n is a, c, g, or t
  misc_feature (352)..(352): n is a, c, g, or t
  misc_feature (389)..(389): n is a, c, g, or t
  misc_feature (446)..(446): n is a, c, g, or t
  misc_feature (452)..(452): n is a, c, g, or t
  misc_feature (457)..(457): n is a, c, g, or t
aggctgccccataagatcttccgggttcccccttcttcagttccctgangcccagtcagccttggctctcaggccctgtgcctngcctcaggtctttctcactgcagcctgctctggcccaatgtccaactctgacccctggggaaggtagcccctcctggcttctcctatagggcacctctctctcttgctgcccccttcctcccaggaaatggtgctctcctgaccctgcctctnggcccgtccctggagtgctgtcctctcagccatgtggcactgtgggttctggacctaggccagggggaggtctctgcccccttcctctggcttgaggctcccatggggcctgctncctcggcttacttccccatctctgagcccagggaggncctgctgatgaccacctgcccttcattcctgattcaccaccatccccaagtgtaccntccctnccctntcttctcagctgcagttgaaggctttaactttgcacactt

SEQ ID NO: 1786 - DNA, 68 bp, Mus musculus
gaaacggctggttcagagcccaaattcttacttcatggatgtgaaatgtccaggttgctacaagatta

SEQ ID NO: 1787 - DNA, 182 bp, Mus musculus
  misc_feature (114)..(114): n is a, c, g, or t
gagcagttcgtctcggcgacctggagcggccgcgcttgcggagccgtcaccatgcccctggctagagatctgttacacccttccttggaggaggagaagaaaaaacataagaangaaacggctggttcagagcccaaattcttacttcatggatgtgaaatgtccaggttgctacaagatta

SEQ ID NO: 1788 - DNA, 509 bp, Mus musculus
ggaacccacattgggctcaggtgatgaatgggcctaccttgagggagggtgtaaaagccagccagaatgctgtagaaacaggaccccaggacaggggagtttgtctgctacttttcatagaaatatataccaaaagcatagcagaagtaggcaccaacctcttcgttttcgtcttcctcatcctctcgaagaaccatgtcgaggacactgcctttgatcttgaagtcccgagaagtactcagcttcatgtgctgcatcaggtttacctgggacagcagaaggtcctttcagtgtgtacttggaggaccctttgcttttaccagatgacattcaccttgaccacctctagctgtgctgcctgccacagagcttgctagactccttccagcagtaaatgagagtggaaataaagaacatttttaccttggactttttagacagttggataagaaatttttcatactgttcaatggcaaagacaaggttagggattggcttggtttcacgaa

SEQ ID NO: 1789 - DNA, 322 bp, Mus musculus
  misc_feature (50)..(50): n is a, c, g, or t
agaggccagggcacaaggccttcttcgcagagccatttctgcgctgtctnccgcagcaggctccctttgcctttcctgtgtcccctgctttggtggaaagtgagatataagacctaaatcctgctaggcgtgaccgagggcctggaagcagtttcttgctcaccctcaattccaaatgcatcaggaattattcccaatcctagtactcgaacccgcctgccccgcgtgactgtcttcacgcctactttccttggatgtctccagctctatccgctccgcggcgcccgaagcacactgacactttgtaccagcgcctctgaac

SEQ ID NO: 1790 - DNA, 151 bp, Mus musculus
agttcctgtgacacctaccccttcatgctctttcctccttccccctgggctgaccaaaaatgtgctatctactgtgagcccctttcccaagaccctgggggacggagagaccatggagtgaatgtaaaaatgccacctcactctcaggcaa

SEQ ID NO: 1791 - DNA, 360 bp, Mus musculus
  misc_feature (36)..(36): n is a, c, g, or t
  misc_feature (95)..(95): n is a, c, g, or t
  misc_feature (129)..(129): n is a, c, g, or t
  misc_feature (154)..(154): n is a, c, g, or t
  misc_feature (159)..(159): n is a, c, g, or t
  misc_feature (177)..(177): n is a, c, g, or t
  misc_feature (204)..(204): n is a, c, g, or t
  misc_feature (207)..(207): n is a, c, g, or t
  misc_feature (230)..(234): n is a, c, g, or t
gggttcaacttgacagtgtacttcgctaggaagganaggcccttgcctgctataaccatgcctagagtgcctgtcctccagtattgcacctgtanccggagctagggccaccccagtgcaggggcaaancaaacctgatgtcagtcgttttgtnttttntaccccaacctcaccctntcaccctactttccaccccccaccccnccnttttttttttttttttttttttnnnnngtgccacattggcagaggggcctataggtccttcactgttccctcctgtgtgttggagttctttagttagcagttcaggctggttggacaggtttgaatcaaattgtactttgttccattgttaat

SEQ ID NO: 1792 - DNA, 566 bp, Mus musculus
  misc_feature (152)..(152): n is a, c, g, or t
  misc_feature (156)..(156): n is a, c, g, or t
  misc_feature (159)..(159): n is a, c, g, or t
  misc_feature (387)..(387): n is a, c, g, or t
  misc_feature (394)..(394): n is a, c, g, or t
ctttggtcccaaggccttagctggggaaatgaagcaggcttcttctctttccatccctaccttgcagggtcccaaaagatgcccagcatctggaacccacttgctattgagaccccctgttagctgagcacatgccaactcattcttagacnccanggngggctcccgtgtctcccccacttcctcctgagttagatctctttcttgttccccctcatccttcctaaggggaggggcagtggtctaggtatgaattccatgcagagaattttagctatgttctcaagtccagagagagccgcgggcctgggcttcatttatattgagatggtttgcatacttttgtaatgaaggggtacctgcagtaggaagttttggggttttttngtttttngtttggttttggttttgtttttcttaaatagtctcttatgggtagctggattctctgccatttgtaatttttcctctgattccaattagcaaaacttccctttttatatgagttgattcttattgtgtatgtaaactgcccctggccacttggctagatttcttatcttctt

SEQ ID NO: 1793 - DNA, 320 bp, Mus musculus
  misc_feature (180)..(180): n is a, c, g, or t
caagagcgtgccaaggagacagagaagccagcggagacgccgggcgagcccagcgaccgaaattgcgaggactgagcgtcgccgaggatgcggctggcgcggtcggcggggacccaggagctggcccttccgcgtccatgccgtttgctttctaatcatttcattactactttgaatgcngacaattaagggccagacaaggaaggacacaggcccggaagccaatcccaggtgtcagcgagcttctgtccccagtctgggagacttgtgtccagcgtggccgaagcttctggtctttctcggacctccgcagtgtgcgg

SEQ ID NO: 1794 - DNA, 352 bp, Mus musculus
ggtatacttaccagagtgctagggagaactttacaatttcatccagaaatttaattttgttaaaggcttgacttgagcttcatatagtattgtgtgagttccctctggattcaatcatttgttcttagtggggaatggaaggcttataagtctcgggaaactgatgaaattctccatcacaaagtccaaagggtctttggacaagggtccaaacatgaagtgctttctggaggagcttttgtttagtccaacaggagtccaaggatgcagattagagttttgtgagtttgctgcccttgctgggctaggcatttcattgttgtaactgcctctgagtaactgatgatcctat

SEQ ID NO: 1795 - DNA, 343 bp, Mus musculus
ctgcatgtgtgctgtttgaacgtactcatttcttttattcaatcctcatggaaaatgagtaacacttcatcgctttattgtggcagtccctcaattgctagccatttaaattgtttcaggatcgccctcccattgacttaagtaagggtttaaagttttacagtaagtactgatgaatcccaaacgttagtttccatacagattacttagaaggtttgcgtagaacaaatagctggtcttcacctagtaataggagattgaccttggaattctgcagtttttatcaggtagtgggacaatggggactctagtggataccagtgctgtcaaccctgattctaat

SEQ ID NO: 1796 - DNA, 568 bp, Mus musculus
  misc_feature (366)..(366): n is a, c, g, or t
  misc_feature (372)..(373): n is a, c, g, or t
  misc_feature (429)..(429): n is a, c, g, or t
  misc_feature (432)..(432): n is a, c, g, or t
  misc_feature (454)..(454): n is a, c, g, or t
  misc_feature (506)..(506): n is a, c, g, or t
ggtcttttgatgttgtcctcgagaagggtactctggatgccatgctggctggggagccagatccctggaatgtatcttctgaaggtgtccacactgtggaccaggtgctgagtgaggtaagccggttgctagttcctggaggccgattcatctcaatgacttctgcaggtccccactttaggatcagacactatgctcaatcccgttatgactggtcactgaggcatacaacctatagcagtggttttcatttccacttttacatcatgcataagggcagagcgctcagtgtgtcccagctggccctgggggcccaaaatcctctcatcccccagccctcctgcctcaccctgcttcctccaagantcaganncaacgaggacttcctcagtgccattcagctgtgagactggaagtgtgatctccaantcntccctgcctttgtgcattaggntcctagggagttggaattcccagtttggggctggggattggttgctgggtantcaaatccagaggtcttgtgcataaaacagtgccagtgggatcaagcccatgtgaaccaata

SEQ ID NO: 1797 - DNA, 565 bp, Mus musculus
  misc_feature (342)..(342): n is a, c, g, or t
ctcctaatgtgcatcatccaatggagaaacatatgccaaggtgtgtggcgtggtcaaaagggcttaatagtggcattttctacatctaatgtgggacaagcaatttggctaattagtatgtattctaaaaatacacttttagggagtggggtctgatttgcgtgggttttgtgaaataaagtgcagaccgtaaaatatgtcacattacctcattttttagactctatttcctaaatcaatgtttcagctttttaaacattttgtataacaaattccaatcctgatacaaggaattattaatatctatttgttatatttgggattttatatgctttcagaagnaaaagcattacaaaaagactgacatggaagtcagtcattttaaggcccctacatcagagcagttttagaaatttttccttatttagtaataggtacattttgataaattgatccttgagtaaatcttattaaaaataattttttcacataccatgtgcattttgaaatcagagtgatctttaattatgttcagtgttaacacagccagtttacattttaccta

SEQ ID NO: 1798 - DNA, 482 bp, Mus musculus
  misc_feature (35)..(35): n is a, c, g, or t
  misc_feature (415)..(415): n is a, c, g, or t
  misc_feature (427)..(427): n is a, c, g, or t
ttagcaaactgctggactgcgtcctgggccaggangataggcacggtctataaccgggaaaaactgctggagatgctccgggttactgacccctataacgacctcgttaaggaagagctgaacatcatccaaggggcgctggagctccgcaccaagacggtggaggacgtgatgactcccctcagggactgcttcatgataaccggcgaggctatcctggacttcaacaccatgtcggagatcatggagagtggctacactcgaatcccggtgttcgagggagaacgttccaacatcgtggacctgctctttgtcaaagacttggccttcgtggatccggatgactgtactcccttgaaaaccatcaccaagttttacaatcaccctttgcacttcgttttcaacgacaccaagnttggacgctatnctggaagaatttaagaaagggaaatcccacctggccattgtgcagcgagtgaaca

SEQ ID NO: 1799 - DNA, 520 bp, Mus musculus
ctcaagcatcgaagcagccacagtggggagaagccacaccactgtcccgtgtgtggcaaggccttcggtcatggctcgttgctggcccaacacctgcgcacgcacggcggccctcgtccccacaagtgcccagtgtgtgccaaaggctttgggcagggctctgcgctacttaaacacctgcgcacccacacaggcgagcgtccctacccatgcccgcagtgcggcaaggcctttgggcagagctcagcgttgctccagcatcagcgcacccacactgctgagcgtccctaccgctgtccccactgtggcaaagcctttgggcagagctccaacttgcagcaccacctccgaatccacactggtgagcgaccttatgcctgcccacactgctccaaggcctttgggcagagttcagcactcctacaacacctccacgtgcattctggcgagcgcccctaccgttgtcagctctgtggcaaagcctttggccaagcctccagcctcaccaaacataagcgtg

SEQ ID NO: 1800 - DNA, 57 bp, Mus musculus
atgtgcttgtgcttgatgactgtgtgtgtaaattctcatgctaagaattgctttaaa

SEQ ID NO: 1801 - DNA, 327 bp, Mus musculus
  misc_feature (136)..(136): n is a, c, g, or t
cattttctgatattgctgcctcggaccactgaaagggatcttgagaaatgatgtgcatctccaaactgccagctgtcctcctcatcctctctgtggcactgaaccacttgagagctacacctgtcagaagtggtancaaccctcagatggacaaacggaagtgcaacacggccacgtgtgccacacaacgcctggcaaactttttggttcgttccagcaacaaccttggtccagtcctcccaccaaccaacgtgggatcgaatacatatggcaagaggaatgcggcaggggatccaaatagggaatccttggatttcttactcgttt

SEQ ID NO: 1802 - DNA, 483 bp, Mus musculus
  misc_feature (343)..(343): n is a, c, g, or t
  misc_feature (349)..(349): n is a, c, g, or t
tgggcaggttaaaagtgagcactaagatgctggaggctggaggtagcaattgcttagtgtgcaaaaaaccttgtgttcaatccccactaacacacaaatattaattactttgtagaattagaataagcagaaccatattaagaaacaacctggggttcaagagtcctggcctatgatatgagagcactggaccccagctgtggggtaaaaatgaatctgcagaagtaagcccctaatggcttcttaaatcaaatcattggacaattggttatagtaaaattaaattctgctgtggattattgagaggtcctggcctgccggggtctacatgaatatagaactnacatantcagaaaagtattgtaaatggatggctgaataagcagggaaacaatgtgctatgtgtaaggatacagaagagaaggaagacaccatgtatattttttgtaaaatgcatttttctactttccctgtttctacaga

SEQ ID NO: 1803 - DNA, 477 bp, Mus musculus
  misc_feature (215)..(215): n is a, c, g, or t
  misc_feature (228)..(228): n is a, c, g, or t
  misc_feature (234)..(234): n is a, c, g, or t
  misc_feature (237)..(237): n is a, c, g, or t
  misc_feature (267)..(267): n is a, c, g, or t
  misc_feature (299)..(299): n is a, c, g, or t
  misc_feature (317)..(317): n is a, c, g, or t
  misc_feature (337)..(337): n is a, c, g, or t
  misc_feature (366)..(366): n is a, c, g, or t
  misc_feature (442)..(442): n is a, c, g, or t
ggatgcttacattccagttagcagaaagactccttctaatcatagtatttagcagtcaacaaaacccccaggagctgatgtttctatcatcttaaagtctggctacttcaggctcctgtggaccacttagaagtgaccacggtctacttttacttttaggagtcaattctttcaaaattctcatgtatcagataaggaaatagaggtttgttcanatcaagtaacttnactgtnatngtgcagggttgaaaccagagttggaacacnaggcttctgatacatatatctctataagaatnctttctttctttcttttnagggagttaaaaaaaaagancaaatgcatgtatttaaaatctatgtttnccatctaaaacacccatgttttcagaaatggcattggaatgctacattctgcttgacttatgctcagagtacagtntcttttccaggctagcaatggctgtatatatttca

SEQ ID NO: 1804 - DNA, 508 bp, Mus musculus
  misc_feature (271)..(271): n is a, c, g, or t
  misc_feature (315)..(315): n is a, c, g, or t
  misc_feature (342)..(342): n is a, c, g, or t
  misc_feature (351)..(351): n is a, c, g, or t
  misc_feature (370)..(370): n is a, c, g, or t
  misc_feature (403)..(403): n is a, c, g, or t
  misc_feature (405)..(405): n is a, c, g, or t
ggcgatgcagatggattcttcactttcccctgggagcgttgcatctggtgctttctgggccaaccagaagggttgatagttgtctgtcacgttgtctctgcagcagcagacactgaagagcttcccagagtcttagactgagctggaatctgctgggctgccgctgggttaaaggattatgctccacttgtgtgggaggcttctaaggggccagaggtaaaacaggtttagagagaccccctgtgacggttagcacagctaggggctcagntttgagtaaaccataaactctgaggtcaggaacagactggggancaccctaaagaagatgagacagaattnttcccactntagactgaggctcctgccnaacttcccctccatttccatttggacttagccncnagaccataggacctcctcctctgggaagggtgatgtggtcactgcactgtggacttgtattggttggtcagtctattactacagtttgactaggtccttccta

SEQ ID NO: 1805 - DNA, 402 bp, Mus musculus
  misc_feature (165)..(165): n is a, c, g, or t
  misc_feature (215)..(215): n is a, c, g, or t
  misc_feature (315)..(315): n is a, c, g, or t
tacttttagcttcacttttgtctccctcacccccgacctcatttatttctgcttcatttagtgtagttcctcctaggtagatatttatcacctctgattatagactcactatgtttttaagtatgttctattatcaacctgtgcatatgctgcattgtcaccatnagagagtaaatattttgatttacttcattcaaatcttattccatcccttnagagtgctatattatgttcatttactgctaattctgaaaggactgggaatggacttctcatctgactaacttgcagtctgactccatatcctgagttttnccagttctctttcttatggcgtgcagggttctagacaagatgagcttagttctgcttgcttctcactaaaaacccactgagaacgtt

SEQ ID NO: 1806 - DNA, 396 bp, Mus musculus
  misc_feature (370)..(370): n is a, c, g, or t
gtcctactttgactgagcaggcgtggtgtggcttggggcatagcctcagatatacctaagaagcagcaaggcccttctctcgctttaacaaatgcatgaactgtagtgctttgaacaatcacatccttaacagggtttccaagcctgggttactttttgttgacgtaaggaagataacttatgataggtcttactttcttctcctaaagttatttacgatttggctttaaatataaaagttcagtaagtgtataccgaagcaaaaattagtcacttgagtaacttggccgctaatatttaaccatctacctctgtttttaattttctttcctaaaggcagcttgagatgtcggtcctaaccttgtctttntttttttcctctttggtagacttatg

SEQ ID NO: 1807 - DNA, 569 bp, Mus musculus
  misc_feature (333)..(333): n is a, c, g, or t
  misc_feature (337)..(337): n is a, c, g, or t
  misc_feature (368)..(368): n is a, c, g, or t
  misc_feature (375)..(375): n is a, c, g, or t
  misc_feature (384)..(384): n is a, c, g, or t
  misc_feature (397)..(397): n is a, c, g, or t
  misc_feature (532)..(532): n is a, c, g, or t
  misc_feature (537)..(537): n is a, c, g, or t
atttcccctttcttcatgaatcacattaactacctccaccgagcctgggaagccggcctggggacatatcgggtgtatccctccaacttgaggggagccgtggggtgtcaaggatgggcaggccggctgagtggaaggggaggtgccatggatgtccccgttaagaaaatgcagctgctcgcctcttccagagcaccaccatctaaggtcagcctcctacaaaagtctctatttttgagggtaggtcagtttaacccctgtgagcctcagtttccccacctgtaagtaattgcactagatcatgtcttgacaggtcctgagattcctcggctngtgnccttgatgctttcgtatcttatctgtagagnatgatanagggtccgnattttacttaccncatggataatgtgctttggaactctttagagattctttttattttttacactcctagatcttttttatagagaacacacaattgaaatgcatattatgatgtaattttcggtttgcttgttctatacaaacacgnccttnccttctagactcagcttttaaccagggacacg

SEQ ID NO: 1808 - DNA, 397 bp, Mus musculus
aggttaccaacatgctctgctagcagaccttcagccaggtgggaggagaggctgtgctaggacaggctaaagggttggtcttggtctggattctcagaagcttagatgggaccacagtggagagttgtgacctgttctgcccttcgttttaagggccagtggaaacccagagactcttctgtcagggaaaaccagggactgtcttttagagccatatagttccttgggattagctcttggccaagaaggctgagtatggctcccaacttttaaatccatttcattttttttaaatgagggaaatggatataatttttcagatactaagtagctggagaggatgttcttgctctccaaagcccaaagggacaaatagggactttgcttaggccaaggc

SEQ ID NO: 1809 - DNA, 494 bp, Mus musculus
  misc_feature (308)..(308): n is a, c, g, or t
  misc_feature (310)..(310): n is a, c, g, or t
  misc_feature (319)..(319): n is a, c, g, or t
ctgactgctgtcatgttgggaggcaagcatcttattgactgacattggtgtgtgtggagcttgaaaacctcagtgggaggatctttctgtactcctgctcatcagtatctcttcctgttattaacaaggcgacttcttgtttaacctcagctttttttaaatgcttttttgcctattaggaaaaaaaaatcatatttagtagaggaaaattggccaaaataaagatgtaaaaatggtttaaaaatgtaattctgccacctaaatactatatgttttggtatagttcatatataggttttttttttttnantgtattcanttggcttttgtttgtctttaaatgacactgggataattctgagcatagtgtctgatattatggtcagctactaacatcagatgtttttcatgttattaaatactcttctgtaacattttaatagctgttgatatttccactgatagatatactgtaatatgcttggtggttggtt

SEQ ID NO: 1810 - DNA, 585 bp, Mus musculus
  misc_feature (39)..(39): n is a, c, g, or t
  misc_feature (49)..(49): n is a, c, g, or t
  misc_feature (100)..(100): n is a, c, g, or t
  misc_feature (137)..(137): n is a, c, g, or t
  misc_feature (358)..(358): n is a, c, g, or t
  misc_feature (364)..(364): n is a, c, g, or t
  misc_feature (367)..(367): n is a, c, g, or t
  misc_feature (388)..(388): n is a, c, g, or t
  misc_feature (400)..(400): n is a, c, g, or t
  misc_feature (515)..(515): n is a, c, g, or t
  misc_feature (532)..(532): n is a, c, g, or t
  misc_feature (552)..(552): n is a, c, g, or t
  misc_feature (556)..(556): n is a, c, g, or t
ggaactcttatatactgaattttagtgatgtctcttagngccactggcntccttggcttcctaggggaggttactccgtagcgatgggggtggggagggntagtgtcttgctgactccccaggtctagtgcagtgcnaagatctggtggttctgttttgggttgtttttgttttgagacagggcctcactgtgcggccctggctggcctggaacttgctatatagaccaggctaacctggaactcagcgaacatgtctgcccagccttctttggttttattgacgtaagatctccagagcctaggctgggtttcaggccacagcaatcatcctttctcaaccacctgaaggtgacagncatacnccntcgtgtgtggcagtttcgtgnctttgtgatganaaatctcccacacccgtgtgcacagaagtgagatcagtgagatcagtggagtacaatgtgctggatgctgctgtatcctccccctccatctctcagggagacagacaaccttctncctgaaccaagatggtnccatgttttctaacccagancctntctttttagcagacctcaataaatctcct

SEQ ID NO: 1811 - DNA, 449 bp, Mus musculus
tgatctggcccctgttagcccatgagccctctttatgtacccatcctccctttctgaaccttccctcagggtggggctggattatggaggaaggaatggatctttggtcagatgagactaacagagggactcactgtcagagttagcgtggattgctgctgccggggcactacctcctggcttctctccctgctgacgtggctcttgtcctggagcagagcagtgcgttgttgggagatggaaagtctatgcgtgggtaccctgtcttcttgcctgtggcccccctcctttctgaaagttagttctctccgcattctttaggaggattcaggggcggcctagtggaagacagtgggctccatgcctctttcccctggggtttgcttcaggggctcctccccgagggcttgctcctggtggcagcagctgagatcaggacatctgtggcc

SEQ ID NO: 1812 - DNA, 379 bp, Mus musculus
atttcttcaggctagcttctacaacactgacctccatgaggtatttactgtgcaataacagattcgtcttctgagagcttgaagcaacccatgatttgtccctccactgctcttcactgggttcacttccaaggagactaatggctctattgtaaaaattgctcttaattcttgaagaggctactgagaagcagtggggtagatctcatgaggttacctacagctacttcatgttcttacactgtaagccttgttgctttgccccaacaattgtaatttgattatagctatgagccttatggtagacactatgtaccctctgcggtgtaattgcattatagctatgtgccttgtggtaagcactatgtactctctgcat

SEQ ID NO: 1813 - DNA, 500 bp, Mus musculus
  misc_feature (276)..(276): n is a, c, g, or t
  misc_feature (284)..(284): n is a, c, g, or t
  misc_feature (286)..(286): n is a, c, g, or t
  misc_feature (289)..(290): n is a, c, g, or t
  misc_feature (292)..(292): n is a, c, g, or t
  misc_feature (294)..(294): n is a, c, g, or t
  misc_feature (308)..(308): n is a, c, g, or t
  misc_feature (324)..(324): n is a, c, g, or t
  misc_feature (327)..(327): n is a, c, g, or t
  misc_feature (330)..(332): n is a, c, g, or t
  misc_feature (342)..(342): n is a, c, g, or t
  misc_feature (352)..(352): n is a, c, g, or t
  misc_feature (354)..(354): n is a, c, g, or t
  misc_feature (366)..(366): n is a, c, g, or t
  misc_feature (378)..(378): n is a, c, g, or t
  misc_feature (380)..(380): n is a, c, g, or t
  misc_feature (389)..(389): n is a, c, g, or t
  misc_feature (412)..(413): n is a, c, g, or t
  misc_feature (418)..(418): n is a, c, g, or t
  misc_feature (475)..(475): n is a, c, g, or t
gaaacagacaacctcctgtcaggatcatctcagttttaaccgtgtcatgagcatagactttctggagttgaaagtcctccagatgtgcacagacctgtgtcttatgtgtgtttagtctgggaagtggttgtagatgttaggtaacattcttagagttgccaggtagcccctactcacctgcttctcagcctgctacacagacaagctttcccatcagcaggtactgctaagcaaagtcacacagggaagagctggtcttgagctagggaggaaccnaggggatntnggnngntnctaagagaagactnctcttgaaccctacanccnacnnnggaacctgancaccatgaantncccccaaaccantgggttttaaancnatcaccacnaaactccctttttagcttttgcnnggggntgggggtggggataaggtttttcattctagttgtgggtaggaagaaagttaatgtanccctgtggtttttcagaagtcggtg

SEQ ID NO: 1814 - DNA, 383 bp, Mus musculus
tgagcttcgccatgcctcccaaagacgacaagaagaagaaagatgccggaaagtcggccaaaaaggataaagacccagtaaataaatctggtggcaaggccaagaagaagaagtggtccaaaggcaaagttcgggacaagttgaacaatcttgtcctgttcgacaaagcgacatacgacaagctctgtaaggaggttccgaactataagcttattactccagccgtggtctctgagagactgaagattcgcggttccttggccagggcagcccttcaggagctccttagtaaaggacttatcaagctggtttcaaagcacagagcccaagtaatttacaccagaaacacaaagggtggggacgctccagctgctggcgaagat

SEQ ID NO: 1815 - DNA, 190 bp, Mus musculus
gagtttctcagggaactgtctttcgggcgtggctccacagcacccgtagggggtggttcctttcctaccatcactcccagggagccctgggatggcaaggatggtgagctccctgtggaggacgacattgacctcagtgacgtggagctggatgacctggagaaggatgagttgtgagccacggcccagc

SEQ ID NO: 1816 - DNA, 316 bp, Mus musculus
atgtctgcacaagcaatgcaacgctgggccactgctgcccgtctgcctccccggcacggcacggctccgcacgcaacctaagcgtgccaccacggtctcttatttatggtgtgatcaccctggagggcgcccccgccctgctggggctatttattgtttaatttatttgctgaggttcctccaagcaaccaccttctccaggcccctggggtgttgaaagtcaaatgtggctgttgagtccacagacccccatcctaattcctgcacctggaggagttccccaacccccgtgtttgcgggaggaagcatttgtaca

SEQ ID NO: 1817 - DNA, 178 bp, Mus musculus
gggaagacagagcttactccagcatatttctaagctgcatctcagtgcctgggagagccctctcgaaacatcactaacctgtctgtattgccgaatctggccccatgttttctgtattcctgtttgtggtaggagataaccagtcttgtttgtttcttacatggcattcctttgttgt

SEQ ID NO: 1818 - DNA, 455 bp, Mus musculus
ggtgccttcacttgctatctggatgcaggtcttgcccgaactacaactggcaataaagtttttggggccctgaagggagctgtggatggaggcttgtctatccctcatagtaccaaacgattccctggttatgactctgaaagcaaggagttcaatgcagaggtacatcggaagcacatcatgggtcagaatgtggcagactacatgcgctacctaatggaggaagatgaagatgcgtataagaaacagttctctcagtacatcaagaacaacgtaactccagacatgatggaggagatgtataagaaagctcatgctgctatccgagagaatccagtctatgagaagaagcccaagagagaagtgaagaagaagaggtggaatcgtcccaaaatgtctcttgcccagaagaaagatcgggttgctcaaaagaaggcaagcttcctcagagctca

SEQ ID NO: 1819 - DNA, 547 bp, Mus musculus
  misc_feature (256)..(256): n is a, c, g, or t
  misc_feature (352)..(352): n is a, c, g, or t
  misc_feature (418)..(418): n is a, c, g, or t
tgaggtcccagctctaatggcttaattccagagccagctctggatcttaatggcatctatctagaagaatacagcttctgggtccctggtgtcaggatgacagccacctcactgtggcagtgatggtggcccattcttaattgctgctaattataaatctggtgatgaactctacacccgattgttgccccaaagcatcagttaggccttgttacaaatgagtgaaaggcgagtgcccacttctctcagaaacacngggagcagagttgccttccaacctgtgcctgctcccaaaatctagatggaagctttgcatgtttccttcctgggagaaagggattgttgagaaggnttcctgttgtcccgtacccaccccaccctcagcctcctgggcaggtcctggcttttcctcattctncttctacagtgcctggtagacaagtgctacgttgaagaacacaaacctcttgttaagacttgtcctgtagtttggtattacagatgtgctactagtgcaataaggtgaaggctgtctgcccagagaaat

SEQ ID NO: 1820 - DNA, 229 bp, Mus musculus
aacagtgaagcagaggataccccaggccttcaggaacgtcccacctgcaggcctgtttcctgagaggccatcagatgatcggcttcagaagtgttgctcagccttgcaactgaattcatttctaatggtgaaaaataaaaccagtccttcacaccacctgtggatcatcatcgggaaaagtaactttctgagacagagtctcactgtgtagcccgtagtggcctggagc

SEQ ID NO: 1821 - DNA, 495 bp, Mus musculus
  misc_feature (190)..(194): n is a, c, g, or t
  misc_feature (196)..(196): n is a, c, g, or t
  misc_feature (198)..(231): n is a, c, g, or t
  misc_feature (236)..(237): n is a, c, g, or t
  misc_feature (241)..(248): n is a, c, g, or t
acttcccagaagaagtcgccattgctgaggaactcggccgcaggcacgctgatggctccttctctgatgagatgagcaccattctggacaatcttgccaccagggacttcatcaactggctgattcaaaccaagatcactgacaagaaataggtactttcaccattcacaaccatcttcacaacatctcnnnnnantnnnnnnnnnnnnnnnnnnnnnnnnnnnnnnnnnngaagnnatannnnnnnncatgcagatgaatacatttccctctagcattgtgtaacccaacgattgtatatgaattaaagtatttccaggatgttgataaaaataacaactttacagtatgaaaattctggattctcatatttttttctcctcattttaaagtcccccccccgagattatttttctgtgatataaattgtaaattatcgcagtcacaacacctggattatactaacagaagacatgaccacctggtaaccgtagt

SEQ ID NO: 1822 - DNA, 399 bp, Mus musculus
  misc_feature (115)..(115): n is a, c, g, or t
tgcccagcgtgtcctatagcatctgctccagctcctcttactggggctcctctgtgaagaataccatggtgtgcgctggtggagatggagtccgctctggatgccagggtgattnctgggggacccctccactgcatggtgaacggtcagtatgctgtccacggagtgaccagctttgtgtccagcatgggctgtaatgtcgccaggaagcccaccgtcttcaccagagtctctgcttacatttcctggatgaataatgtcattgcctccaactgagcgacttccggagtccagtggcctccccaagatggctcttagctttgcaatgagacctgaagtaagcaagaaggagttagagctgaggttatcgctcagtggccgagcacttgtctaatatgt

SEQ ID NO: 1823 - DNA, 156 bp, Mus musculus
gtggatttgccacgatcaaggacctccgggaccacaagcttgacaaccgcatggagtctttcttcctggctgaaactgtgaaatacctctatcttctgttccacccaaacaacttcatccacaacaatggctccacctttgactctgtgatgactc

SEQ ID NO: 1824 - DNA, 346 bp, Mus musculus
aagtgcctcagtgtgcctatggaaacttgggttttttccacacgattgatggattgcgtcctagcaggactttgtacgtttcctttcttccctttcctgtgtaagatgtggctttgcttggtgccgcttcaggtctaccagctgccacttaaaaccctccaacctcttttactctttgagttttttttctaagtagcggaggagggggagaggcagggagtggactgtaagacatactccagttgattcgaatttgctaggtagctttagagaggcaggattgtgtgcatgtgtgtatatgtatatatccatatctaagactaggacttagtctcacttcgggagc

SEQ ID NO: 1825 - DNA, 510 bp, Mus musculus
  misc_feature (355)..(355): n is a, c, g, or t
  misc_feature (381)..(381): n is a, c, g, or t
  misc_feature (388)..(388): n is a, c, g, or t
  misc_feature (398)..(398): n is a, c, g, or t
  misc_feature (401)..(401): n is a, c, g, or t
  misc_feature (406)..(406): n is a, c, g, or t
  misc_feature (483)..(483): n is a, c, g, or t
ctcttggtttagtctcctgagtgcttaaattacaggtgtgtaccactaaaccaaccctaagaatccattttaaaatgtcagtcactttagatttcttagtggggcaaggacctgcccttacatattgtggcctgaagggacaaaatatgagaagttcaatgaaaagataattccccctttcaggaaagatgttctcttattttacttggtgctaaatcaaagaatcaagcctttgttcaagcctttgcaattttggcctattttatttcagagagcaaatggttgttatatatttgggagtgggaaggaatctttgatttttaaatttcactgttgatctttcaaatagactagnccttaggattacaatgaacaactttntcctttntcaacgtttnctntactnccttatttggatgttgataaccacttcctacaacctgttgtgaattacctaaagctaggactgatctgcaggtgatntcagcactgtggctgttgccctttgcc

SEQ ID NO: 1826 - DNA, 475 bp, Mus musculus
gtaaactcactgctaccttaacaggaaaagccaagggaacaggccaccatgctgtgtgtcctctacttatccaatctgctgtgaaaatgcagccactggcacgtagggacgtgtgacttggatatggaccaaggtgtatgacttaggttctgactgaagttctaggagcagcactggcactgacaatggcattaagtcctaagttctcccgtgtcactcagggtgaggaccaagttttaggacctacccgtttgtttccctctttgatccaagcggactgcctgccttgatgagcaagacagtaaacagaaaactaaagggtgacaccacacccatgggaatttgccactctgcaagtagacgggacatgctggggacagccccccagcagaaagactgactaattccactacacaacaggtgtagtaataggattttgcatggtgggttcaaaagcactgtaagggagttccct

SEQ ID NO: 1827 - DNA, 549 bp, Mus musculus
  misc_feature (26)..(27): n is a, c, g, or t
  misc_feature (339)..(339): n is a, c, g, or t
  misc_feature (399)..(399): n is a, c, g, or t
  misc_feature (464)..(464): n is a, c, g, or t
ttaaggaacagccataaccctccganngattgcattaatttctgaccgccctcagcccgttggaagcttggtttagaggacttgttgggctcattttggttttattgaaatgccatctaaatataagttagctgtagataggaggtgcttctggtgaactgaaagtgtctgactcgtgaggaacatggtaggttcctcacttatcactgtagatgattctatatggacacaacagtaagaagaatggggcctcgtccctgtcgacttgaatattatccctatgtattgcatgagaggggtctccctcattccatcagagtaatacacttgctttaattnttaagcctaagtgatacaaacatgccgaattacctgtaaagaatgcatttaaagctattntaaatgggtttttatttgtaagacattatttactaggaagctggtgatattaatgcttactgttntaatccagtggccaaggtattaagaatttgcaagtattttagattttcgaaaatgaatgagagaactgtgtaaacaccccgctgt

SEQ ID NO: 1828 - DNA, 387 bp, Mus musculus
tttgggaaacgaatgcactaactttaaagaaattgaaaatccaggtggatagtcttaacagaggcatgctttatgttatgttagagctttggacccatctttaattgagaaacgtttatctgtataaaacatatttttggataaatatatatatatatatttgtatctacagaaaggctctgaaaagcatttgagtaaaatcttggtccccttttctatgcttgtcctcgcaccctgcgcttggtctgtccactgttgttcagcacatacatgctccatcgtttctcactctgtcaccagctaaaaaatgtccgtgccatgttgactatagaagccacaagcctcaggcctgtggttaagttgccatgctgctagaaagtcatgctt

SEQ ID NO: 1829 - DNA, 457 bp, Mus musculus
  misc_feature (38)..(42): n is a, c, g, or t
atgacctccattctctcaggtggctgcagagcagagcnnnnnagagcagagatctccctctgaacacctgccttccctggcaagagtatactatccatgaagcagggcagtcccacagaagactgtggctgggatggcttgccaaagaaatttctagcctttccctttcccctaaactgcatcagggaagaatccttatctctagcttcgttttcacatgaggttttctgaggaaggggactgggataggaagtctgtcatgtagtaaagtagacgagaaatcttattaatccagttgtatttcagagtttgtccctatgatttttaaagtcaagtttaatttcacaagactttttttctgaaattacttttggggtaatatttaaaatgagagacattttgtaaccctgtaaaatacatagggaatataacattccaatgtacacaacgaaggcaa

SEQ ID NO: 1830 - DNA, 520 bp, Mus musculus
aaatacgttggagtggtgcctgccagtgattgatgccaaaaataagagtggcagcctggagttcagcattcctgggcagcctaatgacttcttccctgttcaagtttctttcatctccaaaaagaattactgcaacatacaggttaccaaagtgacccaggtggatggaaacagccccgtcaggttttccacggagaccactttcttagtggacaaatacgaaatcctgtaataccaagaagggaaagctgaaaaggaaggatttcagattaataaagaagaagccaaaagtggctgaagagttttccaaatttacaagccattggaggtcccccaacccccttttctgatacagtgcacgttctctgcgcgcaaggaccctcaactcacacccagtgttgcggtgtcacagagacatttttgacaaatgacactgacataaagggaaaggctgctgatttctttggccagcaggaagccagctctccagggaatggaatgccccagtaaatagctcttc

SEQ ID NO: 1831 - DNA, 441 bp, Mus musculus
  misc_feature (350)..(350): n is a, c, g, or t
tgggcttaggcgtgacctcacacagacacacgtgttttcactgtggttagtcagaaagctgaatgtattgagcttgtgttgcttcctgtgtgctctctgagccaccacacactacggaccttaagtttctctaatcatggctcacagtccctgggcaaaccaaacgttttcagtggcgatccatcctgtaacccttctcttgacagaattaaattggctccctttgcaacttaaaatacagtcaaggaaagccaaattgctgaactctgctggctcccagggatgtaaggacatcatctcgcaggagcaatttgttgcattgcctgagttttgggaaggaggcctgcggncactgttgacttagtaaggtgtcggtccatagtgtacagatttcaaaacaaaagcccacagagccctggagatcccttcatagccactgct

SEQ ID NO: 1832 - DNA, 487 bp, Mus musculus
agagtcccctttctggatcatcggttttcttcctattacctgtctctgccgccagatatgagaattccaaaaaatggcatagaaaaacatctcctgagagagacttttgaggactgcaacctgctacccaaagagattctctggcgacccaaagaagccttcagtgatgggatcacctcagtcaagaactcctggttcaagattttgcaggactatgttgaacatcaggttgatgatgagatgatgtctgcagcctcccagaagtttcccttcaatactcccaaaactaaggaaggctacttctaccgtcagatctttgaacgccattacccaggccgggctgattggctgactcattattggatgcctaagtggatcaatgctactgacccttctgcccgcactctgacccattataagtcagctgccaaagcttaggcactctctacactcttgtgtaaaagtaaatgtttcttccggctctgaa

SEQ ID NO: 1833 - DNA, 335 bp, Mus musculus
gaggttggtctgtgtactagtcatttttggatggactgtgtcccccgttgtacaggtgccaggagccaagtgacaaagtcaaagttggaaatgaaagggcatttgacttggtgagggaataattcttgtcttttggcagaagttgctttagctggagggtcccaaaccaagagtctagaagaacgatttagttgcagagcttgtaccatgactcccaaactatcccatcccccagggacctctggattctgtgttgactgagttgaaaaaccccatagtcatcttgctataaatctttgaaatctcttcttcttccttggctgttgctttttgac

SEQ ID NO: 1834 - DNA, 477 bp, Mus musculus
  misc_feature (96)..(96): n is a, c, g, or t
  misc_feature (110)..(111): n is a, c, g, or t
  misc_feature (153)..(153): n is a, c, g, or t
  misc_feature (168)..(168): n is a, c, g, or t
  misc_feature (171)..(171): n is a, c, g, or t
  misc_feature (176)..(176): n is a, c, g, or t
  misc_feature (180)..(180): n is a, c, g, or t
  misc_feature (223)..(223): n is a, c, g, or t
gaatgctcccagatcccaagaatactcacatcttcatcagctggatgattgcacagtctgtcactgctgtcgctggcctgacttcctatccttttngacacggttcgccnngtcgtatgatgatgcagtctggacgcaaaggaactgatatcnatgtacacaggcacngcnttganctgnctggcggaagatcgcgcgcgatgaagggagcaaggcttttttncaagggcgcatggtccaacgttctcagaggcatgggtggcgcctttgtgcttgtcttgtatgatgagatcaagaaatacacataattatgtcctaggtgttctccccgagaacaggcatgttgtataatataccatatcttgaacattctggacagattctctgggcttgtctgttttatcagtggcaactatttaccagttgaaaagtgggaagcaataatattcatctgaccagttttctcttaaagccatt

SEQ ID NO: 1835 - DNA, 280 bp, Mus musculus
cacctacttccctgaggtagaacagctcttctcctccaatggctgcaagacagtggcctcccgactcacatttttcctctgagaagcccaggtggcatcgctgcctcctctgcctggtcagagcaaacacgaaaggcctgggtggctcctggaagaaatctttcctaagctggttggcaagtgggacccagagcacaatgttaagatgaagaaaggtgttggccaggccaaggaagaaaggtctagaagcatctttgctaagaaactcctgggtaccccg

SEQ ID NO: 1836 - DNA, 544 bp, Mus musculus
  misc_feature (306)..(306): n is a, c, g, or t
  misc_feature (312)..(312): n is a, c, g, or t
  misc_feature (314)..(314): n is a, c, g, or t
  misc_feature (470)..(470): n is a, c, g, or t
cagagaacgttcttcagtttccctgctgtggttgctccattcaaatgttctgtccttccactgagccagaaccaagagtttatgccatttgtcaaggaattatccgaagctctgaccaggaacggcgtgtctcataaagtcgatgactcctctgggtctattggaaggcgctatgcaagaactgatgagattggcgtggctttcggcatcactattgactttgatacagtgaacaagacgccccacactgcaactctgagggaccgagactccatgagacagataagggcagaggtctctgagctngcccantngtggtccgcgatctggccaacggcaacattacctgggctgatgtggaggccaggtacccactctttgaagggcaagagactggcaagaaggagacagtagaggaatgagaacagctggcagcttatgaccatcgtgctaataaataactcatcatntccactacacagagcattgtgactgcatccagggacggtttttcctcagtggctgcttggttttactcccacaa

SEQ ID NO: 1837 - DNA, 179 bp, Mus musculus
  misc_feature (55)..(55): n is a, c, g, or t
aagtcaaagggctcccttagccagacgtagagccttcccgagcgctgctcttggncgggtgctcctggctgtcccagtggcctacggtggctccagctgcagttcatgcttgctctgcaggcaccgtgtgcacctccagccttcatgggactacttaccaggctgtgtcgctaaggagg

SEQ ID NO: 1838 - DNA, 390 bp, Mus musculus
ctccagccttcatgggactacttaccaggctgtgtcgctaaggagggatgggctcctcaaattttttgagcaatttagtaccccagcagtggatttacaggaagcagaacccaggccacaagtctgtgtcgtcagtttctcccgttgtaattactgaaatggtgtgaagtaaccaagggtcgctttggagacccaggcttggccgcaacccacaaccaaatctaggaagggaccttaaagccataaggctaggtccccctgtgcagaccttcctacactgtgctgtgtacatcctgaagcatctccaatcccttttagttaaacaacctgaggggctaccctgtgtcgggttctgggtcactgaaggtgactactttttgcttgaatgaa

SEQ ID NO: 1839 - DNA, 522 bp, Mus musculus
  misc_feature (128)..(128): n is a, c, g, or t
  misc_feature (232)..(232): n is a, c, g, or t
  misc_feature (289)..(289): n is a, c, g, or t
  misc_feature (294)..(294): n is a, c, g, or t
  misc_feature (300)..(300): n is a, c, g, or t
  misc_feature (304)..(304): n is a, c, g, or t
  misc_feature (326)..(326): n is a, c, g, or t
tgatgggactccacatttggctggccgtaccagtgtcagctcactgctgagctgtgaggtggtgtgacccagcacaagatgtataatggtgtttcctgagctcttggtgtttagcattgtcttggttngtgttaagccggtgttgccctgggcctccccatatcctgggcctccctgcttcctggagctggattacagggcgactttatcacgggagtctccttggattttngccacctagccacagacacccagctcagccctccatagccttcctaccacagagagntgggntagcangtcnctgatctctaggatacaggagncatctggtccccgctttgtgctgtgtgctccatcgttcctggtgtggttgtctgatcggctgcctggtggtgtcatctggttcgttcccaccaagccttcctgttcctgtacccattcctgcaggaagggtgagtgacggaagcctggcttcagcagagtgatggctttcctggaatgtgtcaggtcaagctgcct

SEQ ID NO: 1840 - DNA, 219 bp, Mus musculus
aaggaatacttgatcagcagaggcctgacagacaagacctgccaacagggagagccccagtggaccatttctctgctggaagcttcaacagaagagttaacacttcctggccaacactgctgttcctgacaatgccttgagacttcaggaaaatcttgttgtgaggaaaactgcctagaactaggccaactggttaaactgtggactcttacattgtgc

SEQ ID NO: 1841 - DNA, 471 bp, Mus musculus
ggatctcctcacactggtaatgtctttcctgttagagaggtttatgctaccacttcgcatttcatctgtgaggcatttcatcttttagatatgtcttcatgtccagctacttgtttcaccatggcagacctccctgagtcttcttcctgccctgggtaggaagtgtggctctgggtctgtggtcactctccaccttgtcctagtgttgccatggtagcatggctttgtagtttgcatttaacctggggatctatgcatcctgtcaagagggtgggtccccgtccccgtgtgtggaaaagagacagtgtggcttgctgccaggctcaggccaggtctggacagctctcactctcctcaagccaggactaccgaccagccggctatgggcacattactctgtggctgctggattcttttccagcatggcctgtggcctgtgtgaggcagaactgggacccttgattcccagat

SEQ ID NO: 1842 - DNA, 171 bp, Mus musculus
  misc_feature (110)..(110): n is a, c, g, or t
agagcacaaggcctcccactgttgacagctcagcccatccctggcaggtttggacactgtcccaggctccagctgcaagatgggctcctgtcacctaatggacagatcanctgccacctgatggacatgtcatgctgtccactgctttctatctggtggacagactgcaag

SEQ ID NO: 1843 - DNA, 153 bp, Mus musculus
  misc_feature (73)..(73): n is a, c, g, or t
tgtgtggtctggctcgttgcttttcttttggaatggccctgtggtcacagagctgaaggagctctccactcancccccggggcctccagaggcctccctttgctctcaggctcccacgggccatggaaacttgaaagcagagccagaggacat

SEQ ID NO: 1844 - DNA, 121 bp, Mus musculus
aaacttcgtggcagcccgtgagcagacccagacatagagccaggactggcttccatcctccttgctggggcttcttggctttcagagacacctaccagcttcctcacccaagtccagcagg

SEQ ID NO: 1845 - DNA, 407 bp, Mus musculus
  misc_feature (125)..(125): n is a, c, g, or t
  misc_feature (211)..(211): n is a, c, g, or t
  misc_feature (334)..(334): n is a, c, g, or t
  misc_feature (368)..(368): n is a, c, g, or t
  misc_feature (380)..(380): n is a, c, g, or t
aatgaatcctctatgcccgagtagcttacagggcctttcctctggtgtcacagaactgaggaatgttagccaggaaggatgggcacagactacaatagcaacaagactcagggtgcccaaaaaangcgtcctccccacagagggctccatcgtgggaaagggcaaaccttggactgattgtgtggacatcctcagggacctggttagcccntagcatgggagtgtgtgggttttaaatgaaggtgggcttctgtgacctgagacccacagctgtgaagtgcctgcacaaagtgtcaccacctgggccatgaccctgcttagcccactcctcacntcccactccttccctgacaagcacccactttctntctcaatggatntccctgttctggactcttcctataaat

SEQ ID NO: 1846 - DNA, 142 bp, Mus musculus
accaagggggtcttcatttctgtgggaaagggactccaaaaggcattggtggctatggcctccaacctaggtgctccaaggtgggccagctgctcgtaggggcacctgggaaggtcgaaggactccacctcatcaacctttc

SEQ ID NO: 1847 - DNA, 82 bp, Mus musculus
  misc_feature (47)..(47): n is a, c, g, or t
aggccatcaccattgaggctgagccaagagccgatggcagccgccgnacgacacgctatgacatcgacatgaccaagtgtat

SEQ ID NO: 1848 - DNA, 383 bp, Mus musculus
  misc_feature (70)..(70): n is a, c, g, or t
  misc_feature (120)..(120): n is a, c, g, or t
  misc_feature (173)..(173): n is a, c, g, or t
  misc_feature (232)..(232): n is a, c, g, or t
  misc_feature (234)..(234): n is a, c, g, or t
  misc_feature (282)..(282): n is a, c, g, or t
  misc_feature (286)..(286): n is a, c, g, or t
  misc_feature (317)..(317): n is a, c, g, or t
  misc_feature (329)..(329): n is a, c, g, or t
ctgccctccaggctgttctaggagcctcttgtctcctccagagatacaaccccatcagaacccctgcccnctctggctcctcctccaagacctgcccttgtgctgcctgctcccagaagnctgtcaggtcactgtgccctaatgggttgtctcaaaaaggagccatgtgctgnccccgtgagggcacctggtcatggtaaagggagttctggctacctagtctgagacttcntnttccaggcgtcccttttgccagcgccctggttgggaagagcgactcangccngctagtgaagaaggctggaggctgacgcttngtgaagcagganccgtggagtgtgctttaggggcttggagtagggtatcgagagtgccctgttact

SEQ ID NO: 1849 - DNA, 427 bp, Mus musculus
  misc_feature (392)..(392): n is a, c, g, or t
  misc_feature (399)..(399): n is a, c, g, or t
gaaacagaagaccagacgcacgtgaggaagaaggaggccccgtctcctgcagatgacacagccagggctgccgcctgcctggggacaaaggcacatgctcactcacttcaggcaggccctgggccctgtcacccttgtgttggtgtcctgcctgtctgtcctctcctgtgtagccctgtggtgcaatgcgacgaatggaccctcctgtcaccctgctgaacacaatttattttctgagttgaagataatttattattattatttttgtcagagaagtatttaagctgagctggtggcgtgagaacataatctaatcttccacattcgtttgcaagaagagtccaggaaacatggcgttggtctgctgtgccttctggactttccccaaaccngcccccntgcactcgaggcccgtgccagaagctgc

SEQ ID NO: 1850 - DNA, 183 bp, Mus musculus
tcctctatggccatactgtcactgtggtggggggactgggagtagctgtggtcttcactgccctcctactcagagtctatgcccggggccggaagcagcggggaaagaaggctgtgcccactgagcccccagtacagaaggtgtgagcagtgcagtaaagaccctcatcttctgaggcactgg

SEQ ID NO: 1851 - DNA, 393 bp, Mus musculus
  misc_feature (27)..(27): n is a, c, g, or t
  misc_feature (30)..(31): n is a, c, g, or t
gtatccctctcagtcttaactagacanctnnactgtgtgcttttgtgtctggccctattgcatttactgtgctcatgctgaaaggaaagtaacagctttagaaactgttgaaaataaaataggaaaacaggctgggttgaattcctttgctgggaattgttttacagctcttcagtggtctttctagccagttattcctgtgaagaattggactttgaggagctaaagctttgaatgggggctggtgcaggggcctgggagtggagagtctgctttcagatactttaacctcggagctgtgacctttgattgtagcaaacatcgatttcaaaagcttcttttgctttcagtcacaagcctgcgtaccttactgcgagactgccaatgcttcaa

SEQ ID NO: 1852 - DNA, 402 bp, Mus musculus
  misc_feature (108)..(109): n is a, c, g, or t
  misc_feature (125)..(126): n is a, c, g, or t
  misc_feature (128)..(130): n is a, c, g, or t
  misc_feature (132)..(132): n is a, c, g, or t
  misc_feature (135)..(140): n is a, c, g, or t
  misc_feature (143)..(143): n is a, c, g, or t
  misc_feature (145)..(151): n is a, c, g, or t
  misc_feature (154)..(154): n is a, c, g, or t
  misc_feature (156)..(167): n is a, c, g, or t
  misc_feature (204)..(204): n is a, c, g, or t
  misc_feature (214)..(214): n is a, c, g, or t
  misc_feature (326)..(326): n is a, c, g, or t
  misc_feature (337)..(337): n is a, c, g, or t
  misc_feature (344)..(344): n is a, c, g, or t
gttttgtccagtcaaagctggtcatttcttccttgatgataatttataccaggaaatgggccaaaaaagaaaatgcttgtaatatttatagtacaacgtgaaaccaannaaaaaaaaagttattnncnnnantannnnnntantnnnnnnnaanannnnnnnnnnnntttcctttaataattccttttctataccgtccaggancccaggggtngagcaccacccagctcaatcattaatcaagaaaatgtccctctgcttacattctctcctcccagattaccctggcctgtgtcacgctgacaaaagtctgaccagctcacagntgtgcataagntcccgcntaacattagtctcttctctgtgctgagtctgttagctgctttaatgtgtgcctcacgg

SEQ ID NO: 1853 - DNA, 472 bp, Mus musculus
  misc_feature (42)..(42): n is a, c, g, or t
  misc_feature (47)..(47): n is a, c, g, or t
  misc_feature (116)..(116): n is a, c, g, or t
  misc_feature (123)..(123): n is a, c, g, or t
  misc_feature (135)..(135): n is a, c, g, or t
  misc_feature (154)..(156): n is a, c, g, or t
  misc_feature (334)..(334): n is a, c, g, or t
  misc_feature (342)..(342): n is a, c, g, or t
  misc_feature (356)..(356): n is a, c, g, or t
  misc_feature (369)..(369): n is a, c, g, or t
  misc_feature (375)..(375): n is a, c, g, or t
  misc_feature (384)..(384): n is a, c, g, or t
  misc_feature (415)..(416): n is a, c, g, or t
  misc_feature (431)..(431): n is a, c, g, or t
  misc_feature (441)..(441): n is a, c, g, or t
  misc_feature (445)..(445): n is a, c, g, or t
aaagccaagaagcacaaccggcccagcaatggcaatggcacnggccncaaaatgacctcctcaggccacgtcaggaactcaaagagccaaagtgatggagatgagaagaagccggncccagtngatggagcacgncgctgctcaatgacgcctnnngggtcctaaaggaaatccagagcacgctggagggggaccggaggagctatggcaattggcatcctcaccgcgtggctgtgggttgcaggctcagcaatggagaagcagaatgactgggacagcacccaggctgtgggatgatcacacactactgagggccttgccagcccaagccggnccaggggnctgccagtgccctnggccaccttcctngttgcntgctcctgncctcaggagaggggagctcccaccggggccnncccctcctgggcccntgtctgtctntctntcctgacccttttaccaatgttgcaca

SEQ ID NO: 1854 - DNA, 438 bp, Mus musculus
  misc_feature (265)..(265): n is a, c, g, or t
  misc_feature (267)..(267): n is a, c, g, or t
  misc_feature (271)..(271): n is a, c, g, or t
  misc_feature (274)..(274): n is a, c, g, or t
  misc_feature (278)..(278): n is a, c, g, or t
  misc_feature (284)..(284): n is a, c, g, or t
  misc_feature (289)..(289): n is a, c, g, or t
  misc_feature (291)..(291): n is a, c, g, or t
  misc_feature (296)..(296): n is a, c, g, or t
  misc_feature (300)..(300): n is a, c, g, or t
  misc_feature (305)..(305): n is a, c, g, or t
  misc_feature (308)..(308): n is a, c, g, or t
  misc_feature (312)..(312): n is a, c, g, or t
  misc_feature (317)..(317): n is a, c, g, or t
  misc_feature (319)..(319): n is a, c, g, or t
  misc_feature (345)..(345): n is a, c, g, or t
  misc_feature (361)..(361): n is a, c, g, or t
  misc_feature (380)..(380): n is a, c, g, or t
  misc_feature (388)..(388): n is a, c, g, or t
  misc_feature (393)..(393): n is a, c, g, or t
  misc_feature (398)..(398): n is a, c, g, or t
  misc_feature (412)..(412): n is a, c, g, or t
gttcctcgagtaccgtcgccaggttcgcgattttccaccacctgcgcttgcacttgagctgcaaccaccgccttcccagcgcaactcggtgccgcctcctccaccactgcatggcccgccagtgcgcccccacgggccctcacccacgcgggatgcgctggacacgtgacagcccccccccccccccccgcgcgggccgcacagacgctggactaactgcgcgcggtttgcatgggatgggatggggcaggctccccttagggancnggtnttntganatgcanacctntncagtncctncggtnccngggnccatntntgcttcttcatctcaggaatctctcngaccacggactctcancctccactccactagctcncctcgatncaaanggcanctggtgaggcctgntcttgagtggagatggctcaacccct

SEQ ID NO: 1855 - DNA, 431 bp, Mus musculus
  misc_feature (275)..(275): n is a, c, g, or t
aagagtggcagagcctacctcatggggtgtgtcttagcactctgagtgtatcctagtgataaacaggatggggctctgttcaggcctggtttctgagcagctattgctcaggtaggtctcttggcttttccatcggatgaggtggggcccagggcaagggtattgcaggggagttcagaggtcttgctgccagcttctatctccacatcagcctcctgacactgcatttggaaacgtgacaacagtaatccaggtcagaaatgaagggatgctanctgagaccacacttcccactgtccactgattacagaaagcgttagttagtcacggattgtttgatttctggctcctccctgccagggaaagggggctggccaaatcatcaccactacttctggcctggcaccagggtgagctcttgtttccttaaa

SEQ ID NO: 1856 - DNA, 412 bp, Mus musculus
gcacactgtttgatttggtctctccccaaagctaggctttcacattagaaagtgtttggttttttgccattgaaacataatctcatggtagagtccagcttctgtaactccttatggaactcaggcgatcctcctgccttagcccacccagggttggcattgtgagcatatactgtctttcctgtaagactgccctttaggactaagtcctttgtgtataatgttagtcacacgttcggtcacttcctctcttgctattgtgaataagatagccgtatatatggtatgcagatatgttaccctgttttcaagtcctttacccaggaggggaattgttgggcagggagtgtggcgtcatctggaaaaggagcctgacaggatccgagggtaaagctgctgttccctaactaaa

SEQ ID NO: 1857 - DNA, 269 bp, Mus musculus
aggacccagccgttcttcaaatcctccatcaactgagtcccgggaaaatctcggtcattgttacagtgagggacagtgggtggcatgcaacgctccctctccgtgttgcagagtcaccctgcctccgtgcctacctagcttctcctctgctgcccttggagtgtggagcagggctgggaccctggcactaagtccgttgaggatcacgccagtgtagggtctgggtgggagcagacaggccaccggcctcaatgtctccacagggaaat

SEQ ID NO: 1858 - DNA, 477 bp, Mus musculus
  misc_feature (124)..(124): n is a, c, g, or t
  misc_feature (126)..(127): n is a, c, g, or t
  misc_feature (335)..(335): n is a, c, g, or t
  misc_feature (339)..(339): n is a, c, g, or t
  misc_feature (343)..(343): n is a, c, g, or t
  misc_feature (363)..(363): n is a, c, g, or t
  misc_feature (368)..(368): n is a, c, g, or t
  misc_feature (374)..(374): n is a, c, g, or t
  misc_feature (378)..(378): n is a, c, g, or t
  misc_feature (382)..(382): n is a, c, g, or t
gtgttgaccaaaagccgttctctgttggagctgcaaatgagcagcaacccactgggagacgagggagtccaggagctttgcaaggccctgagccagccagatacagtgctgcgtgagctttggntnnggagactgtgatgtgacaaatagtggttgcagcagccttgccaatgtcctgctggccaaccgcagcctgagggaactggacctcagtaacaactgcatggggggcccaggtgtcctgcaactgctggagagcctcaaacagcccagctgcacccttcagcagctcgtcctgtatgacatttactggacaaatgaggtggaagaacagncttncggnggccctgggaggaaggaaanggccnttcccntganggantcatttcctgatgttcctctggacacatcaatccagccccaggggcagccagcaggatctctggctctgggtgtccttgtgttgaccggcaataa

SEQ ID NO: 1859 - DNA, 477 bp, Mus musculus
  misc_feature (369)..(369): n is a, c, g, or t
  misc_feature (395)..(395): n is a, c, g, or t
ggctcctattgctatttactgattctggaaccacagacctgggctaatgcagagatccactgccagaagcatttctcaggacacctggcatttctgctcacttatggtgaaattatctttgtgtcctctctggtgaaaaacagtttgaccacattcccatacatctggattggactccatgatctgtcacttgggagtttgcccaatgaaaatggatggaagtggagcagctctgaccctctgaccttctataactgggagataccaccctccatgtctgcacaccacggctactgtgcagctttgtctcaggcctcaggttatcagaagtggagagattattattgtgacacaatatttccctatgtntgcaaattcaagggttaggccagttntgatttcaactgcctgaaagtatcctgaagatcacatagacaaaggagcaagcatgatggctcaccaagaaagtccttctca

SEQ ID NO: 1860 - DNA, 277 bp, Mus musculus
atgcccagtaggtaagtcttctctcgctcggcatttctccagaggaagctcaggttttccttctggtacagcattctgcctctttagccccaggcttgcccaaacccctagccaggaagggcaaggccaggaacgaggatcccccagggccccacagtgcctgagaaggaccatcctggcattagcctacctggacttgggtcacctgcagcccccaacctgtctcttgctgcccgccactgtcatgtgcctttgcctttcctgaactctgccaggg

SEQ ID NO: 1861 - DNA, 398 bp, Mus musculus
  misc_feature (67)..(67): n is a, c, g, or t
tcacactgtaccctgaggtccaaatgactgtctgtcctgtaacctgatgtctcaacccagtgagaangagtcagttccttagtgttcaccaacacgggaggcttcaccggaacaggcttttgctttgggctctgctgtttgtttgcagaacacccaagagcgagcgaacacacccttcccagcagtaccttagggttttgccattgtaaatgggtctaatgtgatatgacaagaccagagaaattggatgtaaatttacatttttgaatatgcttgttgtttcacatgatacatttagggtatgcagctccttttgtagtttttatttttactatttaagtttggaaatgatgccaaatttttgtatttctttaatcaatgtgttctccttggtgata

SEQ ID NO: 1862 - DNA, 357 bp, Mus musculus
  misc_feature (121)..(121): n is a, c, g, or t
ctttccactgtctgagctttcctgacccctgtattgtatccttgctcccagggctcccttcatggcttgtgaactgttaacttggtatctcaggttaaactgtcagctggtctagcctgancgaggcctgagaccatcagtcactaagagcagtggctaacctcatcgaagttggaaggaatgtttttaaaattacctcttcgagcctgaatacaaagaataaaagaataaaagaattcttttaatttcagggaagatcagaaaagaaagcctaaagccctttagcgttgtgaacctcagtagtagctgaaagagaagctgccacaggttgtacttgctctgtgagatgttgtagac

SEQ ID NO: 1863 - DNA, 253 bp, Mus musculus
  misc_feature (35)..(35): n is a, c, g, or t
  misc_feature (70)..(70): n is a, c, g, or t
tgagctggctagaggaaaatgtccatgaggttctncaagcggtggatgctggagaccctgctgtggaggntctgtgagaacaggcggaaagtgttgtaccagcgtgcgcccagaaacatccaccgccacgtgatactgtctgagatcaaggaggctgttgctgccctaccctcggatgtgaccacacagtctgtgatggggttcgaccctctgcctcccctggacaccatctactcttacgtcagaccagaga

SEQ ID NO: 1864 - DNA, 349 bp, Mus musculus
  misc_feature (94)..(94): n is a, c, g, or t
tggctgtccagcacctgctctagtgcctcttccctgcaaggcagggaccccgtgtgaatcagagccggtgatgcgtgtgggccttgtggccgcnactcagcggggctcagggttaaggtccctcttgagtttggatgtgaatatcctaaagctatcaagtacctgtgaaactctgcttcactgctcttctccttctgagaggtaaacaaatcatatttttaagggtattttgttttagtgttaaatagcatcccacgagctgcatttttatttattacatacacaaaaagtaaatgtgtttctataaaatacaaagtctagagttggaaactctgggaaaacttgctga

SEQ ID NO: 1865 - DNA, 496 bp, Mus musculus
  misc_feature (331)..(331): n is a, c, g, or t
  misc_feature (344)..(344): n is a, c, g, or t
  misc_feature (346)..(346): n is a, c, g, or t
  misc_feature (348)..(350): n is a, c, g, or t
  misc_feature (354)..(354): n is a, c, g, or t
  misc_feature (440)..(440): n is a, c, g, or t
atatgctacgctgcatcacgtcatagacaagtctaaagaagaccggatggaaagcttctttctcagcgagacttgcaaatacttgtatctgctatttgatgaagagaatccagtacacaaatctggaaccagatacatgtttacaactgagggccatatcatatctgtggacaaacgtcttcgggaattgccttggaaggaattcttctctgaagatggggagcgggaccaagaggaaaagtttgtacacagacctaagtctcaggagctcagagtcattaactccagttctaattgtaatcgtgttcctgatgagaggagatactccttncccttaaagagcntntnnntgcngccagatcgaccagatggttggcttgatttgacctgctcacctcaatgtggccagaacttaaaccaaacccaagtgtaccaaaatntcctctgaggtggaagcggtggagcctgcccatctgtgatgctgtcgaagtttctg

SEQ ID NO: 1866 - DNA, 388 bp, Mus musculus
  misc_feature (184)..(184): n is a, c, g, or t
  misc_feature (335)..(335): n is a, c, g, or t
gtggttcattgtcaccatgtccctgctgtgcccactgctgctggctttagccctggtggctgtccctggtgcccatggcaattgcccggtgcccgcagacctgaagaagtcagatgggacgcgtacgtgcgccagactctatgagaagagtgatccatactatgacaactgctgccaggggccngtgttgtctgtggagccaggtactgacctgccctatctgccctcgggctggtctaacactgcatcgtctctggtagtgggccagcgctgtgagatcactgtgtggtctctccccggtaagcatggcaagacccgcaagttcaccgcgggtncttaccctcgcctggaagagtaccgcaaaggcatctttggagactggtccgac

SEQ ID NO: 1867 - DNA, 471 bp, Mus musculus
  misc_feature (269)..(269): n is a, c, g, or t
gacacaagatgaaaccctgccaaaaaatggaaggaaacctagaaaaggaggatgagccaaagcctgaggaagagccaaagccggaggaaaagcccgaggaggggcaggaacccgaggaggaggagaaatccgaagaaacttttcgggagaggctgatccggtctctgcaggattttcaggaggatatacacaacaggcacctgagcagtgatgatctgtttagagatgtggaggagctagatgagatcaggaaagtgagaaacaaactntatagtgacgcgttggaaggctaaccgaagccatccttacccctatttaatgtagcttggcttgctttcccttttatctgatgttaccattgcgatctagctttcttttcattagcattttcctgataagacctttgcccatcttcctactttgaatctgttgctgttagtggctttagctgtatctcttgttgtctgtatc

SEQ ID NO: 1868 - DNA, 301 bp, Mus musculus
  misc_feature (263)..(263): n is a, c, g, or t
tgtgtgctgtcctgacaccaggtgaggcagggaccagcgagacgtctggggcagtgacctcagctagccagatgaacttcatatccactctgatgtccttgctcccccaattctgccaatcccccccgcctgcagtcagtcatgtcctttgtgcccgtcccggcacaggctcaggacatggaggtgccggatgcagggaggaggtgccgacggaaggaaggaaagaggcgggaaggaaggaaacggtgctggagccaggccantccagggatggtggacagatgtgaccaagaccttcgca

SEQ ID NO: 1869 - DNA, 406 bp, Mus musculus
acatctcgggctttgtcagcggcctcttcctttcctttgccttcctgccttacatcagctttggcaagttcgacctgtaccgcaagcgctgccagatcatcatcttccaggtcgtcttcctgggcctgctggccggcctggtggtcctcttctacttctacccggtgcgctgtgaatggtgcgagttcctcacctgcatccctttcacggacaagttctgtgaaaagtacgagctggacgctcagctccactgaaccagccgtggactccccaggccaggcccggcctcccagggctgaacagatgggtgcttcctggacactgacctcttgtgccttgctcgctccggttgtacgcttacactgctgggcatttagtacatgagttcccatgataacctcctaac

SEQ ID NO: 1870 - DNA, 356 bp, Mus musculus
gatcctcatggcagatgctgacggagccacaaagtttccagatgttgagaaattagaaaaggggctgagtgatctacagccatggcctgagcaaatggctattgcatgtgggtctcgagctcatctggagaaagaatcgattgctcagcgctcttacttccgtacctttcttatgtacggattccatttcctggtgtggttcctctgtgtcaaaggaatcagggacacacagtgcgggttcaaattactgacccgagaagcagcagcccggaccttctcgtctctgcacattgaacgatgggcatttgatgtagagctgctgtacatagcacagtgtcttcaaatcccaatagcag

SEQ ID NO: 1871 - DNA, 68 bp, Mus musculus
aggaccctcgtgtaggtcctgcgcagaccgagttactgtgttccctcataaaggatgagtccctggag

SEQ ID NO: 1872 - DNA, 323 bp, Mus musculus
  misc_feature (192)..(192): n is a, c, g, or t
  misc_feature (195)..(195): n is a, c, g, or t
  misc_feature (199)..(199): n is a, c, g, or t
  misc_feature (202)..(202): n is a, c, g, or t
  misc_feature (265)..(265): n is a, c, g, or t
  misc_feature (285)..(285): n is a, c, g, or t
tttttaggtctctagctacccacaagggaagtgtatagcataaaaagtctaagtagcatatcctgtcctgaaagtgtgtgtagttttacttgttcaacagaatgtccgacagcatcctttaaaacttaaagagaaagacaactttgcagaaagagacacagctggctctctgcagtggtgtcctctctgttngcntgtntcngagagacactgacagtttcgtgtaactcccaggaatactgtacctgtgtttggaggagctttntcagagaaatagcaagcatntcctgttgcttaacgtgtccttgtgaattgcttggttt

SEQ ID NO: 1873 - DNA, 480 bp, Mus musculus
  misc_feature (297)..(297): n is a, c, g, or t
  misc_feature (314)..(314): n is a, c, g, or t
tttgtctcttcaccaaaaggtacagattgctttaaaatacttaatagtataatatgaacttattgtctgaagaactgtgattttctgtgtagtcctaaaattatagcttaaatataattgcttccttgattatatgatgtaagcactagggctctcaggcattgctagcgttccatttcttgaacattaggccagtttacttgtttctctgggccagcctcacacttgttccgagcatctcttgtccaagaacagctttcaatattgttattcttgttcatagaattcttggctgtnccctggggaaaacagcnagaacagtataggttagagtcttcagactggaaatattgcagctattcagactatcttcctgtgataggacactcccattgtatactctgtgtcttgtaaatgtgtcatttcatatttttgatattggttacaagctgtgtgcttgtactgtcttgaaattcttta

SEQ ID NO: 1874 - DNA, 475 bp, Mus musculus
  misc_feature (166)..(167): n is a, c, g, or t
tctttgtgtcctcgtcatagcagagggttgccggagcaggggacaagaaaggctcttccagtgtgatgcttagttattaatctgtccctttcagacctagccactgtaacaggagagacctcgctggctctcttgtatacaaacataacaaacggggggggggggnnctttatgaatgtcagaatgctcaggaaatgactggtaatggaaaaaatgttgtaataaaataatctaatcaaagactattattaaatttaacatagtatatgtctgaaaggcttagttgcttgctatgcagatagatgtgtgaaatctcactgataatgctctccctctgaaaaggcttcaggactgaggacattaccagctaaattgcctcttctgaactgaagtgagtcccggtttccttcattttaatgggagggtaataaagatgaaagaccaacattttatctgatggatcccttaagctatg

SEQ ID NO: 1875 - DNA, 529 bp, Mus musculus
gacatgggatgtcctttgccacttacttgctggcttgggctcgttttttctgactggggtctgacaccagttttgcccactgctgtggtctgaagaggcccgtaggcccgtaggcccagaagctgctgtcctgccctttatcttcctggccactgggcttcattcccagatcttttcctttcactccacagccaaaggctatgacaaaacactccctggccaatggcatcactcctcaggcctatccccagctcttgggatgtgcccctgaccaaagacaggacctcaaaaggttctgtcagccaatggcagctcttcttgggctcctctgggccaatagtgttgcctccagtaccctttgttccctcctcaatgtgtgtccattgcagagaaggggactgggaccaaaggggtggggataatggggagctgcatttgtggccctgcatctgaatgggccctcccctcatccacccacccagttgaactgtgcttagaaccccagaagactgggttctagcactaggaa

SEQ ID NO: 1876 - DNA, 512 bp, Mus musculus
  misc_feature (51)..(51): n is a, c, g, or t
  misc_feature (158)..(158): n is a, c, g, or t
  misc_feature (242)..(242): n is a, c, g, or t
tctaccctgcgcatggtggcagtgttggtgtcgcggactgtgggccctacncagcggctgctgctctgtggcacgctggctgccctgcacatgctcttcctgctctatctgcacttcgcctaccacaaagtggtggaggggatcctggacaccctggnagggccccaacatcccacccatgcagagggtccccagagacatccccgctgtgctccctgctgccaggctgcccgtcgctgtgntcaatgctaccgccaaggcaatagcagtgactctgcagtcacattgaccctctctgaaatcctcggcctgccctgacccccagctccggggcagaggaagattaaaggacagtactgaggatgtgtgtgcccaggtctgcagccaccaggctgtggctgcctaaacacctgctgggcaccaggcttggcttctgaagggcacaagaccaggaactcacagctaggactgcaagtctctgcagccaagtgcagaatatgggtcagctcttc

SEQ ID NO: 1877 - DNA, 126 bp, Mus musculus
  misc_feature (64)..(64): n is a, c, g, or t
cagcattcctccctataaatataaaatcctgtctaccctcaccccatcctttgacttatttttnttttaagattagcatctctgcccccatttcctcctgccttccttctctgagcgggctgggac

SEQ ID NO: 1878 - DNA, 341 bp, Mus musculus
catgttggttcactgatggctttcagacactctgtgacttcagtactcacacatttgattaatgtgtattcaatgggagtcatcatttctaagtcagcgtttgagttctcggctgattaatccttgtaaagaaaggactgtacttagggtagcctggggctcctgtatgtcatcccctcaaacccccactgtgcctcccgagatcaggatgggacagttccgagtgagtgcttgccgtccagcggggccacattctgcctactgagaggaaagattgtcccagagtgtggagggcgttctgaggaactggaacagtgtactaatgtggctggttttctctc

SEQ ID NO: 1879 - DNA, 298 bp, Mus musculus
gttcccgcttatccaaacaatgcattcaaacctggctgggaaaatcaccgggatgctgctggaaatcgacaactctgagctgctgcacatgctggagtcccccgagtccctccgctccaaggtagatgaagcggtggcagtcctgcaggctcaccatgccaagaaagaagctgcccagaaggtgggcactgttgctgctgctacctcttagacaagaaaaaaagagtcgaaagccaaataacccctcatggcatccagctaaggtctgaagacatcctagtttgtctgtggacctcca

SEQ ID NO: 1880 - DNA, 508 bp, Mus musculus
  misc_feature (163)..(163): n is a, c, g, or t
  misc_feature (242)..(242): n is a, c, g, or t
agagtgtactccgtgttctaacttccagattaaaacaacacctgagtgtggttctacagggtatgtggaaaaaatcacatgcagctcatctaagaggaatgaattcaaaagctgccgttcggctctactggaacaacacttattctggaaatttgaaggcgtngtggtggctgtagctttagtcttcgcctgccttgtcatcgttcgtcagcgacaactggacagaaaggctcttgaaaaangtcaggaagcaaattgagtccatatagctgaatttctactgtattatggtggctctttacggactgtatctcagatggagaaagttcagcggctaatttgcactcgtaaacctgtggtagtagcattttcaatgacttcctcttctagaccattaatgagcacaataaaaagtaaaatagagctggacatgacacagacttggaatcccagcacttgagagaatgaggcaggaggatccttggtaactttgtaggccgactaggct

SEQ ID NO: 1881 - DNA, 526 bp, Mus musculus
  misc_feature (66)..(66): n is a, c, g, or t
  misc_feature (365)..(365): n is a, c, g, or t
  misc_feature (386)..(386): n is a, c, g, or t
gcagtctacggaaccgcattgcagccgtacctgtggagaacaagagtgaaaaaatccggagggaangttcaaagcgcctttcccaagagaagggtccgcactttgttgtcggtgctgaaagaccctatagcaaagatgagaagacttgttcggattgagcagagacaaaaaaggctcgaaggaaatgagtttgaacgggacagtgagccattcagatgtctctgcactttctgccattatcaaagatgggatccctctgagaatgcgaaaatcgggaagaattaggagcttacattgtacgctgccctggctgtcgacgatgccgcacagcagatgtgaaagctattttttgtttaagattaaantttttctggtgctgggaaatnttaacttgttaacctttaaattgtagataggatgcacaacgatccagatttatgtgaagtttagaagcctcaagctgtgaggcccagggctgaggaataaagtaaatagaatttggagtatgtacgttctaatttccaga

SEQ ID NO: 1882 - DNA, 142 bp, Mus musculus
gaagtccactgcctaatgacagggaggtacctgcagtgaccttgccctacaggtgtggctaggcatgacagctccagaggtggtactggctaccatgagatctgtactgatgatcttgcagctgaggctgggcctgacctca

SEQ ID NO: 1883 - DNA, 517 bp, Mus musculus
tcatcctcaagacattccttcgggagcttcctgaacccttgctaacctttgacctgtacccccatgttgtgggcttcctcaatattgatgaaagccagagagtggaagtgacacagcaggttctccaaactctgccagaggagaactaccaggtgcttcatttcctgactgccttcctggtgcagatatctgcccactgtgaccagaacaagatgaccaacactaacttggctgtagtcttcggccctaacctgctctgggctaaagatgctgccatcaccctcaaggctatcaatcccatcaacaccttcactaagttcctcctggatcatcaaggggaattgttccccagcacagatgcccagggggtctgagctcaccacctccagccccttctctggcagcccgagttggacttgtcctcctggcattaaccttactggagtccagggctcctgcctaggaaggggccctgaagccccagaagatggaagttggagcctactaactgggcagc

SEQ ID NO: 1884 - DNA, 121 bp, Mus musculus
tgggtgccgcactggtcacagctgacgacttccttgtcttcctgcgccgctctcagcaggtagcggaagctcccggactggtggatgtacccggtgggcaccctgaacctcaggccctgtg

SEQ ID NO: 1885 - DNA, 370 bp, Mus musculus
gttacctctcccaggaagcatgcatgcagcactgctcaggtaagcagatgcatcctttcctgaccccgggcctaaaagcggtgatcctggtggggctgttcctcatggttctgatcctcctcctgggaacctctatggtctgcctcatccgtgtggttcgcagaaagcaggagcgtgcgctgcgcactgtttggagcactgcggatgacaaggagcagctggtgaagaacacctgtgtcttgtagaggccccagtgctcagaaccgggagtacaacttgtgctgtttaaaaagagagcaactgcttgcgtctgagatcattaggggtttggtctttgtttcccagtgctgttgggctgcttagggcctcc

SEQ ID NO: 1886 - DNA, 493 bp, Mus musculus
  misc_feature (94)..(94): n is a, c, g, or t
  misc_feature (224)..(224): n is a, c, g, or t
  misc_feature (405)..(405): n is a, c, g, or t
  misc_feature (449)..(449): n is a, c, g, or t
gaaagatcgacgacctccatgacttccgtagaggactctccaagttaggcacagataactagggcggggcggagcaagtgtgtgtgagaggtgnggtagacgtaggacattctccatttgcttctgtaaatgcaggtgcgatctgtctgtctccagaccaattgtgccgtccgctcactcctccagaataggaaatctctcgcttctctggctttgtgaggtcntggacagctggaagcttctgactcaggaatccagaacttggtctaccttagccgtttacgcagtcagggcagggatgtttagatcttcccttaagggctgttgtaaccctatgaaccggggatgggggagtattttctaatccaagtaccattatcctttacagcaggccctcgggtgccnttctgctgcgtggcattcagtgtatgtgactctccagcaggttntagaccacgggcatgtggagggagcatcttttcccagtatgcat

SEQ ID NO: 1887 - DNA, 480 bp, Mus musculus
gagcctgctcagaatcactttagtgagggctccctttttttcttcttaaaagaatttcaagtgtgtgctgataaagttctaggaatcgagagccgtcatgatttccaggtgcgagtcaaggttggaaagtttgtggccaaactgactgaaaggatgttcccaaagagtcaggaataacttggtggctttgtagtgtagcagcagcagcacaccttgtaaactattctttttctccacgttgtttatatggcaaaggaaccctttcagctgccaattttgaatgatgaatatcatactgtatcaccgatgttgatatttaaccaagtttgtcttcaggtataagtttaatgaatgtacatcactacttgtcctgaaacatgtcgcattttattttgctgcccacattgaaacatttttctgttccctccctataagtgacagcgaatcaattcatcctaagtaggcccctttctgtcatta

SEQ ID NO: 1888 - DNA, 489 bp, Mus musculus
  misc_feature (143)..(145): n is a, c, g, or t
  misc_feature (175)..(175): n is a, c, g, or t
  misc_feature (206)..(206): n is a, c, g, or t
  misc_feature (212)..(212): n is a, c, g, or t
tagcttctaaacagtgcataccattttattttatcttttaacactttgagcttttggaaattatattataaattataattattgcaaactgaaaaaaagtccatgtcaaacacttagacttgaacaaatgattgaatttctannntttaaaaatttaaaggatgtgtatgtgtangtatgtatgtatgtgtgtatgtatacacatncacatncacacatacatacatacaatcacaatttaattgagccaatctagcttttttcagtatagtttatataattaagtgaaattatttccctttaatctttaacttaggaagctagaaacaaagactttagtgtgaagcccgggtcatgtggagctgcccagctataatcactgtcaggtttattgagtttaggagtactggttacagggttaaaactgagaagggtgctggacgctcaggagccacaaaatcccataatgttcttcaagactgtctgttg

SEQ ID NO: 1889 - DNA, 228 bp, Mus musculus
caggcacatggataattgggacattgcagatcttttctctgatcatatgcaccttgtctttcatacgctgtttgaatgtggaagaaccaggttacatatctttaaaaaccaaaacacagcaggggcttggtggctcaagtctataatcccagcattcaggagggcaaggcagaagtgctgcaaattcaaggcaagcgtctactaacagtgtgagtgcctgtctcaaaa

SEQ ID NO: 1890 - DNA, 229 bp, Mus musculus
gcttcctcttcttttccatgctcttcctcatgtttgcagccctcatgccgaccgtgctcacctttcccttagagatggcggtcttcatgagggagcacttgaactactggtatactctcaaagcctattacttggccaagaccatggctgatgtgcccttccaggtggtatgcccagtggtgtactgcagcatcgtgtactggctgtgggctgtgtctcccagtctcag

SEQ ID NO: 1891 - DNA, 433 bp, Mus musculus
  misc_feature (153)..(153): n is a, c, g, or t
  misc_feature (332)..(332): n is a, c, g, or t
  misc_feature (350)..(350): n is a, c, g, or t
gaaaagctacttgaccaggaagggaagtatgcgtattagtggcagcctgttggttcccatgtgttaaggtatactgctccttccttacagcaaaaaaatgtttacttcagaaaccaaaaattaataattaagatgaagaaagccaacaaccancagggcttgtcttcactgtcagaggtgtgggtgttcctcagacctccttcctgtgcacctctgtggggtgcctcgctactgccatgcccccacatgtgggccctccagcccccctagaactgtggaagggccccagcacccacggttccatggcttgtgacaagaagcactggccagangacagacagtatttgccnaatcactgaaccatatttttcttttctttgttggaaaaaataagccgaggtgatttctgaaagtcgccatgttcaggcactgg

SEQ ID NO: 1892 - DNA, 450 bp, Mus musculus
gaaagtctcatccaagctgtgtcttctggtccaggcgtggcccctggccccagggtttctgataggctcctttaggatggtatcttgggtccagcgggccagggtgtgggagaggagtcactaagatccctccaatcagaagggagcttacaaaggaaccaaggcaaagcctgtagactcaggaagctaagtggccagagactatagtggccagtcatcccatgtccacagaggatcttggtccagagctgccaaagtgtcacctctccctgcctgcacctctggggaaaagaggacagcatgtggccactgggcacctgtctcaagaagtcaggatcacacactcagtccttgtttctccaggttcccttgttcttgtctcggggagggagggacgagtgtcctgtctgtccttcctgcctgtctgtgagtctgtgttgcttctccatc

SEQ ID NO: 1893 - DNA, 457 bp, Mus musculus
  misc_feature (208)..(208): n is a, c, g, or t
  misc_feature (263)..(263): n is a, c, g, or t
  misc_feature (272)..(272): n is a, c, g, or t
caagaggcagcaagtgccctggtgagacggagagagagggtggacaagggcgagcaagggaaagtggaaacagcaagaaaactagattaacctcccgtgacactggctgtttatggattgggctagcctcgcctccatttccctaagtgacggaggctcaaatctgacattgagcttgtttgttttccttgtgttgtggatggaagcnagggccttgcataggctaagtgccacccctgagcgctgctcctagtcctcctctntgctgattncccgcccagcctggtcccagcccttgagtgactcagctttggtctggtcggttggtcccagtgctggagctcaacatctaacattgtatccatttgattaagtatttgatacttcctccttatccctccttggaggtgctcactcactgagggcaggagctatgtgtctcggtcacttctcctgc

SEQ ID NO: 1894 - DNA, 467 bp, Mus musculus
agtaccctccttgcaggacattgacgcacagatggagtaccagttgagactgcaaggctccagcaatggcttccagccctgcctggccctgctgtgctccccctactactctggcaacccaggccctgagtccaagatctgccctttctgggtgatgcctccccctgagcaaaggcccagtgactatggaatccccatggacgtagagatggcgtatgtccaagatagcttcttgaccaacgatgttcttcaggagatggtgatgctggctgagttctacaagggtgcccctgacctggtgaagttccaagaggcctggagcccagagcatacctacctggacaaactcaagatgtccttggccagcaggaccccgaaggaccagggcatgtgccacgtgctggagcaggtctgcagtgtgctcaagcaggggagctgaggctgcataggctttgctgtcctgggac

SEQ ID NO: 1895 - DNA, 372 bp, Mus musculus
  misc_feature (181)..(181): n is a, c, g, or t
atgtatttgtatatcttggcctataaagatgagtaataggtgaataaattactgtcaggtgttcaaacacttaactgtctacctcctgagatagcctgttcaatctaccttgtgcaatagcctggctcaatattagaactgcagatccacttgttctcaacttagatgaataatggacacngtttctcataatttcttattagatacacagaaaagctgtctatttcattatcagaatttgtcatttgaaacacaatttacagtcttaactttcaaatgcatgtgagactaagatgtattgtgattcaaatgctaagaagtaaatttacttgtaatttctttacttcagaattctgtttatacttgtagtca

SEQ ID NO: 1896 - DNA, 213 bp, Mus musculus
caagctgattccatccggcgcaggccgagagtggctggagcaggcgccgggcgaccatccggccctggggcacctttcgtggaccagcaacgtttctcgcgaccccgcaatgtgggagagctttgccagcgcctggtacggaactgtggagtattatcaaagcaactacgtgttcgtgtttctcggcctcatcctgtactgcgtggtgacatc

SEQ ID NO: 1897 - DNA, 188 bp, Mus musculus
gtggctttgcccactgcttctggctgtgggccacatgagggtacgtgccatcatctctccaacccaggcctgggggcatgtcacatggtgggaggagatggaattcctcccggctgcagtgtgtctccagcccccagcccagcccctctcccttttactgtgccttgcttagagccagaagggatgat

SEQ ID NO: 1898 - DNA, 481 bp, Mus musculus
  misc_feature (158)..(158): n is a, c, g, or t
  misc_feature (327)..(327): n is a, c, g, or t
cctgctgtcaggttcacaggctgaactgcgccagcaccactgacggactctacagctcaagcggaggccctgggagtcgcacggaggcctcacccgcaccagaggcttcaaaggcgagtctttggctgggtaccctagcacagcctctctccatgganctcggacacaccgtcaaccagaggaggacatggcactagtcagggaggaaggccagagcccttcaaccactgtccagccccagcactacctctcaagcaagaagcttaagacctgtgtcattttgagtggctgttcagtgcaggtgactggcatggctgcctcggccangccatgccaacttcactcatccaaccaggaagacgtggggagacactactaccacctcagagctgttgtcaccgagggctgaagaggcaccagacaggactctgagcaccaggctttccaactttatgtgagagtcttggcctatgaacttttt

SEQ ID NO: 1899 - DNA, 395 bp, Mus musculus
  misc_feature (76)..(76): n is a, c, g, or t
  misc_feature (222)..(222): n is a, c, g, or t
  misc_feature (267)..(267): n is a, c, g, or t
aaggtgagacctatctgccagggctgggcgtggcctgagggccaggctgttggtcctgggatgcctcagcccaaanccagtgagcaggagggtgagagcatgaaggccagccaggaaccagctccccagcctggcacagatgtggtcccagcagcccccaggaagcccagaaagttctccaaactggttctgctgacagcctccaaagacagcgccaaagtngctggggccaagcgcaaaggagtgcactgcatcatgtccctgggngtgccaggcccagccaccttggctaaggccctcctcaagactcatcctgaggctcagcgggccattgaagcgactcccctggagcccgagcagaagcgcagcaagcagaacctggattcagatggtcc

SEQ ID NO: 1900 - DNA, 302 bp, Mus musculus
  misc_feature (276)..(276): n is a, c, g, or t
aattcatagcattcccttgtcttaattaatctcctgtggctatagttttttaaaagtataaacgatattggtgaagattcttgtcaatctttggttacattcactggcacttccttaggggacttacttgacagtggaattactgaattaggtaaaagaacaaaatttgccaatttgctctttccagcatcacatgcaggaggcaacgcccttgtctgcactggggattacgtacttccttttcatcattttataattcaccactcagtagatganagcggtacatcatcacttaagctact

SEQ ID NO: 1901 - DNA, 549 bp, Mus musculus
  misc_feature (150)..(150): n is a, c, g, or t
  misc_feature (218)..(218): n is a, c, g, or t
  misc_feature (238)..(238): n is a, c, g, or t
  misc_feature (415)..(415): n is a, c, g, or t
  misc_feature (417)..(417): n is a, c, g, or t
  misc_feature (459)..(459): n is a, c, g, or t
attgacccttactcactacttgaacctttatttattgcaccatgttggtgtggtgggcagggcaggtgggggacctgccctggatgtgggccctgcagtgcggtggctctgccctagtcctctggtatgtaaccagaatccccccattgnctgctgccaattccacaccacccaggcctccgtagccccagggaccctccaagatcgttgctcctctntccacccagactaccccagnccgtggtagtatcacctgcccatgttccgggccttctggatgagggacagcagagaaggaggcgaagtagctcttcaagggccaagggtcagcatccctcttcattgacgggcccggggcagagccggatcctatgcacagacacagttcctgggactgggcctctcccccatcccntnttttttcatttccttatccttttgtctgtctgcttgtttgtntggatcacttcctatagacccattggtctgttcctggaaaacactacagtccttgtccattctcagttgacccatactgttacccataaa

SEQ ID NO: 1902 - DNA, 513 bp, Mus musculus
  misc_feature (127)..(127): n is a, c, g, or t
tctgctcctgtcgtttctttggatgccagcgctactgccggtggcttcccgccttctgttgctaccccgagctctgctgtcaatggcttctggaagccctccgtcccagccccctccggcctcgggntccggctacgttccaggatcagtctctgcagcctttgtcacttgtcccaacgaaaaagtcgccaaggagatcgccagggcagtggtagagaagcgtctggcagcctgcgtcaacctcatcccgcagatcacatccatctatgaatggaaaggaaagatcgaggaagatagtgaggtgctgatgatgattaaaacccaaagctccctggtccctgctctgacagagtttgttcgatctgtgcacccttatgaagtggccgaagtgattgcactgcctgtggagcagggaaatcccccgtacctgcactgggtgcaccaggtcacagaatcggtttcaaattctggcacagccctaccatgaggagccctgttcctgttttaatgccc

SEQ ID NO: 1903 - DNA, 537 bp, Mus musculus
tggacaccatgcagctgaccgtgaaggcgctccagggccgggaatgtagcctacaggtggcggaggacgagctagtgtctacactgaagcacctggtctcggataagctgaatgtccctgtgcgccagcaacgtctgctgttcaagggcaaggccctagcagatgaaaaacgactgtcagattacaacattgggcccaattctaagctcaacctagttgttaagcctttggagaaggtgctactggaagaagggtctgcccacagactggtcgactccccagccacccccatctggcagctgatctccaaagtcctggcccgtcacttcagtgtagcagatgccagcagggtcctggaacaactacagagggattatgacaggtccttgagccgcctaacactggatgacatcgaacgtttggccagccgctttctacaccctgaagtgactgaggctatggaaaaagggttctgcaaatagcattctgggattgtggggagaaatcccaggtcaggccacagctgcatgttgcatt

SEQ ID NO: 1904 - DNA, 489 bp, Mus musculus
gatagtgacttgatgttgcccagacaagacttgaacttacaggctcagggcatactctgatttcaattcccgttaggtacacaacacctgagagactcagttcttctctttcttcttttcttgcttgaagcttctgtcccaacgctctcaaacaacaccgaatatccccatagcaggcccttgcccacagccaggtcagcaaggaaggggatatcacttacaactggggacctccattgatactcaagtgccagctagacactaggtggcttctcagacctccccctcttcagcatcctctggagctcaggcctgtggggtctttactctccctagtttcagggtcagctagctagttagccatggcctctccctttctgtgatgaccagctggcccaagacatcgtgtacctccttctagggacttaacgctttagcaatgattccctaggcactggggaaaagaacttctcgggtagctgacacgac

SEQ ID NO: 1905 - DNA, 69 bp, Mus musculus
ttagcccacccgttgtagcctttggctgtagtcccagtttcccccgactagggccatgctgcccctcgc

SEQ ID NO: 1906 - DNA, 86 bp, Mus musculus
gggctacccctatggtgagtggaactgacagggactgggatgagaaaatgaggatgccctaagccccttgtagatccttctttctc

SEQ ID NO: 1907 - DNA, 522 bp, Mus musculus
  misc_feature (94)..(94): n is a, c, g, or t
  misc_feature (116)..(116): n is a, c, g, or t
  misc_feature (198)..(204): n is a, c, g, or t
  misc_feature (206)..(206): n is a, c, g, or t
acccttcattcgtcagagcctggataggcggagtcggtgactgcaagttgggggggaactatggacccactgtggctgtgcagcgagaagcccnagaagagaggctgcgagcaggntcctctggctgtacgggccagaccaccagctcactgaggtgggcaccatgaacatctttgtctactggacccatgaagacgnnnnnnntnggagctggtaacccccccactgaatggcgtcatcttgcctggagtagttcgacaaagtctgctggatctggccaggacttggggtgagttccgggtggcagaacgcaaggtcactatgaaggaattgaagcgggcgctggaggaaggccgagtgcgagaagtcttcggctcaggcactgcttgtcaggtctgcccggtgcaccaaatcctgtatgaaggcaagcaactccacatacctaccatggagaacggcccagagctcatcctgcgcttccagaaggaactgaaggctattcagtacggagccagtgcccac

SEQ ID NO: 1908 - DNA, 527 bp, Mus musculus
  misc_feature (92)..(92): n is a, c, g, or t
  misc_feature (307)..(307): n is a, c, g, or t
  misc_feature (326)..(326): n is a, c, g, or t
  misc_feature (329)..(329): n is a, c, g, or t
ctgttcttcacacaagagcactcacaagaggacacagaagccctggctcatttgccacagatgcatcctggcacacacagacacacgtctcntgggctcccagcccctccagataccagcacccagaggcccttaggagagcctctgggcacacagaagacctgctcttatccctacctttatgatcctagaagcttttcttctttctgggttttaccatctgtaaaatgggaatggactgagtgatttccaaaattctctcctgattggcattcctggccactcagaatagagcccacatcccttnttgggcagggcagcagctncantcccagcatcacacagctgccactgtgggttctgggagctgagcaatgctgtgtgaggggcagagtgccagggatggagctggcactgaacagtagctccaggcctcctctgggcccagggctgagccaaactgtgttctgttcctgtagaattctctggattccatagttggaatttcctcttctcgttcagtgaaa

SEQ ID NO: 1909 - DNA, 476 bp, Mus musculus
gctgttggcctgctattcaataccaccttttaaaggattgcacatgttcgttctgtgtcagcagctatttcatgctgacatgtgtgcacattagattcacttctttcccccactgtggacaatcagagccttcctaatctctaacagtctaatgctttcatggaatgtaactgcgagtgctccccacaccctgcatctctccctagcaatcatctagctggatcttaacgagagcctggctgctggaacaagaatgtcacacaaaaatgtgcactagagatctggccatagaaggcagaggttgcttctccatgtggcttgcagaatctgcttgttggctttaaaaacaccctctcacactacaaccttagtctttaaaggaagattcgatgtgcttgtccttgggcgccttctatgaacctctcttaaggaactgactcctttttccctgttgtatggcaagtcactgtctcagc

SEQ ID NO: 1910 - DNA, 481 bp, Mus musculus
  misc_feature (26)..(26): n is a, c, g, or t
  misc_feature (36)..(36): n is a, c, g, or t
  misc_feature (93)..(93): n is a, c, g, or t
gaagcataagtggtttactgaagttntgtgtgtttnttttttttaaatctgaatgtttaaaaatgtggctaaatctccgtgctgtttattggntcaagatttttagagatcagtaattgtctgcttgcattgaatacaatggctaagacagtgcaccccctgctgttaaagtcaaagaactggatgcctggcccagcccagtaaaaccccacagcatgggctatgtttctacaggatttgtacacacttcaaaatggtttgcacaaagctgaaataatggggcccttcataaatccgaaggactgtgaacaactttcgaatgtgctttttaaaactctctgactaatgctaaaatctaatctaattaaatgtcctccagacactgtagtaagcattaggaaatgaatatgggggattttagaaggatgctgtgggttttttaaaattatttattatgcattgtaagtgatacatagcccta

SEQ ID NO: 1911 - DNA, 558 bp, Mus musculus
  misc_feature (318)..(318): n is a, c, g, or t
  misc_feature (332)..(332): n is a, c, g, or t
  misc_feature (365)..(365): n is a, c, g, or t
  misc_feature (387)..(387): n is a, c, g, or t
  misc_feature (453)..(453): n is a, c, g, or t
  misc_feature (469)..(469): n is a, c, g, or t
  misc_feature (497)..(497): n is a, c, g, or t
  misc_feature (518)..(518): n is a, c, g, or t
  misc_feature (530)..(530): n is a, c, g, or t
cagtggctccatgcagtgtccatagatagtgctcatctgggtccgtgttgtttgttgtgaaaagctttatgggctggccaggctgtgtcactttcttcaagcaaagccatatggagtctaactcagactccctgctctgcagactcgctcctgcctatctggcctcacggccagactggacccattatcatagtacctgcctattcgcatgaatgccaggctgcaccaggggcctgggagcactcacaactccagtccgttcctccaggattagcttcccactgcacggagacccaggccactccaaagctctccttncctccatctcacancagtgcccccatcctccatggtggactagaganagctgtgactatggactgtganccttctctccctgctggccacacacctcatatatccctaattaaggattcggggactatttccatntcatccaggtctcctncctctggctccctcccttcccctgaaantcaggtgcattgttctgtctntctgtgttcttncctcataccctcaagcttcgtgctctgt

SEQ ID NO: 1912 - DNA, 461 bp, Mus musculus
  misc_feature (69)..(69): n is a, c, g, or t
  misc_feature (144)..(144): n is a, c, g, or t
tgggattccctggtcttaccttaggcagctccagtggcaaccccctgcattgtgggtctagggtgggtnccttggtggtgagacaggcctcccagagcattctatggtgtgtggtggtgggggtgggcttatctgggatggggnaccccagttggggttctcagtgacttctcccatttcttagtagcagttgtacaaggagccaggccaagatggtgtcttgggggctaagggagctcacaggacactgagcaatggctgatcctttctcagtgttgaataccgtgggtgtcaaagcacttagtgggtctgactccagccccaaacatccctgtttctgtaacatcctggtctggactgtctacccttagcccgcaccccaagaacatgtattgtggctccctccctgtctccactcagattgtaagcgtctcacgagaagggacagcaccctgcattgt

SEQ ID NO: 1913 - DNA, 474 bp, Mus musculus
  misc_feature (364)..(364): n is a, c, g, or t
gggaccatgtcagcaactatcttaaatcttcagttatagctggcatttccacacagacatgcaagaccctgacaaaggaaggggtaataatataagactatagaaatctgtgtttcagtttcatctcttttatttctaaagaataattacaggtaacttgatcttttaatgtaccatctcctatttatttattgttttctttctgaggtattaaaatatctagactgaattttgccaaatgtaagagggagaaagttcctgaagactctgactacttgcttatttttgattgaccttctatgcttatgtcattagtgcctcacaacgtgtttgatgtcctttattgatacaaagtgagcctgtnccttcattttcttgcccattttggtaccaatgtaaatttgtgttagaaaatcttgaaactctgtgagtctgggaagaatatatctgaatcctattcaatacatttgctgg

SEQ ID NO: 1914 - DNA, 511 bp, Mus musculus
  misc_feature (281)..(281): n is a, c, g, or t
agtgcaaaaccatagcctgtctgtcccattagcctaacaagagactcctgttttctgacgtgtgccttcccccctaaggagcagtgacagccgctctattagatttctattttcttttctgaaaaatgtcaatttttcagagaggagaaaatagagcattctgtccatgtttttgtttccaagaacaagtataaacttaagctctgtagaactgaaattctttcaagtcctttcgatcattttgatcatgcccaaaacaaccaaactggacaacatgcttntcagttcagttgaagagcatttgcctttgacagtaggcgtgcacaacagcatatccgctttataaacaggtatattatctgcttccctccgtttccagcatagtcaaaataactgagaatcatacagtttcaacaaaccttgttccttaccattgtcatgaacccccatcagagccatcttctgtttgttaatgggaagaggcatgtgggatttatacaggctcacctgt

SEQ ID NO: 1915 - DNA, 434 bp, Mus musculus
atacctgaccaactcgtgattctagacatgaagcatggagtagaggcgaaaaattatgaagagattgcaaaagtcgagaaactcaaaccactggaggtggagttacgacggctcgaggacctttccgagtccattgttaatgactttgcctacatgaagaagcgggaagaggagatgagggacactaatgagtccacgaacacccgggtcctgtacttcagcatcttttccatgttctgcctcattggactagccacctggcaggtcttctacctgcgtcgcttcttcaaggccaagaagttgatagagtaatgaggctcagtgttctgtcccctagagccagcagaacatcgctgggacatgcctggcctagcccaaggccattctactaacagtaccatcaaggcacagctgagctttcttgccagaactga

SEQ ID NO: 1916 - DNA, 501 bp, Mus musculus
  misc_feature (79)..(79): n is a, c, g, or t
  misc_feature (93)..(95): n is a, c, g, or t
  misc_feature (98)..(99): n is a, c, g, or t
  misc_feature (102)..(108): n is a, c, g, or t
  misc_feature (110)..(112): n is a, c, g, or t
  misc_feature (114)..(119): n is a, c, g, or t
  misc_feature (128)..(129): n is a, c, g, or t
  misc_feature (131)..(140): n is a, c, g, or t
  misc_feature (144)..(146): n is a, c, g, or t
  misc_feature (148)..(148): n is a, c, g, or t
  misc_feature (150)..(151): n is a, c, g, or t
  misc_feature (153)..(154): n is a, c, g, or t
  misc_feature (164)..(164): n is a, c, g, or t
  misc_feature (170)..(170): n is a, c, g, or t
  misc_feature (178)..(178): n is a, c, g, or t
  misc_feature (184)..(184): n is a, c, g, or t
  misc_feature (199)..(199): n is a, c, g, or t
  misc_feature (201)..(201): n is a, c, g, or t
  misc_feature (206)..(206): n is a, c, g, or t
  misc_feature (217)..(217): n is a, c, g, or t
  misc_feature (225)..(225): n is a, c, g, or t
  misc_feature (230)..(230): n is a, c, g, or t
  misc_feature (236)..(236): n is a, c, g, or t
  misc_feature (244)..(244): n is a, c, g, or t
  misc_feature (254)..(254): n is a, c, g, or t
  misc_feature (260)..(260): n is a, c, g, or t
  misc_feature (271)..(271): n is a, c, g, or t
  misc_feature (280)..(280): n is a, c, g, or t
  misc_feature (323)..(323): n is a, c, g, or t
  misc_feature (372)..(372): n is a, c, g, or t
  misc_feature (408)..(408): n is a, c, g, or t
  misc_feature (411)..(411): n is a, c, g, or t
  misc_feature (423)..(423): n is a, c, g, or t
  misc_feature (425)..(425): n is a, c, g, or t
  misc_feature (429)..(429): n is a, c, g, or t
  misc_feature (433)..(433): n is a, c, g, or t
aaggtggttgttgtaagctaagtatatttgtggagggagaagatatgtttttataaagttattctaatggctatttgtncaaaaaaaaaaaannncannaannnnnnntnnnannnnnnaactgctannannnnnnnnnnaaannntnannannacaaaacgtncctttngtgcattnggggtncactttgaaggcgtnanaggtngatgtgggttnataaaatnctganagcatncccagatngctcagagtncacacntgcactgtgtngcaaacatncactcattgcaaccgtctctttctcatttgttagttgactttnaccaagtgctctaaggaagtggaaaccagaaggaacgaagctctgtgtnaggatctaggcttcccatttcttgggtacaacccanctngaaccctggggntntgantacntcagcatcactaagacatggactgattaggatgttggatgaatctggcacctagctcttagcagtgtg

SEQ ID NO: 1917 - DNA, 517 bp, Mus musculus
tggatgtgacgtctcctgcttccaaggtccccaccactgttgaggacagagtcagcgactgcaccccggccgtcgagaagcctgtgtctgatgcagatgcttcagagccttcttaactgggaaccaatgttcagaaccgacgtggtctgtttagttaaccacggggtcaggtctggaatcgcaaactaccattgatttcatactagtgtgtaccgtatctgtaggtgtcctgtacataattctaaggggaaactacgcaagaggctgagggcttgcctcccaccacgtcgggggggttacagccgaggagggcaatctgagaatgtgcttgtattttaaacaaccaaaaaaagttgtcatgggtggcttgctgccaggcatctactgccgtttctgggaggttcatctttggaagagagatggcggggtacccactgggttccctgtaccactgctatgccttgtgtaaggaaatgaaatattttatgcctagtgcccacatgcaacatttcttgta

SEQ ID NO: 1918 - DNA, 462 bp, Mus musculus
  misc_feature (65)..(65): n is a, c, g, or t
  misc_feature (74)..(74): n is a, c, g, or t
tgcctccttcgacaagtctatcaagctgtgggatggccggacgggcaagtacctagcttccctgncgtggccancgtggcggccgtgtaccagattgcctggtcagctgacagccgactattagtcagcggcagcagtgacagcacgctgaaggtgtgggatgtgaaggcccagaaactggccacggacctgcctggccatgccgatgaggtatatgctgttgactggagtccagatggccagagagtagcaagcggcgggaaagacaagtgcctccggatatggagaagatgactccacagcttattgaccccccctccccggattcaacccccacctgccctgccagagaccaaggaatgcacacgaccacctgcctgcccaggacaggtctccagtgtgtgacagtcaggacattacagcgtggagctaagccatgggcacttcctggctaacagcagt

SEQ ID NO: 1919 - DNA, 567 bp, Mus musculus
  misc_feature (50)..(50): n is a, c, g, or t
  misc_feature (69)..(69): n is a, c, g, or t
  misc_feature (283)..(283): n is a, c, g, or t
  misc_feature (306)..(306): n is a, c, g, or t
  misc_feature (327)..(327): n is a, c, g, or t
  misc_feature (330)..(330): n is a, c, g, or t
  misc_feature (336)..(336): n is a, c, g, or t
  misc_feature (371)..(371): n is a, c, g, or t
  misc_feature (416)..(416): n is a, c, g, or t
  misc_feature (424)..(424): n is a, c, g, or t
  misc_feature (454)..(454): n is a, c, g, or t
  misc_feature (488)..(488): n is a, c, g, or t
gaaagaattcactctgctactctcggctgccaatgtgtgtctggaccccnattatttatttcttcttangccagccatttagagaagtcttaaataagaagttacacatgtcactcaaagtccagaatgacctagaggtttccaaaaccaaaagggaaaatgcgattcatgaaagcacagatactttgtaaattcccatccccttccaagtattatcagtcttgttacatgataattaagatacatgaataaaaagcaggcatatgatgataagtaacttagnctagcaatatatctaataatatntatgaagtccaaaaaggtatnatnaaaatnaaatataagtttccatgcaaaatggaagtctgtancacatcacatttttttagaaatcaaaggaacagagaagtggcttngtgggtgnctggcgtatgagttaccaaaaccaaacttntcttctattaactggcttcttagaagacacccantctttccgaccttcctcctaagcattcttccaagcaacactcgtatctatttcatgctttgtactatgcatgtgccaat

SEQ ID NO: 1920 - DNA, 508 bp, Mus musculus
aaaaacgggcagtccatcgcctctttcttccagtattttggggggtggcccaagccagcctcgctctcagggggtgcgatggtaaggctagaacctgaggaccaggtgtgggtgcaggtgggcgtgggtgattacattggcatctatgccagcatcaagacagacagtaccttctctggatttctcgtctattctgactggcacagctccccagtcttcgcttaaaacacagtgaacccggagctggcacttgctcctcagtggagggtgtgacactaacccgcgcagcgcataccaggagggctggccccctggaatattgtgaatgacttaggaagagagggagccacttccagtcccactgctggcaatgaatggagacaggctgtctgaggtcaagacagcgtggagcagtggctgggtttctgcccaggactttagaatgcagtaggctggcagctgtgggtcctggcccaggactccaaggtgggatgctccattcctagtc

SEQ ID NO: 1921 - DNA, 409 bp, Mus musculus
  misc_feature (66)..(66): n is a, c, g, or t
  misc_feature (147)..(147): n is a, c, g, or t
agctggcttgtcctatgtcctgggccagggaaatgctccctctaagtctccccttgtggattgttnggtgttttctttctttctctctctttctctctttctctctctctctctctctctctctatatatatatatatatatatatntgtctgtctgtctgtctgtctgtattctttctttgcttctcctctttttctttctgcaacagtgtcactgtgcaacccaggctgtgatggaactccagagatccctgttgcagggattaaaggtgtctatcaggttcccctgtagcttttatcacatcctgggctgcatcttagcagttggtgacagtttacaggtggtggtcatttctgtcactaccagaacattttgtacatggttatttttgtccatcgtttaaccagt

SEQ ID NO: 1922 - DNA, 508 bp, Mus musculus
  misc_feature (402)..(402): n is a, c, g, or t
  misc_feature (420)..(420): n is a, c, g, or t
tgtcaacttcttcaccaactggcagcactacaaggcgggctttgggcgtccagaaggagaatactggctgggcctggaacctgtgcatcaggtgacaagccgtggggaccacgagctgctgatactcctagaggactgggggggccgtgcagcacgcgcccactacgacagcttctccttggagcctgagagtgaccactaccgtctgcggcttggccagtaccacggcgatgccggagactccctctcttggcacaatgacaaacctttcagcactgtggatagggacagagactcatattctggtaactgtgccctgtaccatcgtgggggctggtggtaccatgcctgtgcccactctaacctcaatggagtatggtatcatggaggtcattaccgganccgataccaggacggggntctactgggccgagttccgtggtggggcgtactctctgaagaaagctgttatgttgacccggcttgtgcgcttgtgactgtcccatca

SEQ ID NO: 1923 - DNA, 532 bp, Mus musculus
  misc_feature (323)..(323): n is a, c, g, or t
  misc_feature (406)..(406): n is a, c, g, or t
gttagcctggaaggagttagctcccagagctccccagggtaccctcccggggtcggccttaccttccatctccattgcacattcctggcccccgttctgcacaggagcaggggctggaccttctaactcatcagcatccaggtcctcccgctcctccttgctgtgccggagactgaaaaccaggcgatggagctgggaagttagggagaagggaccaggtgggagttctggctgtcaccccaggtccatgctggcacacagctttgtcactgtctacacacacacacacacacacacacacacacacaccccagactcccttntggcctgcaggcctgcccaggcccagcacactcagactcctctttccaggacagtctttgccttcacactgaaccccgagctnttcatctagcattaaagtcttcggccctgcccagtcccgtgtttcaccccaagttttaggtctacaccgagaatcatagttcttcagttctgatacttcatattcctattgtcatttgctctgctt

SEQ ID NO: 1924 - DNA, 203 bp, Mus musculus
gtctgaaaataggttctccttatgtagctcaggctgcccttgagctcatgtccctgagtttctcagtgctgggatgacaggcctgccaccacaccttgtgtttgtgtcaatgtttctttctgtgtccctgtctcttgctcatatggctctcgtgtctgccttcctctcactttgactctcttctgtcattccaggttgggtgg

SEQ ID NO: 1925 - DNA, 357 bp, Mus musculus
ggcactgtagcccacctggtggcatcccaaggctcagcacgccacaccgtgcagcacactgcctatccggccagcatcgtccaccaggtccctgtgagcatggggccccgggtcctgccctcgcccaccatccaccccagtcagtatccagcccagtttgcccaccagacctatatcagcgcctcgccagcctccaccgtctacactggatacccactgagtcctgccaaggtcaaccaatacccttacatataaacactggaggaggcccgccagggaggagggtggaggagctcccagaccgacctggagagctgggattttctactgcaggtgccgcacacaaacaatgcaatg

SEQ ID NO: 1926 - DNA, 197 bp, Mus musculus
tgtcatgcccagaagatgtgagtttatccacgcctcctggacttctgactcttggccattccactccccatcctccatgttccctgggctttatggaggtagactaaggaatgttgaactatgatttgtattctattaaaatttgaattgattgttactggcactaagaaatcacttttccatatctgcttctgtaa

SEQ ID NO: 1927 - DNA, 326 bp, Mus musculus
ggaatctggccagcgggcttctaatgggaaaggaagggggctggggcaagaagaggtatttttacattccctttcttaaaaaaacttaaacttctgagatgactggacctagactacatgctaacctaccccatcatacatgtagctccgccatccgctctcccaacgcatctgagccctccatggctgagaagcatgtgggactcagagaacagactctaccccagagcctggcatttgggtactgactgggctatcagtatcttgcctctgtgtttacatgttccgtctctccaaggatggatattgtagtctgtgaatgctca

SEQ ID NO: 1928 - DNA, 479 bp, Mus musculus
  misc_feature (49)..(53): n is a, c, g, or t
  misc_feature (63)..(64): n is a, c, g, or t
  misc_feature (355)..(355): n is a, c, g, or t
tagggcttccttcatgaaacttcagccaaagactagccatagcctcttnnnnnattgcaagcnngttctcagaagcctccgtttctctaagtcaggttggcttaagttccaggacaagcagccacctccccttacagtgacctgtccaggctgagggagagtgagtgtgacatagacatctccgactgtagactctggtcaaccctcctgaacaggcagaatgacagaggggcagaaggccacaatgaagcccttctaggcctccaagccaagatcttctctctttcctttctgaaaagaccttgggcaccactagtaccagggagggacaggggcatctgcagaggcagccggntgagaggcagggaggaggcattgtggactacagtgggcaacacgtggcggcctgttcctgtatctggcctccctgctggtggggagggagaaggaaaataatggatggcctcagtccatagtcc

SEQ ID NO: 1929 - DNA, 495 bp, Mus musculus
gagttctctgagtgcaactagcaacaattccactgtggcttgcattaatagaaatgggagctgccgtgtcaaagaagacgccttcttgcagcggtacagctccgaccccacaggtgctgtaacagaggacaacatagatgacgcattcctccctgtacctgaatatgtaaaccaatctgttcccaagaggccagcaggctctgtgcagaaccctgtctatcacaatcagcccctgcatccagctcctggaagagacctgcattatcaaaatccccacagcaatgcagtgggcaaccctgagtatctcaacactgcccagcctacctgtctcagtagtgggtttaacagccctgcactctggatccagaaaggcagtcaccaaatgagcctagacaaccctgactaccagcaggacttcttccccaaggaaaccaagccaaatggcatatttaagggccccacagctgaaaatgcagagtacctacgggtggcacc

SEQ ID NO: 1930 - DNA, 298 bp, Mus musculus
  misc_feature (151)..(158): n is a, c, g, or t
  misc_feature (162)..(162): n is a, c, g, or t
  misc_feature (164)..(164): n is a, c, g, or t
  misc_feature (166)..(166): n is a, c, g, or t
  misc_feature (173)..(173): n is a, c, g, or t
  misc_feature (182)..(183): n is a, c, g, or t
  misc_feature (193)..(193): n is a, c, g, or t
  misc_feature (204)..(204): n is a, c, g, or t
  misc_feature (245)..(245): n is a, c, g, or t
  misc_feature (273)..(273): n is a, c, g, or t
atctctggggtcagaactcagtggtagagcagttggccctgggtttggccccagcaccacacatgcacacgtgtgcaacttaagtttttttttcctctttctaatcagtgttctaatatgctttttaaattttttttcacgaaaaaaaaannnnnnnncaanancngaagatntggggaagnntcttcctttngagaaatccanttttcccaggttttgtgagaactagttattccttccctcanactgttttccttcccttcagagaactgnagtcctctgatgagcactcctgacc

SEQ ID NO: 1931 - DNA, 442 bp, Mus musculus
gatgtggatgctgcttttctcagtagagacttggctgtggagaaccctataaagtaccaaggactaggccgcctcaccttcagtggactgcttaatgctttggatggtgtagcctccactgaagcacgaattgtgttcatgaccaccaactacattgacaggctggatcctgccctcatacgtcccgggcgagtagatctgaaggagtatgtgggctactgctcacactggcagctgacccagatgttccagaggttctatccagggcaagcaccttctttggctgagaactttgctgaacatgtccttaaagctacatctgagattagtcctgcccaggtgcaaggctacttcatgctgtataaaaatgaccccatgggggctgttcacaacattgaatctctgaggtgacccaccaggccatgatctgctctcaaaaatt

SEQ ID NO: 1932 - DNA, 430 bp, Mus musculus
  misc_feature (36)..(36): n is a, c, g, or t
  misc_feature (138)..(138): n is a, c, g, or t
  misc_feature (167)..(167): n is a, c, g, or t
acacgcatttctgcctgagacaatccgcctttgagngactgtcatattttatctagagtgttctttactatctacttctgtagcagggtgggaagagagcacggaagctggccctggagtccttgaggaagaaggccntttggaggtttggcagaagtcaggtaggntcactgctgcgtcctgtcaaagggaggcaaaagcctgctggagttgggcaaagagccctggctcaaactgggccagccactgacaacaacggtggcctcagggtgcagttccacttcaggagctcgttcattcaccgcatggcttcaggacgtcaggacgctttggtggacagtgggtagggattaaggcttccaaacgccttaaacccccgcccatgctcctccgcggaaaaacaaaacaagcttgcgagatcctgcagcgt

SEQ ID NO: 1933 - DNA, 336 bp, Mus musculus
  misc_feature (31)..(31): n is a, c, g, or t
  misc_feature (284)..(284): n is a, c, g, or t
gtattttcagcactactaccgaaagcagtgncccctggggagagaggggtcgttcagagccagcatgagcacagacccctaagatctgcaggcatccttagcccatcttgtccctccctcttcccttccctggcagaagatgcttcatcatccctcccctgaccccaaagggcacacagtccttggtggccccagggatacctaagttcctgtgacggttcttctcccagtggttcgtccgggccatttctcttatggttgttggtttatctgcggtatgtggntctgccaagtaggtggagttcatatggagaggtggtctctttagctccatgt

SEQ ID NO: 1934 - DNA, 112 bp, Mus musculus
ctggaagttgccactactttataatgcctcctaacccccaatacccatcttttaggccccttcccactaccatgtcctgtgccctcttttcaatcttcaccaggccagatct

SEQ ID NO: 1935 - DNA, 322 bp, Mus musculus
  misc_feature (281)..(281): n is a, c, g, or t
gtatgtgaagaccacatggccaaatgtgtggggcagagcctgtgtgagaagctactatgtgcctgtgaccagatggcagctgagtgcatggcctctgccttctttaatcaaagcctcaagtcaccagacggagccgagtgtcaaggcgagcctgtgtcctgtgaggatggcatgctccagggcaccttggcctcttctgtggactccagttctgaggagaatagtgaggaagctccaccgcagatggaacgcctaagaagatttctggaaaagcctcctgntcccttgggggccagacccctcggtgggaaataagatgcta

SEQ ID NO: 1936 - DNA, 525 bp, Mus musculus
  misc_feature (240)..(240): n is a, c, g, or t
  misc_feature (386)..(386): n is a, c, g, or t
  misc_feature (407)..(409): n is a, c, g, or t
  misc_feature (462)..(462): n is a, c, g, or t
aatgcctttagtcagagttcccaacttattaaacatcaaagaatccacaccggtgagaagccctatgagtgtaaggagtgtgagaaggctttccggtcgggttctgacctcaccagacaccagagaatccacaccggagagaagccgtatgaatgtaagatttgtgggaaagcctattctcagagttcacaactcatcagtcatcacagaattcatggtggtaagaaagcctacgaagangaggacggtgggaagaactttatctataactcacagcctattcagcatcagaacttatattggtgatgaaccgacacatacatgatgtatgggaagactcagaactgtcagagactctgtagaggccctctagaccggagaatgtngaaacagttgacttgttgacnnncttgttcatctaagagaaactcatattggagaagcaccctatgaatgcagtanattctggaagctgtctagtaacagcttgtatttcttttgactcagattattcagtctggcaaa

SEQ ID NO: 1937 - DNA, 216 bp, Mus musculus
aatagatgtcaccacagtcgagagactttctcagacatatctctatcaagcttctctgggacctggttatggtaataacagctttttcttgcatgggaaatacaaggctgctgatctgagaaatctggcccctggtgtaggaatgaatttgccagtatcctgtgttcagattcggaataggaaaggggatcattcaaatgtggaagccgtgccccg

SEQ ID NO: 1938 - DNA, 372 bp, Mus musculus
gcatatagactccttattacaggttgattttgaaaggataaattgccaagggaagcaaaatttaaagtaagtgaacatctcaggagtagaatacaggttgacccaagtcattgctccagaattgtcatagtccgttgtcttgttttgcagatgagatagacattgaaatacatatctgattgcacacatcataatttacgagttagattactatcactatcacagctaaaatagccgtacttcatcacgactcattcagcaaacctcatgatgtttccattcattgacaatgtagtagtatgtatttattttagtgccttaatatatttttgatgtatttggctaatggtaaaatgaactgtctcttgaaga

SEQ ID NO: 1939 - DNA, 210 bp, Mus musculus
  misc_feature (91)..(91): n is a, c, g, or t
  misc_feature (98)..(98): n is a, c, g, or t
  misc_feature (150)..(150): n is a, c, g, or t
  misc_feature (176)..(176): n is a, c, g, or t
gggcttctagcggagcagcaggaagtacagaattttgaagatttgcccctcaccaggaaaaccattgccacagtccctgcacagcgtcttnccctgcngtttgagaacaagtgattctgcccagaccctggagagcctgcccgggatacngttgttcctttccctgcatggcaccntcttgctattctgaactcagctggctatgaaata

SEQ ID NO: 1940 - DNA, 547 bp, Mus musculus
ttgatatctcttgctggctgcccagggagccttcaccccagggctttaactgcacagagacatgaggtctaagcccttcgcatccccaagtaaggctgagccttttttctgcctgtgcttgctctgatgcattgaggatcatgcctggccactgtgcaacttttaagcagagccgtgcaacatcccagggagttgacttctatgtaaacaccttcatccatttctgatgtatgctttgaggtggctcaggctgggctagcccagcccagacagaaatcctaggcatgtgattagaggatcagaacccttctggcccttcttcaggggagagatggggctgaaggtggggttcaaatctcatgccgagtgatggaacccgacatccctaggtgctaaggccccaccaaattctctggataaggaagttccaggaatctttactgataaacatcccaatgtatcaacaaggtagactctgacctccatgggacagaaggatcctgggtcagtcccctccctggggactctgcagttggctgttcattta

SEQ ID NO: 1941 - DNA, 431 bp, Mus musculus
aagatctctagggtccagtgaggacagtgggaacaggacccctggctggtgccctagaattcatacaacttgttcccactaccttataaactaatttaaagatgctatgttttttaaaggaggaccatgcacctgtattgtctagccttgacatctggaaaggctaagctgttgctgctcagggcctaataaagtggcaaagctctccaaagataacacagccccacatcaaagactctcacgaatacccaccaagactccagggagtccatggggcacccttcaactgaccctatatagactctatgcagaccagggcctgtcttgctatattcaagtaagcacacaggttggggatttggtggtaacctgaataatatggttcttatttctctttataagataaatgtgtgactgctctacagggctta

SEQ ID NO: 1942 - DNA, 450 bp, Mus musculus
  misc_feature (68)..(68): n is a, c, g, or t
aagggtccacaaagctctagactgggcaaaattcaggtttccatgggctgagcctagcacgttttttntttctcctgcctcagtttacccgtatcacaggaagagttagagcagggtcagcctccaaacaataggggagacggaagtacagcagtagtcctcccggccctcctcctgtatgccaaaatcatttccgttatcccgaggcaggggagtgggtatgggtgcccggcagcgtttttaagggaccctgccctgcccacagccccagctgaccctctcctggcatgtcgtgcccaggtcaccagcaacagtggtacttcatcagtcctgcagcttgggtgaagggggtgggggacgggtgtcctcctctgtccacctccagggcccctcatgcttttgttttctccttgtcaaagaaacaaaacccttaagagttgtgtactgtat

SEQ ID NO: 1943 - DNA, 296 bp, Mus musculus
caccttcgaaaatagctagtatggaaatcccaaatgacgacatcacagtagagcaagcggtggggctaggaaacaggatcttcctcacctggcgtcacgaccccaacatgacttgtgactacgtaattaaatggtgcaactcatctcggtctgagccctgcctcctggactggagaaaggttccttcaaacagcacggagactgtcatagagtctgatcagtttcagccaggagtaagatacaacttttacctctatgggtgcactaaccagggataccaactgttacgttccata

SEQ ID NO: 1944 - DNA, 520 bp, Mus musculus
  misc_feature (114)..(114): n is a, c, g, or t
  misc_feature (149)..(149): n is a, c, g, or t
  misc_feature (153)..(153): n is a, c, g, or t
  misc_feature (170)..(170): n is a, c, g, or t
gagaaaccgtactttatggacccagggtttttgagtgttataaaacggaccaacaacttgaacaatgccaagtctcaaggacaaaaggatgctttaccaaatgaagaggggacnagaactccagcccattgtgagatagggaccaagangaanctttgactacctgtgancaccgagacaaagtctacagctgttttcacgtgaactagagcacggaagatgttaaaactatgtctatatgcatcaatttaaaaggcacaatattggctgggcacagggacacacatctgtaattcaaaactggaagaggctataaggctagcctgagctacatactcagatgttaaatgctagcctgaatgctacatagagacctcatataaacaaacaaacaaataaggttggctcactggataaaggtgccagttgccaacccgaggaactgaataccccaggacccacatggtaaaaggagagaatcagttcctctaagttgtcctcagagctccacatgtgaact

SEQ ID NO: 1945 - DNA, 379 bp, Mus musculus
  misc_feature (254)..(254): n is a, c, g, or t
  misc_feature (284)..(284): n is a, c, g, or t
  misc_feature (332)..(332): n is a, c, g, or t
gaagccaggtgtccaggtcattgtttatgtcacacagctgacattagctcccctggtggactccagcgctgggcatagcagctctgccatgcttatgctcctctcggtggtattcgtcggcttggctgtgtttctgatctacaagtttaaaaggaaaatcccctggattaacatctatgcccaagtccaacatgacaaggaacaggagatgatcgggtcagtgagccaaagtgagaatgcacccaaaatcacantcagtgacttcaccgagcccgaggagctgntggacaaagagctggacacgcgggtcataggaagcattgccaccattncaagcagcgagagcacaaaggagatccccaactgcactagtgtttaa

SEQ ID NO: 1946 - DNA, 190 bp, Mus musculus
  misc_feature (58)..(58): n is a, c, g, or t
  misc_feature (108)..(108): n is a, c, g, or t
  misc_feature (122)..(122): n is a, c, g, or t
  misc_feature (163)..(163): n is a, c, g, or t
tgcacacctggactctgtgtccgcactgcttattgttggcttccacagccaaccttgntgatccagccaaacactgagggacatctgcatcctgtcagctccatgatnccttgacattcaantcctcacttccatgccaagaataagaatctgaagggggggnggtgttgaagcgatgactgctcttcca

SEQ ID NO: 1947 - DNA, 505 bp, Mus musculus
  misc_feature (185)..(185): n is a, c, g, or t
tccccaggatgtgctcaccaaggatgacaaaggggagggctacctccgtgatcttccgcccttagaggcctggcgggcttaggtggggatgtttcaggtctgctcggtgttgctccccaggtccttcttctcatcccgtctctagtgtgagcctgctaccatttccatgcctcctcaaggatggnagacgtcttctctgcatctctggggtaacctggcatttgaattccaggccagactttgcctccgacagctgttggactccctaacctcctgcaggtcgactagatggcttcccagttatcccgcaaatgtcccttcatgcacccaatatagaagctaggctaaccagggaacctctctgcctttctctgcctccttccatctgtgcagctggggaagtcacctcagaggacaggaagtaggaccagtgtcacactaagtaggaccagtgtcacacttggcaaattctatctggaacctggtggattgttggtgttacctt

SEQ ID NO: 1948 - DNA, 438 bp, Mus musculus
  misc_feature (406)..(406): n is a, c, g, or t
aacatgagcctcctcataatccacaacccagaacctgaggacgatgagagcaatgacctgatgttactacgcctcagcgagccagctgacatcacagatgctgtgaagcccatcgccctgcccactgaggagcccaagctggggagcacatgcctagtctcaggctggggcagcattacacccacgaaattccaaaccccagatgatctccagtgtgtgtccatcaagctcctgcctaatgaggtctgtgtcaaaaaccacaatcaaaaggtgacagatgtcatgttgtgtgcaggagagatgggtggaggcaaagatacttgcaagggtgactcaggaggcccactgatctgtgatggtgttctccatggtatcacagcatggggccctatcccatgtggcaaancccaatacgccgggagtctacacaaaacttat

SEQ ID NO: 1949 - DNA, 453 bp, Mus musculus
  misc_feature (102)..(102): n is a, c, g, or t
  misc_feature (130)..(130): n is a, c, g, or t
  misc_feature (164)..(164): n is a, c, g, or t
  misc_feature (183)..(183): n is a, c, g, or t
  misc_feature (213)..(213): n is a, c, g, or t
  misc_feature (320)..(320): n is a, c, g, or t
  misc_feature (325)..(325): n is a, c, g, or t
  misc_feature (375)..(375): n is a, c, g, or t
  misc_feature (401)..(401): n is a, c, g, or t
ggagaagttactgggcttttccaatgctttatataatacgcacacacacatatgtatgtaggtatgtatatgtatatatgtatatacattccaatttagggnacactgcaagaattattaggaattcccnttgccacccatctagatgaacagggatgcatgtnatatatttggtactttcanccatccgggattctgttggagacagttatnccccttaattttaaatatatccctgtgtttactgaataggactttgacctgttttcttccggtgctgggtgttgaacccagggctacctcctgagctacagcccaanccctntcccaactttcttcaagacatgattaaaattaggaaatgcaccttggagnaaatactgtaaactaaatcatactgnccaaattgtccctgtggtgtctgtagctagctatggatcttacctgggtcac

SEQ ID NO: 1950 - DNA, 507 bp, Mus musculus
  misc_feature (382)..(382): n is a, c, g, or t
accagtgcctataggtatcataccccaactgactcttggggccgggccttcaccccagcctttgatcacacttcccccacacacacaacccctcactcccctgcagccaccttagtcacctttgggcacttatccccagctttacactccttgcacgctgtaaccaaggtggctctggtcctggggtaccattacaacttgcaggaaacttccagaaccagcttgggtaacaacagtccctgtggctgtatcccacttgctgtggcttcagtggtgttagttagtggtacccaccccaccaaactctggggcaccctgggggtttgggcgtgggtttgcagagggtgctatccctaaagaccagcctggctcccaccctaanccccagcaggggccctagcaatgttttcttgttgtacaagaaccaggtccaagtgttgcctcctcttccttccggaagctgaactgctcctttattttttagagctgctgattgtgaatctcaaa

SEQ ID NO: 1951 - DNA, 476 bp, Mus musculus
gatggcaaacttttttattatgaaccttttattatgaaatgtgttcctcatagaacatacaataaaaattaagctaaaaagatatttaaaagccatacagttttactactgataattatgtcaccatttttacagatctctttatagctttatgtgtatgtgtatatttataaaattcattgtcattcaagtttttttccttttagctattctttatatgttcttgtgtcagtggagaagaaatgtagtctggaagtaaatattagctttagtatgcacacttgagttttttggttgctcagaaactaactgtaaatgagtcttgaaagtgtctgttggatttaatcaacaaaaacagttgtcattttctgactaaggagcttattgtagaagtgaagaaaatcattaggaacagagaaagctgatgtaagtattctagtttctttctttccaatccttctgtccccattcttaat

SEQ ID NO: 1952 - DNA, 400 bp, Mus musculus
  misc_feature (358)..(358): n is a, c, g, or t
gaaaaccaagttactgctcctcacgtccggagatggttctccgagctgcatgaagaggaggtggaagtcagcctccctcgatttaaaatagaacaaaaattagacctcaaagaagcattatattctttaaatgtaactgaaatatttagtggtggctgtgacctttctggaataacagactcatctgaagtctatgtctccagagtcatgcagaaagttttctttgagataaatgaagatggaagcgaagctgcagcatccacaggcataaacattcctgcgatcatgagtttgactcagactcaatttctagcaaatcatccatttctgtttattttgaagcacatccgaacagaantcaattttgtttatgggaaaggtgacagatcctgacattcaa

SEQ ID NO: 1953 - DNA, 356 bp, Mus musculus
  misc_feature (122)..(122): n is a, c, g, or t
  misc_feature (124)..(126): n is a, c, g, or t
  misc_feature (136)..(136): n is a, c, g, or t
  misc_feature (248)..(250): n is a, c, g, or t
atcgcaccattgtctcagagcgtgacgtctatctgacctatatgctgcggcaggccgcacggcgccttgagcttccccgcgcctctgatgctgagcccaggaagtgtgtcccgtctgtggtntnnngggcgtcgtnggcatggggcatgtgcctggcattgagaagaactggagtaccgacctcaacatccaggagatcatgacagtccccccaccgtccatctcaggcagagtgtcccgggtggctnnngaaggcggccttctttggtctcctgggctatagcctgtactggatgggccgtcggaccctgaacctggtcctgtcactgcctgctgcacagttctgcctccagagg

SEQ ID NO: 1954 - DNA, 454 bp, Mus musculus
  misc_feature (321)..(321): n is a, c, g, or t
  misc_feature (403)..(403): n is a, c, g, or t
  misc_feature (408)..(408): n is a, c, g, or t
atgcccagttcacttgtcctgtggggtgtcatctttactcctgccttctcctgcccgggaaaaataaccctttagaaccagaatgctcttgtcagcctccctcgacagtcactgtgagtgtagacagaagagctcctgccatgagctgggacctggagtccccacagggtcacctgccaggctccaagcaagcagcctttgtggaacatacaacacactcagccaatcacaggtcagacagggctgtcaccccaataaagagacacctgggttaccaggtaacctgaggtgccccagagaaacacagtgccagtcccaggntaagtccctagactacacaggccacagctctgagctgaaagtgagagacaccttagctggtggaggctttatttctgtattngtttnccacccacggtcactttacctctgagaaacattgagggtgacccca

SEQ ID NO: 1955 - DNA, 405 bp, Mus musculus
  misc_feature (29)..(29): n is a, c, g, or t
  misc_feature (33)..(33): n is a, c, g, or t
  misc_feature (38)..(38): n is a, c, g, or t
  misc_feature (41)..(41): n is a, c, g, or t
  misc_feature (47)..(47): n is a, c, g, or t
  misc_feature (59)..(59): n is a, c, g, or t
  misc_feature (66)..(66): n is a, c, g, or t
  misc_feature (68)..(71): n is a, c, g, or t
  misc_feature (74)..(74): n is a, c, g, or t
  misc_feature (76)..(76): n is a, c, g, or t
  misc_feature (80)..(80): n is a, c, g, or t
  misc_feature (82)..(84): n is a, c, g, or t
  misc_feature (89)..(90): n is a, c, g, or t
  misc_feature (158)..(158): n is a, c, g, or t
  misc_feature (165)..(165): n is a, c, g, or t
  misc_feature (169)..(170): n is a, c, g, or t
  misc_feature (198)..(198): n is a, c, g, or t
  misc_feature (218)..(218): n is a, c, g, or t
  misc_feature (221)..(221): n is a, c, g, or t
  misc_feature (225)..(225): n is a, c, g, or t
  misc_feature (227)..(227): n is a, c, g, or t
  misc_feature (229)..(229): n is a, c, g, or t
  misc_feature (232)..(232): n is a, c, g, or t
  misc_feature (234)..(234): n is a, c, g, or t
  misc_feature (236)..(236): n is a, c, g, or t
  misc_feature (243)..(244): n is a, c, g, or t
  misc_feature (246)..(246): n is a, c, g, or t
  misc_feature (251)..(251): n is a, c, g, or t
  misc_feature (267)..(268): n is a, c, g, or t
  misc_feature (270)..(270): n is a, c, g, or t
  misc_feature (280)..(281): n is a, c, g, or t
  misc_feature (292)..(292): n is a, c, g, or t
  misc_feature (298)..(299): n is a, c, g, or t
  misc_feature (308)..(308): n is a, c, g, or t
  misc_feature (312)..(313): n is a, c, g, or t
  misc_feature (349)..(350): n is a, c, g, or t
  misc_feature (371)..(371): n is a, c, g, or t
cagcaccgattggtcagcaaaagcttccntcancctgnctncaacangagcctccatanaaaccanannnnacntnctgngnnngactnnagcaatgacctgatgctgctccgcctcagcaagcctgctgacatcacagatgttgtgaagcccatcgncctgccnactnnggagcccaagctggggagcacatgcctngcctcaggctggggcagcantanaccntntnaantntnccaaaanncnaaaangatctccagtgtgtgnncntcaagctccnncctaatgaggnctgtgnnaaagcccanatanngaaggtgacagatgtcatgctgtgtgcaggagagannaatggaggcaaagacacttgnaagggagactcaggaggcccactgatctgtgatg

SEQ ID NO: 1956 - DNA, 518 bp, Mus musculus
  misc_feature (104)..(104): n is a, c, g, or t
  misc_feature (106)..(106): n is a, c, g, or t
gggaattccagggttagtccattgatagccgtgtgtgtgtgtgtgtgtgtgtgtgtgtgtgtgtgtgtgtgtgtgtgtgtgtgtagattaagcactgcagacancntgcaggactctgtttccatggcttcttccatcataagtcgggtagaaccatgttcactgcttcacagctctaacccatgtgttgtcttatggctccattatatatttactatagctttggtgtatgctatgttttctttttaaatgactaatgttaaaagttagtttttcagcagttagccatcctctcattacatcttattcttgccggtatggtttgagagtgtagcttgattgttagactttcattgtctgctcagtctattcacacacatctccactgtcaacaagtgggacagctgtcaacaaatcttcatggatctgaagagaatttctgtgaagttgaatgcaagtgtactgtcattcacagtgtttataaaacaccaggaaccttcacttttgctaccttgata

SEQ ID NO: 1957 - DNA, 574 bp, Mus musculus
tgacacttcctagcaaacttctcttcctcaaagactgaaaggctttgctaaagacttcttcgtgatgtcacatccctgccatggagtagaagtcaaactcagtcagctgactccgtgctcccacagaggactttgccccagctactcatgtgagttgcatatacagagccctagtccagacgccagaggatgatctaaatggagaaatcagaaaacagccttaaccaacttgaggtgggacctgggacatgccctccctcgggtagattcgttgcttcccggatctcattttacttcacatttcttatggcacagagaacagacaaccctcccaaagtcttcaaatatgaaatgctattgtcaagattggcaggtggtgacttcctttgtaatactaaaatactaaaatactcagacaatggaggatgggttagacccaatgcatggcaaaaccaaaggcctgggtgcaccgttgtgtatgctgcgggagctttttatttctgacggtttgatgtggctgtagaaagtcagccactgagtagctgttgtgttatcgcccttctgttgtaaacat

SEQ ID NO: 1958 - DNA, 328 bp, Mus musculus
  misc_feature (54)..(54): n is a, c, g, or t
  misc_feature (57)..(58): n is a, c, g, or t
  misc_feature (147)..(147): n is a, c, g, or t
tctgtggttttcctgtgccatccacctcaggcctccttggatggcagcagtttngcnnccatctttacttcccacagaaagtacttgaagaaaatatctcttaaaatagcatacactacctaaggctggacgggacagtctaggttngttcttcatgtagcagacttgccccttgctgtccttttacgaacggtcactacagcagatgcccttcccgagacttttaccctctgtttccagcctgcggcgtctactgcgagaactcagttctcgctgctgctttcctagatgatctcaagcgctttgctctgttctcttacctagagtc

SEQ ID NO: 1959 - DNA, 507 bp, Mus musculus
gcctgcttccttataaaacccgagatcaccagcccacagatggcaccacccacaatgggctgggtccttccccattaatcattaagaaaatgccctacaggtttgcctacagctggattgtacagaggcattttcttaattgagattccttcatttcagatgactgtcaagttgacataaaattagaacagttattatgcaagtcgctagtgtttgtaaagcatgtagcacatgcctgtttcgtaggcctctagagttagtgtctcttctgatccttaggtaactgccaccctgtggattctacttccttccctcttaggatttacatatagtctgtaaagcactcttgagtctcactaatgagaagaaaatgcatgatagactttatattgtttttagcaggagctaaaaaatacattttgaagaagcagcatagcagaggcagaaacatagcacccaagtctgaaacaattggcaccagtcttcccttctgcagtttgttcaata

SEQ ID NO: 1960 - DNA, 554 bp, Mus musculus
  misc_feature (40)..(41): n is a, c, g, or t
  misc_feature (48)..(50): n is a, c, g, or t
  misc_feature (445)..(445): n is a, c, g, or t
tgccaatctcattcaggactcagtgactggtttttttttnnttgtttnnntgttttgttttgttttgtttttcttaatcacaagggcgtgggtcagcctcccctaggacttcatgtctgtatatttccccattcactgctctgactatctgagatcggctgagatgaccgaggtgatgatgaacgctccatccatggaagagattggtctcagcccccgcaaggatggcctttcctatcagatctttccggacccatcagactttgaccgttgctgcaagctgaaggaccgcctgccctccatagtggtggaacccactgaaggggaggtggaaagcggggagctccggtggcctcctgaggaattcctggtccaggaggatgagcaagacaactgtgaagagacaacaaatgaaaagaaggaccagtagagtccacgcaggctngcctgggtcatgccagccagcacacctgaactgtttttcccatggtgatggaagaagagaatgagccacagtcattgtgaaaatgtcaaacgaggcttccgttttgcac

SEQ ID NO: 1961 - DNA, 444 bp, Mus musculus
gcacttctctgaagggctgggaccagggatttgttatggcgtgatctgatcctttgagcggtttctggccttggatggtactgggaacagagcgccttctccccgggatgcagcccaggggcctctgagggggtgtctgctcacctgctgcagctttagtgccttagtctgtgcatggtgcagcctcactggacacagactggaccttagagcattttagaggttgccacatgttccctgcgacactatgtcccgctgaactctggaccagcatgcatcacagtccgggctgtgccctggcctgtcagtgaaggcctcttgcttgtcaccatcccggtgggctatgagtgagcgcctgccaggggtcctgtggacgccagtgtatgctgctcactgcatgttttagaaacaaaagccgcaggcctgacgaatctgcaagcatca

SEQ ID NO: 1962 - DNA, 524 bp, Mus musculus
  misc_feature (148)..(149): n is a, c, g, or t
gggcgttactactttatattacatgctactaaacagtcccctcccctcaactcttctggcaggtgttggaagagaaatgcttagttcaatcatattaggggggattatgaagaagctttaaaatcctaagcctggtatgcagtgtgannagtgttcagagagcttgttcatgagagctggttatcatagacaatttgaaagaaacccaaaaaacagcttccctgacagaagatgccagtgatcaacatcgaagacctgacagaaaaggacaagttgaagatggaggtagaccagcttaagaaggaagtgacactggagagaatgatggtttccaaatgttgtgaagaagtgagagattatattgaagaaaggtctggagaagaccctctagtgaaggggattccagaagacaaaaaccccttcaaggaactcaaaggaggctgtgtgatttcataggcgggaaggcattttcttagaatatttagaattttaatgataatgcaaactgttctcctatataatta

SEQ ID NO: 1963 - DNA, 360 bp, Mus musculus
  misc_feature (82)..(82): n is a, c, g, or t
  misc_feature (107)..(107): n is a, c, g, or t
  misc_feature (111)..(111): n is a, c, g, or t
  misc_feature (163)..(163): n is a, c, g, or t
  misc_feature (175)..(175): n is a, c, g, or t
  misc_feature (186)..(187): n is a, c, g, or t
  misc_feature (196)..(196): n is a, c, g, or t
  misc_feature (211)..(211): n is a, c, g, or t
  misc_feature (213)..(214): n is a, c, g, or t
  misc_feature (233)..(233): n is a, c, g, or t
  misc_feature (235)..(235): n is a, c, g, or t
  misc_feature (240)..(240): n is a, c, g, or t
ggactacctgagatcctaccgcagattgaattctgccatgaagaagggcacagaggtcttccagagtgagagtcagaggaanccacaagtgtccccaggagatgtgnaaanctacaaagacaaagatacagaggagccagaccaaccctccccaagcttgctnagggagaaaggnctggatcttgnnacctgtgantggtggagactgccntnnccaggatcctgtttctgananttccnaggcacctaggctgctgggcatggcttcaaagggcttttggccagaagaagaagtgagaaaggcactaagaactgtgtttggagcccatgaaccctgatgcctgctaagactagcaatta

SEQ ID NO: 1964 - DNA, 378 bp, Mus musculus
agcactggcatcactgtgtacacagtgaggtcctttagtcttcagttcaggactaggctgtctcaactctagaatgtcaagtcagtgacacatgaggaggtatcagtctctggccatgccaccccatgcaggaaggctcctccactgtataatcctcctcaggctaaacccagtggcttcttaggagacgatgtctgcaggtgccatgtcattgccgtacgtggcgtctcttccacctgtcgtctgatcagctctctagaaaggcgacagcacactgctgtcctgactacagggctcccagttctcatcgggcaagtctttgtcaagctggcagccctggcatccagtcttcctgtccaggttgttcagtgccaccag

SEQ ID NO: 1965 - DNA, 565 bp, Mus musculus
  misc_feature (91)..(91): n is a, c, g, or t
  misc_feature (142)..(142): n is a, c, g, or t
  misc_feature (153)..(153): n is a, c, g, or t
  misc_feature (188)..(189): n is a, c, g, or t
  misc_feature (209)..(209): n is a, c, g, or t
  misc_feature (239)..(239): n is a, c, g, or t
  misc_feature (249)..(249): n is a, c, g, or t
  misc_feature (254)..(254): n is a, c, g, or t
  misc_feature (342)..(342): n is a, c, g, or t
cgcccaacctgtgaagcaaatgatttcttatttagttgagtaaacagagatatgcctttagaggcatttgctgtgttgttttatagcatgngtgtcatttgtgttaataatctaaaggatatatttccaacttgtaaagggnagtcactatgnaaaagaacatcagttctcatcaagctataaaaccnngaagaggttgaaacttattntaggcaataaaatcagttcctgcccagggnattccatggntaggnagtgaatggatggctacttttgaacaagcttcaaaggaggcagcaagggaagaaactgtgaggttttgtttttgttttttaacctggnaagccattggcaagtccaggatgagaagtaaaagtctcccgagtctcagtgttggatggtgggagttcagtggtatgctgcagaggttctctgtacaggaagtggacttctgcagacagaagggggatatctcattcctgagttcaattcactggtctttattttttcctaacaatatttttattgactatttagaaatttctcatgatgaaccccaagcacc

SEQ ID NO: 1966 - DNA, 513 bp, Mus musculus
gataagtgcagcaccaccactcaaagtgacatcaacttgaaggatgaactgctgagttctacatctatagagtgtaggccaggcaatgatcttctggaatccctccacaaggaacagaacagatggtacagtgaaaccaagactttttcagattcctcacagcacacaggcagaggttttgaaaaatattggttctgttatggtataaaatgttattatttcgtcatggacagaaaaacgtggagtggatgtaaacagacctgccagatttccagcttatcccttctgaagatagacaatgaggatgaactgaagttccttaagctcctggttccttcagacagttgctggattggattgtcatatgataataagaagaaagattgggcatggattaacaatggcccatctaaacttgccttgaacacaatgaaatataatataagagatggaggatgtatgttgttatctaaaacaagactagacaatgataactgtgataaatcattcatc

SEQ ID NO: 1967 - DNA, 532 bp, Mus musculus
  misc_feature (285)..(285): n is a, c, g, or t
  misc_feature (350)..(350): n is a, c, g, or t
  misc_feature (371)..(371): n is a, c, g, or t
  misc_feature (390)..(390): n is a, c, g, or t
  misc_feature (419)..(419): n is a, c, g, or t
  misc_feature (461)..(470): n is a, c, g, or t
  misc_feature (472)..(475): n is a, c, g, or t
gcttttcaggcgagctgtgtgagcaagagtccgagtgccggggggaccctgtccgggactttcaccgggtccagaggggctatgccatctgccagaccacacgcccgctgtcgtgggtggaatgccggggcgcgtgcccgggccagggctgctgccagggcctgcggctgaagcggaggaagctcaccttcgagtgcagcgatgggacttcgtttgctgaggaggtggagaagcccaccaagtgtggctgtgcccagtgcgcataatgtgcgggtggcacactanccgggctggggcgggcatcaccaggatagcgcctggatcctggtgggcacggggtcactgagctnccttcccagcggactgcactnccggggcagaggagcaagncccgggctgccatgccctctctcaaagtnccttgcacagataggcgcttaataaatatttgttgaatgaannnnnnnnnnannnnaggccacaaacggtggcaggatggtggactcctctgcctgctacctggaactaaaat

SEQ ID NO: 1968 - DNA, 413 bp, Mus musculus
  misc_feature (29)..(29): n is a, c, g, or t
gatcaacaatgtctattcctgcctgctgnaacacagtttccagaaactaagaagttcttgctactgaagaaaataacatctgctaaaatgcccctactaagtcaaggtctactggcgtaattacctgttacttatttactacttgccttcaacatagctttctccctggcttcctttcttcttagacaacctaaagtatctatctagtctgccaattctggggccattgagaaatcctgggtttggctaagaatatactacatgcacctcaagaaatctagcttctgggcttcacccagaacaattttcttcctagggccttcacaactcttctccaaacagcagagaaattccatagcagtagaggttctttatcatgcctccagacagcgtgagtctcagtcctacaaact

SEQ ID NO: 1969 - DNA, 503 bp, Mus musculus
  misc_feature (109)..(109): n is a, c, g, or t
  misc_feature (352)..(352): n is a, c, g, or t
ggtctggtctggtgatcattgtcgctgtggtctgtgcctccctggtgtttctgactgtcctggtcatcatttgctacaaagccataaagaggaaaccactgagaaaggntgagaatggcaccagtgtcgctgagtaccccatgagctcctcacagagccacaaaggggtggatgtgaacgctgcagtggtgtgaacctgcaggccctgggacccactggccagaagggcaccgtggtgacactggtggacatggatggcaggtggacatgagctgaccgtgggcctgtccaggacttcgtgcttcgcgggcttcgagcctcctgaaagagaaagcatcctcttcccaggctnagccctggtcacccccgaggggtgcaacaccgacaccaggcttgagccaggctcccctgcatgtggcccctgagcagcaccaccacccagggatctccatactctccttgtctcgcattgggcgcactgactgtcaccagttgctactgaa

SEQ ID NO: 1970 - DNA, 396 bp, Mus musculus
  misc_feature (210)..(210): n is a, c, g, or t
  misc_feature (215)..(216): n is a, c, g, or t
  misc_feature (219)..(219): n is a, c, g, or t
  misc_feature (224)..(224): n is a, c, g, or t
  misc_feature (241)..(241): n is a, c, g, or t
  misc_feature (244)..(245): n is a, c, g, or t
  misc_feature (264)..(264): n is a, c, g, or t
  misc_feature (312)..(312): n is a, c, g, or t
  misc_feature (317)..(317): n is a, c, g, or t
  misc_feature (362)..(362): n is a, c, g, or t
agctttgcagaaacccgctcttatgtaatgcaagacaaagtgacaatatgacactgctctctggctctggctctgctcaagtagccctggactcctctgcatcttagcaggatgcttcatcttccgggcatcgcagaagaaattggcaagagtggggaaacttgggggcttggcaggccttgctctgtaggcatcagctacaagtttcantttgnnagncttcntctgagggtgagtaggntgnntcagtgggtaaaggcactntccaccatccctgacaatttgactttgttccctgggacacaaggaganccaantcccacagcctgccctctgaacagtcacacatcacatcatggctntcatacacctcatttccccagacacaaaaacaga

SEQ ID NO: 1971 - DNA, 516 bp, Mus musculus
aatagttctgtcagggcttgtgccatagttcaggagcagggcgtgtgcctagcatccatgggcaccacattcgttctcaagatccacagtagcagaaagtgacagggaggattgctgcattctttagtacgttgtttggactgctgttaagatctgactcagtgtgtgccttacccattactggtcgacatgtgggcttcccaggtgcatcacaggtgagccaaccacagggtttggggttgcagctggcagctaggctgcaggcgctgccctgggtacaccactcacctgaggggcacagctggccggaagggtaatcaggaagtgtggctccttttccacttggcatattacatatggggctccctcctgcatctagagatgggaaactgcctgaagaacttactctggtttaccatttgagagagtgcagtcatttatgtcagagaagacacctcgcatctcactactcatgaagcaccgtctcttctgtggattcacggctcagcttgtaaa

SEQ ID NO: 1972 - DNA, 559 bp, Mus musculus
gatcgttctccttgactttttcttaagtggggtgcttatcattttgtctattttgaggggttccattttagagtgtaacttctgaattatgggaaaccgttatgtataccaactcaaaggtggcatctgtcaaaactgggttcggagtctccgcaaggttgctgggcatatctgccaccttctaacactctactagaagctctgatcttcaggctccattgccacttctgctatcggattgtgtagaaactgactccggccacttggagcatgagacctcaggcttgtagtaagatggtcatctccaagtggatagggtcactgtctgatcatggcaaggcttgcagttatgataaatattgttctcatcatcacctttattacagcatgatgcttctgggttagggcactcggaccttcctgaaactcaacacaatcatagttataaaagctgagtgcctgaggtcacaggatgagagcgaactcgggggcttctagcgtctgctcttctgcaattcctgtctttcatgtccttctccccagactcttgtatttacaa

SEQ ID NO: 1973 - DNA, 381 bp, Mus musculus
tgtatctaaagctgcttctccaccatttctccatcttagcatgactgcctgagctcgggtattcaaaaattgtcagtttctgagtccttggctttttctccagatacctcacacatgtcttctgttagcgatatttagcagtaccttgaaaaaaatgtaaggaccatgctagaaaacggacaacaaaagtaataattactgctagtcaggacttttcctcttctgaagaatccatcagaagagtactgtaaggctagtgtacagtgcaaggcgaaagttgatcaactcaagcctcctcatccctgtgctctggacggtgagacaaggttgaagcattcctggccaattgaagctacataataggacctaggaccccatctc

SEQ ID NO: 1974 - DNA, 501 bp, Mus musculus
cttgctctctctggatctgatcgagccgctcttgcagttgttgccactatcaaatgcagtatgcatgttggtgctcacagttctgtgcaatgtcgtagagaagggtccagcttactgccagcggttgtggccaggacccctgctctcctgcgtgcttaacacactggctctctctgacaccgaagtagtaggccagagtttggagctgctgcagctgctattcttgcatcagccagaggctgcccgagccttcctgcagcagtcagggctgcaggccctagaaaagctccaggaggaaactcagcttcaggagaggatacacgcgctccagcagatagctgctacccatggatgacctggctgctcaatatcaccctttaccccgcggcgtatttaccctagggtctcctacttcactttagaagctggtagctttttgttatacctgagtgtggtgttgcacttgagattgtcttagttcatgctcttcagcaacttggc

SEQ ID NO: 1975 - DNA, 372 bp, Mus musculus
  misc_feature (26)..(26): n is a, c, g, or t
  misc_feature (39)..(39): n is a, c, g, or t
  misc_feature (41)..(41): n is a, c, g, or t
  misc_feature (89)..(89): n is a, c, g, or t
  misc_feature (154)..(154): n is a, c, g, or t
  misc_feature (225)..(225): n is a, c, g, or t
  misc_feature (322)..(322): n is a, c, g, or t
tggagagcactctggagcccagccangacctctagaggngnatgggtggcctctcaggagtctgacagcgccgatgccagcccgtcacngtagggaggaccttgccttctcttctagagcttggcagcccgtcctccccagcctccagcagtgnagcggttaaccgagggcataggtgccaacgcaaggtcacagggatgactgaacacagctcagccgcttctntacaagcattccctgagcgccctgtggcctcagccatccaaaggtgggctccagtaagcacaagtccacccccctggggaaagccactgcctggganttgagattggaaactgactcgtctctggaggagttaagctggcaagccca

SEQ ID NO: 1976 - DNA, 472 bp, Mus musculus
  misc_feature (193)..(193): n is a, c, g, or t
  misc_feature (214)..(214): n is a, c, g, or t
  misc_feature (216)..(216): n is a, c, g, or t
  misc_feature (218)..(218): n is a, c, g, or t
  misc_feature (231)..(231): n is a, c, g, or t
  misc_feature (261)..(261): n is a, c, g, or t
  misc_feature (269)..(270): n is a, c, g, or t
  misc_feature (272)..(272): n is a, c, g, or t
  misc_feature (387)..(387): n is a, c, g, or t
  misc_feature (389)..(389): n is a, c, g, or t
  misc_feature (405)..(405): n is a, c, g, or t
  misc_feature (417)..(418): n is a, c, g, or t
  misc_feature (421)..(421): n is a, c, g, or t
  misc_feature (434)..(434): n is a, c, g, or t
cgagaccccagcaaaagtaccatttgagaccccagcaaaggctaattctggcttacgatctatggctctgcaccccaggtgtggttcccaccagaaagagatcatgatgtgccagccagggatcctgcgacccagatcttctctccagagacagttgtgaccttctgacaagcactggcctgttgtcagctcncttacaactcatgcctcctgnantntcctctgagtgcnaaggtccacaccagacatcaaaagcatagntcatcatnngnctccggcaccccacaccactgttgtgctgggcttcccatcccacctcagaaccagtgttatatctctctgtacattgttccctccacttcaaatgccaagccaggcagccccttntntcccgagccctgaacncacctgcagacnntcntccccaaaataangtgtgtccagaaagaattttccaaacatcagtccatcc

SEQ ID NO: 1977 - DNA, 53 bp, Mus musculus
agggcagtggcctcatcagtctgccagggagacaagtacacaccttgactctc

SEQ ID NO: 1978 - DNA, 531 bp, Mus musculus
agggcagtgtggttcccatgaaactggggtttacaggtggttatgaactgcccgcagaggtgctgagaagagaattaagcacctgccctaactgctaagcctccagccctgcaccccgcacccccacacccagcctttgatgtaggagctagggaaggaactcaggtcttcacactggcatggccagcgtctagtggacggagccacctccccattcctaactcatggcaatgcctttgagaagcccaggtccctgttctcagcgtctctcactgtcttcccaagtagcttgcttctctcttaatcctagggcgtaaaatctgtattcaaatctcttagacttgagctttgcttcagagaagtattttaattcaggggctgacggcatggctgagtggttaagagcacttgctgccagcactcacatgatagctcatgaccatctgtaatccagttccagggcattcagagcccacttctgacctccacaggtaccaggcactcttgtggtacacatgtgtgccggcaaaa

SEQ ID NO: 1979 - DNA, 513 bp, Mus musculus
gtcatcagcaacatggcagagcctttcagtgctactgaccccaaggccattggccatcgaaactaccacgcaggctactccatgtttggggctggcctcacagtcggtctgtccaacctgttctgtggagtctgcgtgggcatcgtgggcagtggggctgccctggctgacgcacagaaccccagcctctttgtaaaaattctcatcgtggagatctttggcagtgccattggcctctttggggtcatcgtcgcaatccttcagacctccagagtgaagatgggtgactagatgacctgtatgggtggggccgtgccccactgttatttattgctggttttcctgggatggctggagctgtgtcccttagcctttctggggcttggtgttcagggccctcctgcactcacctcttgctgcctgttgactttggaggcattgcagtccagactgaatcccagtgtgggaagtgggctactgatggtgactgtgtacagctgtgcgcccatgccc

SEQ ID NO: 1980 - DNA, 573 bp, Mus musculus
gcagtcagttctattgtgaattccatccaggttcttgcttcaaagtctgccatcttggaagccacacccaaggaggtgcctatggtggctgtgcctccagtgggctctaaggccagttctcctgccaccagcagccaggccaaaaaagtggatgcagctgccaatcagggtaaaaagtcagagatggctcctgcccagggtcaaaaggcaagcatggtccagagccaggaggcaccaaagcaagacgcacctgcaaagaagaagtctggttccaggaaaaaaggagagcctgtgtgctgatattttattcttcaaaagttggaagcaaccctgaagaaggcattggctcttgtggctgtggcagcgcccctgacgttggaaacacctgtatgaaggccttcgatatcattctccttggtgcaaggccacatgggacacaaatcctaatgagatgttgcagtagataatttctcattaaaattcttatttaatggccttttgaaattactgtaggggcataaaattgggtcttgatatattttattaaatgctgtatcccttattcccaaaaga

SEQ ID NO: 1981 - DNA, 470 bp, Mus musculus
  misc_feature (284)..(284): n is a, c, g, or t
  misc_feature (289)..(289): n is a, c, g, or t
  misc_feature (314)..(314): n is a, c, g, or t
  misc_feature (337)..(337): n is a, c, g, or t
  misc_feature (344)..(344): n is a, c, g, or t
  misc_feature (413)..(413): n is a, c, g, or t
  misc_feature (422)..(422): n is a, c, g, or t
gttttggagcctgtttgactttgtaatctctgcctgtgattttcttttctaaatgacgactccgtgtaaccacctggactaagttgagaaggaaactgccaaatgctttgggtttttagggttttaataggtagactctgttctattattaggtgttaagagtttccaaacgtgttttcttttttcttttattgtttgcttaaactttgaagaaatatgtgcctcagcttagatgttttgtcttcccctttctgcacttaaatacctgacagcctgttcgatcnctgtncctccgagggcgcttctagctcatncgtagatttgtgatgtcatagtncaaactncagtgaccggtaaaatgacctgacatgtaaccgttttcagggaatgcagagggtgttaactaatagacnaaacctttntcccgcgtgctttgcttcaccttgtgctatatagctctttggctcgtg

SEQ ID NO: 1982 - DNA, 385 bp, Mus musculus
tggtccggtgcatccgttttgataacaagaggattgtcagtggcgcctatgatgggaagattaaagtctgggacttgcaggctgctcttgaccctcgggccccagcaagcacattgtgtctgcgcaccttggtggaacactctggacgtgtgtttcggctgcagtttgatgagtttcagatcatcagcagctcccatgatgacactattttgatttgggatttcttaaatgtgcctcccagtgcccagaatgagacccgctctccctccagaacctacacctatatctccagatagcagcctgcactttggcccaatctgggtttcctggtcttgaactactggctatatggctatcacatgcctaagggagttcgttcacagct

SEQ ID NO: 1983 - DNA, 140 bp, Mus musculus
attatgatttcatctgtgttacacctttaccatataatgcttctgagagctgggaaagaaccagagctcatttattgggcatttggaatgacaatgaaatttcatataacatacaagaattaaccaacctgatcagtgat

SEQ ID NO: 1984 - DNA, 567 bp, Mus musculus
aagtctccaggcttgtaagtgttcagcgagacggtggatactgagatgtgctagcagcaggctcacactgtaaactgttcagctcatgtttgaaactgtattctattttgggggaagggcttgtgtcctgactgagtgtagaggtcagaggactgcttcagcagtgagtgctcccctccctcagggggtcctggggaccaagtgaacggagaagggcaggcatggtggcccgcatggctactgagctgtctcactgccctcagttaatcttctccctccagagtcttactttatttatgtgtagtgcattttgcctgtaagtgtgtctgtgcactgcctgcattccttgtgcctgcagaggccagagaaggggctcatatcttctcaattcatttttaagatcagaatcatatagcaacgtgagtgcaatcacccctttaaagattaacctcatcctgacgtgtgtgtacatgtgcgacctcagcaccgggaggtagaggcaggaggaccagagtttcagggttatctatgactgatgtagtaagtttcagaccagcctaggccact

SEQ ID NO: 1985 - DNA, 345 bp, Mus musculus
atgggctctgttctttgtgatgctcacagctgcttgtagtcatcattccagtgaggagtaagaagaattttatgtgtgtctctacctgtgagactgcagaatctcaatcctccagctgtcaccaggtcaccaaccaggcacctgccagcctctgacctgggaaatacaaactctgtgacttctcctcaactgatgttctctgcctactgaaggtcactcagaagccatctcgctgtgattctttaacccgatcctcgactttgctgggccaccctcacagctgggatgaaaagagctggttcagaggaagccctgaacatgtacacatccatgactatgcacgag

SEQ ID NO: 1986 - DNA, 576 bp, Mus musculus
gaagctaaccagcattctagatcctccatctctcttttccaagtgctggcttacaagcatgctactgctcttacagaaaatagacaggcttaagggacttttgtcccttaagtgtgagagaggtcgtgtatgtgtgtgcatgggtgtgaagacagtttatttgctgttgctcagtaagtgtgagggccttcatgtatgtgtgtgcacgggtgtgaagacagcttatgtgctgttgcttggtcagttgtcttgagttttggaaggtgttttgtattgtttttgagaacaagtctctcgctggttggaaccaattaggctggactggctggccagtgagccccagggatctgcctgtttctgcctcccctatgctggagttaagggcattatcatagccaacttctttatgtaggttctggaactaaaactcagatcgtcatgcttgcaaggcaagtgaacactttaccagcagagctgttgtcctagctctggctaattggaattatgtagaccaagctattctcaaatattggacagtcttcctacctctgagcacagattccatttggcctagga

SEQ ID NO: 1987 - DNA, 519 bp, Mus musculus
  misc_feature (139)..(145): n is a, c, g, or t
  misc_feature (363)..(363): n is a, c, g, or t
  misc_feature (464)..(464): n is a, c, g, or t
tgtacgccaccccaaattataaagtgacaggcccaagagagagagagagagagagagagagagagagagagagagagagcgagagcatctgtaaaatatcatcaagaatgaagatctccaagctggctgttgcaaaggnnnnnnnctcagactttgtaatataaggctgttcatctctcagaaccgccatcattacatttgaaatttctatgggggattatttaatgaaaaacatgctatgttttattttaagctgaaggcctattctggatagttctactttggggaaaaaaatgttatcatttaatttcctttctgtaagttaaaactaatgaagtgtggtcatgtcagagcagacagagntgttctgggcatgctgattggccctggggtagttacactgtttgggggtattcttgcgtatgcagacaggacactccttgtctcgagagacagcacagccntgaagcactgaagctgcattccccactggcctgacttggcctcacatgaaccaaa

SEQ ID NO: 1988 - DNA, 310 bp, Mus musculus
agtctggctgctgttttacggaggagttggcatttgcacaggtctctgggtttggggcagaagagtgatccagaccatggggaaggacctcacgcccatcacaccgtccagtggcttcactattgagctggcctctgccttcaccgtggtgattgcctccaacatcgggcttcctgtcagcaccacgcactgcaaggtgggctccgtggtagctgtgggctggatccgctcgcggaaggctgtggactggcgcctcttccggaacatttttgttgcctggttcgtgactgtgcccgtggctggactcttc

SEQ ID NO: 1989 - DNA, 509 bp, Mus musculus
  misc_feature (175)..(175): n is a, c, g, or t
  misc_feature (370)..(370): n is a, c, g, or t
gcagaagtacacatgccatgtggaacatgaggggctgcctgagcccctcaccctgagatggggcaaggaggagcctccttcatccaccaagactaacacagtaatcattgctgttccggttgtccttggagctgtggtcatccttggagctgtgatggcttttgtgatgaagagnaggagaaacacaggtggaaaaggaggggactatgctctggctccaggctcccagagctctgatatgtctctcccagattgtaaagtgtgaagacagctgcctggtgtggacttggtgacagacaatgtcttcacacatctcctgtgacatccagagacctcagttctctttagtcaagtgtctgatgttccctgngagtctgcgggctcaaagtgaagaactgtggagcccagtccacccctgcacaccaggaccctatccctgcactgccctgtgttcccttccacagccaaccttgctgctccagccaaacattggtggacatctgcagcct

SEQ ID NO: 1990 - DNA, 317 bp, Mus musculus
  misc_feature (87)..(87): n is a, c, g, or t
  misc_feature (155)..(155): n is a, c, g, or t
aagaccattatgcatgatccctttgccatgcggcctttttttggctataactttggacgctacctggaacactggttgagcatggangggacaaaaaggtgcccggctgcctcgtatcttccatgtcaattggttccggagagatgaagcaggcngcttcctgtggccaggctttggagagaatgctcgtgtgctagactggatctgccgaagattagaaggagaagacagtgcccaagagactcccattgggctagtaccaaaggaaggagccctggacctcagtggcctcagcgcagtggacaccagtcagctgt

SEQ ID NO: 1991 - DNA, 441 bp, Mus musculus
gtatctacctttgattggaagaacaaccctctcattgtcaacctcaacggtgagctgactgctgaggaacaggtggggattcgaagtagtttcctggcagctcgaacacaactcccagtcatggtcatcattaccccccaggaccgcagaagctctgtgtggacacaggatggaccctcagcccagatccttcagcagctcgtgagcctggcggctgaagccctccctatcctagagaagcagctgatggatccccgggggcctggggacatcaggaccgtgttccggccacccttcgacatgtatgatgtgctgatccacctgactccccgccacattccccggcaccgccaagctgtagaccctccagttgcttccttctgccgtggtctgctcgctgagccagggccttcgtctctgatgcctgtcctgggctatgac

SEQ ID NO: 1992 - DNA, 79 bp, Mus musculus
tactccctcgccttgcgctgctgggccccacaccctgcagaccggcctagcttttccaacctggaagggctgcttcaag

SEQ ID NO: 1993 - DNA, 227 bp, Mus musculus
cccttgacacttatggacagcactcctaaactgaccctctcatctcccctccttgcttctgcctagctccatggcttccttcaggcaaacactgctccactggacccttcttccatcaaggactctgggaaagcagggcttgagcatttgtcactgcaggcttgggttccctccttagactgtgtggtacctgtggcaccgagtgtctgtacttgagtgggctctgt

SEQ ID NO: 1994 - DNA, 535 bp, Mus musculus
  misc_feature (275)..(275): n is a, c, g, or t
  misc_feature (278)..(278): n is a, c, g, or t
  misc_feature (281)..(281): n is a, c, g, or t
  misc_feature (283)..(283): n is a, c, g, or t
  misc_feature (285)..(285): n is a, c, g, or t
  misc_feature (287)..(287): n is a, c, g, or t
  misc_feature (291)..(291): n is a, c, g, or t
  misc_feature (298)..(298): n is a, c, g, or t
  misc_feature (300)..(300): n is a, c, g, or t
  misc_feature (316)..(316): n is a, c, g, or t
  misc_feature (340)..(340): n is a, c, g, or t
  misc_feature (361)..(361): n is a, c, g, or t
  misc_feature (369)..(369): n is a, c, g, or t
  misc_feature (388)..(388): n is a, c, g, or t
  misc_feature (393)..(393): n is a, c, g, or t
  misc_feature (402)..(402): n is a, c, g, or t
  misc_feature (409)..(409): n is a, c, g, or t
  misc_feature (468)..(468): n is a, c, g, or t
  misc_feature (490)..(490): n is a, c, g, or t
  misc_feature (501)..(501): n is a, c, g, or t
  misc_feature (503)..(503): n is a, c, g, or t
  misc_feature (510)..(510): n is a, c, g, or t
catccctgtgactttggctttattttacaataaaacactgaaaatgtccactttgttagttgtgaacatgagcccaggcctaaggtgctgggaaacagaaagggcgggagatttttctttattctatggctagaaaatagttacctcctctctgaaagtcttcttcctcatttctgggtaacagaatatcaaacaccttgcttataagttataaagtagtgttgtccaccatgaacccaccaagtaaaaacaacccaaatacctatcatggatgnatnatncntncnagtntcagatntncactcaatgccacacnatgacaaagatagcaaatgagccncagacggctccacccaacccnatagatgnacacttggttcaaaatcantaaanctcaaatantcccagntcaaacaccaggtaacaagttaatactcaacaaagggggaaaacaaatgttccactgantcctgtgaccctgtgggcgtgnttcacctcctntnttgtttnccatgtgtgctcaggatgagctgat

SEQ ID NO: 1995 - DNA, 561 bp, Mus musculus
ttgtgtacatgttcttcctccaaagagtattcaaatgtgggaaccgaatcataacactatgcatggatcctcacaatctcccagaaactacagggttcatgactcacaacagatggtatgggtcctgactggaaatactttaacagcagttcctgctagcaacaatgtcaagcctgtcattcttagcttgatagcatgtagagacacggaattccaagatgtaaagaaaggtaatctagttttcctgggaatcaagaacagaaatctctgcttctgctgtgttgagatggagggcaaaccaactttgcagcttaaggaagtagacatcatgaatttgtacaaagagagaaaagcacaaaaagcctttctgttctatcatggcatagagggctccacttctgtctttcagtcagtcctctatcctggctggtttatagccacctcttccatagaaagacagacaatcatcctcacacatcagcggggtaaattggttaacactaacttctacatagagtctgagaagtaaatccaacatgggtcatatgtggccagctccag

SEQ ID NO: 1996 - DNA, 567 bp, Mus musculus
  misc_feature (81)..(82): n is a, c, g, or t
  misc_feature (157)..(157): n is a, c, g, or t
  misc_feature (182)..(182): n is a, c, g, or t
  misc_feature (396)..(396): n is a, c, g, or t
  misc_feature (403)..(404): n is a, c, g, or t
  misc_feature (461)..(461): n is a, c, g, or t
gtctcctggtatgctaccctggtaacacaggaattcttcaaccccagcactcctgtcaatgccaggtacgaatttggcccnnctctgttcgtcggctgggcctcggccggcctggccatgctgggcggttcctttctctgctgcacatgcccagagnccggagagggcgaacagcatcccancagccctatcgctctggaccctcaactgctgccagagagtacgtctgagtctgcctaccctgcccagccccctctccccagcaaccctcttgcccagaactcgagccagactaaacaataccctgggcagggtagatggggtatatggatcccttgaactcggtctggagctccaaacacctggtcctcaacatagcctctgagtcaaagagantcagacnntcaaagagagatcagaggcaagacccagcccacacgtgacccagtaaggaccaggcntattctgtcgacaccagaatgaggaccaggatttattcactagcttagccaccagctccttcatttgccaacgtatttgctgaaggacccatctgcctgatacagg

SEQ ID NO: 1997 - DNA, 516 bp, Mus musculus
  misc_feature (70)..(70): n is a, c, g, or t
  misc_feature (75)..(75): n is a, c, g, or t
  misc_feature (78)..(78): n is a, c, g, or t
  misc_feature (382)..(382): n is a, c, g, or t
  misc_feature (418)..(418): n is a, c, g, or t
  misc_feature (439)..(439): n is a, c, g, or t
tgtggagacccattgcttgaccctagcctgcgggagcctgaactggagcctcccgcatgtcctgagccgnctgcnccncatcccggggccaactcctgaaccttttaccaccgtgtcgattccggggcctcgggctcctgcgccaccctggctgcctagccctattggagaggaggaagagagtccggcctgagatcctgggaccaggacccctacggacacctacctaatcctgcactggacatactggcgaccaccagggtctgcacaagctagctaggccttcagaaagccgacctactcattttgaccagcggaatctcccactggggctggtggttttaggggtccatattctcccagctgttgctgcttccctcanccccagccccccactctttaagaggttttgccttcnaaacaccaccacctgacctgntggcctctgttggtcttctgaccgtaccttgggttcttcccttcgagtggaattgacggcctacctcatgaaattgt

SEQ ID NO: 1998 - DNA, 393 bp, Mus musculus
  misc_feature (116)..(116): n is a, c, g, or t
  misc_feature (121)..(121): n is a, c, g, or t
  misc_feature (125)..(125): n is a, c, g, or t
  misc_feature (128)..(128): n is a, c, g, or t
  misc_feature (130)..(130): n is a, c, g, or t
  misc_feature (136)..(137): n is a, c, g, or t
  misc_feature (143)..(144): n is a, c, g, or t
  misc_feature (146)..(146): n is a, c, g, or t
  misc_feature (151)..(151): n is a, c, g, or t
  misc_feature (153)..(153): n is a, c, g, or t
  misc_feature (158)..(158): n is a, c, g, or t
  misc_feature (162)..(162): n is a, c, g, or t
  misc_feature (164)..(164): n is a, c, g, or t
  misc_feature (167)..(167): n is a, c, g, or t
  misc_feature (170)..(170): n is a, c, g, or t
  misc_feature (176)..(177): n is a, c, g, or t
  misc_feature (180)..(183): n is a, c, g, or t
  misc_feature (191)..(191): n is a, c, g, or t
  misc_feature (195)..(195): n is a, c, g, or t
  misc_feature (212)..(212): n is a, c, g, or t
  misc_feature (216)..(216): n is a, c, g, or t
  misc_feature (232)..(232): n is a, c, g, or t
  misc_feature (274)..(274): n is a, c, g, or t
  misc_feature (284)..(284): n is a, c, g, or t
  misc_feature (324)..(324): n is a, c, g, or t
  misc_feature (328)..(328): n is a, c, g, or t
  misc_feature (345)..(345): n is a, c, g, or t
atccttcacctctacaagcagaagccacagacaccatcttccccagctcccaggggatgaacaagattcaacactcaatgggagaccagcctggggccttatcgatggtggccagntgacnaccncanantccctnnatagtnngntcctncntgatntccncnagncanctcccnnatnnnngatatatntggngaaccctgatatgccanctancatcacaacccccacntcaggaggacaagcttggtgtgtgtatgtgtgtgtgtaaaangggcgggggntggggtggggcaggaatacccagtgtgacacactgggtangggncagctatggggcagggnactcaggacacagtttgatcttctggttccataacacgactatggcaa

SEQ ID NO: 1999 - DNA, 528 bp, Mus musculus
  misc_feature (104)..(104): n is a, c, g, or t
  misc_feature (121)..(121): n is a, c, g, or t
  misc_feature (123)..(124): n is a, c, g, or t
  misc_feature (129)..(130): n is a, c, g, or t
  misc_feature (140)..(143): n is a, c, g, or t
  misc_feature (289)..(289): n is a, c, g, or t
  misc_feature (377)..(377): n is a, c, g, or t
  misc_feature (379)..(379): n is a, c, g, or t
  misc_feature (389)..(389): n is a, c, g, or t
  misc_feature (393)..(393): n is a, c, g, or t
  misc_feature (395)..(414): n is a, c, g, or t
  misc_feature (437)..(437): n is a, c, g, or t
  misc_feature (503)..(503): n is a, c, g, or t
gagaaactgcctatcctggtgaagctctaaagaaagtggaggagtttgttcagcagttattacaagacatccagacggggctgcttctttggttttgctgtttngtttgtttgtttgtttntnnttctnnctttctttcnnnntttctttctttctttctttctttctttctttctttctttctttctttctttctttctttctttctttcccaatataaggacattgaagggtttgattcttcatggtcagatgttaatatgaatgaatggcagcatgctgtgggcanatatttccctatcttgctaaagaatgctgcaatagtgtcagcttcatttttactttttccattgtctgtgtgtgtgtgtgtgtgtgtntntgtgtgtgtntgtntnnnnnnnnnnnnnnnnnnnntccttttgaaggaaaattgtttntgtagttcaaatacgaaattcagaccaaataataagccaggtataaattggcaaaatgtatttttntgtttctctctgtaactaagcaaca

SEQ ID NO: 2000 - DNA, 416 bp, Mus musculus
  misc_feature (160)..(162): n is a, c, g, or t
aagtgcatctggagaccaggttctctgccaaccaactatgagctctactatggctttacaagatttgctgtggagctcaatgagttggaccccgtcctgaaggacctccttccccccacagatgcccgattccggccagatcaaaggtttttggaagaannnaacctagaagccgcagccgcagagaaacaaagagttgaggaactccaaagatcgcgaagacgctacatggaggaaaacaaccttgaacatataccaaaattttttaaagcttgtgtctgctcagatttggccccactgtggttagaccaaagatgattactacaggattatttaaaggattatataaacatcacacagatgagtctgtggtttccagatccatcatctgtcatcctcctgagcatgcacaggaa

SEQ ID NO: 2001 - DNA, 530 bp, Mus musculus
  misc_feature (494)..(494): n is a, c, g, or t
tgcaccgccacatcaaacggcagagctgccgcatggcgcgaccccggcgtggtcgcaagcccgcggcctggagggccgccagcctgctcttcgggcccggtggcccctccgccgacaaggcagccttcgtgatgccacccgcgctgggcgacgtgggtggccacctgggcggcacagccgtgtgcctcccgggccccagccccgctaagcacttcctggcttcccccaagggcaccctgagcctgcaggagctggaaaggcagttcgaggagacgcagatgaagctgtttggacgggcgcagctcgaggccgagaggaatgcgggtggcctcctggccctggcgctggccgagaacgtggccgccactcggccctacttcccattgcccgacccctgggcggcaggtctggctggcctccctggtctcaccggcctcaaccacgtggcctccatgtctgaagccaacaactaggctggccctggtccaccctanacccaaaccctgtcttaagtccctctaaggcctgcc

SEQ ID NO: 2002 - DNA, 561 bp, Mus musculus
atggagaaacatccctgtgctacagaattgggggtgggacagctgagggggcaggcggctctttcctgatagttgatgacaagccctgagaatgccatctgctggctccactcacacgggctcaactgtcctgggtgatagtgacttgccaggccacaggctgcaggtcacagacagagcaggcaagcagccttgcaactgcagattacttagggagaagcatcggggcctcgtgagccaggccccgtagccagtgccctgctttactccagccttggtcaggaagtcgaaagcccttggtgtattcctggtctcggagcaaataatgagccagcaccctgaagggtgggctccaactcagacatgcagccagccccctaggtgggtaaacgccctagggacctagggagagcctttgctgcagagattcctaagcaaaacggcgtggtggagctttggcaaccctagccccagctaactttggacagtcagcatatgtccctgccatccctagacatctccagtcagctggtatcacagccagtggttcagacaggtttg

SEQ ID NO: 2003 - DNA, 192 bp, Mus musculus
aatgacacgaaccttcctgaccagtgtaactcatttttacacaacaaggcggagtggaggtgtgaaattgaggcaacccttgagcgactgaagaaactagagcgagatctcagctttaaagagcaggagctcaaagaacgggagagacgtctcaagatgtgggagcagaagctgacggagcaatccaacacc

SEQ ID NO: 2004 - DNA, 47 bp, Mus musculus
ctgcctctctcttgcctgttgacttccacttgtaccggccacaggag

SEQ ID NO: 2005 - DNA, 458 bp, Mus musculus
  misc_feature (338)..(338): n is a, c, g, or t
  misc_feature (343)..(344): n is a, c, g, or t
  misc_feature (348)..(348): n is a, c, g, or t
  misc_feature (350)..(350): n is a, c, g, or t
  misc_feature (353)..(353): n is a, c, g, or t
  misc_feature (356)..(356): n is a, c, g, or t
  misc_feature (361)..(361): n is a, c, g, or t
  misc_feature (410)..(410): n is a, c, g, or t
  misc_feature (419)..(419): n is a, c, g, or t
  misc_feature (433)..(433): n is a, c, g, or t
gagattatgtactgtatgctgccattcttgtcttttcctttcttttctgtttgactacaagtactacagtatgtagtgtgaatgctgagggacaaacatttctgtttgtgttgcgctcacttctggacatctaaatacttaagtaaaaatatacaaatacttcttgatgtgatgattgggctgtgtcccttaaattgattgaaagttgaagtatgtaagctgaaattgcatttaaagctatcagtctgctgcccattaataacagcaaagcctcctatagaatcttgatcatctcccgcttgtatggttagattttatgtgattttgtgactctctgntcctnnccancnatnccngggantattgtactacatacatattgttaactcaggaagaaatcataattaganatatgaagnatgatttctactgngtccatattgtttttacctcatagt

SEQ ID NO: 2006 - DNA, 544 bp, Mus musculus
  misc_feature (120)..(120): n is a, c, g, or t
  misc_feature (136)..(136): n is a, c, g, or t
gggatctaatgtgcctctagttaactatgaaacttaactattttccttccctggtgacctgcactccagtgattagaagtccagccttacctgtgagagagctcctggcatctaagaganctctgcttcctcatcntccccaccgacttgttcttccttgggagtgtgtcctcagggagaacagcattgttgttcctgtgcctcaagctcccagctgactctcctgtggctcgtaggactgaatggggtgaggaagagcctgatgccctctggcaatcagagccggaaggacttcaaaacatctggacaactctcattgactgatgctccaacataatttttaaaaagacctgcattaaatgtttccatggaacaatgaccaactttaacacaaaacacaatggagcattggtgtttagttggtagagctggagaaaagataaatccctaaaacatgccagccagcgtagcatggcagtgctgtccacagatggtggtgggtggtgacgtcttcttcaggtcccagtgacgtgtctgtgtgtga

SEQ ID NO: 2007 - DNA, 451 bp, Mus musculus
acacagatttcattgcagcagccgcgcccagcccagggaagaaaggatgggaaacccccgaggtcttccttgaacatcaggcttccaggccccgttatcttcgccccaggaagggtgcatgggctcccactttaatttttctcttccaagtctccagattctggaactcccgtgtctttttcttttctcacttgcacccctgcacctcgttatgacccctatttttctgggattttcttggtcctcattttctgactctctcccacaacccactccaaaaggtagtacctcaaggcttctcgcactcccctatttcctcgggatatgagaagcctcgataaacatctctgccgttccccatccctatatcaacactctggcttccctttctcccatatcacactctggcccaaggaccccagcctgtatatatccctttcagccccattaa

SEQ ID NO: 2008 - DNA, 332 bp, Mus musculus
gtatgccagataccactgagttcaatgttcaagtttcccattttttcctgtgggtatccatggttagcctaaaacactctattagaccagatgtccttgaatttaaaagtcttctgattcagccttctaaatactagaattactggtgagtaccatcaattttcaatctttctgactcattctctgtagtcacttagcttctgacatattccaccatggacagctccatcttcagctgtctgagcctatctatacagctttggcatctgatgccatgccccttcgtctgtacaaggttgttgaacactgtgctggttgctggtaatgattca

SEQ ID NO: 2009 - DNA, 240 bp, Mus musculus
taggccgtgtagtacacataattcagtcaagggaaccatcacttaaaaactccaaccccgatgagattgagattgactttgagaccctgaagccatctacactacgagagttggagcgatatgtcacctcctgtttgcggaagaaaaggaaacctcaagctgaaaaagttgacgtgattgctggttcttccaagatgaagggattctcatcctctgagtcggagagcaccagcgaatcca

SEQ ID NO: 2010 - DNA, 258 bp, Mus musculus
  misc_feature (46)..(46): n is a, c, g, or t
  misc_feature (69)..(69): n is a, c, g, or t
  misc_feature (83)..(83): n is a, c, g, or t
tgtggctggcccagttctcttgactgtctaccagctgggctggccnctcccctcagtggacttcagggnaagcatgtggcgcnagcagccactttttctgctcacaacctgcttgggcctcagactggtgaagctgctgcaagggcagagaggtgcaccccgtcgagcaacctacgctcaccagccaacagatacctgctgaccacacagcttggacctttagctgggacctagcatctcaaagggtgccttctgttg

SEQ ID NO: 2011 - DNA, 550 bp, Mus musculus
aacaaatgctgcactccctggaggagttatcaccagctccaagtgcacagaccttaaatgctacctgtttggaagtggcatccgaggaaggaaggagcattgatgggagtcttgaaaacactacagaagaaagcagccccccaacaccaagccagctttcagtagcaggccctgtgtgggtttctgtcaaggggccatccatgaagagtgctctgatggaaggagaaagccacactcggatcctgactccagtctccactgtgctggccctgcttctaattgctgctctgatcctattgaaaaggagccttggcagacagaggacatctcagaagaaagaaagggtacccaggatcactctaattcagatgacacatttcctaccagataagctccctgatgagggaaagaactttcaacagagtgaccttcttcctccccaagccagcctgaccgtcctggagaatgacccaagaccctgatgatggaaaggtaaatagctcagtcaccatgaagggaagaccaaatccaaacagctttatcctcttct

SEQ ID NO: 2012 - DNA, 158 bp, Mus musculus
gctggacaccctgatcagaagcttgttgaaaggccgagcgtctgatggcttcccggtgtatcaggaaaagatcatcagagaaagcatccggaagtttccatactgtgaagccacactcctacagcagctggtgcgaagcatcgctccagttgaaattg

SEQ ID NO: 2013 - DNA, 405 bp, Mus musculus
tagatagcacatgggccttgttagcagtgggtgagctgggcaagcccgttgtcctgtgaggtcaggacagtgcctcagcaggtcacctcttcctttcctcactgggctttagaattatgctgtgcagagtcattcacggaaaactgggctacgcttcccttttccttcttgccctctgtaagcttgtgagggcctcctgggagtccgcagagtcagatgaagtcagtgtgaggccagcctgccagccgtgctgtgcctgggagactgggagagcacacctgctgaggaaggtggagacaccacagacaggacggagtccacctaggccaggcagctgtgaggagactcagggtctggacaccacctcctgacctatagatggagatagtttcatacttcctggaa

SEQ ID NO: 2014 - DNA, 153 bp, Mus musculus
  misc_feature (30)..(30): n is a, c, g, or t
  misc_feature (35)..(35): n is a, c, g, or t
ttacacagcacaagatccgcacattggaanggganggagaagactttgaccctgatcaatgtgtactgccctcacgcggatcctgggaagcctgagcggctgaccttcaagatgcgcttctatcgcctgctccagatgcgagcagaagcgctc

SEQ ID NO: 2015 - DNA, 481 bp, Mus musculus
  misc_feature (302)..(302): n is a, c, g, or t
  misc_feature (308)..(308): n is a, c, g, or t
  misc_feature (397)..(397): n is a, c, g, or t
  misc_feature (437)..(437): n is a, c, g, or t
aagattgggcatcaggcctgtgtcctcactgcgcaggaagtctttcccagctaaccaagtggcagcttctggtgtcaaaaatcaagtccgccttgacagtcctcaacaacatggccgtgagaagaaaggaagggaagactggccgatctgagtactattcaaatgatgaatgacagagatggagccaaacttaaaagcgaattttttgaaagctacagaagattcattttagctccttccctggcttccgtagataatgggttgtaacctgtaagatcaaataacctttcttcccccaaatngatttnggttagtgctttatcacagcaatggaaagtaccaaggtagtcaagaatccttcctgctgtctccattgttgcacattcttacccccgtncccatctctgccagtgtgttcttactgctggattatgggnaatgctcccttttcacccaacattccagttcttccgattgtttg

SEQ ID NO: 2016 - DNA, 364 bp, Mus musculus
caagtctgtgctgttgccaagaaggatgccttctggagactcgacaagacagagagcaagatcccagcacgtgtggtcttccagatctgggacaatgacaaattctcttttgatgactttctgggctctctgcagctggatctcaaccgaatgcccaagccagccaagacggctgagaagtgctccttggaccagctggatgacaccttccacccagaatggtttgtgtccctttttgagcagaagacagtgaaaggatggtggccttgtgtgacagaggagggcgagaagaagatgttggcgggcaagctggaaatgaccttggagattgttgcagaaagtgaacatgaagagcggcctgctg

SEQ ID NO: 2017 - DNA, 521 bp, Mus musculus
ctgcttttgttgagtacctgagatcagttcccagcatccacatgggtaggttcacatctgcctgtaatttccagctccaggtaatctgtcatcctcttctggccttcatgggcaattgcactcatgtgcacatatccactcattcacatacatatatatataattaaaatttaaaaaatcaattcttaaaattacctttcccaagtccagcttaatcaagctgtgagtttattgggattacttacaggagtatgggtgaggagtgacttataaaacaaggctgactccagacagctgcatcactgaatggccatctgagcctggctcatggctcagaagagcggcatccctggagctctctatacaacttgcagtcagcttgaaaggccaaagactctcttcctcatagttgtgaactacttctatagctttagaatggctggtgaatcctgtaagtttcaggaactttctaagacttgtgagctgtttatatcctgagccttaaggagctttcttcagga

SEQ ID NO: 2018 - DNA, 421 bp, Mus musculus
tatcagtttctggaagggttgcccccctggtcaggtttcttccttcatcctgcaggatgggttgaccaggtggatgctggcaggtacgtggttggtttggcagtagagaaattgcgttgtgtcttctcattcccggaaggagagagtaggggacggggagaatgcagactttccagactcatcagcaccgtccagctgatttgggcaacacagtgatctcattcagaagctggaagttcaggtcaggtgtgtttagccggatggcagagctggcaattattttggatgcagacatggctggtagatagacttggccaccgctgagtggtttgatctgtgtattcatttcctttattttgactaaatataccatgcatttagaagcttcatccctctatgccgtggatctgaagggactgtc

SEQ ID NO: 2019 - DNA, 526 bp, Mus musculus
caacatgagcagtggtcccgagcctccattcttcaaaaatctaatagcttcacttattcctaatattgcggatagagcaccaattggcaaacattttggggatgtcttgcagccagcaaaacctgaatacagagtgggagaagtggttgaagttatatttgtaggcgctaacccaaagaattcagcagagaaccagacccatcaaaccttcctcactgtggagaaatacgaggactctgtagctgactggcagataatgtataacgatgcctcctgggagacgaggttttattggcacaaaggaatactgggtctgagcaatgcaacaatatactggcatattccagatactgcctaccctggaatctacagaataagatattttggacacaatcggaagcaggaacttctgaaacccgctgtcatactagcatttgaaggaatttcttctccttttgaagttgtcactacttagtgaaaagttgacagatattgaagaaaagcttttctctgtgcacattataga

SEQ ID NO: 2020 - DNA, 573 bp, Mus musculus
ttttcaagatgacttctcagctggggctgtcatgcctggctgatgttggtagaagtgggtagggagggagaggtaaaggttgcttaagcaacattcatgatgatgtttcctgtggcattatgaaatccagaaagatgaactcctaaggatttaacacttgaagctagtttcttcagtgggagtcttgaccctggggaccagggattaaaagcagagagcatgaataacattcataggaacagacttccatggattcacatgcaaatgtaaatctttgtgtgactgtatgtggtgaatggttgagtatttgtacattaatcgagctagactttattacacattcaaggttctggaccttccttaaaaggtaagagcactggcctataggaagctacccataaatgatagaaagagttgaaatgtgagccaggtgaacttgttctcctggaggcttctgctctgaacactttgctttgatgaatttgaataaggcatggatgaagcaagccacattatctctttcttctcaacctccccttccacccctctatcctttgtatgtcctaacctctt

SEQ ID NO: 2021 - DNA, 571 bp, Mus musculus
gacttacctcatcctgtggtgattaagccgggggatgaactgctgatagaatgtcattaccagacactggatcgtgacttcatgacttttggaggtgccagcaccattaatgagatgtgcctcatcttcttcttctactatcccagaattaacatctccagttgcatgggataccctgatatcatctatgtgaccaatgagctgggggaagaagcatcagagaatcccatggagaacctgatggtcctggataatgtggagtggactccagagaacattaagaaagctgagaaagcctgcaaggagtcccagcagacagtattgatcaagaccattgatgaagaagtagaaaatacaacaggttggattcctgatattataccaactcctcgaggaccatgcgtagagtctactggaggcaaggtggaacctcaggacaataccccggcaggcttcagggctgtaccactggccctctctggctccaatactgctactctgaggcccctgcccatgattgctgtactgttcctgcagggtagcctctcgtgtctccttgcaatgctgcaga

SEQ ID NO: 2022 - DNA, 577 bp, Mus musculus
aagaacaactcttcttccatctcatcacccagtccttaaatgccccaccttagtacagggtagggttagcttttgacttgtgttagctttcaacttcttggcttggttttcttttgtgttttggtctagacaaaattatccttggtataagaaaaggaaataaagttttaaaaatgttgggctactactagcacagcaatcactaacatgacaaaagatgactcatttcatgttaattttccgagctcaagatacatcactcaccgctccattcctcgggttcacgttcatatctgtcttttcatctgcacacctggacacgtgcacactcttcctttgcctaagctttagctatgcacagaggtaatggatcgtcaggagagcctggcaggtcttggggcaagggcatgacagccacagacagggagggttgtaacctgtgcctgggcatcctgaacccactggacaccccacacatcacctgcatggttctgcatactgtgctgcatatcagatcacagagaggcctcaaacccccaacccattcatagggaatatcaagtttcctttggcaaga

SEQ ID NO: 2023 - DNA, 580 bp, Mus musculus
gcatctttgcaggatttgtcatctcatataatattccaccaaccaacattccaatcctcacaataccatgatttttaaaaactacagccctaattatttcagcattaggattcctaatcgcactagaactaaacaacctaaccataaaactatcaataagtaaaccaaacccatactcatctttctcaactttactggggtttttcccatccattattcaccgcattacacccataaaatctctcaacctaagcctaaaaacatccctaactctcctagacttaatctgactagaaaaaaccatcccaaaatccacctcaactcttcacacaaatataaccactttaacaaccaaccaaaaaggcctaattaaattgtactttatatcattcctaattaacatcatcttaattattatcttatactcgattaatctcgagtaatctcaataataataaaaatacccgcaaacaaagatcacccagctaccaccatcattcaagtagcacaactatatattgccgctaccccaatccctccctctaacataaccccaacatcatcaacctcatacatcaac

SEQ ID NO: 2024 - DNA, 520 bp, Mus musculus
gagaggctagcataccaccactgaatcccaaagcccaggaagaaggtgaaaggttctttaacctggaggatacgctgggcagacaaagccagatcctacaggccctccaggctctctccaggcagatggcccaggctgagaagcactggaaacagcagctggggtctacagtccaagtccggcctgagggaggctggggaagcagctgcccggatggcttcaggagcacacgtcttctacctgcctgtgggcactaagcatcacttttttgaactggaccatatcctcagcctcctgcagaaggacctccggggtctggtgcaggcaggagctggacaagaggcttcaggagtacctgtccacaggaagcctttctctagagcctgcattacccatcaccaggacgataggggttctgaggagacagcccatctcccccagcatgcaagcctgacccagctcaaagccatgtcttactggggaaaaaaaatgggggatagaggatttagccagtgcccac

SEQ ID NO: 2025 - DNA, 366 bp, Mus musculus
taaacacagcttgcatgacttcctctgtgaatagtgaggcttcactgaccaacacaagtgaagaacaaccagaacaaccaaaaaaaaccataggagtgaaaattcagcaaaacataggtgtgatcgcagcactagctgttgcagtgcttgctgcgggcatctccttccattacttcagtgattagagctccctgatcatccagaaatcacggatcaacagctacagaaaataacgacatcaatgtccacctgcactgaagctagcaagcagctctgctacgttaacatctgttagatgtgtttctgacttacatgaaaccaccagctgccttgtttagccctgctttgattatctggcccaggttt

SEQ ID NO: 2026 - DNA, 409 bp, Mus musculus
gccacactatacacagcttgaacataggagacctcaaagcctgtccccacagtgacaaacttcctccaacaaggtcatacctcctaataataccatttcttatgaggcaagcattcaaacacatgagtctatgagggccaaaccaattcaaaccaccacaggttaacaattgccctctgcagctctctggtggaggccctccttgagagtaagtaacaatttagatgaaggcaagtcctggtatcaggtccaaaagaaactcaggatgaatggtccactgtggttcctattaacatactgaagaacatgacctcaccttacacgtctccacctcactgacttcccttcccctagcttctcattcccaggtaaccctgccattttttggtaatgtgccttcttggttctt

SEQ ID NO: 2027 - DNA, 313 bp, Mus musculus
agagtagtggtatttcaccggcgcccgcgaggccggcgtgccccgaccccgacgcgaggacggggccggggccgggcgccgggggcctcccacttattctacacctctcatgtctcttcaccgtgccagactagagtcaagctcaacagggtcttctttccccgctgattccgccaagcccgttcccttggctgtggtttcgctggatagtaggtagggacagtgggaatctcgttcatccattcatgcgcgtcactaattagatgacgaggcatttggctaccttaagagagtcatagttacgcggccgcaa

SEQ ID NO: 2028 - DNA, 231 bp, Mus musculus
ggaatgaagaagctctactgcaagctctagtaacacatggacccattgctgttgcaattgacggttcacatgcatcctttcattcatatcggggaggtatatatcatgagccaaagtgcagaaaggatactctcgaccatggtttactattggttggctatggctatgaaggccatgagtcagagaacaggaaatattggctgctaaagaacagccatggtgaaagatggg

SEQ ID NO: 2029 - DNA, 496 bp, Mus musculus
ggaagaaccacctttcgtgcattatctgaacacatttagcagcaaagaaccgcaacggggtatgggtttcatgcccaagcggggactggatgtcagcaaatgtgaaatcgccaggttctacaagctgcacgaacgaaagtgtgaacccatcatcatgactgtaccgcgaaagtcagacctgttccaggatgacctatacccagacacgcctggccctgagcctgccctggaagctgatgagtggctatcaggtcaggatgcagaacctgtgctcatttcgctgaaggaaggctacgttccccccaaacaccgtgagcttcgggtcaccaaacgcaacatcctagatgtgcgcccgccggccagtcctcggcgcagccagtccgccagcgaggcccccttgtcgcagcacaccctggagacattgctggaggagataaaggccctccgagatcgagtgcaggcccaagaggagcgcatcactgcgttggaaaacatg

SEQ ID NO: 2030 - DNA, 219 bp, Mus musculus
gtttatacagaagtggcatctcccaatgatacggcacttcccccgacccaccgtgctcattgccctcaagactgcttccaggacccacgcttggcaaaaatggaataatacaagtgtcgggaagagtttgaggggcccattgctggtagcatagcaccgcaaatttaacggcctcacgtcgtgcagcgctcttccctgctcaacatttcctggtggaaa

SEQ ID NO: 2031 - DNA, 520 bp, Mus musculus
gaatagttatttctgcggtttcttaaatacccaatataaaaatgaaaatgggtgtctggcattgaacttctttactgctgcatacctgatgtttttgtttgtggtcctctgtctgtccagcctggctctggtggccaggttgttctgtggtactgggcagataaagcttaccagattgtatgtaaccattattctgagcattttggtttttctcctttgcggattgccctttggcatccactggtttctgttattcaagattaaggatgattttcatgtatttgatcttggattttatctggcatcagttgtcctgactgctattaatagctgtgccaaccccatcatttacttcttcgtgggatccttcaggcatcggttgaagcaccagaccctcaaaatggttctccagaatgcactgcaagacactcctgagacagccaaaatcatggtggagatgtcaagaagcaaatcagagccatgatgaagagcctttgcctggcccttagaagtggctttg

SEQ ID NO: 2032 - DNA, 290 bp, Mus musculus
tttggttgtttctctggccaagtgtctggagggtacaaagttgctggcacaccttaagaagtgtggtgacttggaatgtgaaactttgatcagccgagtcttagccctgagagattacacaggacccgactgtcggtacctgaacttcactacgggagaagagatatctgtttatgttaaacttggaggagacagagaagatttgtgggcaggaagcaaaggaaaagactttggatattttcccagagatgcagtccagattgaagaggtgttcatatctgaggaaattc

SEQ ID NO: 2033 - DNA, 350 bp, Mus musculus
  misc_feature (77)..(77): n is a, c, g, or t
  misc_feature (129)..(129): n is a, c, g, or t
  misc_feature (266)..(266): n is a, c, g, or t
tgaagaactcttcaggtcctgttcccaccttacctgaaggcattacagtggcatacacagtcccaaagaagacgganggattcggcttctgaagtaacagtggaagactccggcgaaagcttggaagantcttatggccaggatgaagaatatgtagacagtggctggcttctgtcttattttctctgcttatgctagtcccttggaattgaacaatcggaactaataaaacttagcgccgccttagttggcatgtgtatcttcancggagttgttatgcctgtgtggaactctagtgggtttcctcctgcttccgtatacaacctaatcacgtaaccacagcgacagaa

SEQ ID NO: 2034 - DNA, 545 bp, Mus musculus
  misc_feature (339)..(339): n is a, c, g, or t
  misc_feature (437)..(437): n is a, c, g, or t
taatcaccactgtgtaccgtccaaacaaagtgtccccgtgccaagccagagtggcaggaacactgtgacttagatgaggaacccccagggccgctccagcctcgaaggccctgcctcatccacagcgctccatagcttcactgtcactgtggaccacacctgtctctaaggtcatttcttcactcacctcgcctgtgtgccctccctgctcccccaaagtcttgtgttcggttccccagtgtgcatgtttcagtccaggcaagttacattcggttgtgtgcaatagaaggtcagaagcaagatcttacctggtgtcattaaaattgttttaacacaagntaggtgtgtccacctctgcattcctgtcacatgatggactttatgtaaaaatggtgacaccaaggctcacagtggagctctttgcatcaaagataatntactgtgtacacacctgtgcattcatagtgtgagtcacaccaggcatttgtaaatgagaaggtatgatcactatgtccaggcttccaaactgcctctgtcattaaaac

SEQ ID NO: 2035 - DNA, 464 bp, Mus musculus
  misc_feature (285)..(285): n is a, c, g, or t
  misc_feature (303)..(303): n is a, c, g, or t
  misc_feature (341)..(341): n is a, c, g, or t
  misc_feature (352)..(352): n is a, c, g, or t
  misc_feature (405)..(405): n is a, c, g, or t
  misc_feature (426)..(426): n is a, c, g, or t
  misc_feature (428)..(428): n is a, c, g, or t
ctacaatgtgtgctaccacccggaccatctgcgccatcctggagaactaccaggcagagaagggcatcgctgtgccagagaagttgagggagttcatgccgccagggctccaagagctgatcccgtttgtgaagcctgcacccattgaccaggagccatctaagaagcagaagaagcaacatgaaggcagcaaaaagaaagcgaaagaggtccccctggagaaccagctgcagagcatggaggtcactgaggcctgagcactgccagacttacttactaagcctngctgggatcccaggcctnccctgggacagagaggccgagaaccactcctcaccctntcccatctganctgcacagcggctggggaaaccatctgccgtggacagagcaggtgttcccttntcctcgcacgggccaggggtntnttcactgatgactggtgaagccacgcaataaagcat

SEQ ID NO: 2036 - DNA, 410 bp, Mus musculus
  misc_feature (284)..(284): n is a, c, g, or t
aactcagccaactattagcctagtcatgtgccttgaatatctatgtgtcctataataagtaaccttccacattcatgctacctgcttcttttttaaaataattaatgcacataggaacacttcttttgatcatcaggcattacacaattgttctttctagacatttttatgaacactattcattgtaattatgtaattatttcctattaggaaatacgtccatctttaaaaaaatatttgacattaccaaataataatttcaaataaaggcttaaaatttattntcctttcttataaaacctgaataaaatttttgtgcatgctttagggtttaattacttaagagtttcttgttctattaataagtaggaatgcttttgaaggcacaagtctccttgtaaatgatacac

SEQ ID NO: 2037 - DNA, 469 bp, Mus musculus
tcatgggttcacatcttgctcaaagggagaaaattcatgagaggaaactggatataaggaatatggaaagacctttcttcatggttcaaaatttaatagacacctggaaaatcatgctgactaagagaactgaattcaaggaatttggaaacatttattcatgattctgcacttaactgatagtaaattctcaaaagggacctgagagaatgtggaaatgcccttcaggtttgcagctgtggggaacagggcttggcaagcaacctggctatcccagagagatggaaaagttttcatcttggactttcctctcatgacaagaagttcatgctggcaccgagccccacaaatgtatgaagtgattttagttaccatggcagcttgggtcaacacctggatatatatactttttcctgtggtatgaaaccctgagctgtgtgtgctgaacacactgtcttgtttctcagct

SEQ ID NO: 2038 - DNA, 302 bp, Mus musculus
  misc_feature (69)..(69): n is a, c, g, or t
  misc_feature (143)..(143): n is a, c, g, or t
  misc_feature (177)..(177): n is a, c, g, or t
  misc_feature (187)..(187): n is a, c, g, or t
  misc_feature (203)..(203): n is a, c, g, or t
aacgtgtatatcctgtgggagagtagaaaatcctgtggagaatctgtaggcttacttagcataattctngtattggaaaagtttctgttataaagtaaatgaaaagttacagaagaggtgagcctaacattacatacagaganggtgctgctggcttcttgtttgagtgtttcgtangggtggatgncagttctgaatggtanagatgtgtgtttagttcagtcctgagtgtcatacaagtgcagtccctggtacctctcttagtactatgtgttacgcagttgtgggtaagtgtgcataca

SEQ ID NO: 2039 - DNA, 135 bp, Mus musculus
gtcaccatggacctgagatctggccttgagctgcatcactttacttgtatgtgcaccctccgattgcccatctcgacgggctggatggttttggtaatttccagctgcttgtgctgtttgttattcttaacttct

SEQ ID NO: 2040 - DNA, 303 bp, Mus musculus
aggtgtccagatacatagcaatcctttccagttaggactgattaaaatttcaaactgaaattttcattttgggactgggttttaaaattcagtctatctgcttaaaagtaatgattagattattgataaaaaaagaaaggggaaattttatttaaatcacatctgttaatctttttatctaaaactttgtatacttttccactttcaaaagttattttaagtatatcaagatttatttaaaactgtcaacaacagtaaaaagtattacaatgaaatcactagagtatttctgggacagaccca

SEQ ID NO: 2041 - DNA, 411 bp, Mus musculus
aaatgcgcagcacagactttggagaagaggagtaaagtcaaacccaaagtaaatgtgaagccatctgtggtcaaggttgtctcagctcccaaattggctcccaaacgcaaggctgtggagatgcactctgccgtcatcgcagccgtgaagccgctcagctccagcagtgtcctgcaggaaagccccaccaagaaagcagctgtggctgttgtcccactcctctctgaggataaacccgtcaccatgtctgagacagaaaacccaaaagacagttctgtgctgtcttcagcccaagctgcttcggaacccttgctcccggaaggctctggcccttcctcatcccagacggcaacaaaaccgcgccggctgagctccgcctccacgggaaagcctccactctctgtggaagat

SEQ ID NO: 2042 - DNA, 518 bp, Mus musculus
gatagtaattctcctccagatgactaagatcataataatatgatattaaatattaacaatacaaaataagaggcactgtggccctagcgtaatatgggtcactgtgtcagttttcctggggatagcagtcattaggcttcatatgacttaggggagatctttttagaaaataagaactattgtttggataaagtcaattgttaggctttaaacatcaaaaatatttaggtccttataagtaaaagcacgtttttcttgttggcagaatgaaaattacagtgtagcatataggagcagagtgttaatatacaaaatactttctgtggggaatgggcaggcagggaatgatgcttacggttagagattgtattggtggaaacgctgcagtgaaataaactccaaaagtaattttgctgcatcaaccccacaactttgcgggagactccctgctactttctgcagctgtcaatgggagaaatcatgaatcgacttctgcctactggtccttcccaaataaa

SEQ ID NO: 2043 - DNA, 448 bp, Mus musculus
  misc_feature (229)..(229): n is a, c, g, or t
  misc_feature (292)..(292): n is a, c, g, or t
  misc_feature (370)..(370): n is a, c, g, or t
  misc_feature (421)..(421): n is a, c, g, or t
tagacaatgattctgaggccctcctgaataaccctgcactttagaagacaacaccctggggcagagctggcagtgaggctacaaaagagggggtggtggtgaggaagggactagaacatcatctcggatgtttgtcccacactacaggagctgcagctcttcttgacaggcacttggccatttcagggcaacgtaaggctctgtccagtgttacagcagcagggctgcnatgtttcagagaacatttatcttagcccacatttgggtgagaagacaccaaaggtatattctncccagaatattggaataatgtctaaattggcttctgtagctatttatacatgatataatttgtctccattcagctctntcccaatgatgggcatgttttcccaacagtttccatcaagtccaggattgncccactcattattaccaggcttgcgat

SEQ ID NO: 2044 - DNA, 532 bp, Mus musculus
  misc_feature (71)..(71): n is a, c, g, or t
  misc_feature (222)..(222): n is a, c, g, or t
agagagctcagatcctggcatgccacctcttgaccctggttaaatctctgtttgcagtccctctgcctgtntagttactcatgtaagaaagtcagctcctcagaggttagctctgccccctccccctctttgagtcagggtttcatatagtccaggctggtgtgtttgtagccatacagataggtgccatcatgaccagtgtcagacttggaatgtatgtanaggcacaagcttcagcccatgggcctcatgtttggccagtctcttgcattgaccacactcctggcccctttgccctcaaaaccaacatagggcaccctacacttgtcaggctgtaaggctgtacctagagaaatgcttttggatatagtgtttgaggtcctggcctagatactatataccttgggaatgtaggcttctcgcttcagccgtgtccatggtaaacatcaagtgtacaccctttccctgctgttccttagctcaagcacagttgaggtgatggctgtagttggtacacaaggttctcagagtt

SEQ ID NO: 2045 - DNA, 405 bp, Mus musculus
  misc_feature (275)..(275): n is a, c, g, or t
  misc_feature (284)..(284): n is a, c, g, or t
  misc_feature (288)..(288): n is a, c, g, or t
  misc_feature (290)..(291): n is a, c, g, or t
  misc_feature (297)..(297): n is a, c, g, or t
  misc_feature (307)..(307): n is a, c, g, or t
  misc_feature (317)..(317): n is a, c, g, or t
  misc_feature (335)..(335): n is a, c, g, or t
  misc_feature (349)..(349): n is a, c, g, or t
cagtgggactgtggctgttgtcttagctgtagctctcagtgggacctgtggctgtccatggtacccatggcaattggcccagcctgtggatgtcagtgggacctgtggctgtcagtggcactggctgctgggctggcgtactgtcagtgggacccgtggtggcccgtgtgatgccggttacatagctgttggtggcgcctgtggttgtcagtggggttggaggtcactggtgtggcctaaggctggcacgtaaacctggcccatgccttggctancccctccancctncnntccttncttcctcctncccagaactntccagagatctccaactntgctttcagaagtncccttcccaactgctcggtttccctcccgggacggcggcagtattgaagcttgtga

SEQ ID NO: 2046 - DNA, 158 bp, Mus musculus
  misc_feature (29)..(29): n is a, c, g, or t
gcccaacccatgaacttcctggagacagncattgggtttatcagcatccccaggccactgctaacaaggatttgactaacatagggtccagaacccttctacttcagccatatctgggcccactggtaaccactggccacagcctgagagttatttag

SEQ ID NO: 2047 - DNA, 314 bp, Mus musculus
gaagcatctatgcagctcctcgagattattttccaccaagggacttccctggcccaccacttcctccgttcccagggagaactgtgtacgcaccgaggggctttccaccttaccttccccccagagctgggttcttccccccacccccacatcctgaaagtagaagtgagctccccccagacttgattccgccttcaaaagagcctgcagctgaccctccagaaacacaggaggcctgacagcgttacgtcttaccggcagtcatttccgtctcattttcagtttaagtaactgctgttacttatgtgattata

SEQ ID NO: 2048 - DNA, 515 bp, Mus musculus
  misc_feature (113)..(113): n is a, c, g, or t
gttcctgctgaccttttgagatagtcacttaaggaaggatggctctctctcatctgtctcttgttccttattgttgcagagctagctccacagagtcagaaagttctgacccnacattagaccccgtgtgcgctgctaaggccatggtaaccctctggggacaggcagccattgatgggagcaaagcttgcaggtgcctggaggtggtcccaccattgcctgcagatgtccttcctctgttcacagttaggtttagtgagcatttcatgtcagggagcctctggccagtgtctctgggaggtcactaatctacccctgaggtacccactctttctgtcgtagctttcttctagggccccaacaagcaagcataaaccaggcttgctggccagcactccttggctcccctgccgaaccacagacagacagttcagattaccaggataatcccaagcagtatctccagtctcggctggtagtggcccagatctatgcaggcccattagcacacattc

SEQ ID NO: 2049 - DNA, 430 bp, Mus musculus
  misc_feature (125)..(125): n is a, c, g, or t
ccttttctatcttctatacggttattacatctttccacagaaaccaaaactctgtactgtctttagtattacttccctattattttaaacacagtatgaagtagcattgtatggaaacattacantaagaggtacttaatatagacacagcgtatgtattatatcatgctggtgtttggtagcttttgctttcctgcgtctagtgaaaatttatcttcggtttgaattctctgctgttgattaaatgtaaaatgttacaggattttcccacaatccttaaacgtttatcactctttactcagtgtgagttttctgatgtggagtagactttaagacttgatttaagagcctgtctctcttgctatgtttataggctgtctggctgctgtgcattatttcatgttaagtcacatatcatgacatcccctta

SEQ ID NO: 2050 - DNA, 532 bp, Mus musculus
  misc_feature (287)..(289): n is a, c, g, or t
  misc_feature (358)..(358): n is a, c, g, or t
gtgacttttatattctgactccaaggtattgttcagacctcagctcctgggggccggcccctggagtcctgcgtccctggtaacctctaaccagcattcccagacaccagaggcagatagacaggtgggcaggggatctactggggctgggccagcaccattccagagacaaatccagggcacatgcaaactgggggacctctcccttatccccagttctgaccctgggtcaggccatgctacactaaccttccctccccacttcacacttttgctccccccccccnnnccagtccattttacttctttcctctccccttcatcttttcccttccccttactgttccacccaggaggnaggaaacttcacatagctgtcctcacccttttattttaaatgaattttgttggggttgagcagggctgcctatggtctgaaggcttttggtgcttgtccacacacccacctcaacccttcctgcccatcctcccctatctcctttcctcctcctgggttcatgctgtaataaag

SEQ ID NO: 2051 - DNA, 218 bp, Mus musculus
ggctgagaacttagcttaacttgcttgggtccctgacctaatgtgctgatttaaagtatgctgtcccaaaatatcgctgagccaagcagagagctgttttatggcattgtcttgagaaaaccagcgagtgctccagaaagcccttgatggcctagaggtagtgaaggaagaaatcatggaaacatttagactgtactggctggttttatgttgtcaac

SEQ ID NO: 2052 - DNA, 246 bp, Mus musculus
acctgccccagctgtctgtatggttcctgggcctacagccaggcctgtgtggcactcccatgactgatttgacaggtgtcttcccatttggaccttcgtctggccagagaccctgcacatcccactgtcagggtagccaggactcttcccatcctcgtgatcagaggagacttcctcgtcccccttccaataaagcacctatgcccacagtgacagcgtgccatgtgctgccactgggctgtttgt

SEQ ID NO: 2053 - DNA, 450 bp, Mus musculus
gagttcaaggagagcccggctacatgaggtcctgtctcaccttttgcacatcttttattttgccattttgaatttgtagcagcaggatcagctcagtttgcagagactgcagtcttcatatgtgaccatatcatgaagtggcaatttatagagcactcagctttcgcttttactccggtatgaggttatccttgggctccagcatcacctctgaacctccttggcagttggcggctcacatctgtgttctgtgccaccgtgctgctttgtcgttacgcgcctctttcccccacgctctgtacgcttactgatggacgagaatgacgtttctctgctcttgatgtctccattatcagcacagtgcctcacgcagagcagttactgaacagctattggaatgagtgagtgggaatggatggatacactcgcctggcctaactaaagtctatt

SEQ ID NO: 2054 - DNA, 187 bp, Mus musculus
tgggtaaaaccatccgtaaggctgaagccttcctgggaagcacgaagaggctgtgctctttcttggcctctgcttgcatccctgcattaattgtatgtgtgaatcactagagtctcgggactctgtagcctaagaattactgtggtgaggacaaatgccaacagtcagggagttctcggagccaacc

SEQ ID NO: 2055 - DNA, 376 bp, Mus musculus
tggctgaactaacaggtcgtcccatgagagttgttggctggtatcattcccaccctcatataactgtttggccttcacatgttgatgttcgtacacaagccatgtaccaaatgatggatcaaggctttgtaggacttattttttcctgtttcatagaagacaaaaacacaaagactggccgggtactctatacttgcttccaatccatacaagcccaaaaaagctcagagtatgagagaattgaaatcccaatccatattgtacctcatatcactattgggaaagtatgccttgaatctgcagtagagctgccaaaaatcctgtgtcaggaagaacaggatgcatatagaaggattcacagccttacacatctgga

SEQ ID NO: 2056 - DNA, 158 bp, Mus musculus
  misc_feature (45)..(45): n is a, c, g, or t
  misc_feature (120)..(120): n is a, c, g, or t
atgccacagatcttcggtgagcaagtggctcgaacgcagttcctnatgggagtgccaaactacagagaaaacctggaggtcctgttgcacctggctcgggcagaggctgtggcgatgcgntcgtcaaaggtggtggtgtgtgtggtgcgcacggagga

SEQ ID NO: 2057 - DNA, 293 bp, Mus musculus
  misc_feature (161)..(161): n is a, c, g, or t
aggcagacgtgaacttggtgaacgctaagctactggtgaaagaggctggcctcaatgtcaccacctcccacaaccctggggttccaggggagcagggtagcggggaatgcctcctgactgtggccctggcaggtgctccctaccaagccgtgggcttggtnccagggcaccacaccaatgctgcagatgctcaacggagctgtcttcagaccagaggtgccactacgcaggggccaacccctgctcgtattccgggctcagccctccgaccctgggatgctgcccactatgat

SEQ ID NO: 2058 - DNA, 507 bp, Mus musculus
  misc_feature (151)..(151): n is a, c, g, or t
gaacttggtgaacgctaagctactggtgaaagaggctggcctcaatgtcaccacctcccacaaccctggggttccaggggagcagggtagcggggaatgcctcctgactgtggccctggcaggtgctccctaccaagccgtgggcttggtnccagggcaccacaccaatgctgcagatgctcaacggagctgtcttcagaccagaggtgccactacgcaggggccaacccctgctcgtattccgggctcagccctccgaccctgggatgctgcccactatgattggcctcctggcagaggcgggtgtacagctgctgtcctaccaaacctccatggtgtctgacggagagccctggcacgtcatgggcctgtcctccctgctgcccagcctggaaacatggaagcagcatgtattggaggctttccagttctgcttctgaccctggggttcagcactctcagccccacaggctcttctgaagaaacccgctcaactgtgacctatag

SEQ ID NO: 2059 - DNA, 421 bp, Mus musculus
aaggcggtgctgaaaggcgtccacagccacaaaaagaagaagatccgaacgtcacccaccttccggcggcccaagaccctgcggctccggaggcagccaaaatatcctcggaagagtgcgcccaggagaaacaagcttgaccactatgctatcatcaaattcccactgaccacggagtcagccatgaagaaaatagaggacaacaacactcttgtgttcattgtggatgtcaaggccaataagcatcagatcaaacaggctgtcaagaaactctatgacatcgatgtggccaaagtcaataccctgataaggcccgacggagagaagaaggcgtatgttcgcttggctcctgattatgatgccctagatgttgccaacaagattgggatcatctaaactgagtccagatggctaattctaa

SEQ ID NO: 2060 - DNA, 543 bp, Mus musculus
  misc_feature (266)..(267): n is a, c, g, or t
  misc_feature (281)..(281): n is a, c, g, or t
  misc_feature (298)..(298): n is a, c, g, or t
  misc_feature (316)..(317): n is a, c, g, or t
  misc_feature (320)..(320): n is a, c, g, or t
  misc_feature (322)..(322): n is a, c, g, or t
  misc_feature (327)..(327): n is a, c, g, or t
  misc_feature (332)..(332): n is a, c, g, or t
  misc_feature (334)..(334): n is a, c, g, or t
  misc_feature (344)..(344): n is a, c, g, or t
  misc_feature (360)..(360): n is a, c, g, or t
  misc_feature (363)..(363): n is a, c, g, or t
  misc_feature (376)..(376): n is a, c, g, or t
  misc_feature (380)..(380): n is a, c, g, or t
  misc_feature (391)..(391): n is a, c, g, or t
  misc_feature (408)..(408): n is a, c, g, or t
  misc_feature (432)..(432): n is a, c, g, or t
  misc_feature (449)..(450): n is a, c, g, or t
  misc_feature (471)..(471): n is a, c, g, or t
  misc_feature (473)..(473): n is a, c, g, or t
  misc_feature (475)..(475): n is a, c, g, or t
agtggcctgcgtggcacgctgcatctgaccagaaggctggactgtgagcctttccgatggaaggatgtgactctgacgacaacactgatccccacctcagccatggctgagcccctctcagagcgggaatgtctaaaggtctcccgcctgccacacagcactcagctctgccctctcagggcttgaacttgctccgatgccctcggtgactttccccacttggaatggctccctctctttagaaagaggcccctaactaaggcccnngtttttctttaatncagttttcaaaaagagngctggggtgggtggggcnnggntncgganatcantntcccctcagnccctccagaagagaanccntacagggcactgncccntggtacatttntctgacatttcttgagncctcacattggggaggggtcactnccttttttttttttttnnatactgagtatatctaagttntntncgtatttttttattttccctgttatgtgctgtagatggagagtgatgacaatcgtgtaaatgtactag

SEQ ID NO: 2061 - DNA, 289 bp, Mus musculus
  misc_feature (94)..(94): n is a, c, g, or t
agagcttctgaaagtgctttatgcagatgtacggtttcttttagtgacaaactggttattcagagcctgatcgcaatttttgatttaaatcttnttgtttgtttcactgttgtaattcagaatagaacattttcagtcttgtacttaactgttttctgagcagctgaagacaccgtatttcactctgtatctcagtgatagggagtaggtgatggctcttcattctgagcgtggggattgccagcacggtcctaccctgtgctgcagttaaacctgctgtgaggaggaa

SEQ ID NO: 2062 - DNA, 301 bp, Mus musculus
atctccttgggcacttgtcaaatatgctgcttttaaccggcgattctaatgggattgactgactggagacctcacatcatgttcacatttaaccttaaacacctatgcagtcatgttgggggagtgtcccaatgttacctcaacaccacgaagcttatttctatactggagttcttcagtatagaaagtggaagtggtttaaatggcatagtacatatacatatatatatggccttgtaaaacagatttgagaccttgtgaagaaatggatatgttatatatttctgctacctggattttc

SEQ ID NO: 2063 - DNA, 258 bp, Mus musculus
  misc_feature (113)..(117): n is a, c, g, or t
  misc_feature (137)..(139): n is a, c, g, or t
gcaactttaacactgctttactaactatgtctattggttatttcctgccaattagtatgatttcttaaagacagtaagttgtttgcaaattaataaaacagcattcctgtcannnnngtaagtaaagcttaatgaannnatatccctgtggacagctccattagcttgttacattagtggaattctgagtaaagcatgggagactggcaaaccctttgatttctctcagagctgcatgcatctagtatgaaaccctgt

SEQ ID NO: 2064 - DNA, 541 bp, Mus musculus
  misc_feature (201)..(205): n is a, c, g, or t
  misc_feature (308)..(308): n is a, c, g, or t
gcttcagttcctaggatccttttataaatggtaaaaccctggatttacaatttgttaaatactaaatagttcctattaatatgatctatttttgtattttacttagttttaagtgcctgtcattctgaagattatatatttataacccaatggtctcatgcctggacctcatggcactgctatgcaatttggtctcaaacnnnnnagacagcaaagcctttacaacagaacctttctgaaccagctttcattcaaaagcttcaggtcctcttagatgctttctctggctactcactgtgagcaagggnacagttctactagttcctgtttcttctgagccagaccttcctcaaagggaccaattaatttaaaactcacttgaagctcagctggctgtggggctgtctttgaagttctggtttctaccttgatgtttctggttcgtggggtcctggaccaatctccaacccctaattatgaagtaaaggtcttgaaatcatgcagcataaattaattgtaaccatcttcaacaacctgtctt

SEQ ID NO: 2065 - DNA, 483 bp, Mus musculus
  misc_feature (157)..(157): n is a, c, g, or t
  misc_feature (291)..(291): n is a, c, g, or t
gcttctatcagagtgactccacagatgtgagacaacatggggcgtcccaaccacacgtgtaccccaccccaccctgtggcctcttaacctttgtaccatctgattgtctggccaccagggtgccaactcaacccagctccgagcagaggggggtgtngggcagggcccgtcggtgagccatgtttacatgacagtgtgccaaagtgactcgccgagcttgtattgctttgtagtcatctgggctatcccaccctcccaactcctgtttttaaaactaaaaactcccaggangccctgggcgcacacaggcaaaggtggctgtcttctgtggtggtccttgagtctccgtgaagctgaaaatgatggtgtctgtgagtatgttttgcaaattcaaaatatagtttggtaattttttttccagttgatttttaaaaaaacaaaacaaaaaactgctgtacagagcttgtactttgtccattttat

SEQ ID NO: 2066 - DNA, 460 bp, Mus musculus
  misc_feature (32)..(32): n is a, c, g, or t
  misc_feature (340)..(341): n is a, c, g, or t
  misc_feature (343)..(343): n is a, c, g, or t
  misc_feature (347)..(347): n is a, c, g, or t
  misc_feature (397)..(397): n is a, c, g, or t
gcacacttcccaaaagtagccgaaatgttganaagcctgtttcaactagtagtaagaaagatgcaccaaggaagccagctgcagccgaccttgaaagtcagcagaaatcttacggcctgaacttggctgttcagaatggaccagttaaaagcaatgggcaggaaggacccttgctagctaccgacgtcactggtaatgttaggactgggttatggaaacacgaaacaactgtgtagcattgcaggggcttccaagacaaggtgaaactgtggtactcacattcctttaagctatgaactcttagaaacaaactgtttacagccaccttggggatacaaanncngttntgagtattcttgtgagctttgggatttacttattttatattcccaaattntcccccactccccccaagagttaaaaatgttttaaaacattgttttacttgtcaaagcaccaa

SEQ ID NO: 2067 - DNA, 312 bp, Mus musculus
gcagcttaacaacacttgatttcagatgattaggtttttgtttctgagacccagcacctgtatatttaaaaattgttccagattacaccttcactatcaaatgagtaaatgactcatgcctgcagacatgtcctgatggtggcaagaacagaaggatctttgactgaaggagaaaaactgtcattgtcatcccagcccccaggaaagaacacctccaaggcaggcaggcaggcaggcaggcatggtggttctagttgaatacacattcaagtcttgcagtggtgctttagatctgtgtagcatgtgaggctc

SEQ ID NO: 2068 - DNA, 446 bp, Mus musculus
  misc_feature (59)..(59): n is a, c, g, or t
  misc_feature (284)..(284): n is a, c, g, or t
agtgtttacagctttgccatgtccccacctgctggcctcaggctgcctgggcctggccnagctatccttctctatgcaaatgcgtcaaagccatgactgctggaacccaaaactgacaaggtttattttttccagagccggtggctggtcttccatttacagtgtcactattccttgatggagcagttatgtgcccgctctggtgatggccccagccagtgatgctaggcctaattgttcatcatcaagccggcgactcatgtggtgcctgccctaggcgtggncctgcggtctggcagatccgtgctacagaattcgcctggttcctctctattttaatttttctaacctagagcttaatttcaataactttttcaacagttctaaatttttatttttggcaccagtataaagacaaataatatctatcgctcccattattttca

SEQ ID NO: 2069 - DNA, 336 bp, Mus musculus
  misc_feature (70)..(70): n is a, c, g, or t
  misc_feature (96)..(96): n is a, c, g, or t
  misc_feature (132)..(132): n is a, c, g, or t
  misc_feature (171)..(171): n is a, c, g, or t
gaagaatgcgccctggaaacctggccccagcccagcatgcacacacccatcaatggctctctcccttccntgctacttctgcccagaggggaggtntccagagtgctgttccccctggatacacggctctcngtgataccccccagactcctcagactctccagccccttnccactgtgaacactcctccatgtcaggccaggctcgccaagctggatgaagatgagctgtaaccccaaaagtgcagtgctattggcgcaggcatgattcctcaatgaatttggagggggaatcctggaaatgtgccagaatccatcctccatgatgtatagagga

SEQ ID NO: 2070 - DNA, 372 bp, Mus musculus
ttggttccgggctctgccgaaagaggagtgggatacggctgtgagagggccgaggttgagtcttgctcacccagaagaccaaggacatcaggtgcagtgatgcggacgtgcagggaaaagactctgctggtcaggccctgactgggacctgttcacacagaatctctcccttcagacaggagggttaccacagctgcctgcagtgtggccacccctgtgctcagaggagaaaggctgggtgctcctcttacctgagcccttccatcaggattaaatctgcagccctttccccactgtgtgcagctactgggcagggtgcccagtgtggcctggtggcaaaggccaattcagagcacttctcagactccattt

SEQ ID NO: 2071 - DNA, 401 bp, Mus musculus
gggttggtttttgcccatctacattttgcatctgctttccccagtaccagtcatagaaaactaaacataattctcagtttgaaacttgaaggggggttgaggggcagggaaacaacacaataaagccctagtgtggacgccttaggttggtcctgaggtaaaaatccccaagcccttgtgagatggaagccttagagaaccacctcgaagcacaagctgtgcacagagataaactgacactttgtctacattcaaaggaaattccatgagcattctttttaatttaggaaaattagtatctaattttctattcttagatcttattatctaagaatacaaatcatcaacaaatgtggacgacattctgcgaagttagatgctagctctgtagggttccttaa

SEQ ID NO: 2072 - DNA, 360 bp, Mus musculus
aggaatgcagtctctggcagggaaatgtttttcactgcccttggaacctgtgttgttcatgtccaagagtccaaagaaagggctgatttcctgaggctggggtcagcccctggtacatgcaggcccttgctttcttcgaaggaccagctggccttctctgtctcctttgccgttcatattttcctctgggccattgctgtatgctctttgtgtcaggacaaggaagagggcaggttggaaaggcacaattggatgcatctagtagtgtatacaagtcccttttaagattctggctctggtcctgctgtgttctcacggtgccagccacaggtgaccgagtttcagcagcggagtcctgtt

SEQ ID NO: 2073 - DNA, 412 bp, Mus musculus
  misc_feature (58)..(58): n is a, c, g, or t
  misc_feature (149)..(149): n is a, c, g, or t
gcactctctgacttcaatttcactaatgtaattattttctcgggaattcttttagatntaaattaccatcatattaacttttcttatacaaagccagcgtttgttctctcaccagactccatgccagatccatcataagaaagctcagnctaagtaattcaaatagtgcttacaactttagggggagggagggtagcattcagtcaatactccaactggttgtttatgcacaaggctacagtcagaacatagaaaaaaaacattctgtgaatgaaacattgtatgttcagattttataaaagacatttttaaaagcccaatttacagccgtatattttcttatgatgtaatttatgaaaaagctgtctgtactaacaggtgctgtaacactactgtcgttgggttttgttgt

SEQ ID NO: 2074 - DNA, 180 bp, Mus musculus
actagcaactctgtcatctttttctaaaaatgaccaactgctgattacagctcaaacggaaccaaatgtttgcgtttctgtttttgttgtcatttatttgacaagttagcctctatgagccaaatagagggggagatgtgtgaacctggagcaccgagtggctacatccacagcctcttt

SEQ ID NO: 2075 - DNA, 562 bp, Mus musculus
  misc_feature (386)..(386): n is a, c, g, or t
  misc_feature (388)..(388): n is a, c, g, or t
  misc_feature (441)..(441): n is a, c, g, or t
  misc_feature (513)..(513): n is a, c, g, or t
tgtttggtctcatcgggagtcctgccactaggcatttgaacaataggacacgtgtcgtggcctttatcaaaatgtttacaaaaatcatttaaattggtactctgatgattgaatccaaaatcttcttacctgtgttttcatctaactgctggaattagtgcagcaccttgtatcttatattttgggaagagggaaaaggtagggattggtttgacgtttaggtacgtagatgacgatgccttacccttgtatatgtttaagtcatgtgggctggcgtgtagagagatttcctaagactcctatctcatgcttgtagtccttgccagggtcacactcacacccctttctggtcccttttggaagggctaaagggtcaggccagccantnttcctttcttgttggtaaggtgaatatatttattactaaactggtctcgagtntaagaacaggcaagccctggttgccgtgacaatacaactcaatcccagagagactaaaagcctccatacatntcaagttggagaaatagactttggggacttggcatgatggctgtcaatt

SEQ ID NO: 2076 - DNA, 441 bp, Mus musculus
ttcttgatcactttcaggacagcttgcctggacagcacacagaccttcagctcggagtgctcaggtggcaagcccgtggaggtgtgggggtactgtaaagggaagagtccattactggctgtccagcttctaatttctaaagctgacacaatttgcatttcataaatacatagtttacagaaccatttgcagcctcaattttctttgtgcttgttatataaattatttttcaaactgtatagattcatgataaaattatcttggttcctctctcttttaccgtgagaggaaaagacttcatttttatcttatacctaatttttttaaaaccccgtgatgacattaaacagaattttttttccaacataagatctgcacagcagacttttaaaaagcctgaaatctgtctggtagaacaatttgtgttctccttttttcata

SEQ ID NO: 2077 - DNA, 566 bp, Mus musculus
  misc_feature (324)..(324): n is a, c, g, or t
  misc_feature (338)..(338): n is a, c, g, or t
  misc_feature (399)..(399): n is a, c, g, or t
agccctctaaggattcctgcatcttcctgaccggccggctctgcctccttacaccccattctggggccttggaggcaaaagggcagattggagcccagcactggacttgaggggcccagccccaagagtgtatgagggtgtgtggggacccatgagggtgaggagctgttgcagccaggcctatggggtccactccccaaacacaccctcctttgcccctttagctttttcctgtcccccaacttcttagcacttaaccccactctacccagagacttgatgagaccttgtgagtggtggtggcaggaacagcagggctgtgcnggtccccgaccccncctctccctatcctacctccattccctgttgctgtttgggagctgttgcccctcccttggnaacgcctacttcctgtctctgctgtctcccggtacctgtgcttctgagcccagactatctcttgtcactgaggggatgggagacctttcatatcacctcacaaacaatcccagcaaaaagggttggagatggagcacccccttgttcttcagcaatcaggtttctaa

SEQ ID NO: 2078 - DNA, 261 bp, Mus musculus
  misc_feature (233)..(233): n is a, c, g, or t
gaacaggacctgaaccacgaggccgcagcagatccagctccaagccctcccaatgattttcagaataacgtgcaggtgaaactcatccggagtcccgcagacttgattcgactgattgaggagctgaaagctgcagaaaaggggaagccaagcgtaaggcgggagcagcctggagacgataccacggaggccccccagagggaagcagagggaacgaaggcgaagggaaaggntggtgagcccccgggtcttatggaagag

SEQ ID NO: 2079 - DNA, 505 bp, Mus musculus
agagaccaccctcttggcaggacaactgcctgctgctagggtctgctgctaaggtcaacccatcaccaggaactgtcactggggacaaaagagtgttcccacaaccttctcttctgctatttaattcaactggtggtgggacccaggctacccctaataccacccattcctaccttgtcacctcttcccaagccttatacctccacccatccccccaccatggtgcagatagtgccaccctcaacgtgggctatgtgggaaccattgtccctgcctcagggtcattgtgccaccacagctagggtgtgccatccaccattcagttctttgcctctgggatcagccaggaccctcagagctgaagcaggcaggacctgagggcaggagcgccagatgatgaagtcggaggcgctgaagccttccctgcctatcctgcctcaccctctgactcaaggggctgcttgtttccagccactctaggtggctcccaagtgtgagttgttca

SEQ ID NO: 2080 - DNA, 415 bp, Mus musculus
tatttcgagcggacctcatgggactcttttccactgtgagatcaacagggaagccagcggaaagatacagagcatgttagagaagtcggacaggtggtggtacgaatacaattcctctgtggcctgctggactgctggaaccagaccagcctaaggtgtagagttgactttggacaatcctgagtgtggagccgagtgcagttttccctgagatacctgtcgtgaaaaggtttatgggacagtttttcagaaagatgcattgactctgaagttctctctgttgagagcgtcttcagttggaagacttggaactgtgaatacacttcctgaaggggagggagaagggaggttgctcccttgctgtttaaaggctacaatcagagcagcttttggctgcttaactgtgaactatggc

SEQ ID NO: 2081 - DNA, 255 bp, Mus musculus
atgtcagaggatgttcaagcgcagagattaccttaagcagcacatgaagactcacgccccggaaagggatgtgtaccgctgtccgcggcaaggctgcggaagaacctacacaaccgtgttcaacctgcagagccacattctctccttccacgaggaaaagcgcccatttgtgtgtgagcacgctggctgtggcaagacattcgcaatgaaacagagtctcatgaggcacagtgtcgtgcacgatcccgacaagaa

SEQ ID NO: 2082 - DNA, 327 bp, Mus musculus
  misc_feature (172)..(173): n is a, c, g, or t
gacttggagccatggacacgtggatggcccagccagccagccgcctggactgcaggggggcggcagcagcagtggcggcagtggcagtgggtgcctgtagtgcgatgtgtcttgagctaataaagtggctgatgaggcaggatggcttggggctgcctgggccccccccccnntccaggatgctgccaagtgtctctctcctccccccagggcacagagatatatataaagtcttgaaatttggtgtgtctttgcggggggaagggcactaccgcctgcctctagggtccttttttattttctgaaatcactcttgggactgccgtc

SEQ ID NO: 2083 - DNA, 95 bp, Mus musculus
cttcctggtagttgtaatgaccactcccataagggctataactgttcttcacaggtggccctgctcaaaatacatcctctcttttcccgttctat

SEQ ID NO: 2084 - DNA, 509 bp, Mus musculus
gaaacagctccagagtcctagtgtggcctatgggacagctgcctggcacctctgcaaacaaaagtgaccctgcggtgacagaagaggtaagcgtggctgtgagcagcataccaaagagctcagaagcactctctccgaagccacccgggcagagcctgtgctggcggcgcccatgcaggggctgatgacactgggcatcctaatgctgactccagaggtcaaactgtcttactgttgctttatgttgggaaccaattctaaaaccaaaaatgcctaactttacttaaggaaaggacattaatttctactgacagaagatgaaaactgttcaacatgtttttcaacaagatcctcttgctgtagcagtaacctcaagcaattaaaacttggtgtcgagacaaaactaaaccctttgtgcctaaatccaactgctgagcctaagcaggctgagcaggttgactggatcctgcccaacagagtggatgtaaagggctctctgactgctaaat

SEQ ID NO: 2085 - DNA, 482 bp, Mus musculus
  misc_feature (181)..(181): n is a, c, g, or t
  misc_feature (186)..(186): n is a, c, g, or t
  misc_feature (208)..(208): n is a, c, g, or t
  misc_feature (290)..(290): n is a, c, g, or t
  misc_feature (374)..(374): n is a, c, g, or t
  misc_feature (376)..(376): n is a, c, g, or t
tggcatcctactgttcaggttaaaacaaagaaagccttctgaacataactgaagggaaaagcactttacgttggcctctgtattcctgtcagttagttggttaggaatggcaataacctttgggcctcaaggtttcctcagctctagaaagaacacgtgtctaaccagcagatccaggttngcagncagtgcctgagcccatgagganataggttataaagccatcaggtaaggagcaagtagaaaattccagctgattggcaggtctcccctctgacagacagccaaantggggcaggttccaggatcctgattggtcgagtgctggaggaggcagagccagagccacacccacaggagcatggaccatcccncnctccccccatcacccaaggtttccactctgttcactagcttctgcttgcactacagagtccactccctgtccttgatcctgagtcacagagttgggccttgtagga

SEQ ID NO: 2086 - DNA, 562 bp, Mus musculus
ccgttttgaactgcacgaggaccaacgtgcagaaatgtctccccaggctcaaggtcttggtgtggatggtgcctgcaggccctgcagtgatgccgagctcctcctggctgcatgcaccagtgattttgtgatccacgggaccatccatggggtcgcccatgacacagagctgcaagaatcagtcatcactgtggtggttgctcgtgtcatccgccagacactgccactgttcaaggaagggagctcggagggccaaggccgggcctccattcgtaccttgctgcgctgtggtgtgcgtcctggcccaggctccttcctcttcatgggctggagccgatttggcgaagcttggctgggctgtgctccccgcttccaagagttcagccgtgtctattcagctgctctcacgacccatctcaacccatgtgagatggcactggactgagagacctgggagcaagccctggatggaccttcttctggagatggggtgttggggagggtgatgggagggtgggtgagaagggtgtggctcggatggcatcctggtacccacagtgag

SEQ ID NO: 2087 - DNA, 488 bp, Mus musculus
  misc_feature (110)..(110): n is a, c, g, or t
tgaccagtgagctcatgttttcctcgaattccagggtgctgctggggttcagagcaaccgtgccgtagtttggaagacttgagctaattgttttttttttgtttgttttnttgtttgtttaaaggtggcctggggggggcggcaaacagacagacatcactttcagctccttacgaggcctttagggaggggttctttagtctggcaccgcgccattcccttccatggtccttgtgagccatacagtcatccttggcccggtcccgcccttggggaagaatgggcccctctgtccggaggcccctgagacgtgctgagcatccagacatggcagagagcctgcagggtgtggggtctcctctgcaggatcctgcttgttcgtttccggcgggagaaatggacaatggggtctctaaagactgtttcccgccactggccccattgttgctatgcctgcctttctcctgggcctcattatttcgcaaaag

SEQ ID NO: 2088 - DNA, 566 bp, Mus musculus
  misc_feature (245)..(245): n is a, c, g, or t
  misc_feature (318)..(318): n is a, c, g, or t
  misc_feature (332)..(334): n is a, c, g, or t
  misc_feature (350)..(350): n is a, c, g, or t
  misc_feature (366)..(367): n is a, c, g, or t
  misc_feature (379)..(379): n is a, c, g, or t
  misc_feature (382)..(382): n is a, c, g, or t
  misc_feature (394)..(394): n is a, c, g, or t
  misc_feature (401)..(401): n is a, c, g, or t
  misc_feature (409)..(409): n is a, c, g, or t
  misc_feature (413)..(414): n is a, c, g, or t
  misc_feature (417)..(417): n is a, c, g, or t
  misc_feature (422)..(422): n is a, c, g, or t
  misc_feature (424)..(424): n is a, c, g, or t
  misc_feature (479)..(479): n is a, c, g, or t
  misc_feature (481)..(481): n is a, c, g, or t
tagcaatgggactagtgcccactgtggggacagaggagggttggggggctcctctgctggccgctgctggggcctatgggctgagcgctgggagttatgccccactggttttcggtgtgctcccggggctggtgggcattggaggtgtggtgcaggccacagggctggtgatgatgctgatgagcctcgggggactcctgggccctcctctgtcaggtaagggctgagctcgcggattcgctcangactctcttctgcccctgagatgccaagcttctaaattcctttcccctcttctcaggcttcctaagggataanacaggagacttcannncctctttcctggtgtncagctctttcatcctnntctggcagtttnatntacatggggctncccaganccctcccntccnnccntccancntcacctccagcaacccctccaccagagagaggggagctgctcccagttccacaantntccctgctttccgcagggggtactggctccatccgggataccacttgttgatcattttcttggttgacctccttccctaataaag

SEQ ID NO: 2089 - DNA, 514 bp, Mus musculus
  misc_feature (361)..(361): n is a, c, g, or t
  misc_feature (434)..(434): n is a, c, g, or t
  misc_feature (439)..(439): n is a, c, g, or t
ttcgtgtttttcgacctcttcaatgccctgagctgtcgctctcagaccaagctgatatttgagattggctttttccggaaccgcatgttcctgtactcagtccttgggtccctcctggggcagctggccgtgatctatgccccgcccctacaaaaggtcttccagactgaaaacctgagcgcgctcgacctgctgctgctgacgggcctggcctcgtctgtcttcattctgtcggagctgctcaagctctgggaaaagttcttgtccagagccaggcccactcagatgctcccggaagctgtgtaacggaaccagtgtgtcaaggccctgactgacctgtgtgcttgggtgcctctggccntgtccccatccatctgtactaaccactccaaggggcaattctcaggaccgtgcagcatcggacgctggctccnacctntcctcctggcctgctgggccatgtcccgcacaggacagggtggagcttattatactgaaacgtggcgctatttat

SEQ ID NO: 2090 - DNA, 445 bp, Mus musculus
  misc_feature (402)..(402): n is a, c, g, or t
gtatcttgtgaagtcatcgatctgcggacaattgtgccttgggatgtggatacagtttgcaagtctgtgatcaaaaccgggcgactgttgatcagccacgaggctcccttaacaggcggctttgcctctgagatcagctccacggtccaggaagaatgtttcttgaacctagaggctccaatatctcgagtttgcggatatgacaccccgtttcctcacatctttgagcccttttatatcccagacaaatggaagtgctacgatgcccttcgcaagatgatcaactattgacgacagagaaaaccaggaagatcatgaccagacatggaaatatttttctgaaacctttttatatttccttatacttctttcttcttacatatagttttatgcaacgaactntcatggatattggctgatgagctgcgaattacttatcatgtta

SEQ ID NO: 2091 - DNA, 231 bp, Mus musculus
  misc_feature (47)..(47): n is a, c, g, or t
atatagttctggaggaggctccagaggtggctccagctcaggaggancaggatctagctctgaaaagggaggttctgggtcaggggaaggttgtggctcaggtgtgaccttctcctttagatagagatatgtcttttctctctactcttggattccagaatgtcagctgttatctctgtatctctaactctgattaaccccaatatttgtaatccacctgatgtgattttt

SEQ ID NO: 2092 - DNA, 333 bp, Mus musculus
  misc_feature (97)..(97): n is a, c, g, or t
gcttggccaccggaaacatttagcggctcaccatcgaaggcggctccggaagcctcaggacaggaagaggcaagtatcccccagtctgcctgatgcnatgctggaagtggatcgcggggtcccagctcctgcatccaagcggcccctgaccctcttctttctccttctcttcctccttctggtgggtgccacgctgttgctgcccttgtcgggggtctcctgctgttctcatgcccggctggctaggacgccctacctggtgctcagttatgtcaatggtctccctccaatctgagcccaccatccaagacacgtgcattaaatggtcacttt

SEQ ID NO: 2093 - DNA, 108 bp, Mus musculus
aaggctacaccaaagcactcactagcccgattatggtttgggttttgaggcagcccaggaaagacagtgctaaggttcagctccgacgcttgtctgttcagactcacg

SEQ ID NO: 2094 - DNA, 377 bp, Mus musculus
  misc_feature (282)..(282): n is a, c, g, or t
gaatgttgccaaaacaactctgtagttgtcctgtgtcatggtgaagaaagatggcttttggctagaaccttcattctgagggtagcaaaggacatcaaatcccattgatgagaaagatggaaaatgcatccggtttcctcagaaattctgaactcttgagtacaataaaatgatgtctttatttttctgatacttcgctgctgtgatactatgcagacaagtgtcttctccatgcgccattttcaaagaaaagtcatttgccaaataattctggtacaattntgctaatgtgcttttggatcttagaaaccaactttctaatggtaacataaatattccatgtaacaaactgattctgtggtcaaatggttcatctc

SEQ ID NO: 2095 - DNA, 314 bp, Mus musculus
gacagccccagatctaagcggtgtgggaatctgagtacctgcatgctgggcacgtacacacaagacctcaacaagtttcacaccttcccccaaacttcaattggggttgaagcacctggcaagaaaagggatgtggccaaggacttggagacaaaccaccaatcccattttggcaactaagctccttctctcctttctagtttccttcttgctttcttcctataacttgatgcatgtagttcctctctggttgctctccaggctattactggttgctttcctgaggcaaagaatggtatctgaaatccccagtg

SEQ ID NO: 2096 - DNA, 212 bp, Mus musculus
  misc_feature (71)..(71): n is a, c, g, or t
  misc_feature (77)..(77): n is a, c, g, or t
  misc_feature (79)..(79): n is a, c, g, or t
  misc_feature (82)..(82): n is a, c, g, or t
  misc_feature (85)..(85): n is a, c, g, or t
ttcagtaagtgaggcccaccagcatgtggctggctgacattctgtgaaccatggtctaccttgccccgtgntagctnanccntcntcccttttgaaagctgccagtgtcaggcccttcccaaaccctctgactggtcaaccagtgggcgctcaggaatctagagtaggggtgaagaggatgcctaagggaaccaaccaaaagtctcaaatca

SEQ ID NO: 2097 - DNA, 461 bp, Mus musculus
  misc_feature (63)..(63): n is a, c, g, or t
  misc_feature (93)..(93): n is a, c, g, or t
  misc_feature (95)..(96): n is a, c, g, or t
tgtggcgatctctgcgtctctggtactgcccctgctgtcaacacaagagtgtgcagcgccccntgcagcggaaacgtggtggtgggcaccccnanngcctgcgccccctgcgccggggcaggcgcctgcagcggaggctgtaagaagtgctaggaggtcacaatgctgcaagccactggcacgggctaccctgcccgaagggacagcacagcgggacagtggcctcggcgcctttatttcaatctgtagctttccctagcaacttgttcctagagttcttgctttctttccctttctgcctttttgctggattcattggtcttaggatcttggaggatccgctgccccaggatcctctttgtctgactttacccgggtccttagcacgcttttgcctgggcaaggagacatggatccacatggttgcctgctttcctgacactccgctagaaaccacgtga

SEQ ID NO: 2098 - DNA, 269 bp, Mus musculus
  misc_feature (171)..(171): n is a, c, g, or t
  misc_feature (241)..(241): n is a, c, g, or t
agagaagaatgtcctgaagatcagcgactttgggatgtcccgcgaagaagctgatgggatctatgccgcctcagcgggcctcagacaagtccctgttaagtggactgcccctgaggcccttaactacggacgctactcctcagagagtgatgtgtggagctttggcatttngctgtgggagaccttcagcctgggggcctcaccctatcccaacctcaccaatcagcagacacgggagttngtagaaaaggggcatcgtctgccttgcc

SEQ ID NO: 2099 - DNA, 494 bp, Mus musculus
  misc_feature (423)..(423): n is a, c, g, or t
  misc_feature (436)..(436): n is a, c, g, or t
  misc_feature (452)..(452): n is a, c, g, or t
aacaacctattcaaggatgaaccatctgctcagcaccgatttgtcagcaaagccatccctcaccctggcttcaacatgagcctcatgaggaagcacatccgattccttgagtatgactacagcaatgacctgatgctgctccgcctcagcaagcctgctgacatcacagatactgtgaagcccatcaccctgcccactgaggagcccaagctggggagcacatgcctagcctcaggctggggcagcattacacccaccaaattccaattcacagatgatctctactgtgtgaacctcaagctcctgcctaatgaggactgtgccaaagcccacatagagaaggtgacagatgccatgctgtgtgcaggagagatggatggaggcaaagacacttgcaagggtgactcaggaggcccactgatntgtgatggtgttntccaaggtatcacatnatggggccataccccatgcggtgaacctgatatgccaggcgt

SEQ ID NO: 2100 - DNA, 532 bp, Mus musculus
  misc_feature (118)..(118): n is a, c, g, or t
  misc_feature (154)..(154): n is a, c, g, or t
  misc_feature (309)..(309): n is a, c, g, or t
  misc_feature (354)..(354): n is a, c, g, or t
  misc_feature (372)..(372): n is a, c, g, or t
acactccctgaccttataatcttattagttatgcttaaatgagtgcagggctcttattctgtaattctcttactatctgtgctgataaacgctggtttcctccatctctggctcaagnaccagattttcgggtggctcctgtagtatgtctcanctgtgagaaatgttctaatttctatttaggaactctgcatatacatctctatttaatcaggagtctcttgctgttagagatgtatgtattttgaactgtatttaattttctagtgcatgttatctactgtttgatacttgacaaatctttgcaantttagtctttccatttctacctgtgacatacagaagatctcttgnaaacttctactgtcccanttcccaaatcatgctagcctatgctgtatcaaaactatgaatatttcttttatggagatttagtgatatacatgtaaatgttttttaagttattttattgaacttcaatatttacatgaacgtataatccttttttaaagtctccgtgccagaactgtat

SEQ ID NO: 2101 - DNA, 289 bp, Mus musculus
aagcatttaaagcaccttctatcaacaaaaatttttcttctgtaaatatcagttaggtaatatttattttatatattcctatgagaaaatgatcattgtaatgttgacatttgtgatgatttgtcagcctgtacatcttaacttattatgatttaatcacctaaaattgatacattgtcttgatttataggaaggtatctaaatgtgagagatttccaactgttccattgtgttctatatagagctacagccaatgcactcttgaatttctcaggagcattgcaaggca

SEQ ID NO: 2102 - DNA, 475 bp, Mus musculus
  misc_feature (124)..(124): n is a, c, g, or t
  misc_feature (322)..(322): n is a, c, g, or t
  misc_feature (326)..(329): n is a, c, g, or t
  misc_feature (331)..(335): n is a, c, g, or t
  misc_feature (337)..(339): n is a, c, g, or t
tccctattcttgtatactgaactatacacaaaggcacttgtgtggccagtgggtgcggtcagaaaggagtacaggctcacgtgactcagctacaagctgagacagctgctgctattaggaaaancaatggaagccagcagtatgtagatttagggagctgacaaatcctgaaaatgaataaaatgagctgggtacttccagaaacacgatacttcttgaccatgaaaaggaaaaaggctgggtttttatgttaaaatttgaatttttgcaaaatgtacttataatcttcccattaaagatgctgataaatagtaaagttaanaaannnnannnnnannngggaattatataatgaaatatgtcaatgtttggaggtctctgtaataatgttataaatcatagaagacttgtttaaaatataagaaagggttggagtgtggctcagtgggagagcacttgccaagaccctgagttc

SEQ ID NO: 2103 - DNA, 283 bp, Mus musculus
  misc_feature (97)..(97): n is a, c, g, or t
  misc_feature (112)..(112): n is a, c, g, or t
  misc_feature (258)..(258): n is a, c, g, or t
cccatagcagagctcagatgccagagaaccctgtccagcagactcagtgtacaaatgggtgaaccaaggcccatgagtgactcacccaaggtgagtntgagacagccctccntacaagctccccatcaccccccccacacacacacacacacacacacacctgtggttgtacaccatgcttttcaaactgtgctccacaggccactggggaaccttgcctggatggcagcagtaaaggtggctggagggatccccagntccccttcaatcacagaggtctgtt

SEQ ID NO: 2104 - DNA, 451 bp, Mus musculus
  misc_feature (77)..(78): n is a, c, g, or t
  misc_feature (116)..(116): n is a, c, g, or t
actaggccatcccttactattgatttacgcttgccccctttctgcccatcttcaaggttattttcatttctcttccnnacacaagacaactctagaaatgttcagttgcagatttnacgttgttattttatttagtaattaaaatcttcaaagataaatattaatatatgcagatggaaaataggatatttctgagcacaggggtctatgcagggaaccctgactctctgaaacatgagggagaaaaccagtttcttatatattaatggctttaatatgaattatactaaaatcaatctatttaaaaatccagctcttgtaattaagaaacaagagtcttttgctctggtatcccttagaaggcatgaaaatatgtgagtgtgttgatgtctgcagtctctgttcagctctacagaagtgttctttgtgcatctagtgcttacctaaaatt

SEQ ID NO: 2105 - DNA, 547 bp, Mus musculus
  misc_feature (178)..(180): n is a, c, g, or t
  misc_feature (183)..(186): n is a, c, g, or t
  misc_feature (189)..(193): n is a, c, g, or t
  misc_feature (195)..(195): n is a, c, g, or t
  misc_feature (197)..(197): n is a, c, g, or t
  misc_feature (201)..(203): n is a, c, g, or t
  misc_feature (221)..(221): n is a, c, g, or t
agtaattcgttgcttcttattcccaatgttttacttgtgtttatgtgtttcagtgttttgtttgctttcttatctgtgcatcatgtccacgatggtgcttgtggagaccagaagagggcgtcaggttcctgtgggactgcacttacagagttggagctactatctgggtgctaggaannnaannnngannnnntngnagannngccagtgctcttacctgntaagtcagctccccatccctcaaatctgattttaaagatcattttggaggcagttatggtgataatatacatggactctcagcactgagaaggttaaagcagtaggatcttgaggttaaggctaccctggaccgtttggtaatctttttcctttacctcctcttcccctctcattgttaataaccccaggtcggagaggtggctcattgcctgctctgcagaggacccaggcttgattcccagcacccatagataaagaggtttacaagtatttacatccatttcctgggtgtccaacaccgtctcctgctgtacatgcagacatt

SEQ ID NO: 2106 - DNA, 437 bp, Mus musculus
  misc_feature (54)..(54): n is a, c, g, or t
  misc_feature (59)..(59): n is a, c, g, or t
  misc_feature (399)..(399): n is a, c, g, or t
tagctggctggtaatgggctgcttcttcctcccagtctgtttcctcagaggagnattcntcacttgcttcagagctactaagagctggcttcctgagctcatctagtgacgagtatctcctagagacctccgctaatcgatcttttttcttctccctttttcctctttttcttctaatctctctccaggtattcctacctaaccttaacttttcctcgggttcaagacccttggaaaggcctgtatacttattttgtgtaccatacttcctctttgttcctactctctctccccgctttacttctgatagattgtcctgaatttcctctagaattttcagccctatcttaatcacttgatagcatgtgaaaaagaacaaaagggctcctaacaccaganaaaattcaaggccaaacatactcactggtactctcgtt

SEQ ID NO: 2107 - DNA, 489 bp, Mus musculus
  misc_feature (169)..(169): n is a, c, g, or t
  misc_feature (190)..(190): n is a, c, g, or t
  misc_feature (213)..(213): n is a, c, g, or t
  misc_feature (216)..(216): n is a, c, g, or t
  misc_feature (360)..(404): n is a, c, g, or t
agatgtatgccaccctataaggctattttccaaaatgactgactccaggttcatctgaagagctcagagtccttccactcaatgctgccaaagactgggacttcctgtctaagactttgctgttttagcctcactaaagtttcctcaagatgaaaagtccagtagactnctgcataaaaatttatttttntacgtgtgaagacactgaggatnctntactggttgtttccacttttatttcactgtgtgagttattgttgtagcagtagactccaacccctcaggcttctggaaccctgtttggtttgatatgttttctatggctaaaaatattgtgactattaaaaccagaaatgaacnnnnnnnnnnnnnnnnnnnnnnnnnnnnnnnnnnnnnnnnnnnnntcagttttaaagctgatgaggagattgcaagaaacttaaagcttaagataacgtttctaatgctcatactgaatggtccatctaa

SEQ ID NO: 2108 - DNA, 541 bp, Mus musculus
  misc_feature (30)..(30): n is a, c, g, or t
  misc_feature (41)..(41): n is a, c, g, or t
  misc_feature (50)..(50): n is a, c, g, or t
  misc_feature (86)..(86): n is a, c, g, or t
  misc_feature (372)..(410): n is a, c, g, or t
aaaatgggcagactccaggccactgaaagnccttgtctcanaacataagncagttagtaatgtggttgctgtccaagcataacaanacggttcagtttttgttgttagttaagtgtttgctgcccaaacataaggaaatggttaagttaataaagtgtttgctgcccaagtgtagacatccaagtttacaccccccaccccccgcagaatctatataaaacctggacatggcagtacgcgtctgtaaactcactgctcggggtagagaaagtggatgctatcggcttgcttgctagacagtctagttgaaatgctggccttcacgttctatgagagaccaccaaaaataaaacagaaatgattgagaaagannnnnnnnnnnnnnnnnnnnnnnnnnnnnnnnnnnnnnngtgtcatgtattgtgtgcatacctgaacgcacaccatcacacctaacccatatgtaaacaaagataactgactaccacctaaggaatggtgcccaaggctagcctcttggcctccaaatacagatgcatat

SEQ ID NO: 2109 - DNA, 542 bp, Mus musculus
ggtacagtgcacaggctttagttgattgtaaaaaattatgtgcttttactgtgtagaatggagaaaagaaaagaaaaaggaaaaaaattaaagctgttaagagctttgctaatgctggtctttctgccaccccatccacacatactgattaaccataacataattttcaacatctgttaatgtttttgctgctgtttgtgtgcataaatatgtctcttcctagcctccaacctaaaaatggataaagtggatattaaaaatgaatatcagtgaacatggactgtaaccatatctctggaaattatgcttttgtcattttttatgtaattgggcaaagatatgagtttgttctcttagggaacacttgtccataagactaaacgtgatgactaattgaaaggtcgtggttatatttcataaaatggaatagaatatgtatagtccttttcttaaaagcaagtttttgtgccttttttcattggtcaggttagtattgctcaaaaaccacttttaaggattttagtgacttgaccttgtgacct

SEQ ID NO: 2110 - DNA, 567 bp, Mus musculus
  misc_feature (57)..(61): n is a, c, g, or t
  misc_feature (94)..(94): n is a, c, g, or t
  misc_feature (111)..(111): n is a, c, g, or t
  misc_feature (254)..(254): n is a, c, g, or t
  misc_feature (256)..(258): n is a, c, g, or t
  misc_feature (260)..(263): n is a, c, g, or t
  misc_feature (265)..(265): n is a, c, g, or t
  misc_feature (267)..(274): n is a, c, g, or t
  misc_feature (343)..(344): n is a, c, g, or t
  misc_feature (380)..(380): n is a, c, g, or t
  misc_feature (382)..(382): n is a, c, g, or t
  misc_feature (385)..(385): n is a, c, g, or t
  misc_feature (422)..(422): n is a, c, g, or t
  misc_feature (456)..(456): n is a, c, g, or t
  misc_feature (461)..(461): n is a, c, g, or t
  misc_feature (463)..(463): n is a, c, g, or t
  misc_feature (469)..(469): n is a, c, g, or t
  misc_feature (494)..(494): n is a, c, g, or t
  misc_feature (502)..(503): n is a, c, g, or t
  misc_feature (530)..(530): n is a, c, g, or t
gagccagcaggttccaggctggattggggaggctacatctcctcccatttgttatcnnnnnaaaaaaaaaaaaaaaaaaaaagggaagggctgncctgaggcaaaaaactnatttatgctcaatagttctgcctgaattcttagggctaaagaaaaaaacctgcctccgtgggaattccctaacttttcttatggcaaactgtattttataagtttgactgaacaaatttgaaatacactttattaagaataanannnannnnanannnnnnnncatttttggatgacaggcgggaaacagggagaaggggtatgaccggctccatagtacagggccaattgnntttttttatttgggtgggaggcagtgaagggcttgncnttncaacagtgcggtctccaacctctctccccccaattgnatatgttcaataaggcaacgcttaactgaggtgntcaananattttntcatctgtagatgagtgggcttttnaccttggnntgagtggacagtgacccgattcctctnatgggtgctgtcacgacccacacctgtggctttggat

SEQ ID NO: 2111 - DNA, 464 bp, Mus musculus
  misc_feature (74)..(74): n is a, c, g, or t
tttccttccatcgtgtgagcagagctcaggttgggaaagcacctaccagtgatctcactgcctccctcccaccncccaccccccagccccaaactgcctttgtagtctgtcaaccattgtatcctatggccatagaaggtttttttggtttttgttttgttttgtttttttaagattgatgtaattctatttgtctgttttcacattcttccctgtgttttcttcggcatgtgtgtgagcgtagtatcacgtgactccattcatttttttttttttaaattttattttctttgcagtactgaggattgaacccagggcctgtgcaggctaggtgagtgctctaccaaccgtgccacagcatcagatccctattcactttttaaacttccttgccttgattgcccatatcttgctccctgctctatcacttccaggtaaagagcctgacttttctatggtgatgt

SEQ ID NO: 2112 - DNA, 386 bp, Mus musculus
caagcttcaacttctgggtattggtacttcctgggagctctgttgagttcttgcaagtttgcttgttaacacatccacaggaaggccccacagcatggtctagtggtgatttctccagcttgctcaagtactacagcctatggagaaacaaaagacaataaagttccatagagcaagtctacatatctgaagctgcaggtgtttaaatcactcagtcctaacttttcagaaagagcagattcaaagaatctcaagacaggtaggagagacaaattataattccctataatatgactgacagaataggaaataatatacctcttatttcaccatgtgctgcagatgaaccatttagctgaccttctcttgccatccctgctaaaaag

SEQ ID NO: 2113 - DNA, 567 bp, Mus musculus
gccatcatcataacctcatattttcaccacacttgtttatcaacttgtctctttgcccctttgttcattcttgtcccttatgagtccttcatattacaaccaggttggattatttttggagtgtaaatgtaattaatttgctcatttaaagcttatattcactggggaaaaaaaaagaagttagctgaaacataaagaaacctcatgaatctaagaaatgttccatatcttgctctgggtagtatatctgtaaatcttagcaagccctgtatgtagtattttaagaactttctgactttgttatcctttaatttttaatgctgttatattaagaaaaacacatttataataaatatggtattttaaataaaaagtattatatcttatagctatttttcagataaacaaaaacaaatttgatacaaagtaaaatatgtataaggttggtgttccagaacaaaatctgcaggaatatttacagcatggtataaagcaacgaaaccaggtcatccaccaacattttgccttagattttctaatatttcagcatatgagtagcacagtatt

SEQ ID NO: 2114 - DNA, 530 bp, Mus musculus
caagcacaccaaaagcatcaccagtgagaagtcacataggacatattagggaaaaaagacccaaggaagggctcttcacagctaagagcacctggctccacgatggatatggctttgtataaacgagaacttctaaatgagctgtacaaagagaatttagaacttgcgaggtactggtcacagattatgcaagccagtgtatcatttttgtggggatgctagagagaatcatcaaattaaagagttaaatttagtctctgtgttttacttagtcccaattcttgcaaaggtcatcattctttctcacaccgtgtacatcaaggtatgtcaggtttcggggacactttttagtcttatcacaagaaagcatgaagggatatgtgctaaaactcagttcctgggctggagagatagctcagtggttaggagtgctgactgctcttccagagggcctgagttcaattctcaacaacttcgttgtggctcacagtcatctgtagtgggggatccgatatctaaccttcttctga

SEQ ID NO: 2115 - DNA, 480 bp, Mus musculus
  misc_feature (55)..(55): n is a, c, g, or t
aggaactaggacattgcttttgcaatccattgcttttgtaataagctgctatttntcaccagttctctccactatgctcctcaggagatagcacagctctgtgtgggtctaatggaaacaatcgtttgcgagtttattctgcatttacaccacactgctctagagttggaggtggtaagcttcatcatgttttatagttaaggttgtactgttaaacaatagcacaattaagtttatagtagaaatagggcttagagcgtcacatttcctagtatatttgctatcattgccttttctgagatgagtatgagaacggtaaaataaaaattctcatttgcgtgagagtgggtgtgtttgatgatagggaccttcagagctgtctcagatcagcatttggctttttaggtggtttgaacattgtgtatctctgttaatcatggccccatctctgtcctgaagctggtgtctaacaagtgttcc

SEQ ID NO: 2116 - DNA, 369 bp, Mus musculus
  misc_feature (210)..(210): n is a, c, g, or t
  misc_feature (302)..(302): n is a, c, g, or t
aatttttaaactctgtgcataggtgtttgcctgcatatatgcttggtacctcaagccagagaggtatcgctctccagggaatggagttacagatagttgttagccactgtgtgggtgctgggaactgaacctatgtcctggaagagcagccagtgctcttaactattgaaccatctctttaactcacaatttagtgcttttaaagatacnaaaatatattctgctggggaattgacttgatgggtcaaatgcttgccacgtaagtctgagggtcagagtttagatccccaaattccagcatncacacagtggctcacaactgtctgtgtctctagctccaagggatttgacaccctcatgcagccacat

SEQ ID NO: 2117 - DNA, 426 bp, Mus musculus
ttggcaaactaccatccttttctaactcttagctgggatggtggatgccttcttaacccaccctgtgtgtgccaaacatgccaccaaagccagatcacttgatgtctcactggaaccaatgtgcttcaggtcctgtgagttcctgttattagctgttctctatgcagaacatcacaatcccaccagctatgcagcactgttgttggggtgagcctgtggggtctggttaggaccctatagttattccatgttcactggtgacgcagctaggcattctcccaacaaaagtagctgagtttgtggcagcctttttaaatcaggaaatcaggatgcccagagccaaaggaatgtcatgccaaggatagctaggtcaggctgttgccttctgcagggccagaacacaggccactgttctgtttattcctt

SEQ ID NO: 2118 - DNA, 488 bp, Mus musculus
gccccatgtaaaaaagcctccttgtgcaatggtctgtttcctttgaacgtgcttctttgtaatgaccgaggtaccgatttctgctaagttttcccaacaacatgaaactgcctattcacgccgtaattctttctgtctcccgctcactttctctctttctctcgctctctttctctcaccgcgtccccatctttcctcgcaaccccctctccccgctgccctccctagctggctttctctcttgcttctctcttttcctcctctccccccacccccaccccctttggtttgacaattttgtcttaagtgtttctcaaaagagattactttagttagcatgcgcgctgtgagcattgttaaaaatgttcttaggtttactgtgaagagaatgtatcctgtatctgtgaattgctttatgggggggagggagggctaattatatattttgttgttcctctatactttgttctgttgtctgcgcctgaaaa

SEQ ID NO: 2119 - DNA, 139 bp, Mus musculus
  misc_feature (30)..(30): n is a, c, g, or t
  misc_feature (42)..(42): n is a, c, g, or t
  misc_feature (47)..(47): n is a, c, g, or t
  misc_feature (51)..(52): n is a, c, g, or t
  misc_feature (63)..(63): n is a, c, g, or t
  misc_feature (67)..(67): n is a, c, g, or t
  misc_feature (72)..(72): n is a, c, g, or t
  misc_feature (86)..(86): n is a, c, g, or t
  misc_feature (94)..(94): n is a, c, g, or t
  misc_feature (102)..(102): n is a, c, g, or t
cttctctcagcatgctgcaaaacctgtggnctctgacactanctccntccnnagcccgtgatnttgnactgnttgatgtctcctcntattccgnatctcttngactctggatctatctatcaaagcttgctgctgctct

SEQ ID NO: 2120 - DNA, 461 bp, Mus musculus
aagggaaatgctcttctcatccaagaagttcaagaagaagatggaggaaattatacatgtgaacttaaatatgaaggaaaacttgtaagacgaacaacagaattgaaagttacagctttactcacagacaagcctcccaagccattgttccccatggaaaatcagccaagtgttatagatgtccagctgggtaaacctctgaacatcccttgcaaagctttctttggattcagtggggagtctggaccaatgatctactggatgaaaggcgagaagtttattgaagaactggcaggtcacattagagaaggtgaaataaggctcctcaaagagcatcttggagaaaaagaagttgagttgacacttatctttgactcagtggtagaagctgacttggctaattatacctgccatgtggagaacagaaatggacggaaacacgccagtgttctactgcgaaa

SEQ ID NO: 2121 - DNA, 535 bp, Mus musculus
  misc_feature (110)..(111): n is a, c, g, or t
tacattagccgtcatcccttgtacagccaaccttcctggtcctcaggcattgggggacatcttcatcctgtcagctccatgctgtcctgggcgtgtgtctcctcacacgnncagtgtgtctcctcatttccacactgaacatgggaatctgaaggtggatgtcaggcagtggtgggcaggccattaatcctagcacttgggaggcagaggcaggcagatttctgagtttgaggccagcctggtctacagagtgagttccaggacagccagggctacacagagaaactctatctagggaaaaaaaagggggggggaatcttgaaggtgaggctggagagatggctcagtggttaagagcactgagtgctcttcctgaggacctgagttcaaatcccagcaaccacaaggtggctcacaaccatatgtaatagcatccaatgccttcttctggtgtgttagaagatacctacagtgtattcacctacatgaaatgaataaatcttaagaaaagaatctgagtgtgaactacttgacc

SEQ ID NO: 2122 - DNA, 480 bp, Mus musculus
gatgttccctgtgagtctgcgggctcaaagtgaagaactgtggagcccagtccacccctgcacaccaggaccctatccctgcactgccctgtgttcccttccacagccaaccttgctgctccagccaaacattggtggacatctgcagcctgtcagctccatgctaccctgaccttcaactcctcacttccacactgagaataataatttgaatgtgggtggctggagagatggctcagcgctgactgctcttccaaaggtcctgagttcaaatcccagcaaccacatggtggctcacaaccatctgtaatgggatctaacaccctcttctgcagtgtctgaagacagctacagtgtacttacatataataataaataagtctttaaaaaattaatttgaaagtgaccttgattgttaacatcttgagctagggctgatttcttgttaattcatggattgagaatacttagaggtttgtt

SEQ ID NO: 2123 - DNA, 554 bp, Mus musculus
  misc_feature (97)..(97): n is a, c, g, or t
  misc_feature (100)..(100): n is a, c, g, or t
  misc_feature (121)..(121): n is a, c, g, or t
  misc_feature (125)..(125): n is a, c, g, or t
tgagcctctggtactggtgcactgtggcttctgctctcacgcctacacacgcctgtactccagagttctaaacttggctcagggtgctaacagctgnagnctgagaagacagatggtgacncacngggggaagggatcagatggagcagggcaggccaaggaggacaggaaggaaagaaaggctcctcttatgggtgagaagctgagactcttcagatcacagctcacgcctgtttagagacaggtgttgagtttgtgacaggcttgagattctaccagcttgcaggctgacacagtagcctgctgttgtatagatgtcagccggtcataggcagttttcagtgcagcaaaagcagtagctagactgttaggcttgttgtcttgggtccccttgttcttccaggtctttacatggaagggccaggcaggtgttgtgcatgcagtaggtttgcattatacctacagaccactgtgcttgtgaaatttgacatcctcatagtgaattaaacagattggtgctttgtcaaggaaaagatacctcatccttccaagat

SEQ ID NO: 2124 - DNA, 306 bp, Mus musculus
  misc_feature (198)..(198): n is a, c, g, or t
  misc_feature (215)..(215): n is a, c, g, or t
  misc_feature (220)..(220): n is a, c, g, or t
ggccccggcaccatgtcggagaagagcgtggaggcagcggccgagctgagtgccaaggacctgaaagaaaagaaggacaaggtggaggagaaggccggccggaacgtatcaggagagaaacagaggaaaaagaagaacgccgtagggcagaggatgagcagagagaaaaaaaaaaaaaaaaagagaccgcaaaagacntagagagataagcaagnctctnggccactgtagttagtggtcagagacaggatagacaggggggagagcggaggaggccccaacttgataaggaccaatgcgcctact

SEQ ID NO: 2125 - DNA, 199 bp, Mus musculus
agaggccaccagagaaacaagatatcaggaacactaaagacccttccattcttggaaggcctggattgctcactaagacttttggtagagggcttctcgaaattagttggaagcacagggcatgtacatatctgtggaagtagaaagtttctttcaactttgccttcctgagaatattatcatccctctcaacgcaaac

SEQ ID NO: 2126 - DNA, 293 bp, Mus musculus
atggagaatgtgaccagagttcggctggtacagttccaaaagaacacggatgagccaatgggaatcactttgaaaatgaatgagctaaatcattgtattgtcgcaagaatcatgcatgggggtatgattcacaggcaaggtacacttcatgttggtgatgaaatccgagaaatcaatggcatcagtgtcgctaaccaaacagtggaacagctacaaaaaatgcttagggaaatgcgagggagtattaccttcaagattgtgccaagctaccgcactcagtcttcgtcctgtga

SEQ ID NO: 2127 - DNA, 156 bp, Mus musculus
gtggctctgtggtgacttttactacacccgtgcaaattaaccagtatggcattgtccagatccctaattctggagccaacggccagttccttaatgggagcattggattctctccactgcagctgcctcctgtctcagtagcagcttcacaaggta

SEQ ID NO: 2128 - DNA, 346 bp, Mus musculus
tacatatggccctatcctggcaggaccacggtcggaccctgctctgccagttctcattgggcgcacacagtagtcggaaagaggtttacctgcaagtgccacatgcccccaaaggtgtggagatcctcctcagctcctcagggaggaacatccttcccggggatccagtcacactcacctgcagagtgaacagcagctatcctgctgtcagtgccgtgcagtgggccagggacggagtgaacctcggagtcacgggacatgtgcttcggctgttctcagcagcctggaatgattctggggcctacacctgccaagcaacaaatgatatgggctctctggtgtcatc

SEQ ID NO: 2129 - DNA, 378 bp, Mus musculus
ttcaaggtactcctgcctgaagagggtggcgggaggagcaggtggaggtcagccgatggccagagtgagcctagggggcagaggctaaggcggcttctagagaagggtgctgcctgtagtagaagtctctggtccttctcactgagtttgggatgggggggggatgctgcgttaccgtggcgaccctcgggagggtcagcctcagaggtatccaagagggagtttttttaaaaaaaaatcaggataatttcagagcgcctaccaagggccttccttatctttgctacgaaatagaaaaagttagaaccttggatcgggccagtccatcttccttaaggttccccgaacctctggatgaacacccagaccgttttgtat

SEQ ID NO: 2130 - DNA, 180 bp, Mus musculus
tacattagttacagtggtggcactttctacaatccatctctcataagtcgaatctccatcactcgagacacatccaagaaccagttctacctgcagttgagttctgtgactactgaagacacagccacatattactgtgcaagagcggagggagatggttactacgggtacttcgatgtc

SEQ ID NO: 2131 - DNA, 149 bp, Mus musculus
gatgttccctgtgagtctgcgggctcaaagtgaagaactgtggagcccagtccacccctgcacaccagcaccctatccctgcactgccctgtgttcccttccacagccaaccttgctgctccagccaaacattggtggacatctgcagc

SEQ ID NO: 2132 - DNA, 156 bp, Mus musculus
ctcagaggcctacttttaagcagctggtggaagctctggacaaggtcctgctggctgtctctgaagaggctggaagctgaccagctctgttccttgcagtaccttgacctccgctggaagctgaccagctctgttccttgcagtaccttgacctcc

SEQ ID NO: 2133 - DNA, 187 bp, Mus musculus
tttttgcagctctttcctggcacaggggagattgctgtgtgcgagacatgcaggctcggccggggaaaatgcaggagagcatgcatagagagtgagaagattgtgggctggtgcaagctgaacttcttctgctgtcgagagaggatctgaacccaacgaccaatggcctttggaccttgcaagccgt

SEQ ID NO: 2134 - DNA, 129 bp, Mus musculus
aaagagccttgctgttggtggttagctaaagtgaggatgataaagggtgaggtgtgccaaagaatcagcacataaggattttaaaaaggcagttggtgccttctctgtaacttatgatccagaaaatta

SEQ ID NO: 2135 - DNA, 495 bp, Mus musculus
  misc_feature (63)..(63): n is a, c, g, or t
  misc_feature (110)..(111): n is a, c, g, or t
  misc_feature (117)..(117): n is a, c, g, or t
  misc_feature (226)..(226): n is a, c, g, or t
  misc_feature (282)..(282): n is a, c, g, or t
  misc_feature (294)..(295): n is a, c, g, or t
  misc_feature (401)..(401): n is a, c, g, or t
  misc_feature (461)..(461): n is a, c, g, or t
gtgcttcctgtgaagtcaccaaggttgtgtcagacctgcatcacggactgctttatttgcatntaagaccccaccccctacatccatcatcaggagtgttcctctagagnntaaagnttctgtttcacccccacctcaccccggcaccatgtgatttccatacactactttcattgactaaggatgcccaaaagcatgaaagggaagcaaaaggcattgaaacacngacaggtggcacctggggaggcaccgaaggtgttccggggtgtgggggaatctcanctgagggaaganntgaccgtgactatgagatgacagatcagaaccatattaaacctgaacggagcaacagcatcagcttcacagcttgatggcagaggtgacatcagcaacaaatacangagcgggaccccaacttgtcacatttctctcaaaccctccccctctaaacattgaaagtntggtaacccgacacctcatttctctcaaatcctt

SEQ ID NO: 2136 - DNA, 484 bp, Mus musculus
  misc_feature (42)..(42): n is a, c, g, or t
  misc_feature (63)..(63): n is a, c, g, or t
  misc_feature (66)..(66): n is a, c, g, or t
  misc_feature (104)..(104): n is a, c, g, or t
  misc_feature (116)..(116): n is a, c, g, or t
  misc_feature (120)..(120): n is a, c, g, or t
  misc_feature (153)..(154): n is a, c, g, or t
  misc_feature (175)..(175): n is a, c, g, or t
gtgattccacttcttctggacctattgatttgagttggtganactgttgggtcagaaccaggnccngcaccaccgaaattctgtcttttacaaactggaccaangcggttgagaanacangggtccgaagagtaggattaataagagtattannaaggggccctgattccgaggngtgtttcctcgcttaagggaaataaggtcccatgatgatgatggcttccagtatgcctgtccagtggtctcacagccccatttgccacagtagccctctctcgggcctccacaccctgttggtacagtatgcccggggcaaacatagaagtcaaatgttcttgccctttttcttcccccgggagtgcgacacccgagtccagtctcatcccagtcgtcccctattaaatcgcacaagtcaagtacagtttgggaaaggcatcggtcattgtccccaggagggaggtagcattagctgtttgtcctgtca

SEQ ID NO: 2137 - DNA, 455 bp, Mus musculus
tacttttgtctcatgataaacccagacattctttaagtaaatgaacttgcacacaataaaaagacaggaatgaagtgcatcaataattgaagcctatcccaggcctaacaggcaaaccaagggtaagttacaatgcatcttcaacctatcctaagtgagcaagtggatattttgaatgtgatgccaatgcaaggaatcaaaggcaaaagagccatttgtgagccataggaaaatctgagctgcctctcctctctgccgctcttagccccgaccgctcagtgcatctcagtatttctcaaactcagtgcatgatcctaaataccaaaatcccgcttgggtttccttgctggttcctgaagcagaatgctcgcctttggacaggaactgtcctttgcatttggcagcccttttgaagagttccaaccaaactgtaaagtggcccgtatcaaaactgt

SEQ ID NO: 2138 - DNA, 556 bp, Mus musculus
aagtctcatgcaatagccagctctatccagagcatcagacactctattctctgagcgttaagaagagtcacgtgagtaaagtatataatcaaagtcaagctgcatatggcaaaaacatgtttttccataaaggtatataaataacagctgaagtaaactctctcctatctgctacacatgagaggagcatgaacacacattccaagaacaattctctttttgaaaaaactaaagtcacaagactcttgttttttcacaagcacttagaaatcttaggtcttcattcttggactgggtgacaataagttagagctaatgtagactttgagaccatgtctcaaaaacaaaaacaaaaactctccccccctacagacacacacacacacacacacacgcaacctatgtgaatgttagttttcataggcaacaagaggccagaaagctccaaggaggattataaggtaatccaattcatgtcttatttacatgtataaaattctaatactaatcagactgaattccctgctatgaggtcaatgtgttgcattggctctaa

SEQ ID NO: 2139 - DNA, 336 bp, Mus musculus
agtgagtgtctacgtttcgtggcccttaagggaaaaaactagactggcatgagtaaacaactgtgtccctaagtttagtatatttatcaggagttatctggtgcttcagccgatgatcacagctagttaagagactcttggagtaggagcattccaaggcttgcctaggctacagactgggctcaacataagcttagataactgaccaacaccctgtctcacaataagaagctgggctgcagctgaatcgtagattacttcgtagatctcgcaaggcccgaggtgcagtccctaatgttgcagaaagaaaagaagtacaatattgcactcctgtaa

SEQ ID NO: 2140 - DNA, 545 bp, Mus musculus
gaagttttcacgcagaagctagaggaaaataaatgatacataactgccggtaggggccagatggttgtactgagatgccttagatacaagagaaaataaaccgttgtgattggtaattccaaccactggattaaatcaaaggggtctcaggtaggagctggaaatggtggctgagtctgaataaaaatcctggcatagagcccatcaccagcacagtggggtagggacacttgaagcattgtatttgtacatatttttccagaggattttatttgattgaagaaaagtagtgtatgtgtgtgtgtttgtgtgtgtgtgtgtgtgtgtgtatgagtgtagtgtcactcttggctatatagtgagaccctatctcaaattacatataagattgtgtatgtggcatttgaaacacattgcctacaattttctgtggcattaattgcattcataatgccattaagtatcatcagtgtttctcaaacattttagtcatcgcaagcagacacttgatatctattaaataataattcctattccctggcctc

SEQ ID NO: 2141 - DNA, 459 bp, Mus musculus
atcaaatgcaactcacaacaccacgcctgacgttaaaccaactaaggatgttgatttgggtgtaaacaatggtgataagcaaggtagtgatgataaaaagaaggttgttaagggccaagatttaacttattctctgaagtcaactgatctcccagccaaccgtgcctttgatgttaattcgtttaagtttgtcgatgtcttgccaaaggaagtcgattataaagctgccaaagtcttttcatcagatgggaaaactgacctaacaagcagctttgatactaaattcgatgagaaatcgcgaacagtcacatttagtgcaaatgctgaatatttaaagttgatgaactctgacaaatcaaagacctttgtaaagccaattgccaatatcttatgtctcagcaaatacagacggatctagcttccaaaacaagtatactgaattcctgctctagtattggg

SEQ ID NO: 2142 - DNA, 463 bp, Mus musculus
ttccccgccttgctgagggacagagtgcataaaatgctggggttggccctgacctaaaggaagccagcttagtactctggctgaatcgcatcctgctgtggaaccccaagtcccgcgtcaggggcttcctcctcagtcatggggtccatttcttcctccacactcttcagcttctcctctgaatccctcttcatctctgggtcatctgtttccagctcatcctctggatcctgaggcaccatactggaggtctcctcctcttttacacctgcatctttctccacctcctcggactgcagcttcctcatctcatcggctgaagcctcggcctccacttggtcctcctcttggtcctcctcttgcattttctttcccagaagatctgtgctgtccttggcatcttgggttgaaggtggatccgagctggccttgtggttctcttggatgctggtgtggctactgc

SEQ ID NO: 2143 - DNA, 216 bp, Mus musculus
ttcaccacctactggatgcactgggtgaagcagaggcctggacgaggccttgagtggattggaaggattgatcctaatagtggtggtactaagtacaatgagaagttcaagagcaaggccacactgactgtagacaaaccctccaccacagcctacatgcagctcagcagcctgacatctgacgactctgtggtctattattgtgcaagatatttt

SEQ ID NO: 2144 - DNA, 131 bp, Mus musculus
aagcaccgagagatgtagccatgttcgtcctgcctttcttcgtgcttgccagtgatctccaccacgccttccttggtcttcactgtgagctcctccggagcgaagtggttgacgtccagggacacgcgcca

SEQ ID NO: 2145 - DNA, 451 bp, Mus musculus
  misc_feature (276)..(276): n is a, c, g, or t
tggatcgcgcggacgcttggctcctccgcaaggcacatgagacagcttttctctcctggttccgaaatggacttctgtcatccggcattggggtcatctccttcatgcagagtgacatgggccgggaagctgcctatggcttcttcctgctgggtggcctgtgcgtggtgtggggcggagcctcctatgcggtgggtctggcagcgctgcggggacccatgcaactgtcgcttgctggtgctgccgctggtgtgggggcagtgttggctgccagtntgctctgggcttgtgcagtaggtctctacatgggccagttggaactggacgtggaactggtgcctgaggatgatggggcagccagtacagaaggcccagatgaagcgggcaggccaccccctgagtaaacaacagggctgtggggactggctgggcctgacgactgggacattaa

SEQ ID NO: 2146 - DNA, 262 bp, Mus musculus
  misc_feature (44)..(44): n is a, c, g, or t
  misc_feature (158)..(158): n is a, c, g, or t
  misc_feature (196)..(196): n is a, c, g, or t
  misc_feature (201)..(201): n is a, c, g, or t
  misc_feature (230)..(230): n is a, c, g, or t
acgacgccggcgagtttgtggacctgtacgtgccgcggaaatgntccgcaagcaaccgcatcattgctgccaaggaccacgcgtccatccagatgaacgtggccgaggttgataggaccacaggccggtttaatggccagtttaaaacctatggcatntgcggggccattcgcaggatgggcgagtcagatgattntattntccgattggctaaggctgatggaattgtntcaaagaacttttgagcagaagaaatcgggaa

SEQ ID NO: 2147 - DNA, 325 bp, Mus musculus
  misc_feature (75)..(75): n is a, c, g, or t
  misc_feature (158)..(158): n is a, c, g, or t
  misc_feature (226)..(226): n is a, c, g, or t
ataattggttagtgtttgcatagaaaatttgttctaaagccctttaaaatttttagggaaatcttgaaatcttanagcacttactttgctaatgtatgcccttatctgtccttacaggtacacgtagcttcctcgtggtgatttatcatattacatangtagagcttgagttcatgctatttgttataaattatcttagttactttagacactgcttccgtttganttttaattattggttttaaataccaaattaaatgctggtttgttggttgttgtttttaaatgattgttccttcaacagcatcccctcctgacggatggg

SEQ ID NO: 2148 - DNA, 450 bp, Mus musculus
gaggatatcgaagtccccaaggccatgggggacatttttgagtctcttgctggtgccatttatatggacagtgggatgtctctggaggtggtctggcaggtgtactatccgatgatgcagcctctaatagaaaagttttctgcaaatgtgcctcgttctccagtgagagaattgctcgagatggaaccagaaactgccaagtttagcccagcggagagaacttatgatggaaaggtcagagtcaccgtggaagtggtgggaaaggggaaatttaaaggtgttggccggagctacaggatcgccaagtctgctgcagcacgaagggccctccgcagcctcaaagctaaccagcctcaggttcctaacagctgaagcttccggactcacaggcggcaagacagcggaccagaaccacagctccacggcacaaggatggttcgggctgacaca

SEQ ID NO: 2149 - DNA, 348 bp, Mus musculus
  misc_feature (58)..(59): n is a, c, g, or t
  misc_feature (125)..(125): n is a, c, g, or t
  misc_feature (131)..(131): n is a, c, g, or t
  misc_feature (180)..(180): n is a, c, g, or t
  misc_feature (195)..(195): n is a, c, g, or t
  misc_feature (200)..(200): n is a, c, g, or t
  misc_feature (216)..(216): n is a, c, g, or t
  misc_feature (241)..(241): n is a, c, g, or t
ggccttggcgcggactctgcaaagagcactggatcgggcctctccgcaggtgagactnnagtggactctgcatggcaccagagagatggcttagtgtttaagaccctgagctgctcttccagagnatgaantcagttcccaggaccccatatagagggggctcacaaccatctgtagctntagcttcaagtgatntgatnccatgttctaggcatntgcattaacgtgcccgcgtgcccantcgtgatgattcagagaatacagcctggttgtctacacacacacactttgaatgagaatggcccctatatttgaatatgttaggtccatgagaaggcaccttggaaa

SEQ ID NO: 2150 - DNA, 503 bp, Mus musculus
ttaaaaatcttgtaggaggctgtacattttgcagagtttgctatacttattagccatagttacaccaattcaggaattgggggagctaattatttaaaactatcagcaatgaaggatatagtactaagtaaaattaatttttttttttgcttttgttttgagacaggatttcactatgttgctctgggctgggctgtaactcactctgtagaccagactagcctggaactcaagagatctgcctgtctctgtttcccaagtgctggggttaaagtgcaccaccaagcctggtggaattgtcttaatggattgaagtgtgtaaacttcatgaaacctgcctttggttacagtacctttgcctttaaaaactattcacagtataacgtgtggaagtttggatcacagtcttccatttcatttctagtagttaggatacctaaaagtttagtccatcatctgtgtttcaaatgtttaattagaagggtgcaactcgtgtcaaataa

SEQ ID NO: 2151 - DNA, 447 bp, Mus musculus
gctcctgactggctacgcggcaaagccaaggtcaatcaagagacaatccagcggctcctggaggagaatgaccagctgatccgctgtatcgtggagtatcagaataagggccgagcgaacgagtgcgtccagtatcagcatgtgttacatagaaatctcatttatttagctaccatcgcagacgccaacacaagcagtctcacaaaggcagtggagtagttttccagaaggctgtaatgaggactgattggaacccatctcctgggaatcagagagctgctcagaacatgggcaaaaagtcccattcattttagactgtgaagaaactcgctaccaactctactgtattctgactataaatatttattaataaaacagatcccacggtagaacctgaggacctgcgaggacctgaggtgtatgacagcggtgtcattgtcaacaata

SEQ ID NO: 2152 - DNA, 379 bp, Mus musculus
  misc_feature (38)..(40): n is a, c, g, or t
  misc_feature (42)..(42): n is a, c, g, or t
  misc_feature (226)..(227): n is a, c, g, or t
acggtccctggacgagcagacagaacagagcgagaacnnncnggtgcagctggaacacctgcagtccaggctccgcaggcagcagcaaaacgcacccctttttgggaagattcgtagtacccgatttggcaccgaggaagccggagacggagccagcgacctggatgaggatgaggacctgcaaatccaggtggcctaggacatccagggtggaagaggaccgacnncccaaagcacagatgcccagcggagcatcctctcaaaccctgacagccatctttcgctgtctgtacgcacttgggttccacccccctgcttcaaaccacttccttctctcccaggaaagcgggagtttcacctatcacacccctgtgaaggg

SEQ ID NO: 2153 - DNA, 420 bp, Mus musculus
agcagcttcgcttacgaccgagagttcctccgtaccccgccggggctcctgatcgtagccgagatcgtcttgggactgctggtgtggactctcatcgctggcactgagtattttagagtccctgcttttggctgggtaatgtttgtggctgtcttctactgggtcctcaccgtcttcttcctcattgtctacatcaccctgacttacaccaggattccccaggtgccctggaccacagtgggcctgtgctttaatggcagtgccttcgtcttgtacttctcagctgccatagtggacgcatcttctgtctccccagagaaggaagggcacaacttcaacagctgggcagcctcctcgttctttgccttcctggtcaccatctgctatgctggaaacacgtacttcagtttcatagcctgg

SEQ ID NO: 2154 - DNA, 463 bp, Mus musculus
  misc_feature (79)..(79): n is a, c, g, or t
  misc_feature (87)..(87): n is a, c, g, or t
  misc_feature (89)..(89): n is a, c, g, or t
  misc_feature (102)..(102): n is a, c, g, or t
  misc_feature (105)..(105): n is a, c, g, or t
  misc_feature (125)..(125): n is a, c, g, or t
  misc_feature (130)..(130): n is a, c, g, or t
  misc_feature (135)..(135): n is a, c, g, or t
  misc_feature (141)..(141): n is a, c, g, or t
  misc_feature (150)..(150): n is a, c, g, or t
  misc_feature (205)..(205): n is a, c, g, or t
  misc_feature (207)..(207): n is a, c, g, or t
  misc_feature (253)..(253): n is a, c, g, or t
gtttttgcatatctctgtacacctgtaggtaagtagtgactctgtttggtgttcctgtatgtacctttagttgtgttgncatggaananccaccagtaagtnctnacagggaaatgatcctgaantgaangaganctgctnaacactggntagcattctaaactgttgtagaattaacccaccttcatatcttgtttcttgttantnttcctgtaatttttatgagattttatcagcactaaggacctgaatnaagtataactacagatgacatagttcttgtcctggtgtcaaggccttctttccacaccactctgtgttatttttttcagagtttattctatatgcttaagggtggaaatgaagatctttctctggtgctcgggattaaacctatggtcatgttaggcaggccgtctcccgttgagctgtacctacttcaaagatcttttaccttcgactt

SEQ ID NO: 2155 - DNA, 559 bp, Mus musculus
  misc_feature (133)..(133): n is a, c, g, or t
  misc_feature (147)..(147): n is a, c, g, or t
  misc_feature (198)..(198): n is a, c, g, or t
  misc_feature (343)..(343): n is a, c, g, or t
  misc_feature (490)..(490): n is a, c, g, or t
tacctctgacaatcgtgctaccaaagccagctagacaactaacacttctagaacactatctgtattctagacacattgtcagagtaccatttgcatttcaaaaatacagagttggattgaacataataacatntcttaaaatcctancacttggaaggaccctatcacaaggcaagagaattgtatacagtgaccctntcttcaaaaaccacaaaccaaagaattatccagtgaatgccccacatctttgtgtatatgggcagcagggggttatttaaaaagaaaataagatttgcagttcagagagagatgggaaataggacaggggaagtggatttgatcnaacgacattatgtatacataaaattcccaataataaaaatatgaggtattttttaaataggcagttggaagaatggctcagtggttaagagtaagttctgctctagaagaggactgaagttcagcagccacactgggctgctcacanccacctgtacctgcagctccaggagatctcacaccctgatactcacagggacctcacgtgcacacattc

SEQ ID NO: 2156 - DNA, 451 bp, Mus musculus
  misc_feature (243)..(243): n is a, c, g, or t
  misc_feature (371)..(371): n is a, c, g, or t
ggcatggagacgaaattgtccttgctgatgcgaacttccctacctcctccatctgccagtgcggacctgtggagatccgagcagacggcctggacatcccacagcttctggaggctgtgctgaggctcctgcccctggacacctacgtggaaagcccggctgctgtcatggacctggtgcccagtgacaaggagaagggcctgcagaccccgatatggaagcgttatgaatcccttcttctcnaagctgactgtaaaaaaaccctgatgaagctagagagatttgaattttatgaacgtgcaaaaaaggcatttgctgtggttgcaaccggggagatggcactctatggaaacatcatcctcaagaagggnaactcttgacctcggaccctcatagagaccaccttcccttggcagcaaccagacctggacatcagcctcgggctcaagaa

SEQ ID NO: 2157 - DNA, 121 bp, Mus musculus
gccccggaaaaaatctgctccagagacgctcacacttccagatccggagaaaaaagccaccctgaatttacctggcgtctacacttccgaaaagccatgtcggcccaaatcagagtaactc

SEQ ID NO: 2158 - DNA, 500 bp, Mus musculus
tgagtggaccagctccatcttgcaggagcttgggaccattgcagctgggataacgaaggcagagctccgaatgctcaacaaagaactgatgacgtatttccagccgtcagccataagatgcctgcctggtgaggtattcaaagagctgtccacggagcagatcgcttccctgggtcctcagaatgcagcctctgtaacccactcccagcgcctgcagctcagctcggcacagctgcagagcctccagagggcactagatggcgccaagactcactcctggcagaccgatcctctgagttccagccctacctggccagcctccactgggtccccaacaggagagcctgcctcccaggcgctttggcttggctgtaccctgctgcttctgacggccaagtcctgatgccgagtggcctgttgagtgttgcaagaagctggtgaaggtgtgcagagtcagaagctgctttcagacgggggagacctttacctgaggagcctta

SEQ ID NO: 2159 - DNA, 382 bp, Mus musculus
ggtcagcactggcatttggtaccatgctgggctacatcacagttctggccttcatttgctttgtatttgcattcaaggggaggaaacttcctgagaattacaacgaagccaagttcctgacctttgggatgctgatttacttcatagcttggatcacattcatccctgtctatactaccacattcggcaagtatttgcccgccgtggagattatagtcattctgatatccaattatgggattctctgctgtatattcttccccaagtgctacattattctttgcaagcagaagactaacaccaaatcagccttcctccagatggtttacaactactctgctcacagtgtggacagccttgccttgagtcatgtttccctgga

SEQ ID NO: 2160 - DNA, 134 bp, Mus musculus
cacccatctaagctaatcccataatgaatagcaattacgatattggttattagaagctttatgttatggaaggcccatgaaaacatgtaaagggtgtgaagcctgagaaagtctggcaagtgccttgaacacaa

SEQ ID NO: 2161 - DNA, 240 bp, Mus musculus
atgaagtcttcagttcccgtagctctgaagtggttctgaacacggtacaaccttcatccctggactgcaatgaccagaataaacccaaggaagctatcaacaaagctggggcagcatcagactccaccccagatgcagggattggggacaatctgcatgatggcccagagataaaggcagactcgataaggaatgaaaaagtgacctcaccttgaaaagcacatgagctgggctgtagca

SEQ ID NO: 2162 - DNA, 536 bp, Mus musculus
  misc_feature (200)..(201): n is a, c, g, or t
  misc_feature (222)..(222): n is a, c, g, or t
  misc_feature (238)..(238): n is a, c, g, or t
  misc_feature (244)..(244): n is a, c, g, or t
agggtgacacaaccacagcgtgattcatcagtactttgcgctgccaacgaaggaaaagagcctgcagtgtgagggggtccccgcgtgacagcctctgtcccccactgacagccccgcccctgggagctgccagaggcaggaaggcaagctaaggcatagaaacctggttttagctccggctctgggtgctgtaaaacctnnccgcatccagtgtcctgaacnaccgggccaccaagancagctncaggaagaggttgaccagacgaagccttcctggttcccttggctccattggacttctttgggtaacctaagcagtctgtggcccagaaacccgggaagaacccaggaaacaccccattccggctaagggtgggacccgctgaagggactcttggatttgaaggactgcttcacatctcacctgcctggccctgctgttgctttaagtgtgtattgggggcttgtacagtgaacacggctcatgtctacagcattggatcacagaaacagtggccggcaatcatcgtttctat

SEQ ID NO: 2163 - DNA, 468 bp, Mus musculus
gtagcaacccctgctcagaaacttaccgtggcaagtttcccaactctgaagtggaggtcaagtccatcgtggactttgtgacgagccacgggaacatcaaggccttcatctccatccacagctactcccagctccttctctacccctatggctacacatcagaaccagctcctgacaaggaggagctggatcagctagcaaaatctgctgtgacagccttgacatctctacacgggaccaagttcaagtatggcagtatcattgatacgatctatcaagccagtgggagcactattgactggacctacagccagggcatcaagtattccttcacttttgagctgagggacactgggctcagaggtttcctgctgcctgcctcccagatcatccccacagcggaggagacatggctggcccttttgaccatcatggaccacactgtcaaacacccctactgaagaagct

SEQ ID NO: 2164 - DNA, 457 bp, Mus musculus
  misc_feature (41)..(41): n is a, c, g, or t
  misc_feature (129)..(129): n is a, c, g, or t
  misc_feature (169)..(169): n is a, c, g, or t
  misc_feature (324)..(324): n is a, c, g, or t
  misc_feature (391)..(391): n is a, c, g, or t
  misc_feature (412)..(412): n is a, c, g, or t
  misc_feature (415)..(416): n is a, c, g, or t
  misc_feature (418)..(418): n is a, c, g, or t
agtcttcccagaacccctttgtgatggtggctgtgcccccngaagccctgtggcatttccatgtcttactggcaaccacacaactcagggaaaggagtgcctgggggtggggcacaggcgggcagcacngagggaccctgccctgcccctccccagctctttccccatntcacccagcagccactgcctggtgggcctggctaagggtgtgtgctgctccttaaaccactgctccccagaacccaaggcaggccacctccaacctgtgggatgtcgtcaggattggaactattctgtacctactggctttgggcttaaattttntcttctgaatttgaatgcttgaccccaggaaggaggagcaggtgtggggctaggtacctggacttcncagtttagaacaagctctggnccnngnccgggccaggccaggcctagggagccaaggcctagctgc

SEQ ID NO: 2165 - DNA, 439 bp, Mus musculus
  misc_feature (323)..(323): n is a, c, g, or t
  misc_feature (346)..(346): n is a, c, g, or t
  misc_feature (351)..(351): n is a, c, g, or t
  misc_feature (390)..(390): n is a, c, g, or t
agctatgggtatgggtgtcctcctctggtgtaactgtgagactaagtgataggaagaagtaaagccttcatagcgagtggatgggatgaggtgtggcacacatccccgggagtgctcgtgggaagtggcctccacagaaggtagtcatcttcatcctctaggacatttaaaacatgctcagtccctggacccagatgatggcttctcagggcaagtcataagttatcaggtccacttgtctggaagaataacaagaaagctgctgctttcgagatcacccgccagaggcggggcacgaggcacactgtgttatactgcatgangccatgaattgggctagaggaanccttntcatcagatactgaccatagcatgtgacactcagacttntcagctcctgtgcatcccagtgtaggctctgaggccacatggaaactct

SEQ ID NO: 2166 - DNA, 443 bp, Mus musculus
  misc_feature (293)..(293): n is a, c, g, or t
  misc_feature (302)..(302): n is a, c, g, or t
  misc_feature (305)..(305): n is a, c, g, or t
  misc_feature (314)..(314): n is a, c, g, or t
  misc_feature (334)..(334): n is a, c, g, or t
  misc_feature (366)..(366): n is a, c, g, or t
  misc_feature (375)..(375): n is a, c, g, or t
  misc_feature (402)..(402): n is a, c, g, or t
tgctgtttgtgcctcaggactcttctgctgaccccgtccaataatttagttctccagcttggtgactcttctgatagagccctactcctggacagagattgcttttgggaggtggagtgggggcttgaaggtcaggcatgaaggccagtttagcgtctgggcctcccagctctctgggcctctgtccatgtttggaaagccccacccctacagccctggatcctctgttcagaatcaaagcagcccttccctgccccggccatgtgattgtgtttggtgattgactgaagtgnctggtgctngtntccctcaancccaaccccctccatggagnccccttcccagtgacactacctggggctccantctgggctncccctagttcaccgttgctcctggganccacccctcctcttacgtctgtaccttgaaagctgctgctg

SEQ ID NO: 2167 - DNA, 258 bp, Mus musculus
tcaggtaattttgacgtcaaagagaaaacaaactgaagcaaatatcaggaaatacaagccttaaatccagtgaggacaaagaagtcatctttttatttgtgtttgtgtgccctgagtgggcagtgtgtgtcagagtcggcttgggggtccaggccagcccctgctagacaccactacagctcagagtggcgtggggctgcctcagatatgagcctgcaaggctgcccttggtgttggtaggaccttagcctgattgct

SEQ ID NO: 2168 - DNA, 539 bp, Mus musculus
  misc_feature (146)..(146): n is a, c, g, or t
  misc_feature (266)..(266): n is a, c, g, or t
  misc_feature (306)..(306): n is a, c, g, or t
  misc_feature (407)..(407): n is a, c, g, or t
  misc_feature (424)..(424): n is a, c, g, or t
  misc_feature (430)..(430): n is a, c, g, or t
  misc_feature (461)..(461): n is a, c, g, or t
  misc_feature (471)..(474): n is a, c, g, or t
tggcagatttcatccgccagaacctctcctccatcaaggcctatctgaccgtccactcctactcacagatgatgctctatccttactcctacgactataagctgcccgagaactatgaggagctgaatgccctggtgaaaggtgcngcaaaggagctttccactctgcatggcaccaagtacacatatggcccaggagctacaacgatctatcctgctgctgggggatctgacgactgggcttatgatcagggaatcaaatattcntttacctttgaactccgggataaaggcttctttggctttntgcttcctgagtctcagatccgccaaacctgtgaggagacaatgcttgcagtcaagtacattgccaattatgtcctagagcatccatattagtgaagaatntggattgccttattttnaaattnttactgttcattccttgtctgatgtgacttngtttgtttgnnnngaggtttgcagattctaatctttctcataattttcttgatgtaatgaccaattggacccctgaaa

SEQ ID NO: 2169 - DNA, 445 bp, Mus musculus
  misc_feature (272)..(273): n is a, c, g, or t
  misc_feature (275)..(275): n is a, c, g, or t
  misc_feature (321)..(321): n is a, c, g, or t
  misc_feature (323)..(323): n is a, c, g, or t
ataaccgcgcccatggtgaagcttgcctgccaaagcccttgccttcctgacggtcaccactgctcatctcagatgccgcgcacgtcactagcgtgaggaaaatgggaaagacttgaataagggttgctcacctgctgctctcggagaatcagtcttgtaaaggacagcccgctgtggttacccatgctgactctgcagcgcccacatgctggttggaggaaggcagtgaacgctttagtcatcaggaactttgtgagatcagggtgggatcnncntcttacaacttcttaaatctgtatgctgcccgttttaatatatttntncttctgatgttcaagtttaaaagggttttctatccactgtcaattttaattatataacattttgtcaaggttttgtttggttttgttttccctttctgattgttacttgatgctagctggaa

SEQ ID NO: 2170 - DNA, 367 bp, Mus musculus
  misc_feature (192)..(192): n is a, c, g, or t
  misc_feature (225)..(225): n is a, c, g, or t
  misc_feature (228)..(228): n is a, c, g, or t
gagccagcaggagattctgagacaagtgaatgaggtgaagaactccatgagtgaaactgtgcggctggtgagtggcatccagcacccgggctcagcaggcgtctacgagacaactcagcacttcatggacatcaaggaacacctgcacgtggtgaagagagatatcgacagcctcgcacagcgcagcatgcncatctaatgaaaaaccaaaatgcccagacctancanccattcccgtcgtgtctatccacgatccactttgtgatatttgtagtggtgcagacagtgttgttcgttggctatatcatgtacaggactcagcaagaagcagctgccaaaaaattcttttgaccttcattttcctata

SEQ ID NO: 2171 - DNA, 514 bp, Mus musculus
  misc_feature (338)..(338): n is a, c, g, or t
  misc_feature (349)..(349): n is a, c, g, or t
  misc_feature (359)..(359): n is a, c, g, or t
  misc_feature (363)..(363): n is a, c, g, or t
gttttgacccactgaagctatctgtctggtctgccttgatcttcttggattaagtatgctgggactaatagatgaggttcaagcgttttattacatctttctttagaacagaaaatctatgtgtgtgcttgagtactgccttaaaagtaaaagcctttcctagggagttcctggttggtcatttgtcaggtgcagttcccttttgcagatcatcagcctcagaaacgttccaagtcaggagaggaggcatgtcagttttggacatcttggacgtgaagctaactgtaagaaatgacggtttagtgtttgcactgctaggggataggaatagtgttggnggattgtgccntaatttattngtanattaaatgagtctagaattttcttcaggtgtaagcaaagtagagctggctttggccgaggctcaatacagcactttctcccagtagaagaaaagacagctaatggaatgagtcatgtctttcactgctttcctgggactttctgtattttg

SEQ ID NO: 2172 - DNA, 373 bp, Mus musculus
aagtacagcacttcgagttttaaagtctttaacattttaaagccaggtggaaaatgcagtgacaggttcgctcttcccagagcctctgcacagtaggggtatggtacctgatacccaagcaagctctcctggcagcaagtattgacaaactgttgctgtgctggtgatttagagtccaaatcctgttgtaccagatcttgggccatttgccctttcctctgcttagccagattggagctttctggttattaggtaactatgatactacctaatcaggtcaagacagagtcataacaagtggtaactttgttatattcaagaagaaatacttcaaattaagttgctactacctctttctgctgatctctggaaa

SEQ ID NO: 2173 - DNA, 526 bp, Mus musculus
  misc_feature (187)..(187): n is a, c, g, or t
  misc_feature (216)..(216): n is a, c, g, or t
  misc_feature (468)..(468): n is a, c, g, or t
gggtctgtttcctttagcctagatcctagaagaggctgggctccacttgcctcctaaagcagtttgtcctactccttgtcttctgcttgatttctggaactgggctttgtttcaagcatgtataagttttgtccttactcccacccaaaccctttcatcccaccatctacaaattaggggaggaagnacctctgcacagggctctgctactgtganctagagtaattctgcttgccaaatgacatctatcttcaccaattcactgactcaagtttaggaccactattttgttttgttttgaatttaaaaacaaaataggacaactgtggtggatgttgttatactagagaagaggtagttcttcctcctgctctatgcttggcctgcaagtagaaaaggggttgactgtctttctaccttgtctggaaatgactagaattaccatctcctgttggctgtcctcccctntctgagaaagatcaagcagacctgatgttcaacaagtagtgttcgctggtctgtgttc

SEQ ID NO: 2174 - DNA, 474 bp, Mus musculus
  misc_feature (193)..(194): n is a, c, g, or t
  misc_feature (293)..(293): n is a, c, g, or t
  misc_feature (353)..(353): n is a, c, g, or t
  misc_feature (355)..(355): n is a, c, g, or t
  misc_feature (358)..(358): n is a, c, g, or t
  misc_feature (429)..(429): n is a, c, g, or t
ttatgcggaatgactcgtgttactcagattttcaatcacttcgagaagtattctttgtaacagagctgtgcccacacacaagtctgtttgctcttcttatgtaacaaagtgccatgggatggggacacagctctagcagagcacttgcctgccatgtgaggctcaaggttcagtttctagcaccaacaaaacnnaacaatttatgaaaatgaaacgttttgttgcaatctgtttttttccaacttagaactacaactaagtagagcatcatgtgtataatatctgggcttttngacccatgtatactgtctatgagtaaacactgggcttatgatgttaaaagcaggtaatantntgncaggctggcagagactgctcagcagagcacggactttctgagaccattccagctgactaaaacatactctncctgctatacagtgtattctgaagggtgtattctgctttgtaact

SEQ ID NO: 2175 - DNA, 555 bp, Mus musculus
  misc_feature (26)..(26): n is a, c, g, or t
  misc_feature (34)..(34): n is a, c, g, or t
  misc_feature (75)..(75): n is a, c, g, or t
  misc_feature (185)..(185): n is a, c, g, or t
  misc_feature (188)..(188): n is a, c, g, or t
tacaccaacgtgcccttcctggtggncctggcgntcttgggctctgtcctggtgggcctcatcctggtccccggncctcctgcaggggcccctaggactgaggaacattgtggacagctccttcaagctactgctgctgggtctggtcgccttcaacttcgtcggcgcctttatgctggagagcntgnctggaccagtgtctcccagcctgcctgcggtggctgcggcctaaacgggcctccaagaagcaattcaagcggctgcaacaggagcttgcagaacatccatggcccactctgcccgttggctccgtgaggtagtgcaggccttggagggcatgctggacactggatctccctgcccctgagccacgactggaactctctcaagagacagtaccagtcacctcccacagccctgaagctggctgctgtcacactgctgtccggacacactctcctggggaagtgctgactgctgtctcactttagaccatcctgtgtagagatagcagctaccaactccatccagagctgctggcactataacaaataa

SEQ ID NO: 2176 - DNA, 186 bp, Mus musculus
tcttacagtggagagtatggaggtaaaggaggaaagcgattctctcattctggcaaccagctggacggccccatcaccgccttccgtatccgggtcaacagatactacatagtaggtctccaggtgcgctatggcacagtgtggagtgactatgtaggtggcacacagggagacctggaggagatc

SEQ ID NO: 2177 - DNA, 212 bp, Mus musculus
  misc_feature (126)..(132): n is a, c, g, or t
  misc_feature (134)..(134): n is a, c, g, or t
  misc_feature (136)..(140): n is a, c, g, or t
  misc_feature (142)..(146): n is a, c, g, or t
  misc_feature (148)..(148): n is a, c, g, or t
  misc_feature (150)..(150): n is a, c, g, or t
gaatctgtgatccaggtgtctggcaagtacaaatcatacgtgaagcagatgatcttcgtgacggacaagggccgctacctgccttttggaaaagcctcaggcacaagtttcaacgctgttcccttnnnnnnncncnnnnncnnnnntntncctccgtttcattagtgggcgatctggctctgccatagattctattagcctgcactgggata

SEQ ID NO: 2178 - DNA, 436 bp, Mus musculus
  misc_feature (221)..(221): n is a, c, g, or t
  misc_feature (282)..(282): n is a, c, g, or t
  misc_feature (406)..(406): n is a, c, g, or t
  misc_feature (408)..(408): n is a, c, g, or t
gtatgtcaatagcacaagcctctaagaccctcctgtcttttttgggtcagagccccagaccattgcatcacagtcattcggcaagagggtccttgcggcagacttctgttcattgcagagtgggactcacccctgaagaacactggtcgaaatattatacaactgcaacccttttctacttgagacattgaagttcagctcaggagacctgaagatggggnctggtgggaaaggaccagcagacatgtaggacttctttacatgtgttcagtcccccacagnagctaagcacagagactggctttgctctctgtctcgtgtgtcttcctgtaaactgggactctaatgggatggtaacaccacgattcccctggtttggtggcctaaacagtgatttttttaaaantntccccttttctggatcctttgtacacat

SEQ ID NO: 2179 - DNA, 484 bp, Mus musculus
  misc_feature (144)..(144): n is a, c, g, or t
  misc_feature (362)..(362): n is a, c, g, or t
  misc_feature (371)..(371): n is a, c, g, or t
  misc_feature (373)..(373): n is a, c, g, or t
  misc_feature (375)..(375): n is a, c, g, or t
gggacgtgggccaggcaccctcattctctgggcatctctgctgcaagtggacaagagtatttcagagatcactgaagcctgagtccatgcacctgccccaggagggggccattgtcctagggaccgcctatcacgccgactgcnttcccgaggccccgggtgggctaaggggctgggtctgcttcaccaatcacccaacctgagtcccccagctttaccacagagctgccaacgtcctttcactgtctccacacgatggcccagtatccttggttgtggatagggtcatccctggctcctcacccagcacccagcttaaccctgccaccccacactcctgggagcactgggctgagggggtntcagctggntntnggagtccagacctcgccatcccctgcccaccattgccgtggagggggctgccaggcatagctgctgtgagccatgtccttgtgtgtgtctgttcactcttaggagccac

SEQ ID NO: 2180 - DNA, 472 bp, Mus musculus
  misc_feature (232)..(232): n is a, c, g, or t
  misc_feature (289)..(289): n is a, c, g, or t
  misc_feature (325)..(325): n is a, c, g, or t
  misc_feature (328)..(329): n is a, c, g, or t
  misc_feature (428)..(428): n is a, c, g, or t
  misc_feature (443)..(443): n is a, c, g, or t
gataggcctaaaccttgtcatgtctcggaatgcaggcaagggggagtacaagattatggttgctgccctgggctgggccactgctgaactcattatgtcccgatgcatccccctctgggtgggagcccgaggcattgaatttgactggaaatatatccagatgagcattgactccaacatcagtctggtccactacatcgttgcatcagctcaggtctggatgataacacgntatgacctgtaccacaccttccggcctgctgttctcctcctgatgttccttagtgtntacaaggcctttgtcatggagaccttcgtccacctnttnntccttgggtagttggacagcactgctcgcccgggcagtagtaacaggactgctggccctcagcaccttggccctgtatgttgctgttgtcaatgtacantcctagcttgacatntcaggtgttggcgaaccttttcatttcct

SEQ ID NO: 2181 - DNA, 508 bp, Mus musculus
  misc_feature (330)..(332): n is a, c, g, or t
  misc_feature (334)..(334): n is a, c, g, or t
  misc_feature (337)..(337): n is a, c, g, or t
  misc_feature (341)..(341): n is a, c, g, or t
  misc_feature (361)..(361): n is a, c, g, or t
atctgtggacgtgttgatgcccaacgttggtgagattgtaggtggctcgatgcgctcctgggacagtgaggagattctcgaaggctataagagggaagggattgaccccgctccttactactggtatacagatcagagaaaatatggcacctgtcctcatggagggtatggcttgggcttggaacgatttcttagctggattctgaacaggtatcacatccgagatgtgtgcctgtaccctcgatttctccagcgctgcaggccataaccatggggccctcaagcacgaaggaaatgaaaagttaagactgcctctgcaaaagaacaaannncnccnaaantcgtcccttgacttcctgtngggggtagtagctttctcttgactttcccattatcagaaaaagcagtaggtatcacttgaacatcaagtgacattgatgctcctttaatgaatatactcattacaaaattttgaggaaatatatgtcatgtcactctttagtatgga

SEQ ID NO: 2182 - DNA, 506 bp, Mus musculus
tttttgtccttttaagtgtcgctgggattctcgaattcaagcatctaaaagagaaattggctgtttgacataaaagatactggagtcaaatacatagccctttacattcactgttagtcttttccttattcatatagtgtttataattctgaggggtatgagttgacaggggaaattaatgaaggggaaatggattataatttgcaatgaacatgattggatggtgggttattcaaatgattccaaccccgttagcctttagtttaagaacggggcagatggggcttccctctttgtaattcctgagtaacaaaagtaaatctgtttgcaaagactttgcacctgaatcttagccaccgtagacagctacgtcatccctgcctggtccttgggtgccatctgcactgccttgccgactcagcagggctaccagtggctgaagtgcagttgctctccccagatgcatgccgtgtgttctaatgggctgtatcccactaaccaataaa

SEQ ID NO: 2183 - DNA, 388 bp, Mus musculus
cccgtgcggaagagaactgctgaagaggaggatgaagcagaccccaagaggcagaagacagaaaacggggcgtcggcatgaacccctgcccgtgggcttggggatgggaggcccctcaggtcctggaggtggggcgggaacacacaaatccagccccctttctcctggctccctgctctggccctgccccagagctgtgacccttgtcctttgacccagcctctcatttccatctctccagacactgctccttcaccctcactgccaccggtccagctcctgacccgcctcatctgagctccccagccagccctcacttgccctagcattcttgttcttctttcctgccttccctcaccatcccatatgttccggtccctgcgaagcc

SEQ ID NO: 2184 - DNA, 416 bp, Mus musculus
gtggtgaatatctcctcctgaataagcttgcttccaacccctgtatttttgtgggtttttattttcccctttctactcttatgttctgatttctttcatctatgccttttaatttcccaattcagttttgtgagcctgcccggtaaagtgaattaagcatcccatctgcgttgtgctgtcttgttcccgtgacgagtacttaattgaagtgattctcctcagcctcccgtcaggaatttttgatcacattcagtttaaatcacattcactctgaaaccaaaactaatctttcagccaaaagttgtcataatgatttaacatgggacggaaagccccgtttctaggatcgtaagcggacgacagaagcagcgttgaagcaggatgtctgtgttggactctaaaacccatctcagcat

SEQ ID NO: 2185 - DNA, 447 bp, Mus musculus
  misc_feature (57)..(57): n is a, c, g, or t
  misc_feature (136)..(136): n is a, c, g, or t
  misc_feature (161)..(161): n is a, c, g, or t
  misc_feature (177)..(177): n is a, c, g, or t
  misc_feature (234)..(234): n is a, c, g, or t
  misc_feature (282)..(282): n is a, c, g, or t
  misc_feature (306)..(306): n is a, c, g, or t
  misc_feature (325)..(325): n is a, c, g, or t
  misc_feature (380)..(380): n is a, c, g, or t
  misc_feature (404)..(404): n is a, c, g, or t
ttccaggtgcttctgccttagagtctgtctgagcactcggtgttcgttctgcagccngcagtctctggttgtagaggctcttctcagtgaggtgctgaatctccagaagaccctgcacgatttcaaacaccgttcngtcgagcagcgccagggccaagtcnctgagcgtggtgtagnacaggcgctgctgaaaggagctggctggtgccatgctctctaccatggtggtcctgnagtcaccttctgaagctgtaagacccccaacaaacccttctgtaagtngccttgttcatggtgtcctcgcancaatagaaaagcctctganacaccagtcactcctctccgcctgtcctccttcctgtaggtagcttcagacattntacctggctcctgtgtggtccggnagccttgaggggcatgtcaaatctagctgtctagctgtgcctt

SEQ ID NO: 2186 - DNA, 442 bp, Mus musculus
tgtactatcgagtccatacacggctctctaaagccctacagagggttcatgtgtttagacctgagaaatcaggacatggaaatcagagcatatacataaggaacttaattttaatgtaatcatgtctaatgatcctcatcttcattccttgagattacccaagtaccgtcatgaccaagaagcctttccgtcattgagtacctgatttttaaaagcaagcacccaaataattctctctagggaatctcatttgttacaggtgagaagacagagggttttatggtgcctgagttagtcctgtgcctaaccagtggagtttccgtctctgtgcttgctaatagtttcacaagtggcttgacttttttagaagtattatgtggtattttactgtgtatcacttctgtggtaaacatgtgaagtcctttggcttagtcatacttca

SEQ ID NO: 2187 - DNA, 533 bp, Mus musculus
  misc_feature (132)..(132): n is a, c, g, or t
  misc_feature (314)..(314): n is a, c, g, or t
  misc_feature (329)..(329): n is a, c, g, or t
  misc_feature (351)..(351): n is a, c, g, or t
  misc_feature (370)..(370): n is a, c, g, or t
  misc_feature (375)..(375): n is a, c, g, or t
  misc_feature (446)..(446): n is a, c, g, or t
  misc_feature (452)..(452): n is a, c, g, or t
  misc_feature (454)..(454): n is a, c, g, or t
  misc_feature (475)..(475): n is a, c, g, or t
  misc_feature (500)..(500): n is a, c, g, or t
  misc_feature (502)..(502): n is a, c, g, or t
gtctgctcaggacacggaactggcactgaagaagtgggagtttgtgctgagacagttgcggccctgaggccaggggatccgggaccccgtgctacgattggagtgggcagtgagatgcctgaagctgttagncctggtgaaggctcatcctctctggaggatggtgacatcattccgtctctggtttgctccagtgacactcctgggatggccttacgcagtcaggaataaccaggcataaggtggggaaagctgtgactgcatatccagagaaggaagcgcatagaggaggcaggccctggggttggggttgnccctggggtgtagcnaggattgcctagtgtgcataanccctgggctccatccccancactntgggttcgaaccccagcagctcacagctcacaactgtaaccctaccatgctaggggattagaagctcaagnccactntnagctactcagagaatttgatncaagcctgggctacacgagaccctntnttcaagaaaatagatccttagtgactgacac

SEQ ID NO: 2188 - DNA, 543 bp, Mus musculus
atccctgtcatcacttggtattgtcagactttaatcgaagccattctaactggtatctagtgacacagcagtatggcattaatttccattattctaatatttaatgataaggaggctccttttgcccactttttaaatgggatcagttatcttatcaagaatcatgaggtatttttttgttttttaattctggattcaagttcttaaagaaatatgtgacttgtgagtattatctccatatttgtgagcgcatccttaggcattttcttaatcatctttgaatagacccagttttcccttcccaatctacatagttatttcttctttgtcttactgaagtaggtagcaacccaggtattgtctgatcactgaggacatttgaacaaatgttaacccattgattagttaacttcatccaacttcattgtgtagtttttgtattaaagtgctaactgccagaagcacgcagaataacctatcttagtttttatttattttatgtgcaactatatttgcctaatatgcagctcttattccaaaggg

SEQ ID NO: 2189 - DNA, 499 bp, Mus musculus
  misc_feature (279)..(279): n is a, c, g, or t
gacagttggctttttcttaccaagccccttcactgtacagaaacaaccctttgacaattcttttgggagtcccccctctctttccccgactccagccctttttatgttggtttagcacaaatctccccccaacctccaaaccagaccccctaccagtcgatattaattgttttatatctatttaatcttattcgatggagaccatgcttcggttgttttatactttgccaggtaaactttattacccaccccacctccaactatgccctaatttttttnaaaaaaggaaaaaaaaaacacacacaaaaaaaacaaaacaaaacaaacacagagactttgggttcgagtctcggtcttaattccctttctgtggcaggttttcttccgtgcgtgtgcctgtgtgtgtgtgtggagtgagttctgatttgtgttcgtttctctgttgatttctcttgttgctttcttccaaccccgaccctggtttccgtatttcacagca

SEQ ID NO: 2190 - DNA, 503 bp, Mus musculus
agtatagcacagtagccttccctgtgactctgacccttccaatgttttcttttgtgtttataatcatggccctgtctccccaaatataccaacttttgcctgtaagttccctaggacatctatttcactgtgtcgtttccttccctcttttgaaatgaagacacaggctccacacattcgtcctttccatagagcaggtataggaccaggtgcaataaaaaaaaatggccttgagtatcggccgagatacaaggtgtaccccatcttccctggcccctgggtctctttcctgtgggagtgtaactgagaagtgacagctacatcttagacgtgtcagtagcacatttcattaccagggtctgtacctcagaggtagagccagatctggagctggccatctggtgtcttcactcctcacaactttttttcgttcatttggaaaactcagaaagtgggttctaaaatacagggtgttctccagtgtctgaccttagctcaagcta

SEQ ID NO: 2191 - DNA, 526 bp, Mus musculus
  misc_feature (79)..(79): n is a, c, g, or t
  misc_feature (327)..(327): n is a, c, g, or t
  misc_feature (396)..(396): n is a, c, g, or t
  misc_feature (406)..(406): n is a, c, g, or t
  misc_feature (478)..(478): n is a, c, g, or t
atcacctcctgagtcatctaaagacctcctctggccttctttctctacatcctagggaatgctggctattatctctganatcctggagccacacctggggaagtgctaatggccaggacatatcgaaaggacattgccctggaaaataaatgaggaaacgaagaggttatgagagacagggtcagccaagaaagggatagagctggagcagggggatgcacagaggaggtcatggaaagaagctaagctatggggactgacaagagtaaggatggagagccctagagactacaaggttgaaatgggaaaagccaggaagaatgagcnaaactggagaaaggataggagggagacaagagatagggctggggaagtgaagcatggaaggagagaggntgagaagggntgaagacagtttttaaagggagatgacaaagcagaggaagacagaagatgataggatgacctggggagttgnccatttctcagggtggtgcgggggagatggctctctggtgggacaacc

SEQ ID NO: 2192 - DNA, 428 bp, Mus musculus
  misc_feature (386)..(387): n is a, c, g, or t
  misc_feature (389)..(389): n is a, c, g, or t
agttttgttgtatcacctgtcacagatgtatgtggaggggttgtttctgagtactagactagcctctgtggtataaaacaagagtctgtctcttgggctttttagacagagctcaccgagttgaagtgtgaagtgtagttccttattgatcacatgaacgtctcctgagcggagactgtagaacttggaaatgagaaatcttgccgtgggcagtggtgcaaactgtggctgaggcccgaggagcttgagttcaagcctgcttcgggctgtgtagccagactgctacaaaggggttaagagagagagagagagagagagagcaagagagagagagggagagcacgcgcgagagcgagagcgagcattcagctggcttgagctgtgtnnantctgcagagacttcagaaccacacattccttcttatgtg

SEQ ID NO: 2193 - DNA, 149 bp, Mus musculus
gtaaactgaggaaggccccacactgacccagcaatagaagtgttgagaaggcagacttaaggctcttccggcttagacacacagtgcctttccctgtgaacctgcagaggccctggtcagcattttctgctttcacagaagcagctcac

SEQ ID NO: 2194 - DNA, 258 bp, Mus musculus
  misc_feature (147)..(147): n is a, c, g, or t
  misc_feature (150)..(150): n is a, c, g, or t
atgcctatcaggtaggtagccccattcaccagattctgccaaagctttgtgctagctcccaagtcatttaaagtgtgaccaagcactgcttttagggaaagacagcagtgaccagctctgtttgtcttgaggacacagggtttccgnagncttcacgttcttcaagtcattcctaccgattctgcctctacccttgtggtggaagtctcatccctcacagtttcttgtcttctgggtctgacctagatgcgagctgtt

SEQ ID NO: 2195 - DNA, 140 bp, Mus musculus
  misc_feature (32)..(32): n is a, c, g, or t
  misc_feature (86)..(86): n is a, c, g, or t
  misc_feature (93)..(93): n is a, c, g, or t
  misc_feature (100)..(100): n is a, c, g, or t
  misc_feature (102)..(102): n is a, c, g, or t
gacagctcctcatggcctcgtgctggatttgncatcactctaacaacacctcgctgtatcttaacatctctgacagctcctcatgncctcgtngctggantnggctaaatgcttagctacctgagaaatgattcggtttt

SEQ ID NO: 2196 - DNA, 168 bp, Mus musculus
gcaggttctgcatttcaaccacaggggtctccagggctacaaatctgcctctccaccttgacttccagctgcctggcactttcggcatgactactcactttctgtgctgtctaaagttctatctcagatctcagcttcctcaatagcccctatggctgtagcagtggc

SEQ ID NO: 2197 - DNA, 114 bp, Mus musculus
aaggccaagatgcactatcggaagaagaagcagatcttgaggttacggaaacaggcagaaaagaatgtggagaagaaaatctgcaagttcacagaggtcctcaagaccaacgga

SEQ ID NO: 2198 - DNA, 134 bp, Mus musculus
ggggcggcagtacctgctgaggccaggggagtataggcgctaccacgattggggcgccatgaatgccagggtgggctctctgaggagaatcatggatttctattgaattttcttactctgccctttcatcattt

SEQ ID NO: 2199 - DNA, 386 bp, Mus musculus
  misc_feature (220)..(220): n is a, c, g, or t
  misc_feature (227)..(227): n is a, c, g, or t
acattgtgatatccagcggcttcgtgggaggctttttgctaggcctggcatcttaaggacttgaaggctctatggtagtggatccaacaatgagaggaagactgtggcagcagggttatctcttaatggcacatgctaccagtctccaaagtaaggaacagccggctggacgattgcaaatgaagcagcttagcattttgccgcctgaagcttaccaagntagtatntcctgtaagacaacctatgtgctgtgtacacaatagtattcttgagcaaccatggattttgcaaatttttaaatttaacatttgtttagaaactagcctatgattatcatcactggatatagtggagacagaaaaagctgttacatgtactgtccaatg

SEQ ID NO: 2200 - DNA, 159 bp, Mus musculus
  misc_feature (60)..(60): n is a, c, g, or t
ccatgaattacctggaccgtttcttggctggagtcccgactcctaagacccatcttcagntcctgggtgcagtgtgcatgttcctagcttccaagctgaaagagaccatcccgctgactgcggaaaagctgtgcatttacaccgacaactctgtgaagc

SEQ ID NO: 2201 - DNA, 264 bp, Mus musculus
ggccttcagcttgtgatcctcctgtctcagcctcctagatcctggaattacagacacaggctacaacctgttgctagataattctttaggcatataaaacttgctgaccaggagcttccttaaagaatgacctgactacaagattaatcttattccttgacaagtacacatgtgagtagagcagcttgtgaacttgttagttcccaaaaccaggaaggtggagacccaggatattgtgtggctgccgagaaagcgctacgtcag

SEQ ID NO: 2202 - DNA, 495 bp, Mus musculus
  misc_feature (131)..(133): n is a, c, g, or t
  misc_feature (147)..(147): n is a, c, g, or t
  misc_feature (221)..(221): n is a, c, g, or t
  misc_feature (242)..(242): n is a, c, g, or t
  misc_feature (246)..(246): n is a, c, g, or t
  misc_feature (315)..(315): n is a, c, g, or t
  misc_feature (318)..(318): n is a, c, g, or t
  misc_feature (326)..(326): n is a, c, g, or t
  misc_feature (342)..(342): n is a, c, g, or t
  misc_feature (355)..(355): n is a, c, g, or t
  misc_feature (358)..(358): n is a, c, g, or t
  misc_feature (360)..(360): n is a, c, g, or t
  misc_feature (362)..(362): n is a, c, g, or t
  misc_feature (384)..(384): n is a, c, g, or t
  misc_feature (386)..(386): n is a, c, g, or t
  misc_feature (395)..(395): n is a, c, g, or t
  misc_feature (419)..(419): n is a, c, g, or t
  misc_feature (425)..(425): n is a, c, g, or t
  misc_feature (427)..(427): n is a, c, g, or t
  misc_feature (430)..(430): n is a, c, g, or t
  misc_feature (461)..(461): n is a, c, g, or t
  misc_feature (468)..(468): n is a, c, g, or t
ttttacatcagcactctctccttcgccttccacgtatgacggtctcctcccgctccctccccttttcctggacacttcctagcgcccgctccacgcctcgcccctcaacccactcttgggatatttcgtcnnnccccccatcgcagncccctcgcttactactcccaaccttgtggcccccttcttccttggcccacttcccagaatccccctccccaggncccagactttgccagcccccncagngcaccgtccttactccgcaggccaccccaactctcagatccaacatcctgtgtttcaagccccttaggnttncctgcccnttccaccccgttttanggtttccagtgtntgntntntaagagcaggtgcaacccttgntnttcagagantcttcctgcctttgcttcttattncgattntnttntgatagtttaaggacaggtggtatatagtcnagctttntaaggatgacccaatgcaatttttaat

SEQ ID NO: 2203 - DNA, 323 bp, Mus musculus
  misc_feature (26)..(26): n is a, c, g, or t
  misc_feature (30)..(30): n is a, c, g, or t
  misc_feature (41)..(41): n is a, c, g, or t
  misc_feature (49)..(49): n is a, c, g, or t
  misc_feature (56)..(56): n is a, c, g, or t
  misc_feature (58)..(58): n is a, c, g, or t
  misc_feature (74)..(74): n is a, c, g, or t
  misc_feature (95)..(95): n is a, c, g, or t
  misc_feature (111)..(111): n is a, c, g, or t
  misc_feature (124)..(125): n is a, c, g, or t
  misc_feature (138)..(138): n is a, c, g, or t
gaagggttatgtctgtggagctggcnctgnggaaggcccanccgccganccgctgnanccaagccatgcgggcntgctggagacgagtttgaganccgtttccgccgcacnttctctgacctgnncgctcagctacangtgaccccaggctcagcccagcaacgcttcacccaggtttccgacgaacttttccaagggggccctaactggggccgtcttgtggcattctttgtctttggggctgccctgtgtgctgagagtgtcaacaaagaaatggagcctttggtgggacaagtgcaggattggatggtggcctacctgga

SEQ ID NO: 2204 - DNA, 260 bp, Mus musculus
tgtctggcccacaggacatgttggggaatgggaaagaaaagatgaataagttctgtcaacattaaatgaagaccaccggaggatgtgtctgtgaacacgcagaggcttgacagctgagctgcagcctggaagccctcgggaggactctccaggaagtagatgcaaagcccaccccctaactaagaagctgttcactgtcgatacctgatgggaaagaagaaatcagtttcctatagcagagtgtcactgggcacaccgga

SEQ ID NO: 2205 - DNA, 274 bp, Mus musculus
gacggcgagggctctcgaccttcgagagcaggatgcaggtccgcgtcaggctgtcgttgctgctgctctgcgcggtgctcctgggctcggcagccgcgacctcggatgacaaaactaaccaggatgactccttagattccaagagttctttgcccacagatgagtcagtgaaggaccacaccaccacgggcaaagtagttgctggccagatatttgttgattctgaagaagcagaagtggaatcccttcttcaggacgaggaagatagctccaa

SEQ ID NO: 2206 - DNA, 553 bp, Mus musculus
  misc_feature (233)..(233): n is a, c, g, or t
  misc_feature (243)..(243): n is a, c, g, or t
  misc_feature (247)..(247): n is a, c, g, or t
  misc_feature (357)..(357): n is a, c, g, or t
  misc_feature (361)..(361): n is a, c, g, or t
  misc_feature (370)..(370): n is a, c, g, or t
gcagttactttttcaatttcttagcttttaaatagtaggtagacagacgtagtggtgcacaacttacaacctctctactttcaacctcagcaagctcaggcaggatggatattagagtgcataagctcaaatatttatcacttgagatgtattaatatttaccaggggttttgatttgttttatttatgtaataaagaaggacatacagttagttttaaattgcattgaatcnagaagctgangtanttcaaatttttttccttttccttctaattgttttgaaattaaagttattgattggttttgaaatgtacttgccattgtgaggtcagagtagtatagaatgtttgcttttntttntctttgagntcctaatgtgtttggaaataaaagaatggtaggaaagttgtccactgattgtcacaaagaaagtaaatttgtgaaagttgatttgagaatggaatttaagatcatgactttgaaagtttttgtttgttttttaatttaaactgaagcagagttcggtaggtcactccaacactctggaagggt

SEQ ID NO: 2207 - DNA, 462 bp, Mus musculus
  misc_feature (187)..(187): n is a, c, g, or t
  misc_feature (400)..(400): n is a, c, g, or t
  misc_feature (402)..(402): n is a, c, g, or t
  misc_feature (426)..(429): n is a, c, g, or t
gccatctcaccagcgagaacatttttttttaaagatagggtattggtgacagttggcgggtctccctacaggatgtgatatagtcacagtgagtctccctttctttctttcttttttattttttgtttgtttgtttttcgagacatggtttctctgtaaccctggctgtcctggaactcactttgtngaccagctggcctcgaactcagaaatccgccagcctctgcctcccgagtgctgggattaaaggtgtgtaccaacacacccggcgagtctccctttcttaaccccatgaggataatccttcgccaccatgatgtgctctcctaactcattttgggcactgttacctacacacgtcctcttttcatagacaaggaaactgagaacaaacaaggtncnaaaaaaaaaaaaaaaaaaaaaaannnngatagggtgttggtggtcatagtgcacaccttt

SEQ ID NO: 2208 - DNA, 513 bp, Mus musculus
  misc_feature (347)..(347): n is a, c, g, or t
  misc_feature (353)..(353): n is a, c, g, or t
  misc_feature (359)..(359): n is a, c, g, or t
  misc_feature (376)..(376): n is a, c, g, or t
  misc_feature (390)..(390): n is a, c, g, or t
  misc_feature (392)..(392): n is a, c, g, or t
  misc_feature (399)..(399): n is a, c, g, or t
  misc_feature (413)..(413): n is a, c, g, or t
  misc_feature (452)..(452): n is a, c, g, or t
gagctgcttgctgagaacgcttgcatttgatgtagggctctggatggtggcaccgcctggaagaggcgtgaggcgtgttgaatcccagaagctgcttagaacctgctgccttccttttcagggatgcgcggctctcggcagagctgcagtgaatgtttgtttcagtgccatacggaatgacaactctcagtggctttcctctttcctttttctttcttcgttctgcaaacatacacaagacactcgagtcatgtctactgtaccctgtctttcctgagagacctttcgtcatcctgttgatgtgcataacttcttacctgtcttctaaggtcctgagcattgacaanctgggnaaaccncagttagttgcaagttnaaccctaaaaacangnttaagtntgagactagaactngccattaagtcaaaagcaaaacaagccaagcaggacgtncttcagggtgtttgggaaatgcagtaactgggaaattttaccagtctacatgccaggtcat

SEQ ID NO: 2209 - DNA, 536 bp, Mus musculus
  misc_feature (92)..(92): n is a, c, g, or t
  misc_feature (106)..(106): n is a, c, g, or t
  misc_feature (116)..(116): n is a, c, g, or t
  misc_feature (127)..(127): n is a, c, g, or t
  misc_feature (131)..(131): n is a, c, g, or t
  misc_feature (143)..(143): n is a, c, g, or t
  misc_feature (145)..(145): n is a, c, g, or t
  misc_feature (148)..(148): n is a, c, g, or t
  misc_feature (150)..(150): n is a, c, g, or t
  misc_feature (157)..(157): n is a, c, g, or t
  misc_feature (168)..(168): n is a, c, g, or t
  misc_feature (177)..(177): n is a, c, g, or t
  misc_feature (191)..(191): n is a, c, g, or t
  misc_feature (199)..(199): n is a, c, g, or t
  misc_feature (226)..(226): n is a, c, g, or t
  misc_feature (230)..(230): n is a, c, g, or t
  misc_feature (258)..(258): n is a, c, g, or t
  misc_feature (263)..(263): n is a, c, g, or t
  misc_feature (307)..(307): n is a, c, g, or t
  misc_feature (311)..(311): n is a, c, g, or t
  misc_feature (326)..(326): n is a, c, g, or t
  misc_feature (338)..(338): n is a, c, g, or t
  misc_feature (345)..(346): n is a, c, g, or t
  misc_feature (353)..(353): n is a, c, g, or t
  misc_feature (360)..(360): n is a, c, g, or t
  misc_feature (377)..(377): n is a, c, g, or t
  misc_feature (381)..(381): n is a, c, g, or t
  misc_feature (384)..(384): n is a, c, g, or t
  misc_feature (389)..(389): n is a, c, g, or t
  misc_feature (391)..(391): n is a, c, g, or t
  misc_feature (398)..(398): n is a, c, g, or t
  misc_feature (402)..(402): n is a, c, g, or t
  misc_feature (415)..(415): n is a, c, g, or t
  misc_feature (439)..(439): n is a, c, g, or t
  misc_feature (461)..(461): n is a, c, g, or t
  misc_feature (491)..(491): n is a, c, g, or t
  misc_feature (498)..(498): n is a, c, g, or t
tgaggccaggccgtgagctgcatccctggctgaggcctcctttagacttctgacttacagaacctggaggcaggaactgaagcagagatcanagggggacagcacntactggcttnctcaacctgcnttcnatataacccagnanctntntctctancgaccacactncccacactntgttacgttttcancaataggntcttcacatctgactgtggtgacagcnggancaaggctacagcaggtgctgttttgagnccctntgggaagacattttttggagcagacaaatggctgagcttctganttgntgagtaggttccggntctttgtttagnttccctnnaggcttntactttntttaggaggatttattntccngtntcctntntggtagntctnacggttttctttntcagactctgggtaagcgaagctntggacagtgcttgctgacagcnccttggcagctgcctctggattcagtgctntccccanccatggtacttgacattcctttctgatgttagtgatac

SEQ ID NO: 2210 - DNA, 245 bp, Mus musculus
  misc_feature (83)..(84): n is a, c, g, or t
tgtgggtaccttctcttctggactgcgctctgggttcagtccccagtaccagcatcataaataaacaactgagatgaaactgnntcatactgtttcctgtcatcctgtttgccctccttggttgcagcccacatagtgcctggcattctcctctctctcagtgtgtaagaactccatgggaagaaagctacacaagtgatgtaggaacagggcctcttcctttgctacttgaagcctgctctttc

SEQ ID NO: 2211 - DNA, 543 bp, Mus musculus
  misc_feature (31)..(31): n is a, c, g, or t
  misc_feature (64)..(64): n is a, c, g, or t
  misc_feature (204)..(204): n is a, c, g, or t
  misc_feature (231)..(231): n is a, c, g, or t
  misc_feature (260)..(260): n is a, c, g, or t
  misc_feature (327)..(327): n is a, c, g, or t
  misc_feature (364)..(364): n is a, c, g, or t
  misc_feature (367)..(368): n is a, c, g, or t
  misc_feature (371)..(371): n is a, c, g, or t
  misc_feature (376)..(378): n is a, c, g, or t
  misc_feature (381)..(381): n is a, c, g, or t
  misc_feature (412)..(412): n is a, c, g, or t
  misc_feature (428)..(429): n is a, c, g, or t
  misc_feature (450)..(450): n is a, c, g, or t
  misc_feature (456)..(456): n is a, c, g, or t
  misc_feature (459)..(459): n is a, c, g, or t
  misc_feature (464)..(464): n is a, c, g, or t
  misc_feature (468)..(468): n is a, c, g, or t
  misc_feature (473)..(473): n is a, c, g, or t
  misc_feature (476)..(476): n is a, c, g, or t
  misc_feature (479)..(479): n is a, c, g, or t
  misc_feature (487)..(487): n is a, c, g, or t
  misc_feature (489)..(489): n is a, c, g, or t
  misc_feature (500)..(500): n is a, c, g, or t
tgacattggctccagcaaactagctgaaggntccgctgtgctgccgccgcagtacatgctcggntccgacctgtgaaaaaacggaaagaagtccaggagctagtgtccaccatggccacacggggagcagtgagggcccacagccctcgggggcctgctgtgcatgtggcttttttaacactgtaactagattagactcagggnttttaaccatccctctccaccctcttngctttcctctcctctttcctctcagccantgtcctttctcttttcctctagaggagttgagctgtctaaactccatctgctgcttccctctcccanctctttcctgctgtcagatggatttggttgggttctnttnnttnttttnnnttntcctttttaaatagtgaacattaggaatganactggggtgttttttnnttttaattaaaaaatattaantttccntgntgcanttgnagcanccncantgtctccntnccagtgtcttnctctgcctcttgaaagggtgacagacagggtggcgctgtttta

SEQ ID NO: 2212 - DNA, 217 bp, Mus musculus
ctcactggaagtctgcacttctcaagcagaaggattaagcctctggggttgcttgcagtgataggcagccactgatgtctttttagtcagtggcctttgggccctggtcttcagtgtcagcactagggtttgtttgtcctctggggtcttttttggcacatgtcagttttgtttatataaaatgaagagactgtctctctgatgatgggtttaatga

SEQ ID NO: 2213 - DNA, 79 bp, Mus musculus
aaggtcttctggtggtctttaatgagccctgttgggagtgaggtgctttaacatggagaagcatgttattaaacagtga

SEQ ID NO: 2214 - DNA, 369 bp, Mus musculus
  misc_feature (119)..(119): n is a, c, g, or t
  misc_feature (243)..(243): n is a, c, g, or t
  misc_feature (250)..(250): n is a, c, g, or t
  misc_feature (267)..(267): n is a, c, g, or t
  misc_feature (271)..(271): n is a, c, g, or t
  misc_feature (276)..(276): n is a, c, g, or t
  misc_feature (279)..(279): n is a, c, g, or t
gagttttttgtttggtgtgtcttagacataatttggctgtgttgctgaggctagcccccaggccctggagtcatgcagttcctctatctcagcctccacgaatgcatgccacagcatgncaatacattgtgtgcgggtgggggtgggtgttgcctgcatgtaggtctgtatcgcatgtgtgcctggtgcccatggaagccagagaagggcaatggatccctagaacctgagttacaaacagtntcagccntcatgtggatgctgagnatcnaaccntantcttctctagaagagtagttcttaactgctgagccatcactacagtcatgacctcttactctttaaaagctagccttgataattataaat

SEQ ID NO: 2215 - DNA, 38 bp, Mus musculus
aaagcggtatcgctggaccacggatcgcaaagtacatc

SEQ ID NO: 2216 - DNA, 490 bp, Mus musculus
  misc_feature (380)..(380): n is a, c, g, or t
  misc_feature (398)..(398): n is a, c, g, or t
gcaaagtacatctagctaccggtaaggtcacccactctttcctccatgtaccagactgcccctatcctctgctaggaagagacttgctgactaaactcaaagcccagatccacttcgagggatcaggagctcaggttgtgggaccaatgggacagcccctgcaagtgctgaccctaaacatagaagatgagtatcggctacatgagacctcaacagagccggatgtttctctagggtccacctggctttctgattttccccaggcctgggcggaaactgggggcatgggactggcagttcgccaagcgcctctgattatacctctgaaggcaagctaactatgggacagccgctagtcatcctggccccccatgcagtanaggcactggtcaagcaancccctgaccgctggctatccaatgcccgcatgacccactaccaggcaatgctcctagacactgaccgagttcagttcggaccagtggtggcc

SEQ ID NO: 2217 - DNA, 272 bp, Mus musculus
  misc_feature (163)..(163): n is a, c, g, or t
  misc_feature (217)..(217): n is a, c, g, or t
  misc_feature (223)..(223): n is a, c, g, or t
aggccgggagctgggcggtgacagcgaggccggggtgaccggtgggggcggccggcacttgtacttttgagtgggccggtaactccgctgaggtgctccggaggagagggggcttcgggagtgaggcgccggcggcagcgctgcctcctaggggaggaggggnctctggagccgggtcgcggagatgccccgggagtagccggtcgcctcctccccnggcggngtctgtcaggttccgatcccgcccgggagcgggcctgcgagtccccgga

SEQ ID NO: 2218 - DNA, 509 bp, Mus musculus
agatactttccactttaggctcacagggttgagttgcaaaagccacagctctttgttctgtgtgcactttcttggagaaccccattgtgcaccctgagttctgcctgtgcttcggctgatcccatattggaccggatagagctcagctcttgcctttgttgctgctaacactggaggtgggcgttcctagctgcagtgtgctgctatgcctctctgcctaggaaccaaattttaaagaagtcagagacattttgaggtggttactacagattactgtttcacattgttttcctcactggacaggactgacaggattacgggggtggttcctttaactcttcaccaagtcctctagctgtatttctgaaggctctcacacttcttctgtgaagcgtgggcttcatttccatggccctgaggcccagagagacagctgtccacttaccggcagggtagtcatagacatagatactgcagcctgccctcctcttgaggctgtttctgacaaa

SEQ ID NO: 2219 - DNA, 493 bp, Mus musculus
  misc_feature (468)..(468): n is a, c, g, or t
gagagcactcactgtacgttggaaatttgtaggttggtgtgtattgagtggggcagaaatggcagccctgggaagtatggggagatcaatgccagacgaagcagggtggttcacagagtggagatgagaggggacagtgacataaatgttaagtatcttgtgctcagtgacagtgtgtttgctgcacctgacagtcagaagcgaaactgagggacccctgtgtgccttgttgaagagacttagatggtctctaaccttgtcatgaccagacttctactttaataaatgtgttgttatggcctgtgcagagtaaaagaccaaagtaggcttgaagtcggctatagtagaaatgtatatgctacagaaacctgcagacactaccaaatacagcttaatggactctttgtgaagaattaactttcatctaacttcaagagtggatagtgaaaaccaaatatcaaatctatnggatttttccccataacatcacata

SEQ ID NO: 2220 - DNA, 323 bp, Mus musculus
tgggcacctgtaccagctcaccaagggctctgcccacatcttctggaggcagaattgtggagttcggtgcgtgcttccctgggctgagttccagtccctcctgtgtgcctgccaccctgtggaaccaggccccaccatgcaggccttgcggtccaccttggacctcacctgtaacggccacgtgtctgtctttgagtttgacgtcttcaccaggctctttcagccgtggcccactttactgaggaattggcaactcctggctgtcaaccatcctggctacatggccttcctcacctacgatgaggtccaaacacgcctgcagg

SEQ ID NO: 2221 - DNA, 537 bp, Mus musculus
gagaaccaactgtaagcacctctgacctccagagcacagctacagacatacacgcacagatgtgttcatattttttttaatttttaatttttttattttttatttatttattttgtgtatgtgggcacactgtcaccatcttcagacacaccagaagagggcatcagatcctcactacagatggttgtgagccaccatgtagttgctgggaattgaactcaggccctctggaagagcagtcagtgctcttaacctctgagccatctatctctccagcccgtgttcatgtttatacacagaaacacacaataaatgtacaaaacatttttaaataatttcttcctgtgttatgtcctgctcactggcatatacttgatttgcttaatctatcacttctaacatgtacttttaaaaaaatcatataatatgttttttaaaaaatcatataagtctttgaagagttgaaaggcttggatcctgagaagaacattgtatactactgagcacagagtatgtacttagtattgtccagtggac

SEQ ID NO: 2222 - DNA, 123 bp, Mus musculus
  misc_feature (94)..(94): n is a, c, g, or t
ctgtggctctgtgctggtgcgtctcatccctgcccccagaggcactggcattgtctctgctcctgtgcccaagaagctcctgatgatggccggnatagatgactgctacacttcagccagagg

SEQ ID NO: 2223 - DNA, 548 bp, Mus musculus
  misc_feature (92)..(92): n is a, c, g, or t
  misc_feature (131)..(131): n is a, c, g, or t
  misc_feature (193)..(194): n is a, c, g, or t
  misc_feature (200)..(200): n is a, c, g, or t
  misc_feature (268)..(269): n is a, c, g, or t
  misc_feature (272)..(272): n is a, c, g, or t
  misc_feature (298)..(298): n is a, c, g, or t
  misc_feature (327)..(327): n is a, c, g, or t
  misc_feature (345)..(346): n is a, c, g, or t
gtggctctgtgctggtgcgtctcatccctgcccccagaggcactggcattgtctctgctcctgtgcccaagaagctcctgatgatggccggnatagatgactgctacacttcagccagaggctgcactgcnaccctgggcaactttgctaaggccacctttgatgccatctccaagacttacagctacctganncccganctctggaaagagactgtcttcaccaagtctccttatcaggaattcacggatcatcttgtgaaaacccnnacnagagtctctgttcagaggagccaggntccagctgtggctaccacataagggtttntatatgagaaagataaannaattaagtctgctgaaaaaaaaaaaaaaaaaaaaaacaaaaaagaaacaacaaaaagagaaaaaagaaaaaaagagacaacccgaaaaatagaagacgagtgtggggcggggggggggcgggggggcgcgccgctcggcgacgtattataaattcatacgcatgtttgtataaatagagagagggtatatacgggcgccacc

SEQ ID NO: 2224 - DNA, 250 bp, Mus musculus
  misc_feature (87)..(87): n is a, c, g, or t
cctgatgaaatggtcttcttcccgtgttgcccagtctggcctagaactttgaatcctatgcctccactgttcagtgctggaattgcntggtgtgtgtaccactgcagcaggcatcttcatcttatcagcagccctcttgcctcagctcagcttctcaaaagtgcctgccacagcttcatgactatagatggacactgtaggctcaatcttgtgccctagtcttttaaatggcctcagtttattaatatag

SEQ ID NO: 2225 - DNA, 291 bp, Mus musculus
atcacaccctgtctgggatggctgctgtcaccttgaccaccactgctcatgtccccagtgtttacacatcctttggatgccaagacagcagctgggggtgggaaagcgatgggggaattggggggagcgggcatggggaagcagtgtccaaagcactttggaggaggcctgccaggcttcctatggcctctgataccctcatgctctgccctgagctgtttcactatgggataagaggttctgtgtccacatcccaccggttcccctcagcctcgtgaccagtgttcctga

SEQ ID NO: 2226 - DNA, 451 bp, Mus musculus
aaggccagttagagtcacggagtgaatctaaaaccagtctggacaatccaatgagatcctgtctcaaataacaacttagaaagaaggcaggagatacagttcagtggtagaggcgcctgcctagcatgtgtggacactgttcagttggaaagaaggaagacatcaacacgggacccaggttccttagcctctttcctaggacctatctgaatggggctgagagagggtctgaccgactgtgggatcaatgactcttaagttccatcccgttctgcgactgactggcaccctacacagtccccggccccagtgcccagaagggcttcctgtggttctgacctgaagtggcacctggcaagatcatttagctcttgcagtcttgggagctgacatattaatgtaaagcctcgtgaaatgtcactcattattatgcgttttgccagtgtttgag

SEQ ID NO: 2227 - DNA, 553 bp, Mus musculus
agccagcttgggttctctgtctaagctcccaccttttgcagatagtagagagctctgcaatgggcccaggcagtgtggcagcacccctgtaaacctggagtcctagacacagcagggtccagctataggcactctgggagagctagtgagacgctcctaggtccctctcaacacagtcccctcacttcctagctccagggaagcctgatcctgggacccagccctgccgcactaggactgggcagtgaaaggacacagaaatgtgtggcatgcccctgttctccctgctgggcagagcctcctctctaggggcgctggggcaaggaggcacctctcctttttctcctctctaaagcccctccacattcactgccccagaggttggcctcctcccaggctctgtctaccctgcccaaaccctcctgatcccatactggccactgccccccagcactcctgaggcctctcccactgagcctctctctgcctggccctccccggctctgactgggccaccctctcccttttctgtctccacagtttgttgcctcag

SEQ ID NO: 2228 - DNA, 374 bp, Mus musculus
tagagaaaccattacgtcccagacactttgttgttctcactttccttgtgttcttctggtatggaaataatgaacttttctgtcatatttcctcccccaagaatcaatcaaaatatttcctagtctatgctgacaagatagctcaccagagaagcacttgccacagattcctgatgttagacacctgagacctaaaagaggacagaagcaattccaggaactgtgttctacactctgcacacgtgccatggcacacgtgtgtccatactcaaacatgtcacacacttgtagataaaagagtgaaatcaagatatttcccaatcaaacgtatataaaattctgagcaactctttgtcacagttatcactcgatat

SEQ ID NO: 2229 - DNA, 287 bp, Mus musculus
agactcggacacctctgtggactcagcagcaggccgcaggaggacagtgggaatcctggacatgggaggagcctctctccaaattgcctacgaagttcctacctcagcctccgaccttcctcccaaacaggaagaagctgccaagatcctgctggccgagttcaacctgggctgtgacgtgcagcacacggagcacgtgtacagggtttatgtcaccaccttcctgggctttgggggcaactttgcccggcagcgctatgaagatctcgtgctgaatgaaacgctta

SEQ ID NO: 2230 - DNA, 540 bp, Mus musculus
gactactccagtacgtatggccttgtagcctgtgcccctgctgctgtgtgtgtggagcatttgaatctgtaagagaacagagggataagaagggaagacccatgttgcacctctcaggcctgagcagtcctttggctttcaaacggatcccacccagttgctaatgaagctgccattggagctttcattggccaaagaggagcccattgtctctgcaagcacaggttgcatccagactcctgtcccagatgaagacagacactgccctattgcacataagctccagagagtcccctgagtccctcatccccctgtgtagggtacaggagtgatcattccacccaggaaaatacatggttcatgctgtgggaagccggtgaggccccagacatcttgcacagaggatcgcttttcctgatgtttctcctccttcacatttcaaacggtggtgctgggatctcccagaagacatctctcacacatacttactacactggaattacgatggttcttttgagatttgcatgcttcatcggtgaa

SEQ ID NO: 2231 - DNA, 407 bp, Mus musculus
tgcgtcggcaatctctacagttagacgtccagatttagccagaagtctaaaaagggtcgggggaaaggttgagagcagctttttcatattatatacacaggacttctacggcgacagcgtttccgaatggccgcctgcggttgtcgcgtctcggcttctctcgggtggagggaagacccgcggcccaagaatcgatcgttcctctcgccgtgattcggggccccgctcaccttcgtccaggcccatcgaggcctcggttcatccaggtctgcgtgctcggccacgggtgggcctcccgtcccgagccggcgatggcagagtgttcttgctcagacccgccgccttaggccgcagaagccccgaaggcccagccttggccttcaggtggatgccattcttcccgtcat

SEQ ID NO: 2232 - DNA, 424 bp, Mus musculus
aatatatccaactcaggtcgcctttgctgacttgctgccatccaaacgtgtgcaacatctcatcttccttaagacaaaacaattcttcaaacgatactgcaagtacatcactaaacaccatgagctctatctgaagggatttctttaggaagaacagattttcccccatctcttggtaatttaaatttcttgcctgctcttatatattcttttgtaaattttttttatttgtttcaaaatcacaaatcaatgtgagccatctatcacataacaaccaggatgatcagacgccccactggtgattacgaaaatgaaaccagcagtgttccctcactgactcaattcctctcatacaaagatctcaaaagtatttttctacatcataaatctttctaaattttccaaccgttgcaaatttcctggt

SEQ ID NO: 2233 - DNA, 315 bp, Mus musculus
gctgggttctcctgtagctcttacagtcttttcacggcaaataagtgcttcccatgtgggagtggaggatgcccccagatgggtcattacgctgacagatatcctgggaaaacaagcagactctaccagacattttacctcaacaccggtgataagagcaacttcgcacgttggcggtaccaggtgactgtcaccctgtctggacagaaggtcactgggcacattctagtttctttgtttggaaatggaggaaactctaaacagtatgaagttttcaagggctctctgcagccaggtacttctcacgtcaatgaa

SEQ ID NO: 2234 - DNA, 262 bp, Mus musculus
  misc_feature (30)..(30): n is a, c, g, or t
  misc_feature (120)..(120): n is a, c, g, or t
  misc_feature (235)..(235): n is a, c, g, or t
taccctggggacatcaccaacaacatgatntgtgttggcttcctggagggaggcaaagattcctgccagggtgactctggtggccctgtggtctgcaatggagagctgcagggcattgtntcctggggctatggctgtgcccagccagatgctcctggtgtatacaccaaggtctgcaactacgtggactggattcagaacacaattgctgacaactagagaaccctagtctctnttcaatcagtattatcaataaagttca

SEQ ID NO: 2235 - DNA, 179 bp, Mus musculus
tggtaccagcatcctcatcccaagatgccttaatccacttctctggagaacagacttccatgggaatgatagcagggtcctctcgtccggcagctggccttctgcccgggttacacattcatcacgtttgccttgcttctcagtgagttttaataacagcttcagattcttcagcacca

SEQ ID NO: 2236 - DNA, 551 bp, Mus musculus
  misc_feature (316)..(316): n is a, c, g, or t
  misc_feature (318)..(318): n is a, c, g, or t
  misc_feature (331)..(331): n is a, c, g, or t
  misc_feature (359)..(359): n is a, c, g, or t
  misc_feature (366)..(366): n is a, c, g, or t
  misc_feature (371)..(371): n is a, c, g, or t
  misc_feature (424)..(424): n is a, c, g, or t
  misc_feature (443)..(444): n is a, c, g, or t
  misc_feature (446)..(447): n is a, c, g, or t
  misc_feature (453)..(453): n is a, c, g, or t
  misc_feature (486)..(486): n is a, c, g, or t
aatatcctcgtcatctgtgtgccaaccatccgcgatatctttgggtttattgggtccacttcagcccctagcctcatcttcatccttcccagtgtcttctacctccgtattgtacctactgaggtggaacctttgttttcctggcccaagatccaggccctgtgctttggtgtcctgggagtcctcttcatggccatcagcctgggcttcatgtttgccaactgggccacaggccagagccgtatgtctggccactgagctggcctggtttgcctcactcagcccctatgctcacgcgtgtatacgagggaatccnantcactttcctgantccttcctgcctgggacatggaggtgtntggtctnctaanaacattgctgtgggaaatggggacagttgaggaggcatagtaagtagtttatnccccttccccttagagttnncnntcactnccaacctcatgagaggaggtatgggaggccagntccttagaagagttcttagcccacatagttctcacttcctagatgaagctgttagggttaccctg

SEQ ID NO: 2237 - DNA, 515 bp, Mus musculus
  misc_feature (362)..(362): n is a, c, g, or t
  misc_feature (392)..(392): n is a, c, g, or t
  misc_feature (422)..(422): n is a, c, g, or t
  misc_feature (435)..(435): n is a, c, g, or t
  misc_feature (455)..(455): n is a, c, g, or t
gaagcttctgtgttggtgtggatcctaatcggaactgggacgcaaatttcggaggacctggagccagtagcaacccttgctctgattcataccatggacccagtcccaattctgaagttgaagtgaaatccatagtggacttcatcaagagccacgggaaagtcaaagcgttcattacccttcacagctattcccaactgctcatgttcccctatggctataaatgtgccaagccagatgactttaatgagctggatgaagtggcccaaagggctgcccagtctttgaaaagactccacggcaccagttacaaagtgggacccatctgttctgtcatctaccaggccagtggcggaagcatngactgggcttatgaccttggcatcaaatantcatttgcctttgaactgagagacacaggntactatggcttcntcctgccagccaagcagatnttgcccacagcagaagagacctggcttggcctgaagaccatcatggagcacgtacgagac

SEQ ID NO: 2238 - DNA, 270 bp, Mus musculus
  misc_feature (26)..(26): n is a, c, g, or t
  misc_feature (32)..(32): n is a, c, g, or t
  misc_feature (44)..(44): n is a, c, g, or t
  misc_feature (67)..(67): n is a, c, g, or t
  misc_feature (83)..(83): n is a, c, g, or t
  misc_feature (98)..(98): n is a, c, g, or t
  misc_feature (158)..(158): n is a, c, g, or t
  misc_feature (185)..(185): n is a, c, g, or t
  misc_feature (196)..(196): n is a, c, g, or t
  misc_feature (201)..(201): n is a, c, g, or t
  misc_feature (228)..(228): n is a, c, g, or t
  misc_feature (230)..(233): n is a, c, g, or t
acgacgccggcgagtttgtggacctntacgtnccgcggaaatgntccgcaagcaaccgcatcattgntgccaaggaccacgcntccatccagatgaangtggccgaggttgataggaccacaggccggtttaatggccagtttaaaacctatggcatntgcggggccattcgcaggatgggcgantcagatgattntattntccgattggctaaggctgatggaattntnnnncaaagaacttttgagcagaagaaatcgggaatttgtt

SEQ ID NO: 2239 - DNA, 507 bp, Mus musculus
  misc_feature (220)..(220): n is a, c, g, or t
  misc_feature (224)..(233): n is a, c, g, or t
  misc_feature (236)..(237): n is a, c, g, or t
  misc_feature (239)..(241): n is a, c, g, or t
  misc_feature (256)..(259): n is a, c, g, or t
  misc_feature (283)..(283): n is a, c, g, or t
aagatcatccggcaccccaattataattcatggaccctggacaatgacatcatgctgatcaaactggcttcccctgtgaccctcaatgccagagtggcctctgtacctctgcccagctcctgtgcacctgcaggcactcagtgcctcatctctggctggggcaacaccctcagcaatggtgtgaacaacccagacctgctccagtgtgttgatgccccantgcnnnnnnnnnntgnntnnntgccccagtgctgcnnnnggctgactgtgaggcctcctaccnctggggacatcaccaacaacatgatctgtgttggcttcctggagggaggcaaagattcctgccagggtgactctggtggccctgtggtctgcaatggagagctgcagggcattgtctcctggggctatggctgtgcccagccagatgctcctggtgtatacaccaaggtctgcaactacgtggactggattcagaacacaattgctgacaactagagaacccta

SEQ ID NO: 2240 - DNA, 424 bp, Mus musculus
gcatcagtgttatctcggccagagactaggactggagagggctctacagtttttaatggggcccagaatggtgtgtgtcagctgatccgaagggagtttcagaccagtgtaatcagcagagacattgatactgctgccaaattcattggtgcaggtgctgcaacagtaggagttgctggttctggtgctggtattggaacagtctttggcagtcttatcattggttatgccagaaacccttcactgaagcagcagctgttctcatatgctatcctgggatttgccttgtctgaagctatgggtctcttttgtttgatggttgcgttcttgatcttgtttgccatgtaacagaaattactgcctgaaatgttggcattcatagtaattacggatgtaattctgtgtatcttgctgtgactccgaa

SEQ ID NO: 2241 - DNA, 285 bp, Mus musculus
  misc_feature (28)..(28): n is a, c, g, or t
  misc_feature (99)..(99): n is a, c, g, or t
  misc_feature (151)..(151): n is a, c, g, or t
ttcaaagagctgctatcctgaaagcttntcccaaaaaagcagctgtggccaaagctgccattgcggcggctgcagctgctgctgctgctaaagctaaantcccagccaagaaggccacaggaccaggcaagaaggctgcaggccagaaggntcctgctcagaaggctgcaggccagaaggcagcacctcctgctaaaggtcagaagggtcagaagaccccagcccagaaagcacctgctccaaaggcggctggcaagaaagcgtgaggctacacagaataataaa

SEQ ID NO: 2242 - DNA, 147 bp, Mus musculus
  misc_feature (26)..(27): n is a, c, g, or t
  misc_feature (29)..(29): n is a, c, g, or t
  misc_feature (69)..(69): n is a, c, g, or t
  misc_feature (89)..(91): n is a, c, g, or t
ttccttgtgaaaacaccttgaacttnntnttggtccttagatgaaatgtttacatagcttctggtgatntccttcataattttatgttnnncctaaaagggtcatgggtgggacacattaaaaggtgagctttgaactgtagataat

SEQ ID NO: 2243 - DNA, 506 bp, Mus musculus
  misc_feature (427)..(427): n is a, c, g, or t
aacagtgcagcaacccttttaattcagctacagattctccttttccagcttaggaaatcccaactgacctgtgcgttcaatccagagaaaggcggtcatctccagcagaagtgaggagcgctgactggacggcgaggctcttccttcctccccatctccttgtcataacataagatgtattctgtacataatttacaaataaaacattttattttaattgttacttattatttagacatttctcaacactgaaatttgtaaaacaaaaaccatgtaaggtatgtttttagaaagtttcagtaacccacagaacatctgatctttctacagcagcttcagttgtgtgccaacattccatgtattttaatatgagtaaaagttatccttattaagtaagaacagacttaaagtagtagctgtttgtacnccttaatgttcattgatttattttaaatctttacatttagaaatgggggctatgtcatcagacgaggaggcactgctgt

SEQ ID NO: 2244 - DNA, 285 bp, Mus musculus
  misc_feature (158)..(158): n is a, c, g, or t
gcaggcgacacaagaagcggatccaggaagttggtgaaccatctaaagaagagaaggctgtagccaaatatcttcgattcaactgtccaacaaaatccaccaacatgatgggtcatcgggttgactattttattgcttcaaaagcagtggagtgcctnttggattcaaagtgggccaaggccaagaaaggagaggacgctttatttacaaccagggagtctgtggtcgactactgcaacaggcttttaaagaaacagtttttccatcgggccctaaaagtaatga

SEQ ID NO: 2245 - DNA, 136 bp, Mus musculus
  misc_feature (28)..(28): n is a, c, g, or t
  misc_feature (62)..(62): n is a, c, g, or t
  misc_feature (74)..(74): n is a, c, g, or t
gaagcagcatgtattggaggctttccanttctgcttctgaccctggggttcagcactctcanccccacaggctnttctgaagaaacccgctcaactgtgacctatagggagaggggatcgcagaaccagggcatct

SEQ ID NO: 2246 - DNA, 496 bp, Mus musculus
  misc_feature (202)..(202): n is a, c, g, or t
  misc_feature (205)..(205): n is a, c, g, or t
ggtttgcttgactgtactggactttgctgtaggaggagggagggaaatggtaatcgctaagagctcatcttttccagatcgtatcatttctcttctattagtggcagagttgattctgtaatttcaaatgatgttcaaaggggaggtatttttttttaaacagatgatctcatttgctgaatgatttaagagtaaaatttanccnctgcgtggctttgtgtatagtaacaacaggttttattgcactatctatggttgaaatacctgtgcaaagaaatgcagggcacaggggaggtaaaaattcaagatgtttgatacgttaaattattactcttaagtttatatttgttttaaatgggacacatcttacttaatccatctcaatttagtgttttaataaaaaaagaactaaaattatttcaacttgggcttacatgtgtcaatatgggcaatatgaatatgggcaatatttttatgcccgtgtattttcacattt

SEQ ID NO: 2247 - DNA, 50 bp, Mus musculus
aaagtacactcatctactgatgctgcggagcgagatcacttacagtgcca

SEQ ID NO: 2248 - DNA, 185 bp, Mus musculus
  misc_feature (70)..(70): n is a, c, g, or t
  misc_feature (73)..(73): n is a, c, g, or t
  misc_feature (76)..(76): n is a, c, g, or t
  misc_feature (103)..(103): n is a, c, g, or t
  misc_feature (106)..(106): n is a, c, g, or t
  misc_feature (109)..(109): n is a, c, g, or t
  misc_feature (160)..(160): n is a, c, g, or t
aaagtacactcatctactgatgctgcggagcgagatcacttacagtgccaaaaacaacaaatgcgagganttnatntgcaactgtgaccgtgaggccgccatntgnttntccaaggtcccgtacaacaaggaatacaaaaaccttgacaccgggaaattntgttagcctgtcacctcacttcctg

SEQ ID NO: 2249 - DNA, 201 bp, Mus musculus
  misc_feature (30)..(30): n is a, c, g, or t
  misc_feature (36)..(36): n is a, c, g, or t
  misc_feature (39)..(40): n is a, c, g, or t
  misc_feature (42)..(42): n is a, c, g, or t
  misc_feature (56)..(56): n is a, c, g, or t
  misc_feature (80)..(81): n is a, c, g, or t
  misc_feature (83)..(83): n is a, c, g, or t
  misc_feature (88)..(88): n is a, c, g, or t
  misc_feature (90)..(90): n is a, c, g, or t
  misc_feature (111)..(111): n is a, c, g, or t
  misc_feature (114)..(114): n is a, c, g, or t
  misc_feature (119)..(119): n is a, c, g, or t
  misc_feature (121)..(121): n is a, c, g, or t
  misc_feature (160)..(161): n is a, c, g, or t
  misc_feature (165)..(165): n is a, c, g, or t
  misc_feature (172)..(172): n is a, c, g, or t
gcctaagtggatcaatgctactgacccttntgcccncanntntgacccattataantcagctgccaaagcttaggcactnntntacantnttgtgtaaaagtaaatgtttnttnccggntntgaaggtcgagacagcgacacaatcagaaagaatgaganntcanccatcantcacccaggcttacttaggcatgaaaaga

SEQ ID NO: 2250 - DNA, 310 bp, Mus musculus
  misc_feature (116)..(116): n is a, c, g, or t
  misc_feature (131)..(131): n is a, c, g, or t
  misc_feature (242)..(242): n is a, c, g, or t
  misc_feature (267)..(267): n is a, c, g, or t
ttgagccattgggaagcctctcgacaccctgatacaacccactccccctggcatctggaggcatcctgtatcctggtggctgtcatggctgagggaagcctcttgccaccagcccntgggtaatatgcacngaggtatttagccaactggcaccttttgaagtgcgtctgttgctgcttagtgtctggggttttcttcgggagcatgggcccttgccccagaagttcatcttccagtctgancgtggccgcttcatccgggactttnccagggagggtggagctgaaggaggaccacatctgtctgtgct

SEQ ID NO: 2251 - DNA, 362 bp, Mus musculus
  misc_feature (60)..(62): n is a, c, g, or t
  misc_feature (66)..(66): n is a, c, g, or t
  misc_feature (70)..(70): n is a, c, g, or t
  misc_feature (72)..(72): n is a, c, g, or t
  misc_feature (147)..(147): n is a, c, g, or t
  misc_feature (305)..(305): n is a, c, g, or t
ttgtcttatgctttgaaaccctcttcccatctgatgccatcacagggtccagtgtccccnnngccntggngntggccttcttctagtaacttgtaaagtgatggatggtgtcacatctgatagatacatttccaagttgtcatcttnaggaaaaataaactttttttcaatcatatttatggctaatgccgatttgactgctgctatttagagtcataatggctacgtcactggattttgttctgagacagcctacagtgtcccagcgcactgcactttttgtttgaattggaaactcataccanccaccaaacgatggtatccagcgtttagaaagatactctgacagttttctgacagac

SEQ ID NO: 2252 - DNA, 386 bp, Mus musculus
  misc_feature (335)..(335): n is a, c, g, or t
  misc_feature (338)..(338): n is a, c, g, or t
gagctattgcagttggcctgcccttttctttgctaggagccaagaagggagggaatagatagatgtatgccaaggttgggcttttcacccatctgccaactttctcttgcttcttgctaccattcaggcctgttcccttggaaaaggatggtccctctgtctttaaactttgtaataaagttaacttccagtcaggatcagacccgtttccttcttcataggcctagaagtagacaggagcctctagtgtgcaaatcagctggtggcttagctgccagggtgggtggctctgcttccttggtgtctgagaaccttccttacctttcctacagacnttntgcagaggtatctgacaatatgtaagtactatgtttccttgtggtgta

SEQ ID NO: 2253 - DNA, 562 bp, Mus musculus
  misc_feature (157)..(158): n is a, c, g, or t
  misc_feature (304)..(304): n is a, c, g, or t
  misc_feature (306)..(306): n is a, c, g, or t
  misc_feature (316)..(316): n is a, c, g, or t
  misc_feature (318)..(318): n is a, c, g, or t
  misc_feature (325)..(328): n is a, c, g, or t
  misc_feature (330)..(333): n is a, c, g, or t
  misc_feature (338)..(338): n is a, c, g, or t
  misc_feature (352)..(352): n is a, c, g, or t
  misc_feature (357)..(357): n is a, c, g, or t
  misc_feature (363)..(363): n is a, c, g, or t
  misc_feature (377)..(377): n is a, c, g, or t
  misc_feature (387)..(389): n is a, c, g, or t
  misc_feature (391)..(391): n is a, c, g, or t
  misc_feature (400)..(400): n is a, c, g, or t
  misc_feature (402)..(402): n is a, c, g, or t
  misc_feature (409)..(409): n is a, c, g, or t
  misc_feature (415)..(415): n is a, c, g, or t
  misc_feature (417)..(417): n is a, c, g, or t
  misc_feature (440)..(440): n is a, c, g, or t
  misc_feature (452)..(452): n is a, c, g, or t
  misc_feature (454)..(454): n is a, c, g, or t
  misc_feature (460)..(460): n is a, c, g, or t
  misc_feature (464)..(464): n is a, c, g, or t
  misc_feature (517)..(517): n is a, c, g, or t
  misc_feature (519)..(519): n is a, c, g, or t
  misc_feature (531)..(531): n is a, c, g, or t
gggcttgccggagaacagtgaaaaagtaggagatgattgtgagctgaggtagcctacagatgggccccacaagtgaggataagagaacactagcctggctggttgtggagcagttgcctgggaaggaccccagtggcctcaaggtggggccagggcnnaggcatggttcaactcagtgttagggaagttgttcctgtcgacctcccctttgagttcctgtgggactaggggtggggaatatggagacgggtgagtggaaaaaccagagagggctgctggttttggacgtcagcactgctgtganancaggaggaantnggtgggnnnncnnnntcctntacgaaacaagcancaganaattgntcatggttgagctncacatctttnnncnatgggaatntntggcacnccccantnttggaagctgaggactgcacctnttcactcaagcncnaaactntctntccctggttagaaacttttttttttttgcagagtactgggttacagagaggtntntgggactcactntcaaagaattattatcccaacatctttacac

SEQ ID NO: 2254 - DNA, 509 bp, Mus musculus
  misc_feature (51)..(51): n is a, c, g, or t
  misc_feature (91)..(93): n is a, c, g, or t
  misc_feature (95)..(95): n is a, c, g, or t
  misc_feature (328)..(328): n is a, c, g, or t
  misc_feature (330)..(332): n is a, c, g, or t
  misc_feature (376)..(376): n is a, c, g, or t
  misc_feature (404)..(404): n is a, c, g, or t
  misc_feature (419)..(419): n is a, c, g, or t
  misc_feature (437)..(437): n is a, c, g, or t
  misc_feature (458)..(458): n is a, c, g, or t
  misc_feature (477)..(477): n is a, c, g, or t
aatttatgttgctgttcccacgtaccctttgaaattgcttagccaaaacgntgatcctgacctacccagctccttcattttacagaagaannnantgaggcttagtggatgtcttctcactattagtgcacttggagcttttatttatttctttgagatagtatctgcctatttagaccaggctgaccacagaatagaaggcactcctccagccttagcctccgtgcctggaggagctgccatacccagcaccttaatttatgtcatttattctagggaaacccaaaactttcttgacagagtagaggagccagatgaactaaggcancnnnaatacatggaacttgatttctctgtatgttgggaggactccaancagtgagctcttcatggctagaccccanccccaaaaccttggntctgaaacaggaaacctntcatgctcttgctttccattntcatcttgaggctcctgtntcatagactgtactatgggagtagctgtgctc

SEQ ID NO: 2255 - DNA, 222 bp, Mus musculus
  misc_feature (26)..(26): n is a, c, g, or t
  misc_feature (28)..(28): n is a, c, g, or t
  misc_feature (31)..(31): n is a, c, g, or t
  misc_feature (53)..(53): n is a, c, g, or t
  misc_feature (57)..(57): n is a, c, g, or t
  misc_feature (59)..(59): n is a, c, g, or t
  misc_feature (71)..(71): n is a, c, g, or t
  misc_feature (84)..(85): n is a, c, g, or t
  misc_feature (141)..(141): n is a, c, g, or t
  misc_feature (185)..(185): n is a, c, g, or t
aacgctgttcccttgcatcccaacantntcntccgtttcattagtgggcgatntggntntgccatagattntattagcctgcanntgggatacctaccctagccactgcaacacttgctgaatgaaacccaccttcctttntgtcaggggtgctgtgtgtgtatgggggtggtggtggtgagaantcccttatcaccaagccccatgaaagtatgcaaatag

SEQ ID NO: 2256 - DNA, 341 bp, Mus musculus
  misc_feature (68)..(69): n is a, c, g, or t
  misc_feature (83)..(83): n is a, c, g, or t
  misc_feature (104)..(104): n is a, c, g, or t
  misc_feature (109)..(109): n is a, c, g, or t
  misc_feature (118)..(118): n is a, c, g, or t
  misc_feature (135)..(135): n is a, c, g, or t
  misc_feature (145)..(145): n is a, c, g, or t
  misc_feature (147)..(147): n is a, c, g, or t
  misc_feature (164)..(164): n is a, c, g, or t
  misc_feature (167)..(167): n is a, c, g, or t
  misc_feature (175)..(175): n is a, c, g, or t
  misc_feature (179)..(179): n is a, c, g, or t
  misc_feature (182)..(182): n is a, c, g, or t
  misc_feature (186)..(186): n is a, c, g, or t
  misc_feature (237)..(237): n is a, c, g, or t
  misc_feature (253)..(253): n is a, c, g, or t
  misc_feature (262)..(262): n is a, c, g, or t
  misc_feature (277)..(277): n is a, c, g, or t
  misc_feature (284)..(284): n is a, c, g, or t
  misc_feature (287)..(287): n is a, c, g, or t
  misc_feature (302)..(302): n is a, c, g, or t
  misc_feature (308)..(308): n is a, c, g, or t
  misc_feature (312)..(312): n is a, c, g, or t
gacggatagccaggaaggctctcccctccactggacagctctgcccctcagttgagggaccaactctnncttccatctggagntacatggtccccggctgaganccctncaggaggancccctcccaattcccancccctcattntnttccctttccccacctnccnaacaggtngccntgncctnccttccccaaaacctcgctccacatgctagagcgtggctgctgggaccagnccctaccctcggtggncccctaaancaatagcaccttagnccccctnccntcttggcacaagagncccagncccntggcttggacttcataccctttattcact

SEQ ID NO: 2257 - DNA, 131 bp, Mus musculus
  misc_feature (48)..(48): n is a, c, g, or t
  misc_feature (50)..(50): n is a, c, g, or t
gaagataacgcaggggtcatagtaaacaataaaggagagatgaaaggntntgctatcacaggtccagtggcaaaggagtgtgcagacttgtggcccagaattgcatccaacgcaggcagcattgcatgatt

SEQ ID NO: 2258 - DNA, 462 bp, Mus musculus
  misc_feature (78)..(78): n is a, c, g, or t
  misc_feature (107)..(107): n is a, c, g, or t
cctagtcttaaacactgaccagtgagaggtgagaagattcagggtcctgatggagacaagttttaagtggacaggaanggtcacctggtgagcatgaccatgagccnttcagcactgtccctgaagcctgaagttgggggagggttaaaacatgctttctgagatctataaattgacaatcaagggtattggaattccttaaacatgttctcttcacagggctcttcagccacttgtgtcttaccaggacaccatttccctattctaggagagggagcagtgtcctgagcagagtattaccacaggggggtgtgctgagatggttgatatacactggtctgaagctaccaacatagttccctactttccttgatcagtaattaaataatttgattggtttcagaatagtaactgaacctgacacactccatttttttgtatgttgattgtttggtttctttc

SEQ ID NO: 2259 - DNA, 216 bp, Mus musculus
  misc_feature (50)..(50): n is a, c, g, or t
  misc_feature (52)..(58): n is a, c, g, or t
  misc_feature (65)..(65): n is a, c, g, or t
  misc_feature (71)..(73): n is a, c, g, or t
  misc_feature (75)..(91): n is a, c, g, or t
  misc_feature (95)..(101): n is a, c, g, or t
  misc_feature (103)..(104): n is a, c, g, or t
  misc_feature (106)..(107): n is a, c, g, or t
  misc_feature (109)..(109): n is a, c, g, or t
  misc_feature (111)..(111): n is a, c, g, or t
  misc_feature (117)..(122): n is a, c, g, or t
  misc_feature (126)..(127): n is a, c, g, or t
  misc_feature (137)..(137): n is a, c, g, or t
  misc_feature (147)..(147): n is a, c, g, or t
  misc_feature (168)..(168): n is a, c, g, or t
  misc_feature (184)..(184): n is a, c, g, or t
aggccttccatttgggcaagagccggcataaactcccttccagaatttgnannnnnnnatttctnatcttnnncnnnnnnnnnnnnnnnnncccnnnnnnnanncnncntntttttnnnnnngggnntctcacttanctgtgagtgnccttgaactgacccttccacnttcatttcccaagtgnctggggttataggtttgcaccatgacacccga

SEQ ID NO: 2260 - DNA, 234 bp, Mus musculus
tctgccattatgacagtgacctgtggccactccttcaggccatcaccattgaggctgagccaagagccgatggcagccgccggacgacacgctatgacatcgacatgaccaagtgtatctactgtggtttctgccaggaagcctgccctgttgatgccattgtggaggtgagcgggctgggtgaagtggctcgcactgaggctcctgagaagggttcgccctgctcactgtcca

SEQ ID NO: 2261 - DNA, 515 bp, Mus musculus
  misc_feature (290)..(290): n is a, c, g, or t
  misc_feature (328)..(328): n is a, c, g, or t
  misc_feature (339)..(339): n is a, c, g, or t
  misc_feature (351)..(351): n is a, c, g, or t
  misc_feature (391)..(391): n is a, c, g, or t
  misc_feature (398)..(398): n is a, c, g, or t
  misc_feature (403)..(403): n is a, c, g, or t
  misc_feature (433)..(433): n is a, c, g, or t
ggatgaaaactcgtaccttggccagctccaccactgtcaggttctccagttctgactggggttgtggtgatggcggtaggtgggaagatccaccctggctcaggagcctgacttgacactggttctttcagccctaagccagcatctgaggtgtgctgtgctcctgggatccattaatttcaccttttcggctggcttctctcatccttctgccattagccagaggggcgggttgtgaactggagccggtgactgtcctctcaccatggactgaagcacagtggtgactntaggaagctggccacctcgaagctgtacatcctctcanccttggagccngggactcgaggntcccagaactgcagctgaaccatctggaaaagctggattntctattntcctnccttatgtatgaacaccacggatccggctnccagccactcatcactgactggcaggagtggtgggacagtgaccttccaaatccttgatggaacttcaacaccgtaggcact

SEQ ID NO: 2262 - DNA, 549 bp, Mus musculus
caatcttaagctttcctttcttcttttcttaggtgatttaatgaagtgccatgtaattgtagcttactaattaatgtttgatagactggttctgtgatattctaaacatttaactctttcttgtcatctctggagaagatggttctattctcattctctctgataaaatcaccagctgctttatttttctatttattacacagttgataaggtctggatcttgaccgaactgctcagctgagatgttttcatagtggacactatagaaaatgtgtgtgcaaaacgacacagttgggtggtggtattctttttcattaatgtgaacattgactaaacaaagcagtcctgccttttaaatcttgtggcagctcagaagggaggtgcttaagaaccttaactattatgtcagatgacaaatactttttttccattttggagattgggtactgctcacacatgatgtatagggctaaatatatgcttgtttccttgcacctgtgtactcttccccttctctcccacttttcctttccctgtaggcaataaatg

SEQ ID NO: 2263 - DNA, 354 bp, Mus musculus
  misc_feature (68)..(68): n is a, c, g, or t
  misc_feature (70)..(70): n is a, c, g, or t
  misc_feature (74)..(74): n is a, c, g, or t
  misc_feature (113)..(113): n is a, c, g, or t
  misc_feature (142)..(142): n is a, c, g, or t
  misc_feature (144)..(144): n is a, c, g, or t
  misc_feature (193)..(193): n is a, c, g, or t
  misc_feature (221)..(221): n is a, c, g, or t
  misc_feature (231)..(231): n is a, c, g, or t
  misc_feature (304)..(304): n is a, c, g, or t
aatgtcccttgtctacgcacttggcgcctggtccctgctgggctcggcgtttttcctttcacggaaananaaantatcagactgtgaagaaggtcaagaggatggctcaaggnatgaaacacctttttctacaagtgaagantntgatttagaaacggaaacggtcgagcttggtggagggttttatgtgaantcatttttaaagtattcagaaaattctntcccagccantcaaaggttcctgacctatctgaagtcatggactggtgggcctggcccgcaagcgtgaacagctgctgaattnctgcaaacaaggacttggctcagtatttgatagatgccttgatttccatt

SEQ ID NO: 2264 - DNA, 168 bp, Mus musculus
  misc_feature (57)..(57): n is a, c, g, or t
  misc_feature (84)..(84): n is a, c, g, or t
  misc_feature (127)..(127): n is a, c, g, or t
  misc_feature (129)..(129): n is a, c, g, or t
gccgaggttgataggaccacaggccggtttaatggccagtttaaaacctatggcatntgcggggccattcgcaggatgggcgantcagatgattctattctccgattggctaaggctgatggaattntnctcaaagaacttttgagcagaagaaatcgggaatttgtt

SEQ ID NO: 2265 - DNA, 446 bp, Mus musculus
accaacactgtgcttagacctagagactcttctcggcctcatttcctctgtcatcacctgaaatcagaactgtcgaattggacagattcatagagattgtctagttggggttgtgtcaggcagatcagtgtggatctgagtttatttctgctcttccctctggcctaactccatctcaaaacacaagactcttgcacaggcatcataccctaagactgtgaccccagggtccccagccacttgctctatcctgacatctggagttggatcaggctgtctggagactgaagcatccttcttcctttgcctagaaaacagaaaggtaggggcgcccaggctcagcgcatgtgagtggaggggcctggagtgacaggagagtgacttcaggagattcatttcttcccaccgggttgcacctattgcatgtacttttggcctgactggaa

SEQ ID NO: 2266 - DNA, 524 bp, Mus musculus
  misc_feature (196)..(196): n is a, c, g, or t
  misc_feature (273)..(273): n is a, c, g, or t
tgaggagacccttcaggactgacctggggaatggttcctttagggtctcaacacttgaaggactccatccaggaaacctagagagtgggcaagataggctcactaatgggccgtggttcacagacagatattcctgtggaccagagccatgccataccccaggggtatcaaaattgtctttgtggggccttgcccntgccaaaaactaagccagcctcacctcttgtgtcagcggacttccttcccctttccctgatctgggtacaccccccnggcctccctcctgtgtcaccgattctgctcacacagaattgtaaatgtttagttgtgaccatgacatattgtttgggccagtgttcctttccaatgcatactaatatattatggttattatatatgaatatatttaatgacatggagaaagttgtggattttctttctttttctttctttttttttttaaagtttttttgttgttagagttgtaatggacccagacggaacttgtaacgtgggccctacat

SEQ ID NO: 2267 - DNA, 481 bp, Mus musculus
  misc_feature (26)..(26): n is a, c, g, or t
  misc_feature (52)..(52): n is a, c, g, or t
  misc_feature (88)..(88): n is a, c, g, or t
  misc_feature (93)..(93): n is a, c, g, or t
  misc_feature (103)..(103): n is a, c, g, or t
  misc_feature (296)..(296): n is a, c, g, or t
  misc_feature (328)..(328): n is a, c, g, or t
  misc_feature (331)..(331): n is a, c, g, or t
  misc_feature (436)..(436): n is a, c, g, or t
acaaacttttgttaggtcaggtgtgngtccatgtagctgaaagaagataganattgctgtttgcataactttcccctgttttgtttcntgcanaattatcacnacagacttgtgttaaatcaaaggatcggttatgatgtgcaatacctaaaatcatgttcagtcctataaggaatcttttcaatgctcacacacaggacataaaggagattgatgtgtgtgtgtctgcgattcactccgactcaaaagattctgagttgagtatagaataaaacagtactcacggagattgacancggagacattcccagctttgtgaaatgttatntcnctgttaaaacgggaaatttgaaccctttatagcataatttcagaatttagcgtccatatcttttgagagacatgattatcacaagaacatagatgatgtaaatancctaagacactgcaaatataaaactactatcgcttggctgttaat

SEQ ID NO: 2268 - DNA, 493 bp, Mus musculus
  misc_feature (198)..(198): n is a, c, g, or t
  misc_feature (273)..(273): n is a, c, g, or t
  misc_feature (278)..(278): n is a, c, g, or t
  misc_feature (434)..(434): n is a, c, g, or t
aaggccaagatgcactatcggaagaagaagcagatcttgaggttacggaaacaggcagaaaagaatgtggagaagaaaatctgcaagttcacagaggtcctcaagaccaacggactcctggtgtgaacccaataaagactgtttgcctcatgcctgcctggcctgcccttcctccgccgccaactagggaagtggggnccaaaggttccttaggcactgctcctgtgggtagaggggacattagagagctgacagcgcaccacctgcatgagnttttnattaaagtgcaaaccatgggatgaatcagttgagcttcagtgttgaaaatgagtagcagggctgccccacccacctgaccaagtaccctattctgcagctatgaaaatgagatctgcacatgagctggggttcacaagtgcacacttggagcactnccttgctccttcccagcagaccacaaagcagtatttttctggaggattttatgtgctaa

SEQ ID NO: 2269 - DNA, 539 bp, Mus musculus
  misc_feature (328)..(328): n is a, c, g, or t
  misc_feature (369)..(369): n is a, c, g, or t
acatagtgactacttgctctggcttctgaattgggatcacaatgatactgaggcaagtgatgtgattactcattcaggagaagaggccgtctccactaagaggtaccataaaatagatgccagcagtcattgtgcccactgagatcaaggtcagagctttctacacccagacaactaactgcctgcctagtgatcacattgcatgtgctcaagttccagagtgttgtaaatgataaccggccccatagcctagctgtaatcgcaatcctgggatctgttgtgttacagtcatctggcaaatatctgctcctgatatttaggaatactncaaagggtttagaattgggtgccagattctgttaattatcncactccttaccagtaacaatttttttgtattgaagtttcaggaaatgttaatttggtgagaatgcttcaaatggaagtgacttggtttcttaatttataagtgaaaggttaaaatacacaaattagtatctgctgtacacatttataccccacattcttgagtccttgaa

SEQ ID NO: 2270 - DNA, 172 bp, Mus musculus
  misc_feature (46)..(46): n is a, c, g, or t
  misc_feature (53)..(53): n is a, c, g, or t
  misc_feature (62)..(62): n is a, c, g, or t
  misc_feature (113)..(113): n is a, c, g, or t
ctgggatgggaaccctcatcccaagggtacttggcccatttaccancctcctntggggtgcncctgggacgggagaaaacaatgatacacatattggtttggcaaaagttttntgaagatgctttagctttatgtgggaataggtataaacctcatttttatgctgtatttt

SEQ ID NO: 2271 - DNA, 446 bp, Mus musculus
  misc_feature (29)..(29): n is a, c, g, or t
  misc_feature (42)..(45): n is a, c, g, or t
  misc_feature (48)..(49): n is a, c, g, or t
  misc_feature (52)..(52): n is a, c, g, or t
  misc_feature (56)..(57): n is a, c, g, or t
  misc_feature (60)..(61): n is a, c, g, or t
  misc_feature (66)..(66): n is a, c, g, or t
  misc_feature (75)..(75): n is a, c, g, or t
  misc_feature (79)..(79): n is a, c, g, or t
  misc_feature (334)..(334): n is a, c, g, or t
cccgggagctgttgacgctagacgagaangaatcccggcgtnnnnttnnagncaannctnncctgnggcggcttnttcncattggggtgctggacgagggcaagatgaagctggattacatcctgggcctgaagattgaggatttcttggagaggcggctgcagacccaggtctttaagctgggcctggccaaatctattcaccatgcccgtgtgctcatccgccaacgtcacattagggtccgcaagcaggtggtgaacatcccatccttcattgttcgcctggactctcagaagcacatcgacttctccctccgttctccttatggcggcgnccgtccaggccgagtgaagaggaagaatgccaagaaaggccagggcggggctggagctggtgatgatgaggaagaggattaattaatacttggctgaactggaggattgtct

SEQ ID NO: 2272 - DNA, 433 bp, Mus musculus
  misc_feature (354)..(354): n is a, c, g, or t
  misc_feature (364)..(364): n is a, c, g, or t
  misc_feature (368)..(369): n is a, c, g, or t
  misc_feature (372)..(372): n is a, c, g, or t
  misc_feature (374)..(374): n is a, c, g, or t
  misc_feature (400)..(400): n is a, c, g, or t
tgaaggaccccagcagcaaacattggcagtgactgtacctgagggactcttgtcagaggcaagaggcagagacaaagcagttggaccctgcttgtgatttgggttttggggttagggacatgcttggaaatgattgtgccactacacgtccgtggagcctgcctggtgtttgacgttgtttaccatgggtcacctcctagagcagattgctaacacaggtcacactcagctacctagtctcagctccagggccaggacagctttgttttccagttgctcttcatcttaaggtcaaaggccacccacagagtgacagccccccgggatgcctcaggccaccacctaatgctcctngtcaggggtngccnnttntnagtgaacatggagctggagggtgggnccgcctggggtggctttgatgacttgtccatct

SEQ ID NO: 2273 - DNA, 517 bp, Mus musculus
  misc_feature (71)..(71): n is a, c, g, or t
  misc_feature (96)..(96): n is a, c, g, or t
  misc_feature (105)..(105): n is a, c, g, or t
  misc_feature (135)..(135): n is a, c, g, or t
  misc_feature (160)..(160): n is a, c, g, or t
  misc_feature (193)..(193): n is a, c, g, or t
  misc_feature (196)..(197): n is a, c, g, or t
  misc_feature (388)..(388): n is a, c, g, or t
  misc_feature (421)..(421): n is a, c, g, or t
  misc_feature (430)..(430): n is a, c, g, or t
  misc_feature (464)..(464): n is a, c, g, or t
tctcatcccctgctgaaaaatctagcacttgaaagcaagcttgactgaaaagattgtacctggtgccatancaatgtgaagaggaagtgttttcanttggtggcntgtatattcctttagtggcatccatgttanactaaaatggcccatgctcagtacncctcttgttttggattatgtggaggatcagccnaannacaagataatcaattttgaaacttgccaactcagatgttagcccctgtattttgtgtatgaaatgctgtgctgtgtctcttcgaccctgcctaggtgccaccatgtgtaaggagggacaactgtgctggtcttcctcagcactgcttctcagcagtttgcagcctgaagttcctgcaggagcccttagtantcaccaaaaggctcagaccagatacacgctgtncacggaaantccttggtccaaaccaagtacataaatccacgtntcctttatttaaaatgacatctacaggtgcagctttgagttttctgagcagaa

SEQ ID NO: 2274 - DNA, 514 bp, Mus musculus
  misc_feature (262)..(262): n is a, c, g, or t
  misc_feature (284)..(284): n is a, c, g, or t
  misc_feature (294)..(294): n is a, c, g, or t
  misc_feature (340)..(340): n is a, c, g, or t
gtctaagtaagccagctgacctctaagcccaaaggactcccccttgcttaccttagacagtccaaccttgggaatagctttaaaaaggggaattaatactgagacagtgaagtccccttaagccgacaagccctccataggtgcacaccgcacacataggcttctctcagtgcagactccaggtggtggtcaacagctgcggcatgcttatctatttgtacgaaatagtgtagggaagccccaggaggtgttatagcttccntataccatgtggcttttgatgnttctggattntcaacagcacaaaagagtcctcgagccggaacatgcgctactccgnttttaaacgtggctgggctgtgagacccgttcttggctctggttttacgaagccatcaatacatacacacccttgatggagctgcagatccgttccttttcctgcagcccacttgtgggggaaaagtgccttactgacttacagtagccactcagtttcaacaggtgcctatct

SEQ ID NO: 2275 - DNA, 539 bp, Mus musculus
ccgtgtacgcggaggtggataccatctacgtccatgagaagtggaaccgtcttctgctgtggaacgacatcgccatcatcaagttggctgagcctgtggagctgagcgacaccatccaggtggcctgtatcccagagcaagattccttgctgcctggggactatccctgctatgtcactggctggggtcgcctctggaccaacggtcccattgctgaagtgctccagcagggtctgcagcccatagtgaaccacaccacgtgctccaggttggactggtggttcatcaaggtccgggagacgatggtgtgcgctggtggtgacggtgtcatctctgcctgtaacggagactctggtggcccactgaactgcccagtggaagacggcttgtggcaggtgcatggcatcgtgagctttggttccagtagaggctgcaacacatacaagaagcccgtggtcttcacccgtgtgtctgcctatattgactggatcaaggagaaaatacaactgtgaagagacggttccagaagtctcgacgcc

SEQ ID NO: 2276 - DNA, 432 bp, Mus musculus
  misc_feature (396)..(396): n is a, c, g, or t
ggatgccttcctcagcataaagcagccaggtgcacgaggctgtgtggatcctgttgccaggcagctaactcgaagggatgtcttgggtgcatctttagtaaagcttacattcccgttcctgttccattgctctggtgtctccggctgtcactgaagacaccgttccacacagaggaaaggcgtggtgccgccctcagtaagcagggaaacctctccttcccttgctgcagagcttgagtcccacatcctgccatggactgtttaatctgcactcactgcccctcctttctcccgggacaggtttccttttcctccagttaccgtcaccctctcaggaaccattgctttttgtccatttctctgacttctgaacctcaacccatcaccaaccccgtntcttcaacattactttccctgaaagtctggctcttt

SEQ ID NO: 2277 - DNA, 487 bp, Mus musculus
  misc_feature (77)..(78): n is a, c, g, or t
  misc_feature (108)..(108): n is a, c, g, or t
  misc_feature (114)..(115): n is a, c, g, or t
  misc_feature (121)..(121): n is a, c, g, or t
  misc_feature (124)..(124): n is a, c, g, or t
  misc_feature (129)..(130): n is a, c, g, or t
  misc_feature (133)..(133): n is a, c, g, or t
  misc_feature (139)..(139): n is a, c, g, or t
  misc_feature (142)..(144): n is a, c, g, or t
  misc_feature (154)..(154): n is a, c, g, or t
  misc_feature (158)..(158): n is a, c, g, or t
  misc_feature (165)..(166): n is a, c, g, or t
  misc_feature (173)..(173): n is a, c, g, or t
  misc_feature (181)..(181): n is a, c, g, or t
  misc_feature (188)..(189): n is a, c, g, or t
  misc_feature (237)..(238): n is a, c, g, or t
  misc_feature (240)..(241): n is a, c, g, or t
  misc_feature (251)..(251): n is a, c, g, or t
  misc_feature (260)..(260): n is a, c, g, or t
  misc_feature (275)..(275): n is a, c, g, or t
  misc_feature (278)..(278): n is a, c, g, or t
  misc_feature (301)..(301): n is a, c, g, or t
  misc_feature (307)..(307): n is a, c, g, or t
  misc_feature (317)..(317): n is a, c, g, or t
  misc_feature (320)..(320): n is a, c, g, or t
  misc_feature (323)..(324): n is a, c, g, or t
  misc_feature (329)..(330): n is a, c, g, or t
  misc_feature (339)..(339): n is a, c, g, or t
  misc_feature (356)..(356): n is a, c, g, or t
  misc_feature (358)..(359): n is a, c, g, or t
  misc_feature (437)..(437): n is a, c, g, or t
  misc_feature (439)..(441): n is a, c, g, or t
gattgcacagtctgtcactgctgtcgctggcctgacttcctatccttttgacacggttcgccgtcgtatgatgatgnnagtctggacgcaaaggaactgatatcatgnacacannggcacngcnttganntgnctggcnggnnngatcgcgcgncgangaagggnngcaaggncttttttncaagggnngcatggtccaacgttctcagaggcatgggtggcgcctttgtgcttgtnntnntatgatgagnatcaagaanatacacataattatntcntaggtgtttctccccgagaacanggcatngttgtataantantannccatnntcttgaacnattctggacagattttntnngggcttgtctgttttatcagtggcaactatttaccagttgaaaagtgggaagcaataatattcatctgaccagttttntnnnttaaagccatttccataatgacaataatgatgggacatctaattat

SEQ ID NO: 2278 - DNA, 102 bp, Mus musculus
  misc_feature (29)..(29): n is a, c, g, or t
  misc_feature (35)..(35): n is a, c, g, or t
tactgcaagtgctattgatgccttgaggntctgtntacccagcctggccttgggaattgctgtagctccaagagccaggaggcaagatgaccccacgacctg

SEQ ID NO: 2279 - DNA, 350 bp, Mus musculus
  misc_feature (296)..(296): n is a, c, g, or t
  misc_feature (299)..(299): n is a, c, g, or t
  misc_feature (301)..(301): n is a, c, g, or t
  misc_feature (305)..(305): n is a, c, g, or t
gtccactccaaaatcatgcttgcgcccttggtgtactaacttccccacagatggcccagactccaccctgtgacgtgcagggctgcagctcctgacccccgggtcctgaggacggcttgttccctttgcaggtgcttctgctttgacacttgactgacggggagggcaggccagagcagtgtgctggccatgcctcaggccgttgaccatagctagacagaaaagaacagcagccgtccaggccgcagcgttctccctctgggcgggctgcatggaatgagcctccactcagagtnttngnaaangcagaagccgtacctcagggaaagcccctggttgaagtgtctgtc

SEQ ID NO: 2280 - DNA, 191 bp, Mus musculus
  misc_feature (36)..(36): n is a, c, g, or t
  misc_feature (38)..(51): n is a, c, g, or t
  misc_feature (53)..(56): n is a, c, g, or t
  misc_feature (58)..(68): n is a, c, g, or t
  misc_feature (72)..(73): n is a, c, g, or t
  misc_feature (75)..(77): n is a, c, g, or t
  misc_feature (79)..(82): n is a, c, g, or t
  misc_feature (85)..(89): n is a, c, g, or t
  misc_feature (96)..(96): n is a, c, g, or t
  misc_feature (113)..(113): n is a, c, g, or t
  misc_feature (116)..(116): n is a, c, g, or t
  misc_feature (123)..(123): n is a, c, g, or t
  misc_feature (125)..(125): n is a, c, g, or t
aaagattaagaaggacccatcaattatcacctgaanannnnnnnnnnnnnntnnnngnnnnnnnnnnntttnntnnntnnnnggnnnnnaacaccntgaggaagcccacagtnttnacccgtntntcagccttcattgactggattgaggagaccattgccaacaactagatccaaggttcggctggcaga

SEQ ID NO: 2281 - DNA, 502 bp, Mus musculus
  misc_feature (271)..(271): n is a, c, g, or t
  misc_feature (298)..(298): n is a, c, g, or t
  misc_feature (312)..(312): n is a, c, g, or t
  misc_feature (357)..(357): n is a, c, g, or t
  misc_feature (412)..(412): n is a, c, g, or t
  misc_feature (416)..(416): n is a, c, g, or t
  misc_feature (421)..(421): n is a, c, g, or t
  misc_feature (429)..(429): n is a, c, g, or t
  misc_feature (454)..(455): n is a, c, g, or t
cttcaccgttcatcagaggctatttttcttgagccagagataagtttcaagggctctgtgtatgtgtgtctgtatatgttggagcctatgttctcagtaagacctgtctacctcccaggaggagaaaaatccccacctgctcctctggttacttgggtaggcatggacttgggccagttctgcccaggcctcctgcctccacagtagaattcaaaggctacatgtatggtgagattgtacttcactagggaatccattttgtgctaggcanccatggggtgaggtataaaggtggagnccctcagatatagnccaatttggggtggtcagtcacttaagtcctgaggttcttggcantcccatggcacagtggctctggagcccattgctttgactctgaccatgggcactntccnagccnagactagncctcattcttgtctgtgtctgggtnntcttctgtggctccttttgcacccacccctggtttgtttgttgactg

SEQ ID NO: 2282 - DNA, 43 bp, Mus musculus
atgtaaacaaggtgactttctgctacaataaggtcactttttt

SEQ ID NO: 2283 - DNA, 457 bp, Mus musculus
acccactcactgactactgagctagcaggcagtgggtcttggcgacacagcactgagactgatggtcactgagattcaggatgctgagattgtggggcagaatgggcttccaccaaggcccagagccatgcatggcagcaaggtcaccagaagctgagtgcccgaccgagtggcgcactcttcccagccaccctatctgccgcctgcccctgtcctgctggcaccgggtctatgggcttccttccatgatgctgcccagtgaccagtggctgccctccctggcccatgcaccctgcccaggatcctggacccctcagacctgacacccagcaagaagggcttacacgggagctcccgaaataggggctgccagcacctggggttccctcactcctgaccccccacttcctccaagctgtgacccctgctccaagctcttgtatctgtgaactttcat

SEQ ID NO: 2284 - DNA, 548 bp, Mus musculus
tgctgtatctcagtcagatgccccacctcacttaccatgcccactgataccctggaatttctgccagcacagctactacaatcaaggaaagctctgtgcttttccaacatggggtgtgggagaaatggcttaaaagcccaagaaatgcccccttgagaccaggacactagagaaggttgccaaggcaggccagaatcagccaggaactcctgcaaagtcgagagcattctgcctacctgcaagaagaacactgcatactgggcatgcaggtaccaccacctgtcagcagtttctccaggctctgctggtatagccagcccagaacccatcataccagaaaataaccttcagtctaaatcaaatgattcattcatggtcacctgatcagtggcttcagtcacacataattgaagtctctaaccctagtcctacccttggcacaggcctccagtgagcctgttctgtttcagaagaaaggggaagcagtgtagcattttttgtttggtctcttaaaaatgtggttaaatccactattttttgctcctgta

SEQ ID NO: 2285 - DNA, 319 bp, Mus musculus
  misc_feature (74)..(76): n is a, c, g, or t
  misc_feature (78)..(79): n is a, c, g, or t
  misc_feature (83)..(83): n is a, c, g, or t
  misc_feature (85)..(85): n is a, c, g, or t
  misc_feature (87)..(88): n is a, c, g, or t
  misc_feature (90)..(90): n is a, c, g, or t
  misc_feature (92)..(102): n is a, c, g, or t
  misc_feature (104)..(112): n is a, c, g, or t
  misc_feature (114)..(116): n is a, c, g, or t
  misc_feature (119)..(120): n is a, c, g, or t
  misc_feature (122)..(122): n is a, c, g, or t
  misc_feature (124)..(125): n is a, c, g, or t
  misc_feature (133)..(133): n is a, c, g, or t
  misc_feature (136)..(139): n is a, c, g, or t
  misc_feature (144)..(144): n is a, c, g, or t
  misc_feature (146)..(146): n is a, c, g, or t
  misc_feature (149)..(149): n is a, c, g, or t
  misc_feature (152)..(152): n is a, c, g, or t
  misc_feature (154)..(154): n is a, c, g, or t
  misc_feature (158)..(160): n is a, c, g, or t
  misc_feature (163)..(164): n is a, c, g, or t
  misc_feature (166)..(166): n is a, c, g, or t
  misc_feature (171)..(172): n is a, c, g, or t
  misc_feature (180)..(180): n is a, c, g, or t
  misc_feature (191)..(191): n is a, c, g, or t
  misc_feature (193)..(193): n is a, c, g, or t
  misc_feature (199)..(199): n is a, c, g, or t
  misc_feature (233)..(233): n is a, c, g, or t
  misc_feature (235)..(235): n is a, c, g, or t
  misc_feature (240)..(240): n is a, c, g, or t
  misc_feature (243)..(243): n is a, c, g, or t
  misc_feature (282)..(282): n is a, c, g, or t
taagcctcgccctcacgaccgacttctgccctcccactctccaggtacatcattcattcccttcttttttaacnnnanncttnancnnancnnnnnnnnnnntnnnnnnnnncnnnctnntngnntacaaganctnnnngcagnantgnatntntgannnacnngncggtnntggttttntacctgcttantnttgttntcacaggcaggggaccagcaaccctagatatttntnggaanttnctttgacctggaaggaacctttgggagctgtgactcccntgtgcagtgttacgtgccactgttagattaaagtgtt

SEQ ID NO: 2286 - DNA, 131 bp, Mus musculus
ccatccatccacacagtgctggggaaggccttccagctctccaaggctgtctccagtgttagaccgtgggggtcccactactggcaggggcgtgctggggtggcaggaagtgacccgggtccttccctcag

SEQ ID NO: 2287 - DNA, 97 bp, Mus musculus
tagtgtgcaggtaacaatcagatttctcctgtgttcagtaccctgagttgaaatttacagagctatcactttagtataaaacactgacattgtttct

SEQ ID NO: 2288 - DNA, 265 bp, Mus musculus
  misc_feature (72)..(77): n is a, c, g, or t
  misc_feature (79)..(79): n is a, c, g, or t
  misc_feature (81)..(82): n is a, c, g, or t
  misc_feature (84)..(91): n is a, c, g, or t
  misc_feature (93)..(94): n is a, c, g, or t
  misc_feature (97)..(102): n is a, c, g, or t
  misc_feature (104)..(106): n is a, c, g, or t
  misc_feature (108)..(111): n is a, c, g, or t
  misc_feature (113)..(115): n is a, c, g, or t
  misc_feature (117)..(117): n is a, c, g, or t
  misc_feature (119)..(120): n is a, c, g, or t
  misc_feature (122)..(125): n is a, c, g, or t
  misc_feature (127)..(127): n is a, c, g, or t
  misc_feature (130)..(130): n is a, c, g, or t
  misc_feature (132)..(132): n is a, c, g, or t
ctcaccatgggcttcaggtcactaacgggcctcgcagcttccgacacgttcactccaccccgggcgagcatnnnnnngncnngnnnnnnnnannggnnnnnngnnncnnnncnnncncnngnnnnanatntnttacacccttccttggaggaggagaagaaaaaacataagaagaaacggctggttcagagcccaaattcttacttcatggatgtgaaatgtccaggttgctacaagattactacagttttcagccatgcacaga

SEQ ID NO: 2289 - DNA, 436 bp, Mus musculus
gaagtgtagcatattccccaggatgctagttccagactgaaccagcagactgaattcacagcacgtgtgtgtcaattgaactagcctagttcattatcacctctactttctgggcagttgccaggatgcaggagatgaagaaagctacaaagcactgctctctttgagattctaggttttcttttcttctcatcatggtaatgaggggcagtgaagccagaggtttaaatgagcatagacccatggtggatggggtatgtagcttagatggaagactgcttgcttagagtgcccgaagccatggcttccttcaccacataaactaggacggtggagtgtgcttagaatcctagcatttgggaggtggaagtgggaagatcgggagttaagggtcaaccagggatacgtgggaccctgtcttaccatgtgtggaaga

SEQ ID NO: 2290 - DNA, 224 bp, Mus musculus
  misc_feature (35)..(35): n is a, c, g, or t
  misc_feature (73)..(73): n is a, c, g, or t
  misc_feature (99)..(99): n is a, c, g, or t
  misc_feature (102)..(102): n is a, c, g, or t
cccagaattgctctctgaggctaaaacaggaaatntggtgtctgaagcaaatttacaggagttgaggggcaanacgggggtggggtgagtgggtggggnaanattcatttagagcaaactgaactttgcaaatggcatctctgtacttttatcactagctccatagtcttttatttttgtatgtcttttcacttttctctcggctatcctttctgctaactctc

SEQ ID NO: 2291 - DNA, 338 bp, Mus musculus
  misc_feature (91)..(91): n is a, c, g, or t
  misc_feature (220)..(220): n is a, c, g, or t
  misc_feature (266)..(266): n is a, c, g, or t
  misc_feature (313)..(313): n is a, c, g, or t
actggctgccagtgtttcctgcatccacacaaagaatgaggttagccaggcaggacctatggccatgtcgcatctggtcaggtggggaacnaattcttcatgtctgtgtccctggaaacactgggctctcttctgttctgttttagtttttcttcttcagtagcttgggctgcagcttctactctgcccattcgatgtgggggaaggccatttctttttntaatttgttctgtgtgtttgcagatctggggctttttgtgtgactnccctgtggtgcacattttactttagagccctagtctgcctgcagtcngtgtctcttatacgtttaaatgtgt

SEQ ID NO: 2292 - DNA, 512 bp, Mus musculus
  misc_feature (32)..(32): n is a, c, g, or t
  misc_feature (43)..(43): n is a, c, g, or t
  misc_feature (153)..(153): n is a, c, g, or t
  misc_feature (239)..(239): n is a, c, g, or t
  misc_feature (376)..(376): n is a, c, g, or t
  misc_feature (466)..(466): n is a, c, g, or t
gcctacctgagaacattctctctctctcctgncgatttactcnccattcaaacttactgcaaaaagcaatgaaaagacaatgggtgattattttaatctctcagtgaactgtactcttctcaaaggaaaatatgtccttgggttaaaaaaaanccacaaatttaatgtacaatcatgtgacctagagcaacatgggccatcacaactgattcactccatactataagtttaagtgggtnagggtgccaactacttaatgactttcaaatctctggcttctactgctgtcttaacaaccatgggtttatagactgaatgatgacacagagtgtggatgtgggcgagtctggatgttttcatattcagaaagtgtatntccctaacaaccatgggtttatagactgaatgatgacacagagtgtggatgtgggcgagtctggatgttttcatattcagaaagtgtatntcccagccacactttttgggatgaagttctgttatctgaggttctt

SEQ ID NO: 2293 - DNA, 529 bp, Mus musculus
  misc_feature (208)..(209): n is a, c, g, or t
  misc_feature (211)..(217): n is a, c, g, or t
actggtcttagctatgttctgctacccttggcccatcaggacactccccaaagggcccaatcaggatctgagttacatggggtgctgcccactacatgaacattgaagacaagttcctctgtggcttagattggcataatccagcgcttgtaatgggaactgctaagacataggaagctctggggctgggtccaatccagtcgggggnngnnnnnnnggaggctgcttggaagggctagtcctgagtgtttaccaatgtactgtgacatccctggcttctgtttcctgtctctggaaagtcagcataatggagaacagcagagaaagcagcagtagcggctctggccccgcctctcactgtcgcatgcagcagagacatgctgcatgatctcaggggccttgtacactgcactgggtaagccaataccatgtcctgggaaggctgacacaaattccaacagaagccacactcacttggcagacttttatttttgggtaaaacaaaacaaatgtacctctcgggtcagaa

SEQ ID NO: 2294 - DNA, 42 bp, Mus musculus
ttcttacttttctgtgttgacttcattattcccatggtattg

SEQ ID NO: 2295 - DNA, 320 bp, Mus musculus
  misc_feature (131)..(137): n is a, c, g, or t
  misc_feature (139)..(139): n is a, c, g, or t
  misc_feature (143)..(150): n is a, c, g, or t
  misc_feature (155)..(159): n is a, c, g, or t
  misc_feature (165)..(167): n is a, c, g, or t
  misc_feature (175)..(190): n is a, c, g, or t
  misc_feature (192)..(192): n is a, c, g, or t
  misc_feature (213)..(214): n is a, c, g, or t
  misc_feature (253)..(253): n is a, c, g, or t
  misc_feature (259)..(259): n is a, c, g, or t
  misc_feature (262)..(262): n is a, c, g, or t
tgagaacccaactgcctgtggtggactatgaacactgctccaggtggaactggtggggcttgtctgtgaagacgaccatggtgtgcgccggcggcgatatccagtctggctgcaacggtgactctggaggnnnnnnncnactnnnnnnnnccgcnnnnnaatggnnnctggcagnnnnnnnnnnnnnnnncnagctttgtgtcctccttgggnntgcaacaccctgaggaagcccacagtgttcacccgtgtntcagcnttncattgactggattgaggagaccattgccaacaactagatccaaggttcggctggcaga

SEQ ID NO: 2296 - DNA, 255 bp, Mus musculus
gagcgcctttgaaatggatgacttattgaagatctgacagtattttatctgatacttggtctgaccagtatagaaaacattttcatgtctatgtgcctcacaaggctgcttgggcattaatattgccttttgagccttaagtgtgcttatagattggagaaaccgtgatgggaacaggacctagttttgcctgttttggttacggcctcacaggcatatagcgtgtagaagattcaaagtgacttccctcatttc

SEQ ID NO: 2297 - DNA, 174 bp, Mus musculus
aaactgtaattcatgtaatgtatgttaaatagcccaaagagttgtttctgagctttgaaacctggggctgagaacatagcagaacagaccaggacatgcccgggcaagcccatcgcctccctagctcccacccctctgacctaagttaaatgttacaggctgctgatgtttaaa

SEQ ID NO: 2298 - DNA, 436 bp, Mus musculus
tgagatatatccctagaccaacatactcttttattctttttaaaattttgtttaagaagtttaatcttgaactcctgatacccacatagtcttatctgggaagagttgtcatttattttccattctgtcacccacatctctttacttttctcttaagagcttgatgtacagaaaactgaaaatatgtaatgctcagtgatcttattatttaggagtgttttgactgatatatttaaagatagattatattcatgctgtcttctgttgactttgagaaattgtacagtagattgtcttgatcattgcatttgttgtctttgaaatgtatattttgtcattttaaattcatttacttttcaggtgtgactttatggttgacttttaaaggtagggatagatgaaaatttaaggaaagctatcttatctatcaactcgg

SEQ ID NO: 2299 - DNA, 118 bp, Mus musculus
  misc_feature (35)..(35): n is a, c, g, or t
  misc_feature (40)..(40): n is a, c, g, or t
  misc_feature (51)..(51): n is a, c, g, or t
actgtggcaagaagagctgaatgaagttgggccanacgcngcctccctgcnaagggttgtgtggatcttttgccgcaccaggctcatcctgtccatcgtgtgcctgatgatcacgcag

SEQ ID NO: 2300 - DNA, 135 bp, Mus musculus
  misc_feature (101)..(101): n is a, c, g, or t
ggggttgtctaaggaaaagctctgatcctctgcagcccaggttctgggctgctgttgatctgtgtgtcctgagaacaagtgattaagggtgactgctccantccctggcactcccctgagctgtcttttggtctt

SEQ ID NO: 2301 - DNA, 269 bp, Mus musculus
  misc_feature (40)..(44): n is a, c, g, or t
  misc_feature (46)..(48): n is a, c, g, or t
  misc_feature (50)..(56): n is a, c, g, or t
  misc_feature (58)..(64): n is a, c, g, or t
  misc_feature (66)..(69): n is a, c, g, or t
  misc_feature (71)..(77): n is a, c, g, or t
  misc_feature (81)..(81): n is a, c, g, or t
  misc_feature (84)..(84): n is a, c, g, or t
  misc_feature (86)..(87): n is a, c, g, or t
  misc_feature (89)..(89): n is a, c, g, or t
  misc_feature (96)..(96): n is a, c, g, or t
  misc_feature (98)..(99): n is a, c, g, or t
  misc_feature (101)..(101): n is a, c, g, or t
  misc_feature (108)..(108): n is a, c, g, or t
  misc_feature (112)..(112): n is a, c, g, or t
  misc_feature (114)..(114): n is a, c, g, or t
  misc_feature (116)..(117): n is a, c, g, or t
  misc_feature (120)..(121): n is a, c, g, or t
  misc_feature (123)..(123): n is a, c, g, or t
  misc_feature (128)..(128): n is a, c, g, or t
  misc_feature (130)..(131): n is a, c, g, or t
  misc_feature (136)..(137): n is a, c, g, or t
  misc_feature (142)..(142): n is a, c, g, or t
  misc_feature (146)..(146): n is a, c, g, or t
  misc_feature (153)..(153): n is a, c, g, or t
  misc_feature (155)..(155): n is a, c, g, or t
  misc_feature (157)..(157): n is a, c, g, or t
  misc_feature (162)..(163): n is a, c, g, or t
tacacattccctaccactcttaaagatctatttatcatcnnnnncnnngnnnnnnngnnnnnnntnnnntnnnnnnncttnccntnngnagatcantnnangagacantgcntntnnttnnanccttncnntacanngacangcanggagaantntnccctnntggctggaaacctggtagtgaaacaataatcccagatccagctggaaaactgaagtatttcgacaagctaaactgaaaagtacttcagttatgatgtttggacctt

SEQ ID NO: 2302 - DNA, 511 bp, Mus musculus
  misc_feature (107)..(107): n is a, c, g, or t
  misc_feature (124)..(124): n is a, c, g, or t
  misc_feature (235)..(235): n is a, c, g, or t
  misc_feature (256)..(256): n is a, c, g, or t
  misc_feature (266)..(266): n is a, c, g, or t
  misc_feature (294)..(294): n is a, c, g, or t
  misc_feature (314)..(314): n is a, c, g, or t
  misc_feature (366)..(366): n is a, c, g, or t
  misc_feature (435)..(435): n is a, c, g, or t
  misc_feature (455)..(455): n is a, c, g, or t
  misc_feature (486)..(486): n is a, c, g, or t
acagcatctcacagcatagtgcaagctgacgtggaactaactgtgcagtccactataatcttgacttactgtcatcctccggcctcgaccgcccatgagttaggatnataggtgtgacctggtntcctctgctcaagatcagcatttttgtttgtttgtgtgttttttttttttgagacatgttttcgatacatagatctggctatcctggaactcactatgtagaccaggctgncctcaaactcacaaagttatnccagcttctncctctcaagtgctggagttaaaggcgtngtatacaaacacgcttggcnaacattttttttaattggaaaaaataacaattttaaagtgaagtatgcagtntcatttattgatagtgcacagctctcagttttatgaaattattccaggaataacctctgttcccatcanccgtcactccggaggcattnttctatgcgcatcccctggcaacagttacanccagattgatcagggcaacttggaa

SEQ ID NO: 2303 - DNA, 187 bp, Mus musculus
ggtaggtgcgcccaggccaaacagtggggctggacacagggtcggtggccaaaaaagagtgctgaatttttgctgcacatgcttaaaaatgctgagagtaacgctgaacttaagggtttagacgtagattctctagtcattgaacacatccaggtgaacaaggcacctaagatgcgccgacgaacct

SEQ ID NO: 2304 - DNA, 360 bp, Mus musculus
  misc_feature (137)..(137): n is a, c, g, or t
  misc_feature (147)..(147): n is a, c, g, or t
  misc_feature (220)..(221): n is a, c, g, or t
ggcttagtagaatcccgcaagctttttaatctctccaagagaagatgatgtccgccagtatgttgtcaggaagcccttaaacaagagaaggtaagaagcccaggacacaaagagcacccaagatttcagtcgacttngttacatccntcgtgtccttgcaacacaaaacgccgacgtattcgctctgaagaagcaacgcaacttaagaaagaacaaggannggaggctgcagaatacgctaaacttttggccaagagaatgaaggaagccaaagaaaagcgcccccaacggaacagattgccaagagacgtaggctgtcctcactgagagcttctactttctaagtctggagtccagtca

SEQ ID NO: 2305 - DNA, 282 bp, Mus musculus
  misc_feature (28)..(29): n is a, c, g, or t
  misc_feature (36)..(36): n is a, c, g, or t
  misc_feature (38)..(38): n is a, c, g, or t
  misc_feature (40)..(40): n is a, c, g, or t
  misc_feature (42)..(44): n is a, c, g, or t
  misc_feature (46)..(54): n is a, c, g, or t
  misc_feature (56)..(57): n is a, c, g, or t
  misc_feature (60)..(66): n is a, c, g, or t
  misc_feature (68)..(68): n is a, c, g, or t
  misc_feature (70)..(76): n is a, c, g, or t
  misc_feature (85)..(85): n is a, c, g, or t
  misc_feature (87)..(90): n is a, c, g, or t
  misc_feature (101)..(101): n is a, c, g, or t
  misc_feature (106)..(107): n is a, c, g, or t
  misc_feature (111)..(111): n is a, c, g, or t
  misc_feature (113)..(113): n is a, c, g, or t
  misc_feature (117)..(118): n is a, c, g, or t
  misc_feature (121)..(121): n is a, c, g, or t
  misc_feature (133)..(135): n is a, c, g, or t
  misc_feature (146)..(146): n is a, c, g, or t
  misc_feature (149)..(149): n is a, c, g, or t
  misc_feature (152)..(152): n is a, c, g, or t
  misc_feature (156)..(156): n is a, c, g, or t
  misc_feature (215)..(215): n is a, c, g, or t
  misc_feature (255)..(255): n is a, c, g, or t
tgtggctctcccactgtggtggctctanngactgtncngnannnannnnnnnnncnnccnnnnnnntntnnnnnnnttatgggcncnnnntcctagacatntgcanntctntntccnnccntggggacacatnnntaccttcaaantanttngaantctgagcatcacgctggagggatgaatttcaggatgttcctacaagtgggaggaagatntacaatcatgcttgacctttttatacaaattattttgacntcctattctcgacctccaggacaaaga

SEQ ID NO: 2306 - DNA, 218 bp, Mus musculus
  misc_feature (105)..(105): n is a, c, g, or t
gcaagtgaggcccctaccggtcgttagtgcgacttttacagacaccaaaggctcttttcagagccacccacaacctcattagaaagcgctgtacactgagcctgncgccagttactggccaggccagttctcctgactccttccgtgcattcctgcatccctgtgcggcgcttggggagctcaagggagaccaacggcttcatctgcgggtggcctgc

SEQ ID NO: 2307 - DNA, 334 bp, Mus musculus
tatcatgtccaaatccacttctgggacctttagctgagaggtctcttctctcattgccttctctgttttacaagtcaagtccctcactgtgagtgggatgatttcctgctgccttccttccctctgcctgttaggtcacataccaaagattgctgagtgctggtgggatgtggagcctcacttggacacctcagacaggaagtccaccagggccaacaagcctaaggagggcacaaagggccactttagttccctgggggactggcttacctggggtcagtgtgtaatgagttttgtctggcaagatttgctgattctgttcaaacgcaccatt

SEQ ID NO: 2308 - DNA, 175 bp, Mus musculus
  misc_feature (65)..(65): n is a, c, g, or t
attgtgggtagatggcccttgtgccaagactctggaaggtgagactgtcaggcagccccccaagnttgagaatgacattcctaggcactcttgtcaagacaggatgaatagtggggagagagagagcacatatcttatgcccctcaacgtgagccatcttgatgctcctcacaca

SEQ ID NO: 2309 - DNA, 470 bp, Mus musculus
  misc_feature (317)..(317): n is a, c, g, or t
  misc_feature (327)..(327): n is a, c, g, or t
  misc_feature (331)..(331): n is a, c, g, or t
  misc_feature (354)..(354): n is a, c, g, or t
accctggcctgtaggtttctgattatgaatttgcttattctggacacttcatataactggaatcatatagtatgtgggcttccatgatcagcttctctcatttaaccatgttttcaaggttcctctgtgttatcgcatgtatcaggacgtcattctgtctttgtggttgaataatggagatgatgaggatgctatgttttgtttatctatttattcagttggcagatgtttgggttgctcctgctttggggctattatgaacgataattttatgaacagtcatacacaaatttttctgtgtgaacatatgttttggntcctcttggnattnccagatcatatggcaactctatntttaactttctgagggacttccaagatcacagcttttatatcttatgaaattcaaagtgaaaaatgacatacaccaggcggtcagaggcagggcacatctgttcctggttggatac

SEQ ID NO: 2310 - DNA, 400 bp, Mus musculus
  misc_feature (327)..(327): n is a, c, g, or t
  misc_feature (358)..(358): n is a, c, g, or t
caggtgtcaccggatgaagtagcttaagtcaagggctgcgttgtgtgaaatctgttaatgcctgggattagacccaggaacaggaagagaagaatgaagaaactgggagcagttaggaagtgaataacccacttcctcataccagctcacaatgacaggccctgttcccagcactccctctgcaaagggcttttcattaattctataattgcatgtatgtgtcacttgtacgtgtggtgtattctcaccttaggtgtgcagcacagaagtgcaatgctaaactttcaaaagaaacgactaagctccacctctcactgcctttgcctntgcttgccctccacatcctagaagctgtgantcttctacctttcctaggaagtcattggtttgtccgtgttta

SEQ ID NO: 2311 - DNA, 357 bp, Mus musculus
  misc_feature (36)..(36): n is a, c, g, or t
  misc_feature (53)..(53): n is a, c, g, or t
  misc_feature (70)..(70): n is a, c, g, or t
  misc_feature (128)..(128): n is a, c, g, or t
  misc_feature (141)..(141): n is a, c, g, or t
  misc_feature (181)..(181): n is a, c, g, or t
  misc_feature (202)..(202): n is a, c, g, or t
  misc_feature (234)..(234): n is a, c, g, or t
gacgagtctctttaaagtttctcctttattgctcanttccccccccccccccngtaaacatggtgctgtnagattgtggcagagaaggcttcctcggtgaggcacggtggctcttctctactggggtntgagtgaggtagncagcaggctcaggtgcccctggtgggggcctggaagtttntgggtcggagcttcatttccntgaagggcacagaaaactcgaagcccttccantggtaccagctcactccctgaggagagggttgtcaagggaagagagtcaagacagcgccatatcaatgccacctaatccagccccaccctgctcctgtaggtgactcccagggtccagctatc

SEQ ID NO: 2312 - DNA, 561 bp, Mus musculus
catatgtcctgtgtctagtctaaacaataaagaatgctagctacaaagtccacttactgatacaagtggatagtaaatttttcataagtatttgctgatctttggggagagtactcttgttttcgttaggtatggactagaaatttcagcttaatttctattgtatggttcaaggtaaaacactttaaacaagttaaaaaatcaaaatgcttcctctgttgtagtctttagacgtctttgtgtcagagcatggagaattgtttacactagccaatggagtagtgactcttaaaaaatgatttcctatgctgctgtaagtagaagcacaaagcttttgggtaatgtggggtttactatggagtgtatgtatgttggcctatgcaggattgaactaagcaggaactgagtccagatggaagaatagtacatatgtgaatgttctcaaaattaatgtgttaaatagggtgctttttcttttccttcctacagaattcttaagttttttaaattataagtccttctagagaatgttaattgataatttcaacgaatactacccag

SEQ ID NO: 2313 - DNA, 136 bp, Mus musculus
  misc_feature (97)..(97): n is a, c, g, or t
  misc_feature (102)..(102): n is a, c, g, or t
tcaggacaaataatttttcaaccttcgatgatatccttgcagcagtttgttggtaaggtgactttcacctagggcagctgttgcatgccaatttttnttttntgtgtgtgtgtgtgaaaacacttcagaattgaat

SEQ ID NO: 2314 - DNA, 303 bp, Mus musculus
  misc_feature (205)..(205): n is a, c, g, or t
  misc_feature (210)..(210): n is a, c, g, or t
gtctgttagttacctggatattttatttttctttttggatcttgcaaggggaaaactacaagtaacaagttttataaatttaatttaaattgttacaggttttcatgttcaggacaaataatttttcaaccttcgatgatatccttgcagcagtttgttggtaaggtgactttcacctagggcagctgttgcatgccaatttttnttttntgtgtgtgtgtgtgaaaacacttcagaattgaattaaaagatgtaaatttaaaattggttgtgtatctaatatgcccaggttcagtaaataaa

SEQ ID NO: 2315 - DNA, 259 bp, Mus musculus
  misc_feature (32)..(32): n is a, c, g, or t
  misc_feature (36)..(38): n is a, c, g, or t
  misc_feature (42)..(43): n is a, c, g, or t
  misc_feature (51)..(53): n is a, c, g, or t
  misc_feature (55)..(55): n is a, c, g, or t
  misc_feature (59)..(60): n is a, c, g, or t
  misc_feature (63)..(63): n is a, c, g, or t
  misc_feature (66)..(68): n is a, c, g, or t
  misc_feature (81)..(81): n is a, c, g, or t
  misc_feature (86)..(86): n is a, c, g, or t
  misc_feature (93)..(93): n is a, c, g, or t
  misc_feature (95)..(95): n is a, c, g, or t
  misc_feature (98)..(98): n is a, c, g, or t
  misc_feature (105)..(105): n is a, c, g, or t
  misc_feature (110)..(112): n is a, c, g, or t
  misc_feature (117)..(125): n is a, c, g, or t
  misc_feature (127)..(129): n is a, c, g, or t
  misc_feature (131)..(131): n is a, c, g, or t
  misc_feature (133)..(133): n is a, c, g, or t
  misc_feature (135)..(137): n is a, c, g, or t
  misc_feature (139)..(143): n is a, c, g, or t
  misc_feature (152)..(152): n is a, c, g, or t
  misc_feature (184)..(184): n is a, c, g, or t
  misc_feature (210)..(210): n is a, c, g, or t
ctcacccactttctagactatactactaacgncaannntccnncgatttcnnngntgcnncgnttnnnccaccttatttanctaancagatcntntanttcattnggatnnngaagnnnnnnnnngnnntngngnnnannnnncagttaaanataccttcattttttggacttgcatatttagntgtttggaacagagttgtttcctttntgaatttcaaagataagactgctgcagtcccatcgcaatatccagtggg

SEQ ID NO: 2316 - DNA, 173 bp, Mus musculus
  misc_feature (28)..(28): n is a, c, g, or t
  misc_feature (41)..(41): n is a, c, g, or t
  misc_feature (49)..(49): n is a, c, g, or t
  misc_feature (85)..(85): n is a, c, g, or t
  misc_feature (138)..(138): n is a, c, g, or t
tacatacatccctaggctgatgtttatnagcaccacaagantcttcacntcaaagaattacaactccacttccacctcagtattncttgggctttggaaccattgttaagtaaaataaatgttgctgggtagtttctncccattgattggactcagactaataaattttggaa

SEQ ID NO: 2317 - DNA, 372 bp, Mus musculus
aatcctttttgagcaattttcccattgggggaattttagctgagatggaactctcatgcataaactcaatagctgaaagtctacccagtaaagggcttaggattttgcactgcatggtatctgcactcagcagttctttcctgttgggtgttcaaaagacagtgctatagaaactcactatctggcatcgttggtttcttggctttgtgcatgttaaacctggtatttctaatgatacagtttttcatatgtacataaatttttgtatgtaggtgtgtcggggagggcagaacaacttgcaagtttgatctcaatgtgggggtcttaaactacctggtcttaaagctttctcttcttcctagggtgacacga

SEQ ID NO: 2318 - DNA, 491 bp, Mus musculus
  misc_feature (214)..(214): n is a, c, g, or t
  misc_feature (416)..(416): n is a, c, g, or t
agatcataaaactctctgctcccttctaacacagtttcccactgttcctgcttttctgtgcctagccccaggatctttcctgatttataactgcacgattcaagctactgaatcttgctccacgtgccccttctatctcctactacatctgtgggaacccaactcaagtgcttttgatcaaagaggggtggctacatcttttggctagctctcnccatgtgataatgtcagtgtgctttccgtatcagatcaaagaggtaacctaagacctccatgacaagttctgttcttgagagattatttttcctagtatactaattgggttctaagaggaacttaatgattctgctatgaccacatacctctgatgtattgtgcccagaaaaaaaaaatggtggtttgggtttccccctganccttatagaatagcaactgatgttatatatctgagagaggcaaccgtatcttcttcctgctaattcatctcttga

SEQ ID NO: 2319 - DNA, 440 bp, Mus musculus
aatgtgcagcgtcttatgtggctctgtgtggcatatgcccacatagaaccccccattcaccccaagaccaggagggctgcaggtaaactgctattctaaactcctgattatcagagctggtctttgcaaccaacttcacttcaggcagtctcactgaccctgccgcaggaaaccagatctcagtgcaggttaaagacgcaaacctgagccagtgagacagctcagcggtacaaagcaatcgccacacaaagacagaaggagagaaccaactcgcaggagttgtccccttttctctgcatgcacgtgcatgtacaatgcatatcccctgtcatgtacatgcacacacaataataagtaaattcttagaaaaattaaatgatgtcataagagttaatggcctaatcaatcccaaacaaaaatcctgggttagctgactgaaa

SEQ ID NO: 2320 - DNA, 246 bp, Mus musculus
  misc_feature (27)..(27): n is a, c, g, or t
  misc_feature (79)..(79): n is a, c, g, or t
  misc_feature (82)..(82): n is a, c, g, or t
  misc_feature (85)..(85): n is a, c, g, or t
  misc_feature (103)..(103): n is a, c, g, or t
  misc_feature (127)..(127): n is a, c, g, or t
  misc_feature (139)..(139): n is a, c, g, or t
  misc_feature (180)..(180): n is a, c, g, or t
  misc_feature (182)..(182): n is a, c, g, or t
  misc_feature (199)..(199): n is a, c, g, or t
tacagagctgcagcctttgcacggggnagaaagcagggcagacattgcgatcccaatgcagaagagaaggaagagaganatnaanttccccatctgcagattntgctgtcagtgctgtaacaaaccntcctgtggtatntgttgtgaagaatagagagcctagagccacatcctgacctntntacacccctgcagcccntcaaccccagtattcattcctgccctctccagcaatgaccttgaaat

SEQ ID NO: 2321 - DNA, 497 bp, Mus musculus
  misc_feature (143)..(146): n is a, c, g, or t
  misc_feature (193)..(193): n is a, c, g, or t
  misc_feature (347)..(347): n is a, c, g, or t
  misc_feature (349)..(349): n is a, c, g, or t
  misc_feature (354)..(355): n is a, c, g, or t
  misc_feature (368)..(368): n is a, c, g, or t
  misc_feature (381)..(381): n is a, c, g, or t
  misc_feature (419)..(419): n is a, c, g, or t
  misc_feature (421)..(421): n is a, c, g, or t
gagagctgccagatcagtagccagatcctagctgtcgcccactgctgtcctcaggcttatgaccactagggggcactcaaaagccccggcaggaagggtggccacagggtggatggggcctgggggtcatctgtgagtgagcnnnnagagggagcacagtgtgctgccagctctcatcccagcgttgctgccncgactcctgcagtttcttccggaactggcttagctttccagcagggtctgggaactttgagaaaagcatctagggaaacaggaaaactggaactcagctccctgcaccaggccccggcctccttgctcgtgtccagtggtgcccctccgctcantngacanntgatggattcatntactcacccacanccctgccctagagaatggctagcctccacctgctattntntcagtttcccctcccatcctcaacacacccctgcagatgcagttaagatggaagcctttagtgtgtctatcaggga

SEQ ID NO: 2322 - DNA, 238 bp, Mus musculus
  misc_feature (41)..(41): n is a, c, g, or t
  misc_feature (47)..(47): n is a, c, g, or t
  misc_feature (52)..(52): n is a, c, g, or t
  misc_feature (89)..(89): n is a, c, g, or t
gccaaagctgccattgcggcggctgcagctgctgctgctgntaaagntaaantcccagccaagaaggccacaggaccaggcaagaaggntgcaggccagaaggttcctgctcagaaggctgcaggccagaaggcagcacctcctgttaaaggtcagaagggtcagaagaccccagcccagaaagcacctgctccaaaggcggctggcaagaaagcgtgaggctacacagaataataaa

SEQ ID NO: 2323 - DNA, 269 bp, Mus musculus
  misc_feature (32)..(33): n is a, c, g, or t
  misc_feature (35)..(35): n is a, c, g, or t
  misc_feature (37)..(44): n is a, c, g, or t
  misc_feature (46)..(50): n is a, c, g, or t
  misc_feature (52)..(53): n is a, c, g, or t
  misc_feature (57)..(57): n is a, c, g, or t
  misc_feature (59)..(59): n is a, c, g, or t
  misc_feature (65)..(65): n is a, c, g, or t
  misc_feature (72)..(72): n is a, c, g, or t
  misc_feature (76)..(76): n is a, c, g, or t
  misc_feature (81)..(81): n is a, c, g, or t
  misc_feature (89)..(89): n is a, c, g, or t
  misc_feature (93)..(94): n is a, c, g, or t
  misc_feature (98)..(100): n is a, c, g, or t
  misc_feature (104)..(104): n is a, c, g, or t
  misc_feature (110)..(110): n is a, c, g, or t
  misc_feature (133)..(133): n is a, c, g, or t
  misc_feature (142)..(142): n is a, c, g, or t
  misc_feature (146)..(146): n is a, c, g, or t
  misc_feature (152)..(152): n is a, c, g, or t
  misc_feature (213)..(213): n is a, c, g, or t
  misc_feature (239)..(239): n is a, c, g, or t
aaattttatcatactcactttccatcctgatnncngnnnnnnnnannnnntnntttnancagatnttccatntccnagagnccactctntccnnccannntctnttcagncccactgaagaagtgtgcagaantcttggaantctntccccnccctgaagagcttcagaaatagtgggagtttccctaaaccctttcatacccttaattcatntcatgtataaattaacataaatcatntctatttacatagtgaaggtccagaataaa

SEQ ID NO: 2324 - DNA, 248 bp, Mus musculus
  misc_feature (86)..(89): n is a, c, g, or t
  misc_feature (91)..(96): n is a, c, g, or t
  misc_feature (98)..(98): n is a, c, g, or t
  misc_feature (101)..(101): n is a, c, g, or t
  misc_feature (103)..(103): n is a, c, g, or t
  misc_feature (105)..(105): n is a, c, g, or t
  misc_feature (107)..(110): n is a, c, g, or t
  misc_feature (113)..(116): n is a, c, g, or t
  misc_feature (129)..(129): n is a, c, g, or t
  misc_feature (132)..(132): n is a, c, g, or t
  misc_feature (153)..(153): n is a, c, g, or t
  misc_feature (163)..(163): n is a, c, g, or t
  misc_feature (170)..(170): n is a, c, g, or t
  misc_feature (178)..(178): n is a, c, g, or t
ttctccaccaccgatgtaaggcaagcactatcttatttcctgcccctggccccaaagacactctgcaggtgcaggtccagggaaannnnannnnnnanctngncnannnnttnnnngaagagtatcggnctnccctggaaaatacatccaagncctagaaaangcccccnaaacctgncaagaagtgacagactcattttatgcagtggaccccatgggaacccaggttctgagctggtaactgatac

SEQ ID NO: 2325 - DNA, 54 bp, Mus musculus
ccctgagcatccttctcaaaacttgcctcatgctgaaagctgagctacctgacc

SEQ ID NO: 2326 - DNA, 85 bp, Mus musculus
ggcgatacctactgaagaaaaaacactatgccacctgcttgtcccgtctgggagtctgatctgctaaaaactgcctgctccggga

SEQ ID NO: 2327 - DNA, 439 bp, Mus musculus
  misc_feature (26)..(27): n is a, c, g, or t
  misc_feature (38)..(38): n is a, c, g, or t
  misc_feature (43)..(43): n is a, c, g, or t
  misc_feature (48)..(48): n is a, c, g, or t
  misc_feature (60)..(62): n is a, c, g, or t
  misc_feature (68)..(68): n is a, c, g, or t
  misc_feature (78)..(81): n is a, c, g, or t
  misc_feature (85)..(85): n is a, c, g, or t
  misc_feature (99)..(99): n is a, c, g, or t
  misc_feature (106)..(106): n is a, c, g, or t
  misc_feature (112)..(112): n is a, c, g, or t
  misc_feature (114)..(114): n is a, c, g, or t
  misc_feature (125)..(125): n is a, c, g, or t
  misc_feature (128)..(128): n is a, c, g, or t
  misc_feature (137)..(138): n is a, c, g, or t
  misc_feature (140)..(141): n is a, c, g, or t
  misc_feature (149)..(149): n is a, c, g, or t
  misc_feature (158)..(158): n is a, c, g, or t
  misc_feature (176)..(176): n is a, c, g, or t
  misc_feature (181)..(181): n is a, c, g, or t
  misc_feature (188)..(188): n is a, c, g, or t
  misc_feature (190)..(192): n is a, c, g, or t
  misc_feature (199)..(199): n is a, c, g, or t
  misc_feature (201)..(201): n is a, c, g, or t
  misc_feature (204)..(204): n is a, c, g, or t
  misc_feature (206)..(207): n is a, c, g, or t
  misc_feature (209)..(211): n is a, c, g, or t
  misc_feature (213)..(214): n is a, c, g, or t
  misc_feature (216)..(219): n is a, c, g, or t
  misc_feature (221)..(221): n is a, c, g, or t
  misc_feature (237)..(237): n is a, c, g, or t
  misc_feature (246)..(246): n is a, c, g, or t
  misc_feature (257)..(257): n is a, c, g, or t
  misc_feature (264)..(265): n is a, c, g, or t
  misc_feature (276)..(276): n is a, c, g, or t
  misc_feature (294)..(294): n is a, c, g, or t
  misc_feature (339)..(340): n is a, c, g, or t
  misc_feature (344)..(348): n is a, c, g, or t
  misc_feature (385)..(385): n is a, c, g, or t
  misc_feature (413)..(413): n is a, c, g, or t
aagtatctgaaggatgtcaccttaannaagcaatgtgngccantccgncggtataatggnnnagttgntaggtgcgcnnnngccnaacagtggggctgnacacagngtcggngnccaaaaaagantgntgaattttnncnngcacatgnttaaaaatnctgagagtaacgctgaanttaanggtttanannntagattntntantnntnnnannannnncnaggtgaacaaggcacntaagatgcnccgacgaaccnacagagnntcatggccggnattaacccatacatgagntccccctgccacattgagatgatcctcactgagaaggaacagatnnttcnnnnnaaagccagaagaggaggttgcacagaagaaaaagatntcccagaagaaactgaagaaacaaaaantcatggcccgggaataaattcagcat

SEQ ID NO: 2328 - DNA, 125 bp, Mus musculus
  misc_feature (85)..(85): n is a, c, g, or t
cctagtaccaaacagtaataatgctacattcaaattgtgaacagcaaaatattttaaatagtgtgtgctttatgatttgtgaaangtctatcatgttgttagtgctgcaatctaaataaaagtat

SEQ ID NO: 2329 - DNA, 405 bp, Mus musculus
  misc_feature (99)..(99): n is a, c, g, or t
  misc_feature (361)..(361): n is a, c, g, or t
  misc_feature (364)..(364): n is a, c, g, or t
tacgtgtagtcccagagcccgtcacagcccttgtggttcaagcttcttctgcctctttaggaagtgagggtttcttgttctcctttaaaaatcagtctntagactacggccatcaggaatctaccctcgcccacctgaccctgcgaggacacgggcacccagcagcacctctcctctgttaccttccccttggcgatcgctcgggtttgtgttaagttaatctgtatgtcctgtctgccagcgttccctgtactataggcctgtgtatagtgtagggcagagcgttgacccactggctagtgcttgacttgggaatcaggacagtacctgtacaggcacggggacccgctccgtccgtgcnccnccctatattgagggctccagctctcccttggtttttgaaag

SEQ ID NO: 2330 - DNA, 402 bp, Mus musculus
  misc_feature (137)..(137): n is a, c, g, or t
  misc_feature (169)..(169): n is a, c, g, or t
  misc_feature (174)..(174): n is a, c, g, or t
  misc_feature (179)..(179): n is a, c, g, or t
  misc_feature (182)..(182): n is a, c, g, or t
  misc_feature (190)..(190): n is a, c, g, or t
  misc_feature (193)..(193): n is a, c, g, or t
  misc_feature (195)..(195): n is a, c, g, or t
  misc_feature (198)..(199): n is a, c, g, or t
  misc_feature (209)..(209): n is a, c, g, or t
  misc_feature (218)..(218): n is a, c, g, or t
  misc_feature (233)..(233): n is a, c, g, or t
  misc_feature (243)..(243): n is a, c, g, or t
  misc_feature (264)..(264): n is a, c, g, or t
  misc_feature (283)..(283): n is a, c, g, or t
  misc_feature (306)..(307): n is a, c, g, or t
  misc_feature (310)..(310): n is a, c, g, or t
tgacttcctatccttttgacacggttcgccgtcgtatgatgatgcagtctggacgcaaaggaactgatatcatgtacacaggcacgcttgactgctggcggaagatcgcgcgcgatgaagggagcaaggcttttttncaagggcgcatggtccaacgttctcagaggcnatggntggcnccntttgtgcnttntnttnntatgatgagnatcaagaanatacacataattatntcctaggtgnttctccccgagaacaggcatngttgtataatataccatantcttgaacattctggacagattnnctntgggcttgtctgttttatcagtggcaactatttaccagttgaaaagtgggaagcaataatattcatctgaccagttttctcttaaagccatt

SEQ ID NO: 2331 - DNA, 261 bp, Mus musculus
aatttggtgttacccatgggcctggacacaccggttcttgttaacagatacaccttcctatgtggacatccccaccgaaagtgttgctaatcactgggatgtgacaccactatttcgcagacccagggggcggctgccaatataaatgtaaaggagcccacctagttgcctggatgtgtgagcaccttctaagtggcccagctgattaatatacacaccactggtgctcttagcaaaggacagacggcatttgccctgaaa

SEQ ID NO: 2332 - DNA, 446 bp, Mus musculus
  misc_feature (268)..(268): n is a, c, g, or t
  misc_feature (274)..(274): n is a, c, g, or t
  misc_feature (302)..(302): n is a, c, g, or t
acggatagccgctatgcctttgctaccgcccatgtccatggagaaatatataaaagacgtgggttgctgacctcagaaggcaaggagatcaaaaacaaaagcgaaatcttggccctactgaaagctctcttcctgcccaagagactcagtataattcactgccccgggcatcagaggggcaatagtgctgaggctaggggcaaccgaatggcagaccaggcagcccgggaggcagccctaagaactgatatagagacctccacccttnctcttnagagacctccgctccgtacacctccagnctttttccactacaccgagacagataaaagagacctggacactctgggagctgcctacgatgagacaaaacggtactgggtctttcagggcaaacctgtgatgcccagtcaaaacaccttcgaacttttggactttcttcacca

SEQ ID NO: 2333 - DNA, 203 bp, Mus musculus
  misc_feature (27)..(27): n is a, c, g, or t
  misc_feature (33)..(33): n is a, c, g, or t
  misc_feature (35)..(36): n is a, c, g, or t
  misc_feature (40)..(40): n is a, c, g, or t
  misc_feature (124)..(124): n is a, c, g, or t
  misc_feature (178)..(178): n is a, c, g, or t
atagacaacccctacaccaacacttantcctantnnatgntccgggagcgagatcacctgcagcgccaaaaacaacaaatgcgaggacttcatttgcaactgtgaccgtgaggccgccatttgnttttccaaggtcccgtacaacaaggaatacaaaaaccttgacaccgggaaattntgttagcctgtcacctcacttcctg

SEQ ID NO: 2334 - DNA, 236 bp, Mus musculus
  misc_feature (160)..(161): n is a, c, g, or t
  misc_feature (165)..(165): n is a, c, g, or t
  misc_feature (175)..(175): n is a, c, g, or t
  misc_feature (181)..(181): n is a, c, g, or t
  misc_feature (211)..(211): n is a, c, g, or t
cgcttggtccagtttgtaaaagacagaatttcggtagtgcaggccctggttttgacccaacagtatcaccaactcaaatcaatagatccagaagaagtggaatcacgtgaataaaagattttattcagtttccagaaagaggggggaatgaaagaccccnncatnaggcttagcnagctanctgcagtaacgccatcttgcaaggcatggnaaaataccagagctgatgttctcag

SEQ ID NO: 2335 - DNA, 541 bp, Mus musculus
  misc_feature (311)..(311): n is a, c, g, or t
  misc_feature (321)..(321): n is a, c, g, or t
  misc_feature (330)..(330): n is a, c, g, or t
  misc_feature (337)..(337): n is a, c, g, or t
  misc_feature (349)..(350): n is a, c, g, or t
  misc_feature (356)..(356): n is a, c, g, or t
  misc_feature (367)..(367): n is a, c, g, or t
  misc_feature (377)..(377): n is a, c, g, or t
  misc_feature (379)..(379): n is a, c, g, or t
  misc_feature (382)..(382): n is a, c, g, or t
  misc_feature (389)..(389): n is a, c, g, or t
  misc_feature (406)..(406): n is a, c, g, or t
  misc_feature (425)..(425): n is a, c, g, or t
  misc_feature (447)..(447): n is a, c, g, or t
tgacctgtaacaagctgggccttacaaggacatagtaaaacttgttaattctggtgacaagtcacggtatttttctggttcacctgctcttggtatatacttcataggactttcagagtagttctcagagcatactctgcagagcacaagagtttgctacctacctgttttcactagcttaaatgaaagggattcccggttctagtgtgttcctgctgatggtccacatgaacaaggaaccatcagattcctcagcccacattcacaataaagtctcacttggcctgatgaagcagttaaaaagagcagtntttttttttnccccagcgnaggtagngggaagggcttnnggaacntgaaagctggncaataagaantnttnagggaantcctccttggtaggtgncccatgctcctgtagatgnccccacatgctttcaaacagtntcagcattgattgaactcagtgcactgttatgaaagagatcaacctgagagggagatgcgtaagggttggggtgctaggctcatatagtacact

SEQ ID NO: 2336 - DNA, 123 bp, Mus musculus
cccctctcggtgtgcaaagaatcgccccagtacccttgtcaatccggcttggccccatttggacccgtggaatagggtagtacctccaacgtggagttgatgccctaaaggtgtattatgtta

SEQ ID NO: 2337 - DNA, 132 bp, Mus musculus
  misc_feature (66)..(66): n is a, c, g, or t
atgagcatcagccatttcctgccctgagcaggggagcctgtccaccagcgttcagctgtagccttntggaatagggttccagccactagccatgttggcaacaacagggacacccttcacgtcctgcaagac

SEQ ID NO: 2338 - DNA, 173 bp, Mus musculus
  misc_feature (47)..(47): n is a, c, g, or t
  misc_feature (50)..(50): n is a, c, g, or t
  misc_feature (111)..(111): n is a, c, g, or t
  misc_feature (115)..(115): n is a, c, g, or t
  misc_feature (120)..(120): n is a, c, g, or t
aaatacaagcccctagacctgcgacccaagaagactagagccatgcnccnccggctcaccaagcacgaggagaagctgaagaccaagaagcagcagcggaaggagcggctntttnctttngcgcaagtatgcattcaaggcctgagatgacaacgacaataaagtgcgagact

SEQ ID NO: 2339 - DNA, 430 bp, Mus musculus
  misc_feature (353)..(353): n is a, c, g, or t
  misc_feature (388)..(388): n is a, c, g, or t
  misc_feature (394)..(394): n is a, c, g, or t
atgccatcacccgtgtcttttgttttccctctgaagggagtgggttatactctgggtgagcttcctccagtgtcctcagaaacagtcccagaagcagtgcgccccacactgggtgcaccctatcatgtgcctcacacttcagcatttgtaacatggtgcatagaagggttgtcccagggtctgcagtaccaggaccctatctgctccttgctagaggcccctgaaccttccacacatgctacacccagcatgtttgcaacactgaggtcaaacccagggcctggcacatggtctgctgctgactgacagtctcagcctgggaaccttagaggaaactggaagggctggaagtntcgcagctgggcagctgctcccttagtatgcactncaaaanccagcggtgctggtgttcgtgtgtaatctcagcatt

SEQ ID NO: 2340 - DNA, 198 bp, Mus musculus
  misc_feature (87)..(87): n is a, c, g, or t
tcaggacaaataatttttcaaccttcgatgatatccttgcagcagtttgttggtaaggtgactttcacctagggcagctgttgcatnccaattttttttttttgtgtgtgtgtgtgaaaacacttcagaattgaattaaaagatgtaaatttaaaattggttgtgtatctaatatgcccaggttcagtaaataaacaa

SEQ ID NO: 2341 - DNA, 154 bp, Mus musculus
  misc_feature (31)..(31): n is a, c, g, or t
  misc_feature (36)..(36): n is a, c, g, or t
  misc_feature (40)..(40): n is a, c, g, or t
  misc_feature (55)..(55): n is a, c, g, or t
  misc_feature (109)..(109): n is a, c, g, or t
ggattcatgaatggcccttagcatttctttntccantttntgcttcccaggtttngtaacctgagggggcttgttttcccttatgtgcattttaaatgaagatcaagantttttgtaaaatgatgaaaatttactatgtaaatgcttgatggat

SEQ ID NO: 2342 - DNA, 202 bp, Mus musculus
  misc_feature (67)..(67): n is a, c, g, or t
  misc_feature (69)..(75): n is a, c, g, or t
  misc_feature (84)..(84): n is a, c, g, or t
  misc_feature (90)..(90): n is a, c, g, or t
  misc_feature (92)..(92): n is a, c, g, or t
  misc_feature (107)..(107): n is a, c, g, or t
  misc_feature (119)..(119): n is a, c, g, or t
  misc_feature (123)..(123): n is a, c, g, or t
caggttgtttactagaatccaactgccaggtcctgccttaatcctgtccctgtccttcattcagggngnnnnnnnggaggcccnactgantntgtgatggtgttttnccaaggtatcancatncatggggccctagcccttgcggtaaacccaatgtgccgggtatttacaccagagttttaaatttcaacacctggataag

SEQ ID NO: 2343 - DNA, 225 bp, Mus musculus
  misc_feature (43)..(43): n is a, c, g, or t
  misc_feature (51)..(51): n is a, c, g, or t
  misc_feature (57)..(57): n is a, c, g, or t
  misc_feature (82)..(82): n is a, c, g, or t
  misc_feature (97)..(97): n is a, c, g, or t
  misc_feature (116)..(116): n is a, c, g, or t
gcaacgacaaaacgcccgacgtatttgctctgaagaaagcaancgccactnaagaangaacaaggaggaggctgcagaatancgctaaacttttggnccaagagaatgataggaangccaaaggaaaaagcgccaggaacagattgccaagagacgtaggctgtcctcacgtgagagcttctacttcctaagtctgaagtccctagtcaaaacaatgagtcttta

SEQ ID NO: 2344 - DNA, 546 bp, Mus musculus
  misc_feature (280)..(280): n is a, c, g, or t
  misc_feature (285)..(285): n is a, c, g, or t
  misc_feature (313)..(313): n is a, c, g, or t
  misc_feature (333)..(333): n is a, c, g, or t
  misc_feature (336)..(336): n is a, c, g, or t
  misc_feature (343)..(343): n is a, c, g, or t
  misc_feature (364)..(364): n is a, c, g, or t
  misc_feature (391)..(391): n is a, c, g, or t
  misc_feature (412)..(412): n is a, c, g, or t
  misc_feature (467)..(467): n is a, c, g, or t
  misc_feature (493)..(493): n is a, c, g, or t
aatactgtagattctgctgtccgcagttgcccgtgtgaatttgctataaagcttctggggttgaagcagctgtgctctgctctgacctccttggctgcccctctgcgtccagggctggggctaggaagaggcaggatgggtgcaaggagcagggctgggagctcaccgtgtacagttggcactcacacatcagagcttcactgaaccaagctcctgtctgtgtgaagcggggtcagggaagagaggcactgctgtgtgtcctgtgtgacctgtgctcctnatcanctttgaagtgaagaaagtgaggtggtcnttctgaaggttcagtttttnatntacaganatagtgatgtttgctatacancaagtgataggtgtaactggtaaccanggctagctaccagcattggtntccttcctctgaactggaatcggttattcaggaataagttttcaaaccttttctncctgaagaattcatgagtattagacngggtgtgtaactcggtgggaaagcatttgtagcatgcccaaatccctgggttt

SEQ ID NO: 2345 - DNA, 167 bp, Mus musculus
ttcccattctctttcatcagactcaggctagaattacaggtgtgttcctttctaccaggtgtgtgtgtgtgtgtgtgtgtgtgtgtgtgtgtgtgtgtgtgtttgtgtgtgtgtttacacatatgcatacgtgcacgaattcttatacatatggacctcagaagaca

SEQ ID NO: 2346 - DNA, 251 bp, Mus musculus
  misc_feature (160)..(160): n is a, c, g, or t
ttatcctctcttcctgttaatgcatttcttaaaatgggtcaacggtgagagaaatttaaatatttacctttgaatacttctctcttttcatatatataaagccatggaagaaataagctgttttcctttggcagagatgccacattttcttaacaggctnctgacctgccaacccacttcaccagattgaagtggaggtcagtggtgttacctgaagaaacatctccatccatggccttagaagagtgctt

SEQ ID NO: 2347 - DNA, 107 bp, Mus musculus
  misc_feature (55)..(55): n is a, c, g, or t
  misc_feature (57)..(57): n is a, c, g, or t
gagaagttgatggagtttcggaacagggaagacaccaccacaactgactgaaatntntcctggctatttttctaacatgttcatgtattgatgttttgtgtatgtgt

SEQ ID NO: 2348 - DNA, 124 bp, Mus musculus
atgtgcttgtgcttgatgactgtgtgtgtaaattctcatgctaagaattgctttaaactgagtattgatcaagttcagagtgaagtcaatgtctctaatcacacatgttcttgctatacattta

SEQ ID NO: 2349 - DNA, 269 bp, Mus musculus
  misc_feature (59)..(62): n is a, c, g, or t
  misc_feature (64)..(64): n is a, c, g, or t
  misc_feature (66)..(68): n is a, c, g, or t
  misc_feature (70)..(72): n is a, c, g, or t
  misc_feature (74)..(79): n is a, c, g, or t
  misc_feature (81)..(82): n is a, c, g, or t
  misc_feature (84)..(86): n is a, c, g, or t
  misc_feature (88)..(88): n is a, c, g, or t
  misc_feature (90)..(91): n is a, c, g, or t
  misc_feature (102)..(102): n is a, c, g, or t
  misc_feature (107)..(108): n is a, c, g, or t
  misc_feature (147)..(147): n is a, c, g, or t
taattgcagagatgcgcgggatccggatgggatcctggtctcttatcgtttaatcaatnnnncntnnntnnntnnnnnntnnannntntnntgatttcctgnatatnnacagtacctttttcattcccccctcagtgagaatgcacnatgtgcttgtgcttgatgactgtgtgtgtaaattctcatgctaagaattgctttaaactgagtattgatcaagttcagagtgaagtcaatgtctctaatcacacatgttcttgctatacatt

SEQ ID NO: 2350 - DNA, 82 bp, Mus musculus
  misc_feature (46)..(46): n is a, c, g, or t
aagatctacaatcatgcttgacctttttatacaaattattttgacntcctattctcgacctccaggacaaagactagagatt

SEQ ID NO: 2351 - DNA, 109 bp, Mus musculus
  misc_feature (37)..(43): n is a, c, g, or t
  misc_feature (48)..(48): n is a, c, g, or t
  misc_feature (51)..(51): n is a, c, g, or t
tgcaacaccctgaggaagcccacagtgttcacccgtnnnnnnncagcnttncattgactggattgaggagaccattgccaacaactagatccaaggttcggctggcaga

SEQ ID NO: 2352 - DNA, 359 bp, Mus musculus
  misc_feature (57)..(57): n is a, c, g, or t
  misc_feature (186)..(186): n is a, c, g, or t
cattctcagcctctcgacgtaatttcatttcatttacgaaagctcgtcttaaggagnggctaactccttaaaacctttaacattttcattggaaacagtgactgagacagactgacttgactgtatccactggggagatgaccttggtgtgtctgtgaagttacgggcgcacatcctagacatctncagtctgtccccggcctggggacacacggtaccttcaaagtagttggaatctgagcatcatgctggagggatgaatttcaggatgttcctacaagttgaaggaagatctacaatcatgcttgacctttttatatgaattattttgacatcctattctcgacctccaggacaaa

SEQ ID NO: 2353 - DNA, 293 bp, Mus musculus
  misc_feature (31)..(32): n is a, c, g, or t
  misc_feature (34)..(34): n is a, c, g, or t
  misc_feature (37)..(38): n is a, c, g, or t
  misc_feature (40)..(46): n is a, c, g, or t
  misc_feature (48)..(51): n is a, c, g, or t
  misc_feature (53)..(53): n is a, c, g, or t
  misc_feature (57)..(57): n is a, c, g, or t
  misc_feature (62)..(62): n is a, c, g, or t
  misc_feature (64)..(66): n is a, c, g, or t
  misc_feature (68)..(78): n is a, c, g, or t
  misc_feature (84)..(85): n is a, c, g, or t
  misc_feature (91)..(91): n is a, c, g, or t
  misc_feature (95)..(95): n is a, c, g, or t
  misc_feature (97)..(101): n is a, c, g, or t
  misc_feature (108)..(108): n is a, c, g, or t
  misc_feature (113)..(115): n is a, c, g, or t
  misc_feature (117)..(119): n is a, c, g, or t
  misc_feature (122)..(123): n is a, c, g, or t
  misc_feature (125)..(125): n is a, c, g, or t
  misc_feature (127)..(129): n is a, c, g, or t
  misc_feature (132)..(132): n is a, c, g, or t
  misc_feature (135)..(135): n is a, c, g, or t
  misc_feature (137)..(137): n is a, c, g, or t
  misc_feature (146)..(146): n is a, c, g, or t
  misc_feature (148)..(148): n is a, c, g, or t
  misc_feature (150)..(151): n is a, c, g, or t
  misc_feature (186)..(186): n is a, c, g, or t
  misc_feature (197)..(197): n is a, c, g, or t
  misc_feature (199)..(199): n is a, c, g, or t
  misc_feature (266)..(266): n is a, c, g, or t
tacccatgagtcaggggtgaagccagagaanngnaanncnnnnnnntnnnnantttncaaanannncnnnnnnnnnnngaccannagatcntacntnnnnnggcagcngaagnnnannnccnntncnnngcntgnanccccccccnantnncccccccatcccccagtgtcggctgagatgttgcntttgcacggtntntgtgtgcagttcccaactttctgcagaagatggtccttgcccttgtcctgaagagtagtaatggttnttgaaaaagatttcaaataaagcctgc

SEQ ID NO: 2354 - DNA, 47 bp, Mus musculus
tagagtggatctggtgctagacagcgcttggcccgtggcatccaagc

SEQ ID NO: 2355 - DNA, 207 bp, Mus musculus
  misc_feature (45)..(45): n is a, c, g, or t
  misc_feature (53)..(53): n is a, c, g, or t
  misc_feature (55)..(55): n is a, c, g, or t
  misc_feature (60)..(60): n is a, c, g, or t
  misc_feature (84)..(84): n is a, c, g, or t
  misc_feature (90)..(90): n is a, c, g, or t
  misc_feature (117)..(117): n is a, c, g, or t
  misc_feature (119)..(119): n is a, c, g, or t
  misc_feature (140)..(140): n is a, c, g, or t
  misc_feature (142)..(142): n is a, c, g, or t
cacatcagatgactgtcttgccatgagaaacccctccactccagncttacacntntcagntccttgacgagtccaaccttacanccatgnagaagtgtgttatatacacctttattntntgtatttggagaaataaccantnttatctgtagaagcatcataccactgtgttttatgtagtgcgattgtttgaaattcagtttagtt

SEQ ID NO: 2356 - DNA, 62 bp, Mus musculus
tttcctacactcctacactatgactgcattcatataatagacttcattctccttaaaaacaa

SEQ ID NO: 2357 - DNA, 505 bp, Mus musculus
  misc_feature (293)..(293): n is a, c, g, or t
  misc_feature (435)..(435): n is a, c, g, or t
  misc_feature (439)..(439): n is a, c, g, or t
gtaaacagccctttgttcacagctgatgtgctcagaagatgctcggccccccaggctcacccagatggctagggacgggaccaagggtgctgtgagttgggggtccagcccacgtgtagcttctagttcctgctcttgcatgcacacacgcacattgttcacccaccaaccaagtcctgcagtttccttaccagggtagtcgagtagagagacctggctattgtgtgacagacaggcaaaagataccttcaaaacatccttgtgatcagagggaaagacgcctgcacctcctnttgaaaatcatccctctcttgtatgtaaaaccatcgctttccctccccttatggtggggctcaggggggcccagggggtagtttgtttgttttttttttttctaaaatgcaccaccttctaagatgagaactggtgctccancccntgagccctgaggactgaaagagtgttgagtcccaggaaggcacagaaggtggctggcccgttacaa

SEQ ID NO: 2358 - DNA, 234 bp, Mus musculus
gctgctattttctcaagtctcaacttccttgtgtgctgtcctctgcctgcattcagcagcaagcccaccgagggacagcagctctgtgactgagcgtttgccatcctgtgctgggcccaggctcccacctggggaagagcggattcttagacaggattctttgatccccagggtttgctgctgagatacaatcatgaattcatgccgttgctggttttatttactctactttct

SEQ ID NO: 2359 - DNA, 97 bp, Mus musculus
  misc_feature (31)..(31): n is a, c, g, or t
  misc_feature (38)..(38): n is a, c, g, or t
  misc_feature (40)..(40): n is a, c, g, or t
  misc_feature (69)..(69): n is a, c, g, or t
  misc_feature (71)..(72): n is a, c, g, or t
tgtagcagcaacactgtgcatgaagatgttntgcagtntntgtacccttgttaatggtgtgcccgtgcntnnttcccataataaacgttcctgatgc

SEQ ID NO: 2360 - DNA, 89 bp, Mus musculus
  misc_feature (31)..(31): n is a, c, g, or t
  misc_feature (64)..(64): n is a, c, g, or t
ctgtattatttagacttgtatttagaacgtntcacttcctcgagctgttactgcctgtacggantcgtggacaacatcggatacctttc

SEQ ID NO: 2361 - DNA, 81 bp, Mus musculus
  misc_feature (38)..(38): n is a, c, g, or t
gcttgtctgctgtaggaccatgagatgtaggggttggntgagtgtattagcatcctttgaggcaagtgttccctttgggca

SEQ ID NO: 2362 - DNA, 255 bp, Mus musculus
agggatgatccttatgtgatataataaacatctattgcttaattgtcattctttcaagtctgtgtctaaaatcaagtaagttactgattgtccatctatcaaattctgtaagaaagtaactgatcagacaaaaaagacaagctacacattcttctcttttagctaccctcaccaacatcatggaaatccatacacttagcttgtttataaaattctaacctcttacaaatttatttagcatttaggcaccaaagt

SEQ ID NO: 2363 - DNA, 515 bp, Mus musculus
  misc_feature (316)..(326): n is a, c, g, or t
  misc_feature (416)..(416): n is a, c, g, or t
  misc_feature (438)..(438): n is a, c, g, or t
  misc_feature (489)..(489): n is a, c, g, or t
ttctggtcctttttcttgcagaaaattacaaatgaggtgcatcagaatgttaacaataactgttttgctgctacatgaatattctttatgcagttattttctaatcagtaactcattaattgtcagttatttttttaactaggtttcttcactaaacatttattaagtaaatctaagaaagaggcaaagctatgattcattgacttaatcaagttttgagggtatctttaattttttaaaattgcagttgagtagatagatatattggtgctgctcctgtgtgtgtgtgtgtgtgtgtgtgtgtgtgtgtgtgtgnnnnnnnnnnntcgtattaaagaaggacaaattacttgaaggaaagaaatggtgtgcttatttaatgaccacaaattttttaaacttttccaaatttaggntcttactatgggtttcccactnaaagggatcacaataaatgcaaaaatatatacatatataactgtaaggtanccttggctagttattttatgcagaaa

SEQ ID NO: 2364 - DNA, 534 bp, Mus musculus
  misc_feature (242)..(242): n is a, c, g, or t
  misc_feature (448)..(448): n is a, c, g, or t
  misc_feature (481)..(481): n is a, c, g, or t
  misc_feature (506)..(506): n is a, c, g, or t
aggatcctcagctatcagcaggtcatcagagtgggccaacccttgctgccttctgttggttttgtgggtttttctggtgtgggattaaaaaaaaaatgctattgcatgcacagaggtggctgcagttctccctccggaatgtcctattgatacggtgtttttatttttcagctgaccatctgcctcttgagagaaagaagtgggcatcctacctttaaattcaggaaccatttttttttttnatttgactctgttacctgcatcccttaccgaagttgtttggggagggggttctgctcgttttgggggtggggaattccaactagccactcctgcattttgtatttgttattcaaacttttggtatcaaaaatcatggcaatcctaagttcacttcaggggagaattctgtttaatatgttcttctcttagatgcaattttaaagtncccctttttgttactagagttttgatctacaantcttaactatgtttgaattgtgccnagtgttgggtaaatgacttttctgcctt

SEQ ID NO: 2365 - DNA, 256 bp, Mus musculus
  misc_feature (31)..(31): n is a, c, g, or t
  misc_feature (75)..(75): n is a, c, g, or t
  misc_feature (87)..(91): n is a, c, g, or t
  misc_feature (95)..(96): n is a, c, g, or t
  misc_feature (127)..(127): n is a, c, g, or t
  misc_feature (129)..(129): n is a, c, g, or t
  misc_feature (131)..(131): n is a, c, g, or t
  misc_feature (134)..(135): n is a, c, g, or t
  misc_feature (211)..(211): n is a, c, g, or t
ctgaggaggaagagattttaaacaaaaaacnatcaaagaaaattcaaaagaaatacgatgaaaggaaaaagaatnccaaaatcagcnnnnncctnnctggaggagcagttccagcagggcaagcttntnanccnntgtattgcctcacgaccaggccagtgtggcagagcagacggctatgtgctcgaaggcaaggagctggagttctatntgcggaagatcaaagcccggaaaggcaaatgagcctcatgtgtag

SEQ ID NO: 2366 - DNA, 168 bp, Mus musculus
  misc_feature (28)..(28): n is a, c, g, or t
  misc_feature (31)..(32): n is a, c, g, or t
  misc_feature (59)..(59): n is a, c, g, or t
  misc_feature (63)..(63): n is a, c, g, or t
  misc_feature (73)..(74): n is a, c, g, or t
  misc_feature (91)..(98): n is a, c, g, or t
gaagcagcatgtattggaggctttccanttnntgcttctgaccctggggttcagcactntcanccccacaggnntcttctgaagaaacccnnnnnnnnaactgtgacctatagggagaggggatcgcagaaccagggcatctgcctgaactaatacctagtaaagaat

SEQ ID NO: 2367 - DNA, 508 bp, Mus musculus
  misc_feature (115)..(115): n is a, c, g, or t
gatgaacctaccgatgaagtctcttctcctgagtttttacttgtagacactgaaatattttctgctttaacttttatctccttggcgtcaccttcagtcacctccactttatctnattttctctacttttgggttagcttgatcatttataaaaggaatttctttaagagtgctttgttctacaagtggctgagcctgctcatatacttgaccagtggtgcccaaaaggctttggagtatgtcatccacaggaagaggcttatttgctaattccagagtagaaggttgattgtcccagccaatcaggaccccaggaaggaaccttaagggttttggtggctcctgcttggtgacttccatcagaggttcagctgctgttggcaggtcttcctgaagaggctgtgagggcttatttctctgcttgtgtaacacagttgtaaaggaattgaaaaagtcactctcttcctctgctgcttcctctgtgcatgactccattttacctttcttg

SEQ ID NO: 2368 - DNA, 141 bp, Mus musculus
  misc_feature (36)..(37): n is a, c, g, or t
  misc_feature (66)..(66): n is a, c, g, or t
  misc_feature (68)..(68): n is a, c, g, or t
tccccacacagacgaaggtagccagtcacaaggttnntgtgccaccctggccctagtgcttccatntngatggggtgaccacacccctcacattccacaggcctgatttttataaaaaactaccaatgctgatcaataaag

SEQ ID NO: 2369 - DNA, 117 bp, Mus musculus
  misc_feature (30)..(31): n is a, c, g, or t
  misc_feature (34)..(34): n is a, c, g, or t
  misc_feature (62)..(62): n is a, c, g, or t
ttatttctgtactttccccctgtgaagttnnttnttggtttgtgtgtggtatggcttcaatntgtagactattatatggaagtggatgattgctactgttcatgtgcaaatggacca

SEQ ID NO: 2370 - DNA, 140 bp, Mus musculus
  misc_feature (26)..(26): n is a, c, g, or t
  misc_feature (30)..(30): n is a, c, g, or t
  misc_feature (32)..(32): n is a, c, g, or t
  misc_feature (40)..(40): n is a, c, g, or t
  misc_feature (42)..(42): n is a, c, g, or t
  misc_feature (53)..(53): n is a, c, g, or t
  misc_feature (107)..(107): n is a, c, g, or t
  misc_feature (110)..(111): n is a, c, g, or t
cagtagcttcctgcctgggagatggntctntntgcagaantntggtgttttanccttcaggtgtttggttttgtatgtgctccctcattttaaacattaaaccaaanttnntggtttcctttagacaatccaagagaaat

SEQ ID NO: 2371 - DNA, 154 bp, Mus musculus
  misc_feature (30)..(30): n is a, c, g, or t
  misc_feature (76)..(76): n is a, c, g, or t
aagacaaactttgcagtaagcggacagatntatgtgaccatgccctgcacagatctcacgatgagctatgaatcantggagcaagcagcctacaccaaacgtgatggaacacccccaggaggggaagatggcagcattgccttttatattacgt

SEQ ID NO: 2372 - DNA, 125 bp, Mus musculus
  misc_feature (74)..(74): n is a, c, g, or t
  misc_feature (76)..(76): n is a, c, g, or t
  misc_feature (96)..(96): n is a, c, g, or t
tcattttgccaaggaattcaccccagaggtgcaggctgcctggcagaagctggtgattggagtggccaatgttntntcccacaagtaccattaaantccattccagtacactggcaatcccatgt

SEQ ID NO: 2373 - DNA, 56 bp, Mus musculus
gggttcacattaaacttgtttccattctcatccccatgtttagctgacacacttga

SEQ ID NO: 2374 - DNA, 282 bp, Mus musculus
  misc_feature (59)..(59): n is a, c, g, or t
  misc_feature (66)..(66): n is a, c, g, or t
  misc_feature (109)..(109): n is a, c, g, or t
tagaagattgtaaatcacgtgaataaaagattttattcagtttacagaaagaggggggnatgaaanaccccttcataaggcttagccagctaactgcagtaacgccatnttgcaaggcatgggaaaataccagagctgatgttctcagaaaaacaagaacaaggaagtacagagaggctggaaagtaccgggactagggccaaacaggatatctgtggtcaagcactagggccccggcccagggccaagaacagatggtccccagaaatagctaaaacaaca

SEQ ID NO: 2375 - DNA, 407 bp, Mus musculus
  misc_feature (187)..(187): n is a, c, g, or t
  misc_feature (203)..(203): n is a, c, g, or t
  misc_feature (214)..(214): n is a, c, g, or t
  misc_feature (237)..(237): n is a, c, g, or t
  misc_feature (246)..(246): n is a, c, g, or t
  misc_feature (285)..(285): n is a, c, g, or t
  misc_feature (298)..(298): n is a, c, g, or t
  misc_feature (315)..(315): n is a, c, g, or t
  misc_feature (351)..(351): n is a, c, g, or t
tgccgtccactccaaaatcatgcttgcacccttggtgtactaacttccccacagatggcccagactccaccctgtgacgtgcagggctgcggctcctgacccccgggtgctgaggacagcttgttccctttgcaggtgcttctgctttgacacttgactgacggggagggcaggccagagcagtgtnctggccatgcctcagnccgttgaccanagctagacagaaaagaacagcanccgtccagnccgcagcgttctccctctgggcgggctgcatggaatgancctccactcagantcttggaaaagcagaanccgtacctcagggaaagcccctggttgaagtgtctntcctctctgaaggcacaagggccactctgagtgttctgtccttgcatcatttttag

SEQ ID NO: 2376 - DNA, 220 bp, Mus musculus
  misc_feature (51)..(52): n is a, c, g, or t
  misc_feature (54)..(59): n is a, c, g, or t
  misc_feature (61)..(64): n is a, c, g, or t
  misc_feature (66)..(68): n is a, c, g, or t
  misc_feature (70)..(73): n is a, c, g, or t
  misc_feature (83)..(84): n is a, c, g, or t
  misc_feature (93)..(93): n is a, c, g, or t
  misc_feature (95)..(95): n is a, c, g, or t
  misc_feature (98)..(98): n is a, c, g, or t
  misc_feature (104)..(104): n is a, c, g, or t
  misc_feature (111)..(112): n is a, c, g, or t
  misc_feature (122)..(122): n is a, c, g, or t
  misc_feature (129)..(129): n is a, c, g, or t
  misc_feature (134)..(134): n is a, c, g, or t
  misc_feature (140)..(140): n is a, c, g, or t
  misc_feature (144)..(144): n is a, c, g, or t
  misc_feature (147)..(147): n is a, c, g, or t
  misc_feature (151)..(151): n is a, c, g, or t
cactcaatctcctcttttcggaaatatattgcaacccccgcgccgacctgnncnnnnnncnnnngnnntnnnntttacccagnnaccccccananaancagatngatactnnccatattttnctttttngacanttcctngggnatntacnagaacctcccttccccctccccgagtaagacctaagaccatttaagtgtgtgttaaacaactacaaaat

SEQ ID NO: 2377 - DNA, 226 bp, Mus musculus
  misc_feature (35)..(35): n is a, c, g, or t
  misc_feature (37)..(39): n is a, c, g, or t
  misc_feature (41)..(46): n is a, c, g, or t
  misc_feature (48)..(48): n is a, c, g, or t
  misc_feature (50)..(54): n is a, c, g, or t
  misc_feature (57)..(61): n is a, c, g, or t
  misc_feature (68)..(68): n is a, c, g, or t
  misc_feature (70)..(76): n is a, c, g, or t
  misc_feature (78)..(79): n is a, c, g, or t
  misc_feature (82)..(83): n is a, c, g, or t
  misc_feature (87)..(87): n is a, c, g, or t
  misc_feature (94)..(94): n is a, c, g, or t
  misc_feature (104)..(104): n is a, c, g, or t
  misc_feature (113)..(113): n is a, c, g, or t
  misc_feature (153)..(153): n is a, c, g, or t
  misc_feature (180)..(180): n is a, c, g, or t
tcccgcagtgctttttacaccacagactctatctncnnntnnnnnncntnnnnngannnnnttttatnannnnnnnanngtnnttcnatatagnacacatcatntattttgtntttttgttttgacacatccattaaagagtttgacctcttnaaacccccaggatcatgaataaatgcntcatgtatatttattttttaataaatcaagatttctgtgtgctttt

SEQ ID NO: 2378 - DNA, 128 bp, Mus musculus
  misc_feature (37)..(37): n is a, c, g, or t
  misc_feature (40)..(40): n is a, c, g, or t
  misc_feature (42)..(42): n is a, c, g, or t
  misc_feature (57)..(62): n is a, c, g, or t
  misc_feature (96)..(96): n is a, c, g, or t
gggatattttccctggttcctctatgtgaactaatancantncctgttcgtgaatgnnnnnntactcagctcttacttgttttgacttgaattttntcaccaaagacttcatatgtgtaccatcaata

SEQ ID NO: 2379 - DNA, 153 bp, Mus musculus
  misc_feature (38)..(38): n is a, c, g, or t
  misc_feature (60)..(60): n is a, c, g, or t
  misc_feature (67)..(67): n is a, c, g, or t
tatgagttgaaatcccacttttgtgaggacacggtatnccagtttcccatggaagagacncctctgncctgttgttcttgtaaaggtattcttaaggggacatatgttttgattctttcccactcactgggttcaattagatattaaaaggct

SEQ ID NO: 2380 - DNA, 262 bp, Mus musculus
  misc_feature (89)..(89): n is a, c, g, or t
  misc_feature (135)..(135): n is a, c, g, or t
  misc_feature (137)..(137): n is a, c, g, or t
  misc_feature (152)..(152): n is a, c, g, or t
  misc_feature (156)..(156): n is a, c, g, or t
  misc_feature (191)..(191): n is a, c, g, or t
gtgaccttggagtgagtagtttttctgatcatttttacgtagttgttggggcacgaaaagtacattcagacaccagagtggacgcgatnaagggaaagcagttaacctgtgtccatatgtggcagctttcaaagnancctcatcttttttancctntgctgttaacagctgcatggttcatgcttcttgtntccagtatctttgttattttgttcatccaacctcacttgagtgtttggataattgggattacaactccttg

SEQ ID NO: 2381 - DNA, 144 bp, Mus musculus
  misc_feature (49)..(49): n is a, c, g, or t
  misc_feature (57)..(57): n is a, c, g, or t
  misc_feature (60)..(60): n is a, c, g, or t
  misc_feature (66)..(66): n is a, c, g, or t
  misc_feature (72)..(72): n is a, c, g, or t
  misc_feature (75)..(75): n is a, c, g, or t
  misc_feature (77)..(77): n is a, c, g, or t
  misc_feature (79)..(79): n is a, c, g, or t
  misc_feature (82)..(82): n is a, c, g, or t
  misc_feature (94)..(94): n is a, c, g, or t
  misc_feature (96)..(96): n is a, c, g, or t
  misc_feature (98)..(99): n is a, c, g, or t
  misc_feature (109)..(109): n is a, c, g, or t
  misc_feature (115)..(115): n is a, c, g, or t
gggtgggcaccattctatggaacaggtttgaggccagaggcagaccccngcagaagnaanagggtntccttnacntnanatncctgcttcccancntnnacctgaaatnagcggnctgctcagcagattccagagcttgcacaa

SEQ ID NO: 2382 - DNA, 89 bp, Mus musculus
tatgacttgacttgggctggggaaagaggcacacagctcccctggtttttatcacccacattcttctgaaggctgattatgaaacaaaa

SEQ ID NO: 2383 - DNA, 266 bp, Mus musculus
  misc_feature (26)..(26): n is a, c, g, or t
  misc_feature (28)..(28): n is a, c, g, or t
  misc_feature (34)..(34): n is a, c, g, or t
  misc_feature (37)..(37): n is a, c, g, or t
  misc_feature (41)..(41): n is a, c, g, or t
  misc_feature (59)..(59): n is a, c, g, or t
  misc_feature (66)..(66): n is a, c, g, or t
  misc_feature (69)..(69): n is a, c, g, or t
  misc_feature (84)..(85): n is a, c, g, or t
  misc_feature (91)..(91): n is a, c, g, or t
  misc_feature (94)..(94): n is a, c, g, or t
  misc_feature (101)..(101): n is a, c, g, or t
  misc_feature (104)..(104): n is a, c, g, or t
  misc_feature (113)..(113): n is a, c, g, or t
  misc_feature (118)..(118): n is a, c, g, or t
  misc_feature (140)..(140): n is a, c, g, or t
  misc_feature (168)..(168): n is a, c, g, or t
  misc_feature (174)..(175): n is a, c, g, or t
  misc_feature (177)..(177): n is a, c, g, or t
  misc_feature (203)..(203): n is a, c, g, or t
acttctctggagacccccttaatagnantttcanttnttgncatttggggtactttganatccaanttntttttaaattccatnnttggtnccnatagatntantttttacancctgnaaattaactcccatgaacattnctttggtgatgtaagcaagtaaaacccnatgganntntgttgtgatatccttttgtgttccancctaggctaagtgtttgtgaaagccatttgtgagtgcttggagtgttcttcctaataaacaca

SEQ ID NO: 2384 - DNA, 77 bp, Mus musculus
  misc_feature (29)..(29): n is a, c, g, or t
tgtgtcatgctagggacagtggcacagtngttggataatgttgccttggaaacttcccgctgtattaaaaatggaat

SEQ ID NO: 2385 - DNA, 157 bp, Mus musculus
tctcgttccctgctttaccagtctacccacctatctcctttaagatggcctagcatgtcagctgcagtccaaaagtaagtagacaaagcctcatgttaagtagacagtcagggtggactggccctgttagcagtgttggagtcagattccagtggaa

SEQ ID NO: 2386 - DNA, 555 bp, Mus musculus
  misc_feature (365)..(365): n is a, c, g, or t
  misc_feature (384)..(384): n is a, c, g, or t
  misc_feature (452)..(452): n is a, c, g, or t
  misc_feature (456)..(456): n is a, c, g, or t
gggacccaggcgtcatggaactacagctgaggcggcacaggaggcacctccgcccacggaacaaaccacaccaggcagaagcgtgtggttggggcggctatttggtgtgcctgggtgcccctcagaaactgagagtggcgccttcaagtctaggagaccatccagctggttgcccccaacagtaagtgtgctggctctggtgaagagggggacacctcctgagactcctcctgaggcgcttgtgagctcaccaggcagcgtggtgcaggctgacagggcagtccgggctctctgtgaccacactgctgcaggacctgaccaattgagcttccagcgtggggaattgcttcgagtcattgccacantggatgaagactggcttcnctgtgggcgggatggtgtggagggactggtgcccgtgggatacacttcccttgttctgtagctcagancctncctcctttccctaggctcatgaatattgttcatgtgaacttaccatgccaggggcacttgtccttctgcaaacccacatttcttcccatatctatttct

SEQ ID NO: 2387 - DNA, 425 bp, Mus musculus
  misc_feature (185)..(185): n is a, c, g, or t
tctaattctcagctggcggcgtccagtgtgtgacaagaagaaagctggggggcaccgtcacctcccaggaaccagtgttgtccagtgggccttgtccagtgtacgcccagcatttgcccccgttcttccccaaggggatagctggaagaagtcaggcaggatcccaaccacagggccagctgggngggtggcacttggcagatggaaggaagaaacggaagggagtgtgtgtatctgctcctcgggcaggcccagcccacccgcagagacactgcctcttgggaatgggcaagtatggagacggtggggtgcggtgccataggcttctctggttttcgagtccagcttcccctggatggctcccattgggaaagggctgccgggtcctgagtttacaccgtgttgagcgcatcatccgccaggaa

SEQ ID NO: 2388 - DNA, 221 bp, Mus musculus
  misc_feature (31)..(32): n is a, c, g, or t
  misc_feature (34)..(35): n is a, c, g, or t
  misc_feature (38)..(39): n is a, c, g, or t
  misc_feature (41)..(42): n is a, c, g, or t
  misc_feature (44)..(48): n is a, c, g, or t
  misc_feature (50)..(53): n is a, c, g, or t
  misc_feature (56)..(56): n is a, c, g, or t
  misc_feature (58)..(58): n is a, c, g, or t
  misc_feature (60)..(60): n is a, c, g, or t
  misc_feature (64)..(65): n is a, c, g, or t
  misc_feature (67)..(67): n is a, c, g, or t
  misc_feature (69)..(69): n is a, c, g, or t
  misc_feature (71)..(71): n is a, c, g, or t
  misc_feature (97)..(98): n is a, c, g, or t
  misc_feature (100)..(100): n is a, c, g, or t
  misc_feature (113)..(113): n is a, c, g, or t
  misc_feature (124)..(124): n is a, c, g, or t
  misc_feature (149)..(149): n is a, c, g, or t
  misc_feature (151)..(151): n is a, c, g, or t
  misc_feature (154)..(154): n is a, c, g, or t
  misc_feature (164)..(164): n is a, c, g, or t
  misc_feature (170)..(170): n is a, c, g, or t
ctttgaagatatacacactgtacttataaannannaannanntnnnnnannnnaanananaagnntncnanctacacaggcccagaggacacaagtnngntctgtttgtatgntgggagctagntcccctgagagctagataatatatntncantctgtgagtntattcntcagaacttccctaaaacaccaagcgaaagtagctgttgtgcttgtaaatt

SEQ ID NO: 2389 - DNA, 62 bp, Mus musculus
tcgctgacggactggtgtttctgcccgccactctggcttttaatctcggctgtgaccccctg

SEQ ID NO: 2390 - DNA, 230 bp, Mus musculus
  misc_feature (57)..(57): n is a, c, g, or t
  misc_feature (59)..(59): n is a, c, g, or t
  misc_feature (70)..(70): n is a, c, g, or t
  misc_feature (73)..(73): n is a, c, g, or t
  misc_feature (87)..(87): n is a, c, g, or t
  misc_feature (91)..(92): n is a, c, g, or t
  misc_feature (95)..(95): n is a, c, g, or t
  misc_feature (99)..(99): n is a, c, g, or t
  misc_feature (121)..(122): n is a, c, g, or t
  misc_feature (124)..(124): n is a, c, g, or t
  misc_feature (127)..(127): n is a, c, g, or t
  misc_feature (129)..(129): n is a, c, g, or t
  misc_feature (166)..(166): n is a, c, g, or t
  misc_feature (204)..(204): n is a, c, g, or t
ccgctctgcgcgtactacagtactaacttccccacacacagcttccgtccatcaagnancctttaccctnctnagcttctcaggagnaaanncancctncctcagtttaggaacacatccnntnctntntgacaggtagaaggtgaggagctgctttaccacagcnccacagagcagaggaggagaaagcactcaacagtgtgntccacgttgttgggatgcactttttt

SEQ ID NO: 2391 - DNA, 273 bp, Mus musculus
  misc_feature (41)..(41): n is a, c, g, or t
  misc_feature (43)..(52): n is a, c, g, or t
  misc_feature (55)..(56): n is a, c, g, or t
  misc_feature (59)..(61): n is a, c, g, or t
  misc_feature (64)..(67): n is a, c, g, or t
  misc_feature (71)..(71): n is a, c, g, or t
  misc_feature (78)..(79): n is a, c, g, or t
  misc_feature (82)..(82): n is a, c, g, or t
  misc_feature (85)..(85): n is a, c, g, or t
  misc_feature (91)..(91): n is a, c, g, or t
  misc_feature (93)..(93): n is a, c, g, or t
  misc_feature (97)..(97): n is a, c, g, or t
  misc_feature (101)..(101): n is a, c, g, or t
  misc_feature (107)..(107): n is a, c, g, or t
  misc_feature (110)..(110): n is a, c, g, or t
  misc_feature (112)..(116): n is a, c, g, or t
  misc_feature (118)..(118): n is a, c, g, or t
  misc_feature (121)..(121): n is a, c, g, or t
  misc_feature (126)..(126): n is a, c, g, or t
  misc_feature (132)..(132): n is a, c, g, or t
  misc_feature (135)..(135): n is a, c, g, or t
  misc_feature (138)..(139): n is a, c, g, or t
  misc_feature (162)..(162): n is a, c, g, or t
  misc_feature (198)..(198): n is a, c, g, or t
  misc_feature (206)..(206): n is a, c, g, or t
  misc_feature (237)..(237): n is a, c, g, or t
  misc_feature (240)..(240): n is a, c, g, or t
tcatattcatcctgacaggatctgatttacctacgagaaantnnnnnnnnnnccnntgnnnccnnnnccanagattanntgnganaggaantnccanctgnatgtgngtngnnnnntngcntgggntcccantgnttnnaaagggaaaatggagaaattganctgtttcctcactggggatgtgatgagatgcaccgntcgcctgntacggcagccatagctacttttgctactgtnccntccttgccacagggactgtaccttaactgtgag

SEQ ID NO: 2392 - DNA, 127 bp, Mus musculus
  misc_feature (73)..(73): n is a, c, g, or t
  misc_feature (79)..(79): n is a, c, g, or t
caataaagctgtccattcaattccaaatattggttataaagtagaaccattgataactttcatgtttagaaantccttntcttactattcaaaaaatgtttttaatcatgctaataaacgtttttgg

SEQ ID NO: 2393 - DNA, 284 bp, Mus musculus
  misc_feature (125)..(125): n is a, c, g, or t
agtcttctcacctctgagcctcgggctacctgtctgtaagatgggcacctggctcagctgatgtctgactcgcttactgccagccaggattcacactggtaggtaggcagagggcccagagaacncagtgtgggatccatccatttcccaggaaatgtggtctttctgggcacggtcagtgcctgtgcccgtgaaagcagaggtcttggcaccagcacagagttaccagtttggacctgcctgggcgggggaaactgagctctggctgtactgtcctctaaagg

SEQ ID NO: 2394 - DNA, 331 bp, Mus musculus
  misc_feature (45)..(45): n is a, c, g, or t
  misc_feature (172)..(172): n is a, c, g, or t
ggcctcaatgtctccacagggaaattgtgtagcagctgtcgcaanacagtcttctcacctctgagcctcgggctacctgtctgtaagatgggcacctggctcagctgatgtctgactcgcttactgccagccaggattcacactggtaggtaggcagagggcccagagaacncagtgtgggatccatccatttcccaggaaatgtggtctttctgggcacggtcagtgcctgtgcccgtgaaagcagaggtcttggcaccagcacagagttaccagtttggacctgcctgggcgggggaaactgagctctggctgtactgtcctctaaagg

SEQ ID NO: 2395 - DNA, 484 bp, Mus musculus
ggatttcactgtcactgtgcatttctttcacctcctgggctgctggctctacagctcccgtttcccctcggcgctgacctggtggctggtccaggctgtgtgcattgcactcatggccgtcatcggggagtacctgtgcatgcggacggagctcaaggagatccccctcagctcagcccctaagtccaatgtctagagttgggccctttggacactctgctggcacttgggccccatcaccttgggctgctcagacctccagatggggtctggcccaagtctgagcagaaccctggaaatgtgaagtctgttggtggagagataatgaggtcccatcataaaggcaggtagcagccatgatcacagatgtaagaatggcctctgtctgccaaagccttgatatctggaggccagtaagggacctcatggagggtagtggcagatttggaaccatgtcacatgagccatcatactgtcaccagcc

SEQ ID NO: 2396 - DNA, 233 bp, Mus musculus
  misc_feature (41)..(41): n is a, c, g, or t
  misc_feature (45)..(45): n is a, c, g, or t
  misc_feature (62)..(63): n is a, c, g, or t
  misc_feature (70)..(74): n is a, c, g, or t
  misc_feature (77)..(77): n is a, c, g, or t
  misc_feature (81)..(81): n is a, c, g, or t
  misc_feature (83)..(83): n is a, c, g, or t
  misc_feature (88)..(88): n is a, c, g, or t
  misc_feature (94)..(94): n is a, c, g, or t
  misc_feature (101)..(101): n is a, c, g, or t
  misc_feature (108)..(108): n is a, c, g, or t
  misc_feature (115)..(115): n is a, c, g, or t
  misc_feature (117)..(119): n is a, c, g, or t
  misc_feature (130)..(130): n is a, c, g, or t
  misc_feature (136)..(136): n is a, c, g, or t
  misc_feature (139)..(140): n is a, c, g, or t
  misc_feature (143)..(144): n is a, c, g, or t
  misc_feature (146)..(146): n is a, c, g, or t
  misc_feature (156)..(156): n is a, c, g, or t
  misc_feature (158)..(158): n is a, c, g, or t
  misc_feature (166)..(166): n is a, c, g, or t
  misc_feature (170)..(170): n is a, c, g, or t
  misc_feature (172)..(172): n is a, c, g, or t
  misc_feature (193)..(193): n is a, c, g, or t
tgcgctccgttctgtccactgttgtttaatcacatacctantccntcctttctcactctgtnnccagctnnnnnatntccntnccatnttgacnatagaanccacaancctcagncnnntggttaagttnccatgntgnnagnnantcatgctttntnttctccanccgntnacctgcttcctgggaaagtantcgctccctggagcagtaccgactttcagtggaaccaaat

SEQ ID NO: 2397 - DNA, 187 bp, Mus musculus
  misc_feature (39)..(39): n is a, c, g, or t
  misc_feature (47)..(50): n is a, c, g, or t
  misc_feature (53)..(56): n is a, c, g, or t
  misc_feature (61)..(61): n is a, c, g, or t
  misc_feature (72)..(72): n is a, c, g, or t
  misc_feature (82)..(82): n is a, c, g, or t
  misc_feature (90)..(91): n is a, c, g, or t
  misc_feature (99)..(99): n is a, c, g, or t
  misc_feature (106)..(106): n is a, c, g, or t
  misc_feature (120)..(120): n is a, c, g, or t
  misc_feature (132)..(132): n is a, c, g, or t
ggatttaaggcctaccactttcagaagttgaattatggnaagtgtgnnnnccnnnnaagcncaagaggaagnataaatggantgccaagnntaagagangaaacantaccgggactggtnggatgaggcacntaaagattttttaccgcagattcagacatggattccgtgagggaacaacgccgaa

SEQ ID NO: 2398 - DNA, 144 bp, Mus musculus
  misc_feature (48)..(48): n is a, c, g, or t
  misc_feature (50)..(50): n is a, c, g, or t
  misc_feature (57)..(57): n is a, c, g, or t
  misc_feature (70)..(70): n is a, c, g, or t
  misc_feature (90)..(90): n is a, c, g, or t
  misc_feature (99)..(99): n is a, c, g, or t
tcagataaggcacagaaatgttcatcacaccaattattccttataagntnttccatntgcttcagacatntgatggacttggggcagctncctaacccncaacatttgcattatgttcagactgtaacctgcttactgatggta

SEQ ID NO: 2399 - DNA, 302 bp, Mus musculus
  misc_feature (105)..(105): n is a, c, g, or t
  misc_feature (108)..(108): n is a, c, g, or t
  misc_feature (117)..(117): n is a, c, g, or t
  misc_feature (128)..(128): n is a, c, g, or t
  misc_feature (139)..(139): n is a, c, g, or t
  misc_feature (141)..(141): n is a, c, g, or t
  misc_feature (144)..(145): n is a, c, g, or t
  misc_feature (148)..(148): n is a, c, g, or t
  misc_feature (151)..(152): n is a, c, g, or t
  misc_feature (156)..(157): n is a, c, g, or t
  misc_feature (162)..(168): n is a, c, g, or t
  misc_feature (172)..(172): n is a, c, g, or t
  misc_feature (178)..(178): n is a, c, g, or t
  misc_feature (180)..(180): n is a, c, g, or t
  misc_feature (185)..(185): n is a, c, g, or t
  misc_feature (187)..(187): n is a, c, g, or t
  misc_feature (193)..(193): n is a, c, g, or t
  misc_feature (195)..(195): n is a, c, g, or t
  misc_feature (198)..(198): n is a, c, g, or t
  misc_feature (226)..(226): n is a, c, g, or t
  misc_feature (229)..(229): n is a, c, g, or t
  misc_feature (265)..(265): n is a, c, g, or t
ccaacgactcttaaaaacgaatgatagactcttcaccaaaccaacggcaaatgctgaaaagggccacaaaatccacccaccctccaggagaagcatgccatgaancancctttcatngaaatgatganccagaagattnancanntcncanncccnnggggnnnnnnncagnccacgntncaaancntgagantncantgcagaaatgaagcagagtgagggaccnttnttcaaggggcctgggactttttccggcaatggcctnctgggaaagtggcctgggaagagagtgttttgtgttt

SEQ ID NO: 2400 - DNA, 81 bp, Mus musculus
ttctttctcccttacatatccccaacactccgcaatcggcatttcaacatttttttagtccatgcatctttgcatctctaa

SEQ ID NO: 2401 - DNA, 363 bp, Mus musculus
  misc_feature (234)..(234): n is a, c, g, or t
gtgtgtttactctcaaagcacagcatttccacagcagcagccaacatggggtttagtagcttcactcacccctaactaaagctttgaataaaccagtgattttactacaaaaaacactgtccttgaaagaaaggagcggcagtcatacatgaacgtgaaacttggaatgatcaggtcctaaacatggcacttagaaagtagcttatcagaacacccacacttcggtggttcctnttctgtccctccattaatttcccctcaaaaaaaaaaaaaagaaagaaaaagaaaaagaaagaaaatccttcaaaaaatcccattaaacttaagtttataaaattttagaaatgccttgtacccaaaaca

SEQ ID NO: 2402 - DNA, 192 bp, Mus musculus
  misc_feature (44)..(44): n is a, c, g, or t
  misc_feature (46)..(46): n is a, c, g, or t
  misc_feature (49)..(49): n is a, c, g, or t
  misc_feature (61)..(61): n is a, c, g, or t
  misc_feature (63)..(63): n is a, c, g, or t
  misc_feature (69)..(69): n is a, c, g, or t
  misc_feature (95)..(95): n is a, c, g, or t
  misc_feature (100)..(100): n is a, c, g, or t
  misc_feature (135)..(135): n is a, c, g, or t
atctgacttcccctgcaggtctaattccccactggacaggagcntnttngcatgtggttantntgtttnttcctcagttgacatttccttcatanttttntagagactgtaaaacttgtcagattcaatataaantcaaatttggttacttttaataatacagatttttgtcaaatccaataaaggtcaatg

SEQ ID NO: 2403 - DNA, 436 bp, Mus musculus
  misc_feature (189)..(189): n is a, c, g, or t
gccgttacagctcttcgtgcgaaacaggcgactgaggcggattttgaaggagcccttccgagaagggcctgcgagaggccggaggggcccgggaggcggcggcggtgggggaggttgctgctgctgctgctcccctcggctcaagcgccctggagggaccaagtcctgcagcggaaagggcaccggggntagttcgggacccggaggctgcagaagcagccggccacccactcctcctcctccacggccggggctgctgagctcctcttccgagcagctgttagtctccaggctctcggcctccgattccaagccctccaggaccagcagcgcgtcgctcgtctccgtcgggtcctccccggcctgcggggcggcagcaggcggcgggggttgcggcggcggcggctgcgggggacacgggcacggacagcagcct

SEQ ID NO: 2404 - DNA, 233 bp, Mus musculus
gtgactgaggcaccaaagacaggcaggcatgtgtgttgacaaacaagataaataggaacaagagctcaaagcccctcttcctgatcatgttacagctgttgcctggtgcatgggtaagtgacaactgcctcctaggtggcagttttcctggccaagatgatgagtgcacattaatctgaactgctgtagtgaatggaccttctgtagaacctcagtcctgtagacttagggcc

SEQ ID NO: 2405 - DNA, 89 bp, Mus musculus
acctcacaggttccccaaatggaaggactcaagctactacatggccctgaatttcaaagtttttaattttgtacaagagaacagagatt

SEQ ID NO: 2406 - DNA, 128 bp, Mus musculus
  misc_feature (36)..(36): n is a, c, g, or t
tcagaaggctgcaggccagaaggcagcacctcctgntaaagttcagaaggttcagaagaccccagcccagaaagcacctgctccaaaggcggctggcaagaaagcgtgaggctacacagaataataaa

SEQ ID NO: 2407 - DNA, 82 bp, Mus musculus
  misc_feature (57)..(57): n is a, c, g, or t
ggaaataaattaggagcgactactttgtattgtactgccattcctaatgtatttttnatactttttggcagcattaaatatt

SEQ ID NO: 2408 - DNA, 136 bp, Mus musculus
gtacaagtacatataaaaagtgcacttttttccagtagagcctacaaggtcacagaggtgcaggagaccaaatgcctgttttttgaggtggaggcgtcagctccaagctgctgttgaataaaaccctgatcatgtt

SEQ ID NO: 2409 - DNA, 104 bp, Mus musculus
  misc_feature (38)..(38): n is a, c, g, or t
  misc_feature (41)..(41): n is a, c, g, or t
  misc_feature (45)..(45): n is a, c, g, or t
  misc_feature (47)..(47): n is a, c, g, or t
  misc_feature (55)..(55): n is a, c, g, or t
  misc_feature (58)..(58): n is a, c, g, or t
tccaagcagtgagatcacgcagttagctgggttatacnttntttntntttttccnttntgtcccatttgagccagccagctgttggcaattaaaacccacttgc

SEQ ID NO: 2410 - DNA, 52 bp, Mus musculus
ttcttttgaggctaaagtcccctatccgaggagatggtttcaaaggctaact

SEQ ID NO: 2411 - DNA, 71 bp, Mus musculus
ttagaacgtttcttgtttcctcagacagggtggaagatggaggaataaggtccattaaaggctgcagtttc

SEQ ID NO: 2412 - DNA, 89 bp, Mus musculus
  misc_feature (46)..(47): n is a, c, g, or t
ttctgaagaaacccgctcaactgtgacctatagggagaggggatcnncagaaccagggcatctccctgaactaatacctagtaaagaat

SEQ ID NO: 2413 - DNA, 454 bp, Mus musculus
  misc_feature (266)..(266): n is a, c, g, or t
ctttttgactagtaggcagcatccttgctgggcagagccatcggcagcaaggccacgtgaccctcagcaccgcatccagaagccccagtcagcgtgagcctgagcgttgtgtgccctagggctccgtccatgcgttccctacatgcaagggaggcacctccttccatcggtccccacaccttcctgggacttctcataagtcatttccacttgtgaaaaaaaaaaaagtgctaaagtgctcttcccagagagagcacacttcctanacgaaactgtgacaatctttttggttgattcttgactgcttttgagagcataaggagacagcaaatcacgctttctcagttttccctcctctacctctctgctcttccatcccaccctacctccatctcggccccatcaccctgcccccagtgtcttgctgtggctaccctcatttctttcaaacttt

SEQ ID NO: 2414 - DNA, 366 bp, Mus musculus
  misc_feature (188)..(188): n is a, c, g, or t
  misc_feature (243)..(244): n is a, c, g, or t
  misc_feature (310)..(310): n is a, c, g, or t
ggttttgcgttatatctgaacttcgaattttctgttgaataatggtttccttttcaagcaattatacggagatttttttcaccccccatccccttcagctgtatctttccaatgtctgcacctgctgttttgaaaacccgtgctgcatttttttttaaattgccaaagttgctggtgagatctccccnttgtgtttataaacagggagaaaggactgccctgccacatgaagccattgttttnntttgttaaactgagcaaagtttcttttgctctactctaaagtgggaatgagtattacagtcccttncaacagagccatttcagaatgtaagcctgtagggtgtccacacctgagagactgac

SEQ ID NO: 2415 - DNA, 207 bp, Mus musculus
  misc_feature (40)..(40): n is a, c, g, or t
  misc_feature (64)..(64): n is a, c, g, or t
  misc_feature (77)..(77): n is a, c, g, or t
  misc_feature (81)..(81): n is a, c, g, or t
  misc_feature (94)..(94): n is a, c, g, or t
  misc_feature (128)..(128): n is a, c, g, or t
gaacagaatttaaaggttcacagaaacccctgaaaattgncaaaaatagaatttcattgttaancagaactagcttncacngatttagaaaaantagaggtgcataatgctctggccgctccttgaancccgtgtgtctgccaatgttttgaccgttccttgacccatgtgtgtgcccactgctaaagtccactgccaggtgtttgt

SEQ ID NO: 2416 - DNA, 425 bp, Mus musculus
  misc_feature (33)..(33): n is a, c, g, or t
  misc_feature (65)..(65): n is a, c, g, or t
  misc_feature (110)..(110): n is a, c, g, or t
  misc_feature (393)..(393): n is a, c, g, or t
gtagcttttaccctgagcatggttagagaaacnggcgacagtcacatccataccaaggacagaangcagtttgagcaggtgtctatatggtaccctgcatccggggcccnttgggaactggccggttatctgatgtcagtaggtagccagtttgcaacttagccagctgcctcattgattctgagatttcctaataaaggcagactaaagacgaagggtcttcacctgagccgggtttcccgtagctggtctctgtagagagacagtctgtgacgtccgagtctttggactgtggctcctctgcatctctcttggacttgtatccatgcggtgttccgagtgtgaagttggttacttgttgacgttttcttactgtatcagtgaaacacacanttgtcatgtcggttcttgccatgaatttctca

SEQ ID NO: 2417 - DNA, 276 bp, Mus musculus
  misc_feature (101)..(101): n is a, c, g, or t
  misc_feature (103)..(106): n is a, c, g, or t
  misc_feature (113)..(113): n is a, c, g, or t
  misc_feature (115)..(115): n is a, c, g, or t
  misc_feature (118)..(119): n is a, c, g, or t
  misc_feature (122)..(122): n is a, c, g, or t
  misc_feature (124)..(125): n is a, c, g, or t
  misc_feature (131)..(131): n is a, c, g, or t
  misc_feature (164)..(164): n is a, c, g, or t
  misc_feature (169)..(169): n is a, c, g, or t
  misc_feature (173)..(174): n is a, c, g, or t
  misc_feature (192)..(192): n is a, c, g, or t
  misc_feature (196)..(196): n is a, c, g, or t
  misc_feature (238)..(238): n is a, c, g, or t
tacgcacggtctctaatgttcctattcaacaatttactccactgtcttagaaaccagtccctacgctcagtgaatcactcacccctggaggcctagtcagngnnnntgggacngnaannatntnncatgcntatgagttgaaatcccacttttgtgaggacacngtatnccanntttcccatggaagagacncctntgccctgttgttcttgtaaaggtattcttaaggggacatatnttttgattctttcccactcactgggttcaattagatat

SEQ ID NO: 2418 - DNA, 159 bp, Mus musculus
gaagaccataattaaagccctagatttagagcctagtttgtgcccccacttcctcctgatgctgctcccggactctttggtggtgatgtggacagttcttcggcctgctgctgtagaactgcataggatgctcctactgtctgactctgctccacaggg

SEQ ID NO: 2419 - DNA, 259 bp, Mus musculus
  misc_feature (27)..(27): n is a, c, g, or t
  misc_feature (29)..(29): n is a, c, g, or t
  misc_feature (34)..(34): n is a, c, g, or t
  misc_feature (36)..(37): n is a, c, g, or t
  misc_feature (42)..(44): n is a, c, g, or t
  misc_feature (51)..(52): n is a, c, g, or t
  misc_feature (55)..(55): n is a, c, g, or t
  misc_feature (58)..(60): n is a, c, g, or t
  misc_feature (62)..(62): n is a, c, g, or t
  misc_feature (64)..(64): n is a, c, g, or t
  misc_feature (66)..(71): n is a, c, g, or t
  misc_feature (75)..(75): n is a, c, g, or t
  misc_feature (77)..(77): n is a, c, g, or t
  misc_feature (80)..(81): n is a, c, g, or t
  misc_feature (84)..(85): n is a, c, g, or t
  misc_feature (87)..(87): n is a, c, g, or t
  misc_feature (90)..(90): n is a, c, g, or t
  misc_feature (92)..(93): n is a, c, g, or t
  misc_feature (106)..(106): n is a, c, g, or t
  misc_feature (108)..(108): n is a, c, g, or t
  misc_feature (110)..(110): n is a, c, g, or t
  misc_feature (119)..(119): n is a, c, g, or t
  misc_feature (133)..(133): n is a, c, g, or t
  misc_feature (185)..(185): n is a, c, g, or t
  misc_feature (187)..(187): n is a, c, g, or t
  misc_feature (192)..(192): n is a, c, g, or t
  misc_feature (200)..(200): n is a, c, g, or t
  misc_feature (220)..(220): n is a, c, g, or t
actaccattataactagatctacaccntnttctngnntgtcnnnagacagnnacngtnnntntntnnnnnntaantnatnnttnngncgnannaaacagaagactncnanctacacagncccagaggacacangtaggtctgtttgtatggtgggagctagctcccctgagagctagataatatntntgcantctgtgantctattcctcagaacttccntaaaacaccaagcgaaagtagctgttgtgcttgtaaatt

SEQ ID NO: 2420 - DNA, 97 bp, Mus musculus
  misc_feature (43)..(43): n is a, c, g, or t
  misc_feature (48)..(48): n is a, c, g, or t
  misc_feature (50)..(50): n is a, c, g, or t
  misc_feature (71)..(71): n is a, c, g, or t
caggtcatgctggtacttcctgccagtggtgacctgggtaganccccnanccctcaactcaggggttcagnccccacttttctaatcaggaacgaca

SEQ ID NO: 2421 - DNA, 53 bp, Mus musculus
tacaacaggtttctctccacacttttcataccctgagctattcttatattttt

SEQ ID NO: 2422 - DNA, 46 bp, Mus musculus
agaacagtgtttcatatgacccattttttcctagtgcatgagaaat

SEQ ID NO: 2423 - DNA, 165 bp, Mus musculus
  misc_feature (28)..(28): n is a, c, g, or t
  misc_feature (31)..(31): n is a, c, g, or t
  misc_feature (92)..(95): n is a, c, g, or t
gaagcagcatgtattggaggctttccanttnctgcttctgaccctggggttcagcactctcacccccacaggctcttctgaagaaacccgcnnnnaactgtgacctatagggagaggggatcgcagaaccagggcatctccctgaactaatacctagtaaagaat

SEQ ID NO: 2424 - DNA, 111 bp, Mus musculus
  misc_feature (38)..(38): n is a, c, g, or t
cagaactggccccagtgcagattaaggttgaggaagantttggctttgaagcagatgaggccttggattcaagttgggtttcccgagagccagacaaattgctaccctacc

SEQ ID NO: 2425 - DNA, 85 bp, Mus musculus
gaagaagagagttccgtaatagggtattcaggtgctttgtgcttgtacatattcttgtgttgctgtgtttgctgtaataaattat

SEQ ID NO: 2426 - DNA, 568 bp, Mus musculus
  misc_feature (68)..(69): n is a, c, g, or t
  misc_feature (71)..(71): n is a, c, g, or t
  misc_feature (73)..(77): n is a, c, g, or t
accaatgcttcagatcatctctgcaacaataattttggatgctgctcaaaaatagaatcctcaaaaanncngnnnnnaggatttctgtcctaatgctttattatttatcaaggaattcataatatacctaagggtgcttctgtggtactgtcagttcccaccatgacatactggattcacaagatctctactatcgaaactatttgacgtacaatagcaacttatactcataatggttagatcctataatttaatgtttggctttgtataaatttaactgttcattcaaatacctattaagttcatcacaaattatataatttaaaaatctaactaggagatgctgtcaagtcaaatacctctatgatcaattatccttttaaatttcaaaattaaaaactacatccaattctgtgaatttgaatttccaaatgctcctgaaaagagttagcactcatcctcccattttgctgtttttgttttaaagcacagtccatttgtctcagaggtactctcttctcccggtgaggcagcagtcaccacagtgtgacctgtggtgtcgtaccct

SEQ ID NO: 2427 - DNA, 458 bp, Mus musculus
agaactgcagcattggccccaatgtaagcctgggtcctggtgtggtggtggaggatggtgtgtgcatccggcgatgcacagtgcttcgtgatgctcacatccgctcccattcctggcttgagtcatgcatcgtgggctggcgctgccgtgtgggccaatgggtgcgcatggagaatgtaacagtgctgggtgaagatgtcatagttaatgatgaactgtacctcaatggagccagcgtgctgccccacaagtctatcggggagtcagtaccagaacctcgtattatcatgtgaaggatatggagggctggccaagcatccactttgccatcagcagggtaggactcaatgcttcacgaggccctggacttggtgccatttgtctagggaggagtggatgactctgaagctgtcggacttctgccttctggtggggacagacatggacaggaccctgct

SEQ ID NO: 2428 - DNA, 163 bp, Mus musculus
agtaagggtcggtctgtggtcatatataaaagtcccaaaggtccagcctcccctgctgacccacctagcgcagacccctgggcagcccagcccgcctccatgaagcctctcccaagagtaaggccatattctgttttgattttggtagataatcttgtgccgt

SEQ ID NO: 2429 - DNA, 392 bp, Mus musculus
  misc_feature (312)..(312): n is a, c, g, or t
  misc_feature (329)..(329): n is a, c, g, or t
  misc_feature (344)..(344): n is a, c, g, or t
gacagctgacaatttggacagtctctaacatttcttataacattggagcatctttctgcagccttctggcccagaacaactgactgaagagaagtatgaaggacttatgaaggactagctttagcttaccttgtcttggcagagcttagtagttgactatcccgcgtctgtttatctttttttggatagcattctgtctgcagatgaagtcagggcatttcttgcctagtggctagctcgccacaaatgaagcaacttcacatggaggtaatgatgcttaacattttctttgaagtggaatggggtatgctntcaggaacagacacatnttttgtagtcaaatntcttttaataataaaataaccttgaatgtcatactctgtggttctctg

SEQ ID NO: 2430 - DNA, 351 bp, Mus musculus
  misc_feature (123)..(123): n is a, c, g, or t
tgagaaaatgccctcccgagtgcaggccgtcctcctgatgactcaagctatgtcaagtagacacaaaactggccggcacacccatcttccctcactcttttttgtagctctacctgtgcactntaattcccactcgccctttgcagtgttccaagatcactggacctgtcagcccagaagcagaggaccctagtactgtctgcatcctctagtacatggagtatgctttgtcatgattactgagttctggctcctatcctttcctgtgagatgaaaccaaggtacacacttctttccctcaaggcagggcttttctgtacagccatagagggcctgcctgggactcatgct

SEQ ID NO: 2431 - DNA, 458 bp, Mus musculus
  misc_feature (97)..(97): n is a, c, g, or t
  misc_feature (159)..(159): n is a, c, g, or t
  misc_feature (161)..(161): n is a, c, g, or t
  misc_feature (164)..(165): n is a, c, g, or t
  misc_feature (167)..(167): n is a, c, g, or t
  misc_feature (169)..(169): n is a, c, g, or t
  misc_feature (172)..(172): n is a, c, g, or t
  misc_feature (176)..(176): n is a, c, g, or t
  misc_feature (178)..(178): n is a, c, g, or t
  misc_feature (183)..(183): n is a, c, g, or t
  misc_feature (186)..(187): n is a, c, g, or t
  misc_feature (190)..(192): n is a, c, g, or t
  misc_feature (197)..(197): n is a, c, g, or t
  misc_feature (199)..(199): n is a, c, g, or t
  misc_feature (209)..(209): n is a, c, g, or t
  misc_feature (223)..(223): n is a, c, g, or t
  misc_feature (225)..(226): n is a, c, g, or t
  misc_feature (241)..(242): n is a, c, g, or t
  misc_feature (244)..(244): n is a, c, g, or t
  misc_feature (249)..(250): n is a, c, g, or t
  misc_feature (252)..(252): n is a, c, g, or t
  misc_feature (256)..(256): n is a, c, g, or t
  misc_feature (263)..(265): n is a, c, g, or t
  misc_feature (268)..(268): n is a, c, g, or t
  misc_feature (270)..(270): n is a, c, g, or t
  misc_feature (272)..(273): n is a, c, g, or t
  misc_feature (283)..(283): n is a, c, g, or t
  misc_feature (285)..(285): n is a, c, g, or t
  misc_feature (309)..(309): n is a, c, g, or t
  misc_feature (322)..(322): n is a, c, g, or t
  misc_feature (328)..(328): n is a, c, g, or t
  misc_feature (332)..(332): n is a, c, g, or t
  misc_feature (338)..(338): n is a, c, g, or t
  misc_feature (341)..(341): n is a, c, g, or t
  misc_feature (361)..(361): n is a, c, g, or t
  misc_feature (406)..(406): n is a, c, g, or t
  misc_feature (433)..(433): n is a, c, g, or t
gggactcaaagctatcttgacatgcagtttttaggttgtgggtgctgtgcctaaagttggtgatccactagagggatatgaggccttggagacttgnccccagcagccgtgtcactatccactggtcccatgtcctgggtagggtggtaagggcagcgntntgnncnancantctntncgagnccnnccnnncagantntggaaggcgnacaccatgaaaagncnntggaactcctgaagnntncacanngntcantgaaacnnntgntncnntacactcctngngtgctggaggagatggaagcccgnttcgagaagatgngatctncccntcggcnccnagcagcaccacagctacacntccttggagtctcgaggctgaaatcacagaccaggaccctccttntcctcccctgtacagtattatttattntcactggctccttatttaaagatct

SEQ ID NO: 2432 - DNA, 150 bp, Mus musculus
  misc_feature (36)..(36): n is a, c, g, or t
  misc_feature (42)..(42): n is a, c, g, or t
  misc_feature (58)..(58): n is a, c, g, or t
  misc_feature (72)..(72): n is a, c, g, or t
  misc_feature (75)..(75): n is a, c, g, or t
  misc_feature (122)..(122): n is a, c, g, or t
tgcccaaggtcacagcagtgcgcaggtgatagactngtacgntccaagagggcagggntccttgttttattnttntgctgtttcccaagtaccctgaacaatatttagcacataacaggcantcaataaacacatgatttgattagcccc

SEQ ID NO: 2433 - DNA, 190 bp, Mus musculus
  misc_feature (31)..(31): n is a, c, g, or t
  misc_feature (33)..(34): n is a, c, g, or t
  misc_feature (36)..(40): n is a, c, g, or t
  misc_feature (43)..(45): n is a, c, g, or t
  misc_feature (47)..(49): n is a, c, g, or t
  misc_feature (57)..(58): n is a, c, g, or t
  misc_feature (60)..(62): n is a, c, g, or t
  misc_feature (67)..(67): n is a, c, g, or t
  misc_feature (73)..(74): n is a, c, g, or t
  misc_feature (76)..(76): n is a, c, g, or t
  misc_feature (80)..(82): n is a, c, g, or t
  misc_feature (90)..(90): n is a, c, g, or t
  misc_feature (94)..(94): n is a, c, g, or t
  misc_feature (104)..(104): n is a, c, g, or t
  misc_feature (114)..(114): n is a, c, g, or t
  misc_feature (125)..(125): n is a, c, g, or t
  misc_feature (138)..(138): n is a, c, g, or t
cagtgggtattctagactcctgttcagctgncnngnnnnnttnnntnnntttctttnncnnnccttntccacnngnattnnntgacccantgantttgtacctncacaggggtnttttagaaatncccttttatggcnttgattccttttagacctacagatgtgattagtgaactgttgatgtaatgtt

SEQ ID NO: 2434 - DNA, 556 bp, Mus musculus
  misc_feature (26)..(26): n is a, c, g, or t
  misc_feature (203)..(203): n is a, c, g, or t
  misc_feature (324)..(324): n is a, c, g, or t
  misc_feature (336)..(336): n is a, c, g, or t
gcaagaagccactggaatctgacgtnacgagaagttccttgatggtgaaattcaaatacaaagacctatgtccaagactggtgaggtggcccaggagggtcaactgtcttgctaccaagctcaacaaccttcttctgactccctaacctgagtttaacccctgagacccacatgatggataaagagaacttgctcctgcaagnttgtcccctgacctccaggaacatggcatgcctgaacacacaaatgcatgcacacatacacatacacacacgcaaaaataaatgttttggggttgttttgttttgagacaaggtttctgtntagccctggctntcctggaattggctctgtagaccaggctaaccttaaattcagagatccacctgcctctgcccctcaagtgctaagatcaaaggcgtgcgtcaccaccggtgactggtgggggtggggagttgtttgttttaagacaggatctcactatgcagcactgactggcctggaactcagagagtatgcctttctacttgcttctccctccctaaagtgattggat

SEQ ID NO: 2435 - DNA, 338 bp, Mus musculus
  misc_feature (60)..(60): n is a, c, g, or t
  misc_feature (66)..(71): n is a, c, g, or t
  misc_feature (73)..(73): n is a, c, g, or t
  misc_feature (75)..(75): n is a, c, g, or t
  misc_feature (77)..(77): n is a, c, g, or t
  misc_feature (79)..(84): n is a, c, g, or t
  misc_feature (86)..(90): n is a, c, g, or t
  misc_feature (93)..(96): n is a, c, g, or t
  misc_feature (98)..(100): n is a, c, g, or t
  misc_feature (102)..(105): n is a, c, g, or t
  misc_feature (107)..(107): n is a, c, g, or t
  misc_feature (109)..(109): n is a, c, g, or t
  misc_feature (111)..(112): n is a, c, g, or t
  misc_feature (114)..(118): n is a, c, g, or t
  misc_feature (120)..(121): n is a, c, g, or t
  misc_feature (124)..(126): n is a, c, g, or t
  misc_feature (129)..(130): n is a, c, g, or t
  misc_feature (132)..(133): n is a, c, g, or t
  misc_feature (135)..(138): n is a, c, g, or t
  misc_feature (144)..(144): n is a, c, g, or t
  misc_feature (153)..(154): n is a, c, g, or t
  misc_feature (164)..(167): n is a, c, g, or t
  misc_feature (171)..(171): n is a, c, g, or t
  misc_feature (191)..(191): n is a, c, g, or t
  misc_feature (194)..(194): n is a, c, g, or t
  misc_feature (198)..(198): n is a, c, g, or t
  misc_feature (217)..(219): n is a, c, g, or t
  misc_feature (221)..(223): n is a, c, g, or t
  misc_feature (226)..(227): n is a, c, g, or t
  misc_feature (260)..(260): n is a, c, g, or t
  misc_feature (283)..(283): n is a, c, g, or t
  misc_feature (286)..(286): n is a, c, g, or t
tccccaccaccctcacattattgaatcctaaattttttcaccctcacaccctcttttcangatctnnnnnncnantntnnnnnngnnnnnaannnntnnnannnnanananntnnnnntnnctnnncannanntnnnnttcctntatattgtnntcttttttannnnttgncatgttgcttttggaatcanccntgantctttgcccagtatatgannntnnnttnnactggtattttactgtttattgatgaacatttnttcattaagaattttttgaaaantcntcaaattcaatgaataagttttcttcataacccatttggaattattcctaat

SEQ ID NO: 2436 - DNA, 248 bp, Mus musculus
  misc_feature (55)..(55): n is a, c, g, or t
  misc_feature (58)..(58): n is a, c, g, or t
  misc_feature (60)..(62): n is a, c, g, or t
  misc_feature (65)..(67): n is a, c, g, or t
  misc_feature (69)..(70): n is a, c, g, or t
  misc_feature (72)..(72): n is a, c, g, or t
  misc_feature (74)..(76): n is a, c, g, or t
  misc_feature (79)..(79): n is a, c, g, or t
  misc_feature (85)..(85): n is a, c, g, or t
  misc_feature (95)..(96): n is a, c, g, or t
  misc_feature (100)..(100): n is a, c, g, or t
  misc_feature (112)..(112): n is a, c, g, or t
  misc_feature (119)..(120): n is a, c, g, or t
  misc_feature (122)..(122): n is a, c, g, or t
  misc_feature (124)..(124): n is a, c, g, or t
  misc_feature (133)..(133): n is a, c, g, or t
  misc_feature (167)..(168): n is a, c, g, or t
  misc_feature (179)..(179): n is a, c, g, or t
cggccccctcgggagaaagatgactcccccttatcaccaccgtaccaaaatgccngtngnnnttnnncnncntnnnatncacacntccatttccnntcantttcttatttgnaaaaaannanantacacaccnagagcatccagactccacccctgaagggaccccnncctctttattntgagcaacttgttcccgttttcagtttttcttccttcctttcgcggactaccctccttggttgtgatgt

SEQ ID NO: 2437 - DNA, 136 bp, Mus musculus
  misc_feature (36)..(36): n is a, c, g, or t
  misc_feature (50)..(50): n is a, c, g, or t
  misc_feature (52)..(52): n is a, c, g, or t
  misc_feature (98)..(98): n is a, c, g, or t
  misc_feature (101)..(101): n is a, c, g, or t
ataacagattcctcccatgagtatctgatgttttcnaaatccttaaatantnatatagatgaataattcataaaccaaagctgactttgaaatttttnatntctggttgctttcaaccctttggaactttgttgct

SEQ ID NO: 2438 - DNA, 123 bp, Mus musculus
ttgttccttaggcattcattctatctttgctcaaattgttgaaggatggtgatttgtttcctggtttttgtatttgagtctaatgcacgttctaacatgatagaggcaatgcattattgtgta

SEQ ID NO: 2439 - DNA, 236 bp, Mus musculus
  misc_feature (36)..(41): n is a, c, g, or t
  misc_feature (45)..(45): n is a, c, g, or t
  misc_feature (47)..(49): n is a, c, g, or t
  misc_feature (51)..(53): n is a, c, g, or t
  misc_feature (55)..(56): n is a, c, g, or t
  misc_feature (58)..(58): n is a, c, g, or t
  misc_feature (61)..(64): n is a, c, g, or t
  misc_feature (72)..(73): n is a, c, g, or t
  misc_feature (82)..(82): n is a, c, g, or t
  misc_feature (84)..(85): n is a, c, g, or t
  misc_feature (91)..(91): n is a, c, g, or t
  misc_feature (102)..(102): n is a, c, g, or t
  misc_feature (110)..(110): n is a, c, g, or t
  misc_feature (130)..(130): n is a, c, g, or t
  misc_feature (145)..(145): n is a, c, g, or t
  misc_feature (202)..(202): n is a, c, g, or t
agggtccccaaaagcaaccgcatcattgatgccaannnnnnccangnnncnnntnncnatnnnnagatgaanntgcccgagntnnataggnccacaggccgntttaatgnccagtttaaaacctatggcntttgcggggccattngcaggatgggcgagtcagatgattttattttccgattggctaaggctgatggaattntttcaaagaacttttgagcagaagaaatcgggaa

SEQ ID NO: 2440 - DNA, 84 bp, Mus musculus
ttaatcttcgccaagctcggagaggccaaaatcctatctgacagggactgctcctttctcactttcgttttccacatcaatcct

SEQ ID NO: 2441 - DNA, 146 bp, Mus musculus
  misc_feature (26)..(26): n is a, c, g, or t
  misc_feature (94)..(94): n is a, c, g, or t
  misc_feature (99)..(100): n is a, c, g, or t
caagtccatctttgttgttccttagncattcattctatctttgctcaaattgttgaaggatggtgatttgtttcctggtttttgtatttgagtntaatnncacgttctaacatgatagaggcaatgcattattgtgtagccacagt

SEQ ID NO: 2442 - DNA, 64 bp, Mus musculus
ttgcgtgtactttgaagaatggaattgtattattcaccctgttaatcccacttcagagtttggg

SEQ ID NO: 2443 - DNA, 161 bp, Mus musculus
  misc_feature (41)..(41): n is a, c, g, or t
  misc_feature (60)..(63): n is a, c, g, or t
  misc_feature (120)..(120): n is a, c, g, or t
  misc_feature (122)..(122): n is a, c, g, or t
cttggtccttagatgaaatgtttacatagcttctggtgatntccttcataattttatgtnnnncctaaaagggtcatgggtgggacacattaaaaggtgagctttgaactgtagataatntnttaaaaaaatctcattttagaccattaaaatgtttgtgc

SEQ ID NO: 2444 - DNA, 168 bp, Mus musculus
  misc_feature (30)..(30): n is a, c, g, or t
  misc_feature (34)..(34): n is a, c, g, or t
  misc_feature (48)..(48): n is a, c, g, or t
  misc_feature (107)..(107): n is a, c, g, or t
ctgtgggggatatcttgaagcatgaatatnaaantatttttatttctntactttccccctgtgaagttactcttggtttgtgtgtggtatggcttcaatctgtagantattatatggaagtggatgattgctactgttcatgtgcaaatggaccaatatctatataga

SEQ ID NO: 2445 - DNA, 112 bp, Mus musculus
  misc_feature (55)..(58): n is a, c, g, or t
tccttagatgaaatgtttacatagcttctggtgatatccttcataattttatgtnnnncctaaaagggtcatgggtgggacacattaaaaggtgagctttgaactgtagata

SEQ ID NO: 2446 - DNA, 456 bp, Mus musculus
  misc_feature (123)..(125): n is a, c, g, or t
agtggccaggcctgagatctgagcttcctgctctgttgtttccttatcctgcatcctttatcaaggtagacatagctcctgtgtgttgcagttgtgaggaagtttttttctgtcagtttactnnnttgtggtgacgagttagcccgagtcttacatgctttttgtggagtgccccactgaagtgtcctctgcactggctgagccagtgagtctcattgtaagctcttaagttagatcagtcaaattacgtgagtctgagctgttcccctaactcagggtgctacaaacacaagacttgctcaggaaagcttccgaagagaacagcttccagcctgcttcccgtgacactcagcagcacacgggaagtgggccagtggattgccaactacatcaggtagccttactactgctaatcactgtcaataatgtcctttcactctccgaggaaagccgtga

SEQ ID NO: 2447 - DNA, 86 bp, Mus musculus
tgccccaactccctatcccttggtacctttctgccctctggctgaggctgggttctgggtcttcccaacaggtgggaggatcgccc

SEQ ID NO: 2448 - DNA, 332 bp, Mus musculus
gagaacccacatggctttggacatttttcaatgtgatgaaacaatggtccaaatcaggactgactcttcactggctttctgctatctatgaaattatggtcagatcctaaaaacctgctattctctctgtgcttccagtcattagttggtcctcaagattgtagtcagaacagttctttgtacacagtaatggagggataggatgtttaaccttgtttcacataacctctcaatgtgcaatggggatattctgatatttcccccttctgcatctgcctggtgggtgggtcatgtgtaaaagtcttcaaagtagcaatgtatgccaagccaaa

SEQ ID NO: 2449 - DNA, 486 bp, Mus musculus
  misc_feature (162)..(162): n is a, c, g, or t
  misc_feature (456)..(456): n is a, c, g, or t
agaccggttacagcaggactagaagcctctgcatggaccatccctgcctatggagatcaggctggccttgaactcacagaactctgcctgcctttgcctcttgagtaatggaagtgaaggtctgctccgacatgcgcaggctgcagatgacattccttgggntttggtggaagttactgttgtgatcatactttagaaaaggtgaaggatttatattgttataggtatggctacactgcggccctggacagcccaggatgactttgctttaaccacacacggtctccaaatgctaacaaagcaacctcattgtttgggttttgttattaaaacagggtctctaagtaacactggctgctctagaatgctctatgcagaccaggttggccctcaaatctcagagatccacctgtcttcttcccaccacacccccagtgctctcatcaaaggcatggnccacctgacttggttccctgtagaatcctc

SEQ ID NO: 2450 - DNA, 430 bp, Mus musculus
  misc_feature (72)..(72): n is a, c, g, or t
  misc_feature (123)..(123): n is a, c, g, or t
  misc_feature (224)..(224): n is a, c, g, or t
  misc_feature (238)..(238): n is a, c, g, or t
  misc_feature (310)..(310): n is a, c, g, or t
  misc_feature (320)..(320): n is a, c, g, or t
  misc_feature (322)..(322): n is a, c, g, or t
  misc_feature (356)..(356): n is a, c, g, or t
agcagacagcttgttccacagcaggtctgtccccagtttatcagtgctaatgatgggaaaatggaaaacagnagtgaccagaaagactcctgttgctactccagtgctgatccccaaaggggnccgtgttgagggtccttaactcttctgaagatgctcacatcatagaggctacctgtgacacacctgttagcataccttgcagcgaagcccagttagcaggnacacttccattctnccctatgaaacagacaggctcgggctcccagcccttgacatgcagaagtggaccggcagacatgtctcccgntctggagacntntcttcggcccaaatctagaaaagaggacacaatntgcagtgccactgctaagaaaatggtccctgtgtacagcacggcaccaggaagcagtgactccatcaggcaagg

SEQ ID NO: 2451 - DNA, 339 bp, Mus musculus
gtagtcccagcatctgagaagtagaggacaaaggattagaagttcaaacccattctttgctatatataagactctatctaaaaacacaaacccatagagctgcaaatgttgcttagaggttagaagcacatactgcccttgtgtaaggcccaaggtcagttctaagctcccacatcaggtgaggcaggacctcctatggcttcagctctgggaggtctgatgctgtcttcctcgcttctgagggaacctgtactcacatgtacatactcccatgcagacacccacataaccatgtaattcagaatagaatcttaaagccagacttgatggtgcgcacct

SEQ ID NO: 2452 - DNA, 389 bp, Mus musculus
  misc_feature (30)..(30): n is a, c, g, or t
atagtgtcagccattctcttcttaagctgntgatatgctggccacttctaaatctggatctccaaccccagcttcccctctctttagacctgtttttattacccactggacatctccacaggcatgtccataatagtcaagcattattcctcttgaattcctgtcctggtgaccttcgttacaagctacacctacatggtattagtcagcatcacacacccttctactcttgacactctgaagttcagctgttcctctccctttcttaatttacagagcatgggatttggagtcaagttggtttgggcttgaattccagctctcatttttggttgtgtaaaagagttatttaacctctctggagcctcagtcctcccatatgtaaaatg

SEQ ID NO: 2453 - DNA, 354 bp, Mus musculus
  misc_feature (128)..(128): n is a, c, g, or t
aaatctattctaatgtggctttttatggagggtgtaactgtaatgtattcaaaattgtcagtgtggtggcatcaaatatgtagagatggtctttctgtggagaatttgtggaactttagtgtggagancaaagaaggagttggagatgaaaaagtggtactgtgtcaagggaagatttttgtgagttttccatcatgttggccatcacatcctgactgaagtctcaagattcctggaagtgaaggaagacacaaagcttaaaactcagatgagatgctctgactccatcgtgaagtggtcactgaaaaaaatgttgctggtttcttgggatgaaagaactgagccagcatctga

SEQ ID NO: 2454 - DNA, 494 bp, Mus musculus
tcatagtgtattaggagtccgtccaacaattatggttgggtaaatggatggactgtctagctaccagttcctggtcctttctagaactagtagtactttttttttaagggtttatttattttatatatgtgagtacactgttgttgtcttcagacataccagaagagggcattgggttccattacaggtggttgtgagccaccatgtggttgctgggatttgaactcaggaacttcagaagagcagtcagtgcacttaaccgctgagccatctctccagtccagagttgtgattctttgaatgcaatttttgtgtatctggcaaaaaatgcccttcagcaaatttgcataattaaaaaatctttataagccttattaccttgctttatcttgacatcagtgtatattacactgtcctttagaaaaacaaacaagcataatgttctttgcctcagaaatggggatgggggtgggataactcctggtggcaaagac

SEQ ID NO: 2455 - DNA, 459 bp, Mus musculus
  misc_feature (123)..(123): n is a, c, g, or t
  misc_feature (146)..(146): n is a, c, g, or t
  misc_feature (376)..(376): n is a, c, g, or t
tgccttgtgggactgctagatccttggacttccattcatatacagtaggaaagaaccaacacctatatgttgtcccctggcctgcaagggtgcacaggaaagcatttgatgtgctggtgtgangaccggagctggcattttcgagncccacataaagctaggcatgttagcacatatctgtaacgtcagccctcctacagcaagatgaagggtagagacaaatgcatccctgggagctttctgaagggcctgctgtacaccgtcgcaatcctcaaagttcaaaggtgacagcctaaacttggggtcgtcctgactgctgtgcacatttgcatttgcacccccactcaacacacacacacactaactattgcttacntcatcaacttgttggaagggttagctaaatatgtccaaagtgcttagagaggagagcctggaatccagtcaacctctgtacct

SEQ ID NO: 2456 - DNA, 511 bp, Mus musculus
  misc_feature (66)..(66): n is a, c, g, or t
  misc_feature (76)..(76): n is a, c, g, or t
  misc_feature (79)..(79): n is a, c, g, or t
  misc_feature (87)..(87): n is a, c, g, or t
  misc_feature (101)..(102): n is a, c, g, or t
  misc_feature (105)..(105): n is a, c, g, or t
  misc_feature (126)..(126): n is a, c, g, or t
  misc_feature (132)..(132): n is a, c, g, or t
  misc_feature (136)..(136): n is a, c, g, or t
  misc_feature (159)..(159): n is a, c, g, or t
  misc_feature (169)..(169): n is a, c, g, or t
  misc_feature (177)..(177): n is a, c, g, or t
  misc_feature (265)..(265): n is a, c, g, or t
  misc_feature (272)..(272): n is a, c, g, or t
agctcgctcttacgtggtgacaatttcaagcagatggaatggggaaaaataagggaaatgcaacanaacctttatnttnatttattnatttattttttttnnttnataattgtacgtgtgtgtgtnctgtgnttgncagtatgtacatatgagtgcaangtcccctggnaactggantgacagatgctagagtgaattctgcttcaagagtggtctctccagacttactccgagtttgaggagatctccatcccagctcactttnaagcacngttcctatatagatttatataggattaaacttaaggaaggccaagagaagtccttcagatacagcaggtgcacagtaggatggatgctattatgtctggagggtctactgggtgcatttagttaggatgccagacacttcacattgttctttcagccctaggctccagcatggcccttgaccacaactgaaaactttagtcaagtgtggtggttcatacttttaattccagtgctgatg

SEQ ID NO: 2457 - DNA, 438 bp, Mus musculus
  misc_feature (32)..(32): n is a, c, g, or t
  misc_feature (73)..(73): n is a, c, g, or t
  misc_feature (94)..(94): n is a, c, g, or t
  misc_feature (102)..(102): n is a, c, g, or t
  misc_feature (104)..(104): n is a, c, g, or t
  misc_feature (107)..(107): n is a, c, g, or t
  misc_feature (115)..(115): n is a, c, g, or t
  misc_feature (122)..(122): n is a, c, g, or t
  misc_feature (124)..(124): n is a, c, g, or t
  misc_feature (126)..(126): n is a, c, g, or t
  misc_feature (134)..(134): n is a, c, g, or t
  misc_feature (151)..(151): n is a, c, g, or t
atttcaacaaatactctgcaacctgagtaagnatagagcatcctttaattgttaatttttgttcctggaagtnccaccagacttcttaaataancgttgtgncnctnttttgacnccttacncnanttgcccantatgcggaccggtcagntccccctttaaaggaggttgcagactggtttcacccgctcactgtctttgctctcatccatctctgtaaacgttagacaaaagatggtaccactaactgaggtgaggaaacctggggtgaaagatgtttcagaggttaagtcaaggcttatgctaagttttgcgtcctattagacacccaagtggatgggcgagtagttaatggtctctataaatagatgctccgtctaggctggagctataggcttgcatttagtatctatacatagatactgtctaagctggagc

SEQ ID NO: 2458 - DNA, 444 bp, Mus musculus
  misc_feature (26)..(26): n is a, c, g, or t
  misc_feature (36)..(37): n is a, c, g, or t
  misc_feature (61)..(61): n is a, c, g, or t
  misc_feature (77)..(77): n is a, c, g, or t
agaggctggtcttaatccctcagccntccacgcccnnagtgctggggtttcgggtgtgtgnccaccacacccacccngaactgcccttgaaaataccacggttgtaaagagttcgaggaagggctcagttcccttggtggttagacttctgaggcaggccaggctggccttgaacttacagaaatctgcttctgctgtgctggggttaaaggggtgtacccggatcactgtttctagtaaactctagctagccagtattttgtcaagttgctagtagccacacctaccagtaattagtaaattcaggaaggaagggacaccaacacagagacataacaaaaaaaggaacagaaacattgggaacacactaatagattaagatgaatagtttgctggtgtacgtaaaaggcatttctgatgttgggtccagatctttcaaagttt

SEQ ID NO: 2459 - DNA, 330 bp, Mus musculus
ctgttttgttatccctatctctatttcctgtctggtgttggacacctaggctggttgcatagcttagctattgtgattattgctgcagcgctcacggatgagcaggtgtctcagatggtctgactcgcacccctgggtagcacaggtacacagcaggtctctttctatgagaaacttccatactgatttctgtacaagtcacactagtttagattcttacacacagcagtgtgtaagagttccctttgcccacatccaggccagcgtttgctgttttcttaatgactgactttgtaactgaagtgagatgtctgacctgcattgctctga

SEQ ID NO: 2460 - DNA, 353 bp, Mus musculus
gaagtgttttggctttgaggtttcagaagctcatgccaacttcagagtctttttctcccctactgtttgtggatccagacgtagaacactaagctccttctcctgtgtgctgccatgctcctcgccaagctaatgatgaactaaacctcttatagtataggcaggccgtaatgaaatgctctcctttataagatgtgcttcctcggtcatggtctcttcacagcagtagaacatcgacacctactgaatagcagagggtgttacatttttcaaattatattgatggttactgctttgtagcccacagatcctcaataaaaatttacactgagagctgggtacagcggttcctc

SEQ ID NO: 2461 - DNA, 332 bp, Mus musculus
  misc_feature (40)..(40): n is a, c, g, or t
  misc_feature (42)..(42): n is a, c, g, or t
acatctttattacaccgtacctcatatactaggtgtttcntnagtcttacacagtacctcatatagtagatgtttcctcaatcttacacagtatctcatatactaggtgtttcctcaatcttacacagtacttcatatactaggtgtttcctcaatcttacacagtacttcatatactaggtgtttcctcaatctcttggctccttttgaggaaagctgattccttcttcccaaaccccaatatttatattaagcgctattattatttgaagtatgtacagactatatatttgccttccactccaatttttttgtacggtcctagtcagtag

SEQ ID NO: 2462 - DNA, 360 bp, Mus musculus
  misc_feature (26)..(26): n is a, c, g, or t
  misc_feature (36)..(36): n is a, c, g, or t
  misc_feature (40)..(40): n is a, c, g, or t
  misc_feature (90)..(90): n is a, c, g, or t
  misc_feature (118)..(118): n is a, c, g, or t
  misc_feature (165)..(165): n is a, c, g, or t
  misc_feature (212)..(212): n is a, c, g, or t
caactacatcttgacagctattcagnacctagctgntacngctctgctgtgctcacatgtgtaaatcttgtgaaatcagagacatcaccnaattccggaagtagttcagtgcacgggnattacccccgagttcactcaccccgtggtgggtcagtagtagtatanttcataacacaccaaatacgttcctattgctgttttgtcaccagccntgctcttggctttcaaaatccctaccgatttaaagcataattggcagagaatttacactgcttggtaactatatactttcttccttctctgttttcattttgatgcctgaaaatactagaaagttgtagcagctaccaactggtggga

SEQ ID NO: 2463 - DNA, 459 bp, Mus musculus
  misc_feature (36)..(36): n is a, c, g, or t
  misc_feature (56)..(56): n is a, c, g, or t
  misc_feature (74)..(74): n is a, c, g, or t
  misc_feature (89)..(89): n is a, c, g, or t
  misc_feature (134)..(134): n is a, c, g, or t
aagaggtaagaaactggccttccagtttccgtttanccctggagctgatgctgtgnccacagtgatcctacccnaataccaccacaagnaagctaacctcccaagaatacagtcaagcctgtgagtgcactacnagagtaagaccactacttcatctcagagggacccacgtggaaccctcaggacacaggaacggaggacaggagccttcctggttccctctgctccaggagttgatcctgtgcttcagagcccagaactgatcctgtgccacatcgatccatggccaaatacagccaggagagagagggtctcccaggagtgccaacacataagtgagcacagataagaccacaacttcttttcaaattcctgggtcaagagggaccctcccagaaccatcaggacacaggaatcaaggatcagctggggacaggatacttgtggtttctgtctgca

SEQ ID NO: 2464 - DNA, 477 bp, Mus musculus
  misc_feature (175)..(175): n is a, c, g, or t
  misc_feature (191)..(191): n is a, c, g, or t
  misc_feature (198)..(198): n is a, c, g, or t
  misc_feature (213)..(213): n is a, c, g, or t
  misc_feature (433)..(434): n is a, c, g, or t
  misc_feature (437)..(437): n is a, c, g, or t
acaggagaaggccactacacagtcgccactgagtctgctggggctgctgagaaatgccagagactacgttctgtcttggtgactattccactttcatttggaaagaacacgcatcctgctggttggaatgcggctatatcatcaatcaactctgctcatccagttacatccctcngggtcatctctgcccnttgctgncccatggtggctcgnttttacatctgagaggagggaacctcaactgagaaaatgcctctgtaagatcaggctgtcagcaagccggtagggcatcttattaattactgaatgataggggagggccctgcccatgatgggtggtgccatccctaggctggtggtcctgggttctagaagaaagaaggctgaacaagccatggtgagcaagccagtaagcagcaccctcccatggccnntgnatcagctcctcctgcctccaggttcctgatctgttaagag

SEQ ID NO: 2465 - DNA, 449 bp, Mus musculus
  misc_feature (47)..(47): n is a, c, g, or t
  misc_feature (55)..(55): n is a, c, g, or t
  misc_feature (65)..(65): n is a, c, g, or t
  misc_feature (93)..(93): n is a, c, g, or t
  misc_feature (95)..(95): n is a, c, g, or t
  misc_feature (144)..(144): n is a, c, g, or t
  misc_feature (165)..(165): n is a, c, g, or t
  misc_feature (193)..(193): n is a, c, g, or t
ggtgagaatcggttacaagcccattgaccagacccttcattacttangaagcacngacacctcangccagtcctcagtggcttctaggtaccngncctagaattataaattacagaattataaattcctgcgttaatgtatgangcctgtctactttcattcacnagacacatggctgtctctgtgctaacanatgctgacacatgctaacacatgctgacacatgctaacacatgctgacacatgctaacacatgctgacacatgctaactctgtggccttcctgccttcctgcactcctcctcccttcccccacttcatattctcattttctcagatatgcaggaaacaaagaaaatactgtatgaactataacctaatatttctcaggtgtggatatcatgggctcggctacatacttgtctctagttagctgacccctggttgca

SEQ ID NO: 2466 - DNA, 186 bp, Mus musculus
tgtgcctgcaaatacccttacacgggaccagactgctccaaagtgcttccggcatgcaggccaaacccctgccagaatggcggagtctgttcccgacacagacggagatccaggtttacctgtgcctgtccagaccagtataaggggaaattctgtgaaataggagacttataacatgtttatgga

SEQ ID NO: 2467 - DNA, 553 bp, Mus musculus
  misc_feature (59)..(59): n is a, c, g, or t
  misc_feature (307)..(307): n is a, c, g, or t
  misc_feature (325)..(328): n is a, c, g, or t
actgtgcttcctactgactcagtagtgcttagctcccaagacccgctcctccgccattntcagcactctttccctttgttcacttggaaggatgtgtacatttaagttggacgttgaaattcttctttcctctcagaagattctggcagcgatgaagatttcctaatggaagacgacgatgatagtgattatggcagttcaaaaaagaaaaacaaaaagatggttaagaagtccaaacctgagagaaaagaaaagaaaatgcccaaacccagactaaaggcaacaggtgagacctgcgagaggaaancatttctcaagaactaannnnttgcctcagcattggccctatatctatctcgtagaaatacaagaaatccaaaggggttctgtcttacacatatgcctttgttcccttcaagactggtgagggctgaagagatggctcagtgagtaagctcatactgcttccagaggacccaagttcagatccacagccacattgtgtgactaacagctatctgtgactccagctgacttagccacctgtacacat

SEQ ID NO: 2468 - DNA, 445 bp, Mus musculus
  misc_feature (28)..(29): n is a, c, g, or t
  misc_feature (355)..(355): n is a, c, g, or t
atttctcacaacttctgccatttaaagnnactgaaaatgtggaattaggaagtgatgcatgcctgtcactcaggagaaaagatggttgcaagtttgggaccagtctagtctgtgtagcatccccatttcaagcaaaacaacaaaacaaacatgtggaagtcatgattaattacttagtgatgagataattttttgattaattccctcctgtcacattgaatacattccaggttgtccttaaaattttgtgtttggaagcactggggagactgaggcaggaggaatgaaagttcaaggcatatcactattggcatatcactgtgttaaaggtagctttggccacatgcatctcaantccttgcctaaaaatatttttaattacaaagcaaaattaggtgattggagagtggctcagcagttgagatcactggcttcagagaacctg

SEQ ID NO: 2469 - DNA, 413 bp, Mus musculus
  misc_feature (27)..(27): n is a, c, g, or t
  misc_feature (38)..(38): n is a, c, g, or t
  misc_feature (41)..(41): n is a, c, g, or t
  misc_feature (55)..(55): n is a, c, g, or t
  misc_feature (88)..(88): n is a, c, g, or t
  misc_feature (203)..(203): n is a, c, g, or t
catcaccacagcacaaggcagggaaanccattcctaanccntagggcaattgggnaattgtcgggacaattccaggcctagaagatanccaagttgcctctagattcttgtctggacaaataaaactgtatttccccccacaattggcaagcagatggcagtctggagtccacaagtagcaggaggatgcacctggacacatnccttgcacttctgaatctctggttcattttctctccatccatgctccccacccccaccccacctcatcctctgtaaacagaaggagcaatgcactcaccacaagtggtcctgataagtgtggagcacagagacaccttttcccttcaggcctgaagccagcatctgagctgtggacatggcggccactccaattgcaacgggcgctctag

SEQ ID NO: 2470 - DNA, 287 bp, Mus musculus
atggtgtttgtgtgggagtctccctggaggccagaggtcagtcttaactgtcgtctatggctttttggcttttagctctgccttttgagataagatctctagtttgtctggtgtttgcttgctctgtcagctagacgggttggccaaggaccccaaccccagcctggggtcacgggcacatgccaccacacttgggtgctaagaatccaaacttaagtcctcaaggctgttcagtattcaccttactcacagagctatctccctgtcccaacgttttatacacacac

SEQ ID NO: 2471 - DNA, 240 bp, Mus musculus
  misc_feature (158)..(158): n is a, c, g, or t
acaagtcccagtattagagtagaatcgaggagcctgaggctgccagaggaggcccaatttgttgtttagaaagcaaaatattctcaagatggttggtgatgatgatggcccaagaccacagatgtgcccggtgtcatttaaaagtggttccactgggnctggtgccccaggcctgtaactccagctactcaaaagttgaagaaggaggaactcaagttcaaggccagttttcttctcaaa

SEQ ID NO: 2472 - DNA, 231 bp, Mus musculus
  misc_feature (59)..(59): n is a, c, g, or t
  misc_feature (144)..(144): n is a, c, g, or t
  misc_feature (146)..(146): n is a, c, g, or t
  misc_feature (150)..(150): n is a, c, g, or t
  misc_feature (161)..(161): n is a, c, g, or t
  misc_feature (169)..(169): n is a, c, g, or t
  misc_feature (178)..(178): n is a, c, g, or t
  misc_feature (189)..(189): n is a, c, g, or t
  misc_feature (203)..(203): n is a, c, g, or t
taaagtcccttatggatagctgtgatcccaaattctttttgtttgtttgttttgttttntgagacagggtttctctatatagcccgggctgtcctggaactcactttgtagaccaggctggcctcgaactcagaaatccacctncntctncctcccgagtnctgggatnaaaggcatncaccaccaccncccgactctgagtntctttaaaaacaagtctctggggctgga

SEQ ID NO: 2473 - DNA, 122 bp, Mus musculus
  misc_feature (45)..(45): n is a, c, g, or t
  misc_feature (77)..(77): n is a, c, g, or t
tgctattccagcaatgtaccacccactgctgtggatttgaacgtntctgttggcctttttttttccccattgagtgntccaagcactttttcctttcttagttgtgcacttgaggctgacag

SEQ ID NO: 2474 - DNA, 454 bp, Mus musculus
  misc_feature (75)..(75): n is a, c, g, or t
  misc_feature (169)..(169): n is a, c, g, or t
ataggatactgcctgtcatcactggtcatggtccctggtggtctaagtgtccactctcatcacacacacacttcntgaacctgctcacctgtggggctgtgcacgacgaggtctagaaagctggtgcaagttactttttttataactaatcagcatttggaactcaatnaaggacaaagtcttgcaaagtctccctcctgctccatatacatataggatttacaaagcactttgtggcttttataaacactaactatattttgattcttgctctcatatagctaaggtggcttaaatatctacttgggggtagtgtctgctgctaacttaaagcccccccccccagaatgagtggccatgaggagtggaaggggatgtgactcattggttatctgttggattcaaggtgcttattctaattccatgcagaggaaacaacccatagctctgcagt

SEQ ID NO: 2475 - DNA, 456 bp, Mus musculus
  misc_feature (157)..(158): n is a, c, g, or t
tgagccacgttgacagtccgcatagactttcttggtaaagcagtaacagaaatgaagggtcagaccaggttgtgaatgaacaactgtatgcatgcttctcctcagattctgaaacgtttcctcaactcaaacaatgccatcataacctagctcttcnnctgcgcgaatggagtgtgtgtgctgtgtgtgttatgtattcaccacacattcatttacactgatcaaaaagaggaaatagcactgagtatggagtagaacgcctttaatgtcagcactcaggagacagaagcaggtggatctctgtgagctgaaggctagcctggtctacatggagaggtcaggacagccaaggctatgttgagagatcatatctcaaaaataagaaatggggtggagggcagtcttccttgtaactataattcagacataatgcctaaaatcactgcatgctagttt

SEQ ID NO: 2476 - DNA, 508 bp, Mus musculus
  misc_feature (207)..(207): n is a, c, g, or t
  misc_feature (237)..(237): n is a, c, g, or t
  misc_feature (255)..(255): n is a, c, g, or t
gtgttctaatcacatacaagatggaaatatagaaatgggcatattttaccttacaattggtgggtcttttacaattagggataacatgtcaaatttaaataaagtgatcgaattttattttgtttataaaatgtgtatcgcaaattttaaaagtacaactagagaatggaaggtttttatatattctgatgtgattgctaaagtatnggaacaataaaaattgtatatacatttaantagatggtttgatcaaangttgagcagtcacagtcacctgacaccatgcccagtgatctgagttcaaactctgcaatccacttgatggaaggaaagaagtaatttctacaaattgtcctctgacctctacatgctaactctgactttcagaaacccaataataatgtacattgtgatgttttgaatatgcttgggccagggagtgacactatttggaggtgtgacctagtttgagtaggtgtgtgttgcctttatatcctcttcctagctg

SEQ ID NO: 2477 - DNA, 393 bp, Mus musculus
  misc_feature (88)..(88): n is a, c, g, or t
  misc_feature (90)..(90): n is a, c, g, or t
  misc_feature (128)..(128): n is a, c, g, or t
  misc_feature (134)..(134): n is a, c, g, or t
  misc_feature (173)..(176): n is a, c, g, or t
gaaggaaacaagtattttagtggattccattgtaaaaggctttggattttgaaggatattggatattttaaaagcattgaacttttantntgtaaagtctgtggggctttcaaagttgtgtatatctngggcangaataagaaactaagagttgagcattactagtgatgtgnnnncgcctcaaattgacaaggtgtcaattatactggctaattttgtgtcaacttgacacaagctgaagttatcacagagaaaggagcttcagttgggaaatgcctccatgagatccagatgtaagacattttctcaattagtgatcaaggggaaaggccccttgtgggtgggaccatctctctgcactggtagtcttgggttctctaagacagcagtctg

SEQ ID NO: 2478 - DNA, 435 bp, Mus musculus
  misc_feature (190)..(190): n is a, c, g, or t
tgcctggctatgctgtacttctgagcatgtcctgctgcctgctgcctttgttaggggcttgtataaaccccacagtgtgggcttgtcttgttggttctgttcagggttgatacttgagacactggctgccacccagtaggtgtcctcagagaaggccttattttgtgaataaacagcttggaaaggccanttgcgccccagggcctctttccatgtggcttagctcccagagtagcctatgcatagtaagtgctggaaaatacctgtctgggtgggcaacaccagccaagcacacccaccaaaggcacaaagggctcagccactccatctgagagcagcgaaacagcagccaggtatggaggcacatagctgtggacccaacaccccggaaggctgagctgagaggaccaggaattgaaggccattcacagctac

SEQ ID NO: 2479 - DNA, 529 bp, Mus musculus
  misc_feature (292)..(292): n is a, c, g, or t
tttatggcttatgtccacttatcagtgagtatataccctgcatgccattttgggactgtgttacctcacttaggatgatattctcaaattccatccatttgccttcaaattaatgatgtctttgtctttaatagttgcaatgtaatttatggagcacttggtaccacattgtgtctattctttcaagctgcttgtgcccttcacacactgctctgcttactattggtagacaatgcagcccaaggggaaaatgttccatttgttcttcttttttttctttttacatccaaancatttcaataataaggaaaaaatcataaatctcaataatgcatttctaatgatcaaaatctcaagttaaaaaacttcgaccttcaatatccattgcaagtaaaagtaacaaaacgtatctgaatacaataaaaattctgatgatatatagtcattttatattgaggccacaaatatagtaacataaacccaagttatctgtgtaattaattttaaagtctgaaatccttggtaaagt

SEQ ID NO: 2480 - DNA, 517 bp, Mus musculus
gaccgcccatggtctgagactagatagaaaggagaagaaaaagcactcgtgtaaaactcatcctattagaagaaaaataacattttcataaaatgaacatagaaaatgcactgcctctcctttagatacatttcttcagtcaactgactggcttaccaaaagtgttctcttagttcaattattgcacaaattacttttaaacaaatgtcagtgtccactatttgtctgaataaaacctttcaaagaatactactcattttaaaatctcctctcttcagtaaagattaattaaaaacaagcccaccactctttgcttcacaattttaatattaatgaataagtctctccaagctgaagtggtatttctttgaggtctgacctaaacgtgtagcagtagattcctaatatatgcagaattcccaagactcaaaattaagagtcaaaaacaaaaaacaaaacaaaacaccaaaacccagagccaaggaatcgctggaaatgttctcttgagcaggccctg

SEQ ID NO: 2481 - DNA, 371 bp, Mus musculus
tccagcctctggttctcaggcaaggctgttactgctattaccccactggtcgtctatgctcagcttggatgtctggcacccgaccatggcgacggtgaaaactttccctaaatatcagtctcctgatctacaggttgtatttaactacacatagataatctttagccatttttttatactgccttcagttgaccttcagggagtacgtgtatcgtataaattaaaatgctgtatacagaaccctttatcgaagcccacgtgtactgaaagtggaaaaaaaatgagaaactgaaaaacagtgctaaaatattttgtgacaaacatttttgtaaacataaagtctttcaggagttgcaactttttaaacagtg

SEQ ID NO: 2482 - DNA, 481 bp, Mus musculus
  misc_feature (312)..(312): n is a, c, g, or t
cagttacaccttgagattctttctacatcatctgtcttactcccattcatacttcctaaaaggggagagaggagcatgatatagtacatgtctgtaatcctagcacactgggacaccgaggcaggaggatgataaatttgaggccagcctatgctgtcagatttttctatcaaacacaagtatttggggccaagtgaaatgttaaaattgatttgtacaacttcatgctgggtccagggatggttaataacaagagccagtcctcatcctttgtcccccattaccagcagggtcctactacataggcatgcnccaccacacccagcttttctttttctttttttactttttttttttccagatgggtaatatgcccacacctgaacaaggtttaggggaggtacatattctgtgaacacccagtcattgtgattatgaaccaaataaggatctcccacactgctcttgtaactgctatctt

SEQ ID NO: 2483 - DNA, 535 bp, Mus musculus
  misc_feature (349)..(349): n is a, c, g, or t
aaacactgacacattgctactatttaactctctagctctagtcagtctttctcggtttttctcttgtcatttatggtaaaggactctggtctaagttagctattccagttgttaactcttcttaagagtttccacaagtttttgttgttgggttttgggttttgtttggggatagtaagtacccctgactggcctgcaacctactgtatagagtaggctggcctcagactcccagtgttctgtgtgcctctgcttcctgggtgctgagattaaaggtgtatgcccccatagccagcattttttaacttcttgggtcaatgattggattgccttagttttatctctttanagatatagtcgtaaagctgttctctgcatcctctcaggtggtaatgccttgttacttaagactcactgcagacacttaattcaagtgacttcttacactacagagttactccttttcctttttaactcacacctgtgtgggggaagatatctcactctcgtacacgtgtgcgcctcacagatcagg

SEQ ID NO: 2484 - DNA, 458 bp, Mus musculus
  misc_feature (104)..(104): n is a, c, g, or t
  misc_feature (405)..(405): n is a, c, g, or t
  misc_feature (416)..(425): n is a, c, g, or t
  misc_feature (429)..(429): n is a, c, g, or t
ggtaacaccagaacttgccacatgtagctactacagcaaggcttctgtgtacttgccggaaacgaagggaggtcctgctcactccatttctttcgtttgaagcngaagggatgtgtagccagggaaggctcccttcaccagtgtaaagagctgatacagtactcagaagactgaacaaatacttgaaaatgggttcaatgtagactgccattctgtgtggtcttcccattaaatgtgaacattttaatatgtatgcattcaccttgcctcttgcacaaatgtcaaaatggaaagatgggaatgtctcaaaacaaaatgagcttggagattaccaagcagtttgctgaaaattcaatctttgacccaaactgtagcaatttttattttctgagtgtggcactgttntgttttatttnnnnnnnnnngttntgtttttcaatgccaccaacaaactatgt

SEQ ID NO: 2485 - DNA, 304 bp, Mus musculus
tttagtctttgttctattcctcaatttttctgcctgttataccctcaaagtgttccttttgagcttattatggacttaaggctttttgtttttgttttttatgttttgtttttcaagacaaggtttctctatcaacccttgggctgtcctggaactcactctgtagaccaggctagcctcagactcacagacatctgtctgcttctgcactgagcactgggactaaaggtgtgccactacctggctttaaagactattttttatgaagagtagaaaagaaaggttcctgtctagctttgataaa

SEQ ID NO: 2486 - DNA, 537 bp, Mus musculus
  misc_feature (41)..(41): n is a, c, g, or t
  misc_feature (54)..(54): n is a, c, g, or t
  misc_feature (69)..(69): n is a, c, g, or t
  misc_feature (90)..(90): n is a, c, g, or t
  misc_feature (97)..(98): n is a, c, g, or t
  misc_feature (106)..(106): n is a, c, g, or t
  misc_feature (124)..(124): n is a, c, g, or t
  misc_feature (131)..(131): n is a, c, g, or t
  misc_feature (136)..(136): n is a, c, g, or t
  misc_feature (145)..(145): n is a, c, g, or t
  misc_feature (147)..(147): n is a, c, g, or t
  misc_feature (169)..(169): n is a, c, g, or t
  misc_feature (186)..(186): n is a, c, g, or t
ggcctggtgttcactgtgtagcttagactgaccttgaactnacagcagtcctantcccaggctcctgantgctgggcttacaggcctagnctttaannttctagancaattaaacttgggtggncatcagnaacgnaatctttangnacacggccttctgtgctttagncggtactccatctcttnagcttcatttggagactatctgccctgtagccccagattcacaaatcccttcctgttttcagatataaccagagagagaagctgtggggatgatcagcagatgggagcctgtttctccagttctacttgaactcctgtgtttccaggatgacaaaggcacagaggaaacagaaggaagcctgtctattcctgtgcttagaaagacccagataaacagagctgactgaatgcaaggcactaagtcactggcaaaaacaacggtgttgaatctcaagaactgtactaagttagtacagttagtgtggaacaagaagggagacaaccctgaacgccaagcttacacctcaagta

SEQ ID NO: 2487 - DNA, 537 bp, Mus musculus
gaggttcaatgctagccttggctacacagcaagttctaggccagcctgggctacatataccctatcacaaaacaaagtaaagcaaagaaacaaaacatcaaagaagctatgcagaaaactgaccttccctttctttccttcatttcttttttgagacaggtgtcaccccgtagttcactctggcctggaactgttaggtactcagctcatctctcttttttttccttcctttaggcaggtctatatagcccaggctgtcctggaactcattatatagaccatgctggcctcaaactcagagacccgcctgccttggcctccaccttttccttcctcttgcctttgtccttccttctttcagaactaaccctaggcaatgttctacagtgtgaggacatcagagcctggaacagatgagagcaacaagtccttgaatttaaaggaaaaaaaaaagcaattatgctggatgtggtggtatacgcctataattccagcaaggacaaggttgaggcaggccacatcactaggtcaggtctg

SEQ ID NO: 2488 - DNA, 336 bp, Mus musculus
aacaaggtctcattaggtagctctagctgtcttggaattcaccgtttaggccagactgccctcaaactcacacagatctgcctgtctctgcctcccaggtcctgggactaaaagcatgcacgactatgctggtgtatggaaataaagtttagtcaatgttgaaaatctctcctggttgaatgacttgctcaatttctcttggaatccctactgagaacagaattagcaaccttgtgggaaggagacagtggggagggaagagccaaaatgttaggctatgtggctgtgtttcaggagcaggatgtatagcttgcctttcaagtctaagtttctgtg

SEQ ID NO: 2489 - DNA, 421 bp, Mus musculus
  misc_feature (211)..(211): n is a, c, g, or t
  misc_feature (364)..(364): n is a, c, g, or t
gaaagtctcagtcagaacctagtgaacaagacggtgtacttgacttatctactaagaaaagtccatgtgctagcagcacttccctgagccattctccaggctgctccagtactcaagggaacgggcgacctgggagacccagccagtaccgcccagatggacttcggagtggtgatggggtacctccaagaagcttacaggatggaaccanggaaggctttggacactccacatcactcaaagttccactggctcgatctctgcagattagtgaagaactactgagcagaaaccaattgtccacggctgccagccttggtccgtctggattacagaatcacggacagcacttaatcttatccanggaagcctcttgggcaaaacctcactatgaattcagcctcagccgaatgaagttcag

SEQ ID NO: 2490 - DNA, 410 bp, Mus musculus
  misc_feature (44)..(44): n is a, c, g, or t
  misc_feature (54)..(54): n is a, c, g, or t
  misc_feature (56)..(56): n is a, c, g, or t
  misc_feature (64)..(64): n is a, c, g, or t
  misc_feature (106)..(106): n is a, c, g, or t
  misc_feature (124)..(124): n is a, c, g, or t
  misc_feature (129)..(129): n is a, c, g, or t
  misc_feature (164)..(164): n is a, c, g, or t
  misc_feature (292)..(292): n is a, c, g, or t
  misc_feature (323)..(324): n is a, c, g, or t
caggcatgatgcaggtgtagctgctggttctacatcttgttacnaaggcaaacngnagactaantactaggccgctaggatgagggtcttagaacccacacccacnatggcacacttttttcancaagnccacacctactccaacagggccactccttgtagtnatgccactccctgggccaagcatctacaaaccatcacactgttttaattttattgtatattatttttatttcaaataattcttacatttaaagctattttagctcatattcttcccctcccccacatncttccagatcctaccctccaccaaactttcnnaagaaacaacccaaaaacccagtacaacagcaaaaccccaaagcctactaaacaagatacattaactctcagcataaataagcaaa

SEQ ID NO: 2491 - DNA, 369 bp, Mus musculus
tcttctgggaagagctaccagtgctcttcactgctgagctacctctccagcccttgttttaaaatcttaacgtaaggtgttttagaaagtacagaccaatacacttgagatgtttctacactgagtatcccaacccttccttcttgtgctttaaggtgcaaaaaaatggttccagcttcaaagagattcacaatccataggtcctctaatgttcttaccatctcactgaagcgctttgccaacttcaccggtggaaagattgctaaggtatgcccatgattcatgactgttctcatctctgtacagtgagttttccccttttcttcacaattaatgaagggtaaagtggtcaagatgcacagtcatgtg

SEQ ID NO: 2492 - DNA, 400 bp, Mus musculus
ccctggattggtggtctttaattctataaaaaagcaggccatgaggaacaagccagtaagagttcctgcttctaggttctgctgtttgaattcctgtcctgacttcctttgataatcaacagtggtatggaagtatgagttaaataaaacctttcctccctcagttgttttgttcatagtgtttcattacagtaataacaaccctaattagtgccgtagaatatatttcaacaaagtccaaagcaaggggaggggagaaattcctttcacctttgatcatttatgttcccagatgaaagacatacatagcctttatattttagtatgtcttaagcagcagaatagctcggtagccgtctgtcttccatgttgttagaatctactttctaatccataaccc

SEQ ID NO: 2493 - DNA, 102 bp, Mus musculus
aaagctcttacagtgaagactcaattagatcctcattcacaagcaattaggttggtttattcaggtacaagctgttattgtcaacattttgcagtattttta

SEQ ID NO: 2494 - DNA, 530 bp, Mus musculus
  misc_feature (68)..(69): n is a, c, g, or t
  misc_feature (131)..(131): n is a, c, g, or t
  misc_feature (213)..(213): n is a, c, g, or t
  misc_feature (215)..(215): n is a, c, g, or t
gagtcaccctattgtaagcctaaatgtctactgcaaaaatcttgaagcatttatttctaatgagcaannggtgtgtgtgtgtgtgtgtaattagatggtagagtatatccaatctacacagctcggtgatnaaggggagtgggtgaacattgcaggcagacactcagagggaaacggcggcaccttcccaagcccaatgaagaagtataaccngnaggcttttcagaatgcaatcagtgcgtgccaaagctgcttttctcaaatcgcgaaggagaggggcacgggactgcacaagtctgggctccaaggctaagcacctgttttaaaaatgggcctggggcatctgcacacttgcctggtccggccagaggcatgcacatcctcggagctttaaaacagaaagctaccatccatcccaaggaaggtaccgggagctcagtgcactcccaggacaccgctcgcttgcaacatctcggcgcggcgccaggcaagggcccgcttctccagcctgcaagcggtgcctacgggat

SEQ ID NO: 2495 - DNA, 408 bp, Mus musculus
actcccctgggaactgaacaatagaagaagctatttttgcagcaagaagactgcaaggcagacagcaaaaagaacttcagaatgattatttgcagaaagaagacccaccctaaatctgcgtcacatctcctggtggcggccttcgcgaaaggacatgggagaaggatgcgtcgcttcctgtctgctgcccccactctcactgccaagtttgtgtatcttgttgctgtggctggcgggaaatccaatttcttcaggatttcagtgcacactgaagaccagaagctctccaggattcctcccagtctccagcatgagaaggactgctgggatacccagcctcctggacagagctaatactggattctccgtctttccatcattgagacactcgtcgttggacaaccttaa

SEQ ID NO: 2496 - DNA, 371 bp, Mus musculus
  misc_feature (263)..(264): n is a, c, g, or t
  misc_feature (330)..(331): n is a, c, g, or t
aacgttgccaattttgtatatatctttgattcatgaattatcatctatattttttaatcactgaaggcacaataatctctgtcatctctactaggatgtggtttctttaaaattagcaattattgaatgcctgaagtatatcgggcccacatatggctcctgacttcatatttagctcaatgattttcttatttatttattttatatcccaattctacttcttggaagctttatttctggaaaatagtcggggcactttgganncctgaaagagcagtcactgttaaagcttaattgtatgggatgtggaaatgctgcaataaatctgtnngggttgtatctaggttagaagtatacggttgtctttaata

SEQ ID NO: 2497 - DNA, 233 bp, Mus musculus
tctggaggaaaacaacttgctgacagcctcaggctgctggatttccactgcctctctataggaaattttggttaaaaaaaaaagaaaaaagaaagaaaaagaaaaagacctcatcctagctgcgttggaagccagtattctcctagcagccttcagatgaagatgtagaactctcagctcctcctgcaccatgcctgcctggatgctgtcatgccctcaccttggtgataatg

SEQ ID NO: 2498 - DNA, 253 bp, Mus musculus
gaatccagaccttcaaatatgctagctcttaatagattttttttttcttttttaagttctggctatcctggaactcactatgtagaccaagctggcctcaaaatatttaagatgaaccttacctttgcctccagagtactgggattaaaggcatgttccattactgctggctcctgacaaaatttttatagtttttctcttacttcagtatgtatagttttcaatatatccacacctatagataatttcattt

SEQ ID NO: 2499 - DNA, 179 bp, Mus musculus
tttggaaatgagacgtgctggagatcaaagccaaaccctttcgaatgctatgcaagaggcctgtcaaagctatgctcctagcgcttatgtttgagtatttgattataaattgcttctaaaacattgccgtcaaattacattcattagaacagtaaaaatgtcactttatttccaaatat

SEQ ID NO: 2500 - DNA, 116 bp, Mus musculus
tataagtaaaggatgtactgccccaatccacagggtctggggaagtggctatgttcttccctgggtaggcacatgtgggcacataagcacagcccctactggagaacagttgactg

SEQ ID NO: 2501 - DNA, 89 bp, Mus musculus
atcacatttaaagtgtcttgtctccacggcctcccgtgcagcggtcctcaccgaaagatcccttagatcgtcgctgaataaatgaactc

SEQ ID NO: 2502 - DNA, 69 bp, Mus musculus
  misc_feature (26)..(26): n is a, c, g, or t
  misc_feature (31)..(31): n is a, c, g, or t
ggaacacctgtatttgcaggacgganggcanatgtccacagccttgggcattcttgtatctcctgtgta

SEQ ID NO: 2503 - DNA, 276 bp, Mus musculus
gaccttggattcttatgtgtcgttcctgactacaaatgagtttaggccagcctgggctacgtgaaagtcatggtttttctttgtagatgataaccttcaactagcaccctagcccaagccatcctacgtcagcaccccaagtggctgggggtacaggtggttgtttatccccttttcctaagaaaggaagacagggcctcatatctgataaacctctgtaccaaagtatatccccagctacaccctcagccctcctgggttgtttccaaacaacag

SEQ ID NO: 2504 - DNA, 286 bp, Mus musculus
tttggctttcacagtgaacccttgatcctatacatccattaattccaaagacaattattcgagtgattaaagtttcatagcatcgtgtatgtgcaattgaagtagctcagggatacttcttcatagctttttagcccagtgctgaagtggtaccagagcttatggctccgtgaaggcaaacatcttttagcaccctgtgtttgcacatgctgttccttggctttggaatatccttactaactgcaaaattcacttcatagtaatactgatttttctgtacctcgaa

SEQ ID NO: 2505 - DNA, 463 bp, Mus musculus
taagttgtacttactcctaattgaaaagttctgcatacacatccttggtcctttctgcagtactagggattgcttccagcaaggttggcaagcaccactctttcatgaactctatggcaggcagctctgcgccctgctggtgttccttttctttctatcatcctgtctcagtccctcaagcagttgggatcacacacacttgagccaagcatggtgttagactttatgacacatggttgaaaaagataagccaaggtgctgaggcaaaaggaaggcagagaaatggaaaactggaactaatcagatatatttgcatatgggatgatctgggtggtggaccagggtgtcatacaggagtacgaagatttttatcataaggaatctgaatgagaaaaggataaataattattaacctgtattttgaagtggaaacatacagactgcacaaggtaatttgatcact

SEQ ID NO: 2506 - DNA, 507 bp, Mus musculus
  misc_feature (241)..(241): n is a, c, g, or t
agtactccatccaggatctgaccagatttaaaaaacaaaacaaaacacacaacaagcacttgtctgaccagcagcagcactgtaggaagcagtaactgattgtcacattgtgggtcactgtcacagttcaagtgtacaatggaagtaagacaggattatctttgaactctgtagtcacagtgaaggcaaggcaggcaatgatcagcagatgcgtggttatggcttgactcttcgcgtactngagggctcttgtgaaacaacgggcaaaccagatggaagaaaaaagctagcaaggtcctaagagccctgcactaacctaacacgggatgaaaagtccatattgctcttggcagaacaggaaatcatttctggcaaaatctgtgcaccaccagggctttaatcagactggcaacatacaaaagtgtgcgtgacccactgatgaatgtaacttccgagggtccccgcctgtcagttacttttttaaggttcttagagactcgcagcaca

SEQ ID NO: 2507 - DNA, 202 bp, Mus musculus
ttggcttgtagcctgactatagcaagcactggctgagtcaaagaaggcacagtccttgcatcctactgaggtactgaggtagtgagtattcagttacaccgggctgaagaaaactctacaaaatggctacacacacagcagaggaggtttaatagtgtcagcaactacatcttaacagtatccacttgttactggagtgctt

SEQ ID NO: 2508 - DNA, 243 bp, Mus musculus
  misc_feature (39)..(39): n is a, c, g, or t
  misc_feature (47)..(47): n is a, c, g, or t
  misc_feature (59)..(59): n is a, c, g, or t
  misc_feature (87)..(87): n is a, c, g, or t
  misc_feature (94)..(94): n is a, c, g, or t
  misc_feature (102)..(102): n is a, c, g, or t
  misc_feature (109)..(109): n is a, c, g, or t
  misc_feature (179)..(180): n is a, c, g, or t
tgtgagaatgtttgcagcagacatttctaaacagtagcntgctgttnacatgggcctgnccggggatggagggaggggaaggtggantgggagnttcattcnagctttntgcacagcgaggcattttcaggcagtgtgtgtgacaactggaataaagcaggacactgaccgttcacttnngcgtgaagcagacctagtgctcctcaccagcttcaggtagacacatttgtttccccactgctc

SEQ ID NO: 2509 - DNA, 464 bp, Mus musculus
  misc_feature (72)..(72): n is a, c, g, or t
atttcattttctgggacactcggtgggtgggaaagctggtgtcctcaccatggagctgggaaaacagaggcntgaaaatgacaagtgactatggtctctgtgtggcatagctacctcactgctgcacccattgcctcctggactctaggtttgcagaagcccctctgaatgcccacctcattatccacctcattgtgcctctgagacatccttagggctggggtacccagctctcgaagacaccatgccatgacttctaggttttgagaaccgttacttaaaggctgacatgccaaggccccttgtgtgcttctgtgacaaacttatgaaaagggagtacttatgtgtgggagtgaggaattctgtctcttgcccaccaagattcatctgtgatgaacgatagcccaatgttctttgtggttcctcccgctgagagctcggtccatttgcaacccttgaatcta

SEQ ID NO: 2510 - DNA, 508 bp, Mus musculus
  misc_feature (425)..(425): n is a, c, g, or t
tgtcctggtacacggtctgttgagttgaccaggctggccttgaacagatctacctgcctctgcctcctgagtgctgggattaagggtgtgtgctaaaagtcactatatagcctaggctggccatgctgatgatctgccttggcttcctaagagctgggattttagacatgtgtcaccatgtccgtcctgtatgtatcacttttgttacagaaagaaaatgcaggcaggtaaaaacaagacctgggggctggtaggatcgctcagcgggtaagagcactgactgctcttccaaagatcctgagttcaaattccagcaaccacatggtgggctcacaaccactcctaatgagatccggacgccctcttctggtgagtctgaagacagctacactgtatttattataataataaataaatttatttantttaaatgtatttatttataataataaataaatctttggggccggagtaagcagaggtactaaagttagtttccaaccagatg

SEQ ID NO: 2511 - DNA, 406 bp, Mus musculus
gtttaatccatatttgtcctctccacccaccagttttggcttttctccccaaggctgatgatataggcccatgaactggattggacttagcaactcaataggatcagggttgggctctacattaaaagcaactttgaccctggctagtccggactatcatccctaaccatgatataagcagaccaggctcctgtctggacatttctaaaggtgaacagttggggggggggtgtttcctctattcacctgtgtttaaaggaaggagagcagaggaggtgaccctacctcttaatttccaactgtaactatgttaacctactcgcatccccggggcttccctaagggaatgtgtctgtctcactgtcgtgtctcagtgtgttcactgcatgctggtgtgtgtctaatc

SEQ ID NO: 2512 - DNA, 441 bp, Mus musculus
tttggctaagggaaatgatggatctgggttcaggcaagggcatttggaggtgagcagccagaaggcatgtagtaacccacagtactcctgctatcttgacggcaggaacaccaagacagaaactagctgagattcatcttctaaggtctatcgcatccgaaatgtggggctgtgagcctgtgttagcccgagtgtggggagtgtggggagtgtggggctgtgagtatgtaatcttacttaggaagtacagaatcaggagcttgacactgtcttaaaaccaaccaaccaaacagacagacagaaattcaagccatgtggtaaggcctcctatttagtagccgggctgttttgagcatatgacgaaccaacccacttaggaacagcgttcgtcattcacaagatggatgatgatgatggccctcacctcttagaccaataaaa

SEQ ID NO: 2513 - DNA, 406 bp, Mus musculus
  misc_feature (288)..(288): n is a, c, g, or t
gggcagttatgtgaccggcatcacccgagagtccataacccaaaatttctgcgtagatccgagctcctctctgaacagcatgctcatgttcttccagcaccagcacagcagctccctcacccatgacaaaaccatctctctctggatgaaacggccggcaggtagcttaggatctgggtttgagctcagagcccgggctctggaaaacccagcgagagataatggactaatgcaagagtctgtgcccccaggccaccatcacatctgggtcaccatggggtatgaatnctaaaggagttctcccacaggcatgtgcacctgtggtgagggctgtggacactgagtgattgggggccctgagtttgtagcgaatgctaaacctgggcctgcagccatattgattcag

SEQ ID NO: 2514 - DNA, 98 bp, Mus musculus
acactcggtgggcatttctcctggggggactaggaagaaccgatttcctagttgaccaggaattaggcctcacactcattaccgcatcagtttctcac

SEQ ID NO: 2515 - DNA, 402 bp, Mus musculus
  misc_feature (344)..(344): n is a, c, g, or t
tcttccctttgtataggagcactgcactcctataaaagatttttaaaatacaaaatgtacaagaaaacacaatcccaagtgctgtaaacataaccaagaaccaatttcttcacctaaacatccgttctataaacacaaggtttcatcttgagcccatgctctacatgttaactgggcttcttgactaggtccagcagaggtctggtgatactggctggccctgggtgttggtgggctgtacccagggcagcagcaccacgtgtgaacccaaacatttttctagtaaacagaaggctgctccttcatccttcctcaagccaagctctagtacaggtgagggaaanggtgtgtgctagcaaggccagctgctcagtgctgctcctagaaatcaacttgcatagt

SEQ ID NO: 2516 - DNA, 268 bp, Mus musculus
  misc_feature (42)..(42): n is a, c, g, or t
  misc_feature (72)..(72): n is a, c, g, or t
atacccagccggcatcgctgatttccaagagcagctcagcancggaagatcaagagcaaaggatcggagagntgaggagaaaagcccttccacaggatgcgaagaagtgggacgactggaaggacacccatcccaggggctacggcaaccgacagaaacatgggctagtcatgccagaaggccaaaggacagcgtggtgcacaccttcacaccaaggacaacttcaggagggtgcagtgagggcagccgtgtggagtcttgctttgca

SEQ ID NO: 2517 - DNA, 383 bp, Mus musculus
acaatcttgttgtggaaactgcagtgtgttacagtgtgtcccacagtacacccttttgcccacacgtcgttactttcaaacattcattgcaatgagtcattggtctgtttcaaggcctctggcttctgctacaccaatggatcctcactggggctctttttggatatcctgctgttgccctgtgtcagggacatcctgcagctttgtatctgagggactagtgcttcattcgagtgctccagtgggtcatagatggggtagagttggggcccggcaactcaaagccctggatctgggacttagctgagttggtcagcccactagctctcctgcacctgcaccaccagggtgagctctccagcaatggctcagctaggtcagct

SEQ ID NO: 2518 - DNA, 96 bp, Mus musculus
  misc_feature (62)..(62): n is a, c, g, or t
gattttaattgaacctaagcagccattagtggcctgctagtcttaaactttctagaagtttnctttttgttacagccaacaaactttcagaggttt

SEQ ID NO: 2519 - DNA, 417 bp, Mus musculus
gctacactagcaagaagatccatcaagcatttacatagtaaattttcatcattttacaaagattcttgatcttcatttaaaatgcacataagggaaaacaagccccctcaggttacgaaacctgggaagcagagagtggagaaagaaatgctaagggccattcatgaatcccatgtccacctgacatgtcgggggggcaggtgtggaggtgcacacctggtgaagcccagcacttgggaggtggggtcaagagggtcagaagtttctgcctagcctcggctacatagtttgaagccaggctgggaaaaaactgtcaaatgaccctccctgcgatttagagtatactaccacctttaagataaactagaatctcaaaagctgtagtactggaatacctttgaataccttagacagctg

SEQ ID NO: 2520 - DNA, 423 bp, Mus musculus
gggaatggaagatcctggcctctaagtcatagaccaaagtctgctgtagaacaaaaaaaaaaatactggagggcagagatagcaaaccaagtctccaaacaatgctgtcagtattagcatgcggtgccgtgggcatggaaaccttgccttacttcctggtcctaaaagggagctgtgcagatgtggatcaacatttgttgaaaataaagtattaatactttaaaagtcaaataaaatatagtgtttacattctttaggtcctgggaggagttgggggggggggactctgataatacagatagtaaaagcagtaatttctttaatgttatttttctggttagtaattatttttaacagtacttaattactgtatgtcgtgagacactaaaatcaaaaatgggactctcattttgtctttatttg

SEQ ID NO: 2521 - DNA, 424 bp, Mus musculus
aagggatgcagctaacctacctgccaccctctcctgtcctggcagaatccaccacccccattactgacatcagggccttcacagcaacactcagcctcttcccctaccataaaatagtcaaataaactgcagtctcattggcctgaagcaacgtgtatttaaagacgtgtgtgcattttatggagttacactgctgccttagggcttccattggattttttcgatggcaacctaggatttgatttactttttacctttcctctacaagattagctcaggatggcaatgagatagtaggcaagtgtgacccaaacacttacgtcagcaatgtgggggcccctggcctgtgtcctctgaggagaacccagctcttgtgtgcctatctgtaattaatttgatatagcaccaaactgccctggttttg

SEQ ID NO: 2522 - DNA, 98 bp, Mus musculus
aaggctggcctactgcttgagcccaagtgttgagactacaggtagaaggcacctgccctgttctgatgggattctctgcagctatgttgcttcaggca

SEQ ID NO: 2523 - DNA, 110 bp, Mus musculus
aaggctggcctactgcttgagcccaagtgttgagactacaggtagaaggcacctgccctgttctgatgggattctctgcagctatgttgcttcaggcaggctgtggtcct

SEQ ID NO: 2524 - DNA, 161 bp, Mus musculus
tttctctgtctcgactactccataaacttccctccccatgccctaaataaactctgattcctcagggagaagggatgcctcagcatgggcttgcagaggcacccccttcccccatgccataccttgcctccaccaaacatatctcaggcttctttttcttt

SEQ ID NO: 2525 - DNA, 284 bp, Mus musculus
gacagacatccgcagagacgacagacatgcacagtgaggaggaacaggcgtagtgaggacagaagcaaaacctgaagttgcattgccacaagctgtaggaagaccacacgggagaagcccagccggcctccagcggtcagaagggagcaggctcgcagcactgggcctgacaggtgagctgagaaccgtcacactcttctgatcagtgtgatgggttcttgtggcagctgtaggaagtccacagacctacatgtcgccattcccttcagctgcttttaaaggtt

SEQ ID NO: 2526 - DNA, 289 bp, Mus musculus
gtcatttcaaaaacctcagccttagttccctgggacagcatgccagaggtacaaattgtaacttctctacaaccccccagcaagcatccaagtccacagcttcagaaagccagttctcttcagtctactcctctgcttcctggtttttctttcaagagaggaaactcaaaagtaggtagctaggtgtggtggtgcacaccttaactctagcactgaggaggctctctgtgagggctagcctggttgacatagtttgaagccagctggaattagcgagaccctgtttcaa

SEQ ID NO: 2527 - DNA, 267 bp, Mus musculus
aggcaggctggaacctgtaatcctcctgttttcaccttctaggtactcaattgtaggcatatactgcatctggctgatttttcccccatttgttattattacattgggggggaagggtgagcgcagaggaagatgagttagtgcatgtgccagacttggactctggacttacaggctgtcgtgagcagcctgacagggtgctgggaaccaaacttgggtcttctgcaagaacagaacattacttgctctcattagctgagccatcat

SEQ ID NO: 2528 - DNA, 243 bp, Mus musculus
gggttcacctagtgtgttagtgacttttcttactgttgtgatcaagcacccgattaaagatgacgggtttagtttggctcacagttggaaggaatagtttcctgtggggaagtcatggaggcaggagcacgaggcagctgtcacatggcatctgtagtgagaaatccaggtgcagtgagtgctggtactcagctcactttctcctttgcattcggtccaagacctcagctcatgggtgatgct

SEQ ID NO: 2529 - DNA, 231 bp, Mus musculus
aaaggccacagttcacttcaggtaaacaagctttaatggtctcaagcataggaatgctggggataagctgtaaaaagaaggtgaaaccggaacggagaaggaagctgcctctcagcagcctcggggaactgggcggaaggagcaaaatccttaacaggtggtctggtgcacctgttcccgggatgatatgactttgacatcctaaacttcttccagaagggtgagcacctg

SEQ ID NO: 2530 - DNA, 137 bp, Mus musculus
ccttgagattgctcactcagtgaccacctcctgggaccaacataaataccttacttttcccttgaagaccctgcttcttgagatttttttttgccccccctgctccccagaggcgcgagaccctgagattccagatt

SEQ ID NO: 2531 - DNA, 165 bp, Mus musculus
taagctggaaaactccaaagggcaaaaaaatctggaatctcagggtctcgcgcctctggggagcagggggggcaaaaaaaaatctcaagaagcagggtcttcaagggaaaagtaaggtatttatgttggtcccaggaggtggtcactgagtgagcaatctcaagg

SEQ ID NO: 2532 - DNA, 186 bp, Mus musculus
tgctactcgcttcccatcacagaaaggcctgccaggcattctatatttcctgcaatgtgaatctatccaaaccagaaaaatagcataccgaaatcaggttatagcttcaatagctgaagaaacatggaaatttccatttttaaacattaaattttctattattgttctatgagtaagtttttacca

SEQ ID NO: 2533 - DNA, 131 bp, Mus musculus
gggacaataatcttgtttacttcctcccctggacccaatttggatccctagaggacacatccagacctagagctattttcctcttcataagcttgtcatttggaaggtgggtagtgatggacacccaggaa

SEQ ID NO: 2534 - DNA, 136 bp, Mus musculus
gacaaatcaaaatcacctcttaatctccctctacagtgctccacaggaatcttgccccttcaagtgaatcaagtgagtcacctgctggtagtagacatgcttgacgagaaacaaaaacagggtagtcaggccgtag

SEQ ID NO: 2535 - DNA, 112 bp, Mus musculus
tgggaggcacaggaaacctggcatttttggggccctcacacctgcacctccatcttctgggcccaggcaaagaaaatgcctttgacatcatctacccccgtgcagaggtggg

SEQ ID NO: 2536 - DNA, 67 bp, Mus musculus
ttaatgggatcgtccagcccttctctgtgtggcttaaacctaggttccttgcttatacattttcact

SEQ ID NO: 2537 - DNA, 89 bp, Mus musculus
gatgtatggacacacggatgagtaacctgttggtttgataaacttttggagtcagattgttcagggtccaatcccgagcctgttacctt

SEQ ID NO: 2538 - DNA, 86 bp, Mus musculus
taacaggctcgggattggaccctgaacaatctgactccaaaagtttatcaaaccaacaggttactcatccgtgtgtccatacatct

SEQ ID NO: 2539 - DNA, 70 bp, Mus musculus
cattgtgatggagagaactgatttccagaagttatcctctgatatcagataccagtgtagtgcatatggt

SEQ ID NO: 2540 - DNA, 58 bp, Mus musculus
atatgtaccatatgcactacactggtatctgatatcagaggataacttctggaaatca

SEQ ID NO: 2541 - DNA, 194 bp, Mus musculus
aaggctagcccctgaggtctcagtgcttggcctggcacggctctgtcaggacttctctcactaggttaatccataggattgctattctaagacctagtgtctacagtgattaaatgtcactccagaggaaacctttccacaaaggaagctttcatgaccccatttaccgaacataatccctgtcctttataaat

SEQ ID NO: 2542 - DNA, 346 bp, Mus musculus
  misc_feature (145)..(145): n is a, c, g, or t
  misc_feature (183)..(183): n is a, c, g, or t
  misc_feature (196)..(196): n is a, c, g, or t
  misc_feature (206)..(206): n is a, c, g, or t
  misc_feature (211)..(211): n is a, c, g, or t
  misc_feature (218)..(218): n is a, c, g, or t
  misc_feature (220)..(221): n is a, c, g, or t
  misc_feature (237)..(237): n is a, c, g, or t
  misc_feature (260)..(260): n is a, c, g, or t
  misc_feature (268)..(268): n is a, c, g, or t
  misc_feature (298)..(298): n is a, c, g, or t
  misc_feature (301)..(301): n is a, c, g, or t
  misc_feature (313)..(313): n is a, c, g, or t
cctatgattgcagctggcttatttaacaccatggttcagacccatcttctcctgatgatgaagaagacttccccagagtatgaagagagcatgcgcagatatcgggaggcagctaagctcttccagggacagattctctttgttntggtggacagcggcaaaagggaaaatggaaaggtgatntcctatttcaaantaaaagagtntcagntgccagntnntggccatttatgagtntgtggatgacaagtgggacacantgcccatngcagaggttacggtggagaaggtccgaggnttntgcgagggattnttaaaggggctgctgcagagagatcacgaagct

SEQ ID NO: 2543 - DNA, 550 bp, Mus musculus
  misc_feature (179)..(179): n is a, c, g, or t
  misc_feature (338)..(339): n is a, c, g, or t
  misc_feature (375)..(375): n is a, c, g, or t
  misc_feature (380)..(380): n is a, c, g, or t
  misc_feature (418)..(418): n is a, c, g, or t
  misc_feature (517)..(517): n is a, c, g, or t
  misc_feature (524)..(524): n is a, c, g, or t
tggagcaactctggctaatctggagagggaagacaaagtttagatctggttgagatttggttacatttctaaaagagaacctccaaaagcttccagatttgcaggcgtaagataaagacagccctgacatttgccgggaggtacggtgatcgctgcttctcagcagttcattttttttncccccaggcactgctggcttcctttgactattatagttgccagaaaaatccttgctttttttactttacaaccagcatttgagtggcaagttggatataatgggatgagaccaaatctctccattcctcctgggagcaatgatgggacacaatttccanntcccacaagttctgaatcttgtagcgtgtagcactntcagncctgttcttgtcggggtgggcagtagtgacggtatttncaaagagataataaaaaagaactgggcagacttccgttaactttaattatgaaattgaaataaggcatgccactttaatattggaggctggtctgtttnccaaagncccttctctttgtgtactcactggaa

SEQ ID NO: 2544 - DNA, 551 bp, Mus musculus
  misc_feature (68)..(68): n is a, c, g, or t
  misc_feature (298)..(298): n is a, c, g, or t
  misc_feature (305)..(305): n is a, c, g, or t
  misc_feature (315)..(315): n is a, c, g, or t
  misc_feature (330)..(330): n is a, c, g, or t
  misc_feature (342)..(342): n is a, c, g, or t
  misc_feature (354)..(354): n is a, c, g, or t
  misc_feature (362)..(362): n is a, c, g, or t
  misc_feature (418)..(418): n is a, c, g, or t
  misc_feature (472)..(472): n is a, c, g, or t
  misc_feature (474)..(474): n is a, c, g, or t
tacctctttctcctctgtgacgtgtccctcttttttttatttataaatgtctaatttggttttttttntttaaggacaaaccagtgtgtcgtagacctctatgtaacctgctccttagtctcattataggtatgttataaggatggatattttacttggctttagaatgtttttcaagaaaactaattcttaactgatgaagttgttgctactaaaatgcttgttttcatcatgacgtcgtgcgcttctaaattaatcatcattttcgttgtagaaaaatggagtgaatttatattantcttggnaactaataanagcattgtaaatttntgagatgatttnaacagaaaaatnatagaagnatatagttattttaattgtaatattactaactgtagggtgaggcggggtcctgttngtggtgaactgttatagcttgttactcagtttctttttgatcattttctcggtntntgaggtgaagcgagttattaattgaatctgtaaactcacatatgcatattgtatatgtgtagcgatgtgatcacact

SEQ ID NO: 2545 - DNA, 559 bp, Mus musculus
  misc_feature (135)..(135): n is a, c, g, or t
  misc_feature (303)..(304): n is a, c, g, or t
  misc_feature (326)..(326): n is a, c, g, or t
  misc_feature (343)..(343): n is a, c, g, or t
  misc_feature (352)..(352): n is a, c, g, or t
  misc_feature (387)..(387): n is a, c, g, or t
  misc_feature (390)..(390): n is a, c, g, or t
  misc_feature (412)..(412): n is a, c, g, or t
  misc_feature (442)..(442): n is a, c, g, or t
  misc_feature (445)..(445): n is a, c, g, or t
  misc_feature (452)..(452): n is a, c, g, or t
  misc_feature (464)..(464): n is a, c, g, or t
  misc_feature (476)..(476): n is a, c, g, or t
  misc_feature (503)..(503): n is a, c, g, or t
  misc_feature (509)..(509): n is a, c, g, or t
  misc_feature (513)..(513): n is a, c, g, or t
  misc_feature (531)..(531): n is a, c, g, or t
aaaactctttctcacactgaaggaaaacaagaggcttcggaagcggctgaaagcccagaggctgctgttgcggaggacatgtggccgcctgagagcctacagagagggacagccgggacctcgggccagacggcnggcacagggaagctgagcctgagcaagctctgggatgtgggggtggtggcaacaccttagcaggaagtggtgttctggcctgctatgggcgtttctacccgctgctgatgctgcaggtgccttgagagtgggatgggatgctgcgacaggcagttgtcgggtgggggnncccaagtactgcggaggcaccntcccaggtttcttgggnctgaggctntcagctgtggggaagcagcagtgaccaaatgtganccntcacaaccccctcaagagatgntcccagagggagagctggtcattcttacanccnggtgggngtccttactgtntccccatagganccattctgatggcaggcagggcaaggntccccntcancctgtatttctgagtgantctttttctgcctggttcgtgtagatgt

SEQ ID NO: 2546 - DNA, 361 bp, Mus musculus
ttccttaggacaggtgtgaccttctggtccctctgtcccattgccctctcgtattccatttaaaaaagtcattcatgatcctttccacccgctctctgtattttcaatgtttttctctcagcgccttgccttaacaatccccagacagtgttctctcaagcagtgttccagacttgttgggtgtgaagataaatgcatgtaagagcagccctttggaggctgaggcaggagaatctcaagttcagggccagcctgggccacatactgataccctgtctctcaaagggagaaaaattacttaggtatgtcagcacttttgtcctgtaactgtagatctgtctcaattgaagttaactcacta

SEQ ID NO: 2547 - DNA, 463 bp, Mus musculus
  misc_feature (228)..(228): n is a, c, g, or t
  misc_feature (302)..(302): n is a, c, g, or t
  misc_feature (321)..(321): n is a, c, g, or t
  misc_feature (323)..(323): n is a, c, g, or t
  misc_feature (326)..(327): n is a, c, g, or t
  misc_feature (329)..(329): n is a, c, g, or t
  misc_feature (336)..(336): n is a, c, g, or t
  misc_feature (342)..(342): n is a, c, g, or t
  misc_feature (350)..(350): n is a, c, g, or t
  misc_feature (362)..(362): n is a, c, g, or t
  misc_feature (372)..(372): n is a, c, g, or t
  misc_feature (375)..(375): n is a, c, g, or t
  misc_feature (404)..(404): n is a, c, g, or t
  misc_feature (419)..(419): n is a, c, g, or t
  misc_feature (421)..(421): n is a, c, g, or t
gatcatgtcccatttgtgttactaagaagtcaatggagtggctgctggttcatcgcctctaatggtggccctccagatctaatgccgtgccacactgttccaccaatagaaagaatccttcagctctacaccattgaccacctagaacccattccagacacatgatactgataaaagtggtcattactgtcacactgccgcctttctgcttgcaggaagtccaggccntctgtgagaagtccctcctgtcacatgagtattggtaggggtggggataagtttgtgcccttggctggtcaggncatgatgggaaggaacttntnttnntngggaccnatcttnatccactntcccccactcancctctttaancantgctattcataatatgctacagaggtgtnccttctcattaattntnccctgggagcattaagttaaagcgcttttgttacctcccaag

SEQ ID NO: 2548 - DNA, 393 bp, Mus musculus
  misc_feature (269)..(269): n is a, c, g, or t
  misc_feature (284)..(284): n is a, c, g, or t
  misc_feature (327)..(327): n is a, c, g, or t
  misc_feature (348)..(348): n is a, c, g, or t
tacgtgggaccccagaccatcacgaccgcccctagtctgcccggcctctttggaaattctaccctgtctccacaccccaccaaggggggctacgctgtctctgattatctcacctacaactgcctcacgagtgacactgacctgtacagtgactgtctgcgttccttctggacctgcccacactgtggcctgcacatgcccttcacacccttggagcgcattgctcatgagaacacctgccctgaggcgccaggcgatgatccagggtntgaggaggctgctcntgcaccaccacagaagacatcagccctgcagaggccctaccantgccaggtgtgcgggcagganttccactttaccccaactgaggtactaagacatcgaaggcagcat

SEQ ID NO: 2549 - DNA, 306 bp, Mus musculus
tgaggtgtggctgactttatagatcacgtgacaggtgcctctgctttggaaggacagacaccaggttaagaatatcactgctttctattcaaatggatttcctgagtttccaaatctttcctttcaaatgtattgtggagatagtcaacttcaaggccaattttgaacccttggtactgactctggctgctatgaattctgttttactttgactataaatgatcagaataactccagagcactgtggtgtttctgactggttgaaattgatgattgacattaataatgatttcctgccacctgaac

SEQ ID NO: 2550 - DNA, 566 bp, Mus musculus
caatagccttcccatgtcttatataatggagtttatagaaagagatggacataattgacccaggaaaaaaatttgggggtgatttgttgtggttgctacaaatttgatgactagaaggatcattccttgtaaattgagtgattcttaatttcttatctgctattcatgtacttgtctctgccaaatgaatttacgctgtgattcttaggaaactagtgtgaagacttgtcaagttgaactgggcaacactcctactgtgttatctctagctgctggtgcctcccgtggccagtgttttgtgtgttttctccttgtttaagagcaacattcttgtatggagaaaggcttgctctggctaaaatctgtgaaaagcagattttctcatttaaaatagtgttacttttgtggaaattttaaatttagcttttatctgaagtgccttaagtagattcttaatttacttttctagtactggtttgaatataattcattatgtatttttaatatactgttcaaaaatgatacatactatagcaaagataaccaaatgtctggcttactgcttt

SEQ ID NO: 2551 - DNA, 392 bp, Mus musculus
gagcttgtcactaggcagaggaattctgtttgaaggaactagctattaagttaggtggcctttgcctagccccttatcccttttgaataaagcaacatgcatcttttgttgttaaatgcttcttttttgaagcattttctcgactctatgaatcccctatttagtctgccttaaagtgaaacaacgaccagtgaaccgaagcatgacattttaccagctgtgcagtggttagctaagtgtgtcttgagatgttagcatcatcatgcacttaaacttgacactagggctattttacaaaccttaacaaacaaaacagatgccaccttgtacattatcctgttactgagctaaaaatccaaatagcaatcatgggcatgctttagaactgtggt

SEQ ID NO: 2552 - DNA, 482 bp, Mus musculus
  misc_feature (334)..(334): n is a, c, g, or t
  misc_feature (344)..(344): n is a, c, g, or t
  misc_feature (348)..(348): n is a, c, g, or t
  misc_feature (350)..(350): n is a, c, g, or t
  misc_feature (366)..(366): n is a, c, g, or t
  misc_feature (370)..(370): n is a, c, g, or t
  misc_feature (373)..(373): n is a, c, g, or t
  misc_feature (375)..(375): n is a, c, g, or t
  misc_feature (378)..(378): n is a, c, g, or t
  misc_feature (389)..(389): n is a, c, g, or t
  misc_feature (399)..(399): n is a, c, g, or t
  misc_feature (401)..(401): n is a, c, g, or t
  misc_feature (414)..(414): n is a, c, g, or t
  misc_feature (417)..(417): n is a, c, g, or t
gagctgcagtgatccgcttgtgcttctctagggttgctgagctttctctaccaaaaaggcctcacctagtgtagataagaataaaccgccagccacgtggtggtgggacgcacctttatctcagcactcgggaggctgaggcaagcagatctttgtgagttcctggacagcaagggctgcacagagaaacactgtctcaaacaacaaaacaaaacaaaacaaaacaaaacaaaacaaaacaaaacaaaacaaaaatgagaaggaggaggaggaagaaggaaagaaaagctgcagtagcagcccctgctgcctaccctaagtatcctgggggtgncggttattangatngncatgagcgcttgatcntccnttntnttntgagcacattntaagcaagtntntttgggcagattntcntacaattgctatgcacaggtttcctttgtgagcagtgtagggagtaccaaaggacccaggccagt

SEQ ID NO: 2553 - DNA, 533 bp, Mus musculus
  misc_feature (175)..(175): n is a, c, g, or t
  misc_feature (247)..(247): n is a, c, g, or t
  misc_feature (381)..(381): n is a, c, g, or t
  misc_feature (504)..(504): n is a, c, g, or t
  misc_feature (508)..(508): n is a, c, g, or t
actggaccgacgagccacttagttttaaactgccaataaatcttggcaagcagactgtgaaacttacgattgatttttgtcaacggcttctgatgtgctccgagaagagagaggaaccagggggaacggagaagaccagcagacagcctcagtgccgggccagaggggctgtggncaagaatgttgcgaagtttaggggcgccattcctgtgctgagatgtcagcgtgagcctacgagtcccaggtntgcgctgcctcttgccatcagccagtgcctctggccaccgtcttgccgtgggccatcgtggtctttcttgtttactaataggcatgattgtttgtggtaaagcagggattccctttacaagagcagctacccancttaacaatccagtttcctgaagaaacccacccaccccgagaaggagaggaagggacgtggcagggtttgtcaattcatagactgtttccaaaaagaatttttaaacttttccactaggcatntgtntcctgtgcaaaatgcattgcctgtt

SEQ ID NO: 2554 - DNA, 300 bp, Mus musculus
  misc_feature (135)..(142): n is a, c, g, or t
  misc_feature (146)..(146): n is a, c, g, or t
  misc_feature (160)..(160): n is a, c, g, or t
  misc_feature (173)..(173): n is a, c, g, or t
  misc_feature (179)..(179): n is a, c, g, or t
  misc_feature (181)..(182): n is a, c, g, or t
  misc_feature (184)..(185): n is a, c, g, or t
  misc_feature (187)..(188): n is a, c, g, or t
  misc_feature (191)..(191): n is a, c, g, or t
  misc_feature (197)..(198): n is a, c, g, or t
  misc_feature (200)..(201): n is a, c, g, or t
  misc_feature (206)..(206): n is a, c, g, or t
  misc_feature (209)..(209): n is a, c, g, or t
  misc_feature (214)..(214): n is a, c, g, or t
  misc_feature (217)..(217): n is a, c, g, or t
  misc_feature (224)..(224): n is a, c, g, or t
  misc_feature (231)..(231): n is a, c, g, or t
  misc_feature (235)..(235): n is a, c, g, or t
  misc_feature (237)..(238): n is a, c, g, or t
  misc_feature (252)..(252): n is a, c, g, or t
  misc_feature (258)..(258): n is a, c, g, or t
  misc_feature (261)..(261): n is a, c, g, or t
  misc_feature (263)..(263): n is a, c, g, or t
aggacagacgacctcaagacatcgcagctgagcccactgcggatggttcaccaacgcaacatgataccctcctgcggaccgcaggtagcacaagatgctcctaaataccggctcaagaactatgaccagttccgnnnnnnnntggnaaatccctaccggnagcccaagagcantgaagngnntnngnnccngaaccnngnntcagnatngaagnccntctgctntcagggncaantnngatacagtggaggnctaggnctntncactttcacagggctgggtaggctgaaataatggcta

SEQ ID NO: 2555 - DNA, 213 bp, Mus musculus
gtgtttatctgtctccgcactcttccaatataggcagcattcctagatgtcctggcacttgtgtctttgagatcccattgtggttctctcgacaggagaaacgaatgcttacttctgtgtgattaggccaacgtttgggaagccgggcacctgccatcccacagataacctgctggacgtccacactctgttcttctcgcagttgtcctgttt

SEQ ID NO: 2556 - DNA, 480 bp, Mus musculus
  misc_feature (204)..(205): n is a, c, g, or t
  misc_feature (412)..(412): n is a, c, g, or t
aatcaagcactatctcctgagtcaggagataccccctgactgggaccaggggccagtcaagactctcgtgagcaagaattttgagcaggttgcctttgatgaaaccaagaatgtgtttgtcaagttctatgccccatggtgcagccactgcaaggagatggctccagcctgggaggcattggcagagaagtacaaggatcgtgnnggacattgtcattgccgagttggatgctacagctaatgagctggaggccttctctgtgctcggctatcccactctcaagttctttcctgcagggcctgaccgaaaggttatagactacaaaagcactagggacctagagacattctccaagttcctggacagcggaggtcacctgcctaaggaggaacccaaggagcctgcagcctntgccccagaagcacaagccaattccaccttgggtcccaaggaggagctgtagccattgggacactgta

SEQ ID NO: 2557 - DNA, 539 bp, Mus musculus
  misc_feature (78)..(78): n is a, c, g, or t
  misc_feature (382)..(382): n is a, c, g, or t
  misc_feature (401)..(401): n is a, c, g, or t
  misc_feature (404)..(404): n is a, c, g, or t
  misc_feature (425)..(425): n is a, c, g, or t
  misc_feature (457)..(457): n is a, c, g, or t
  misc_feature (459)..(459): n is a, c, g, or t
  misc_feature (474)..(474): n is a, c, g, or t
aggatttgtgttggccttgcacagtgagctctggcaggcacaagtaactaaagctttggtttactttagtttttgagntgaggtctccctgtgttgcccttgccagctcagccttctgagtagctgttgctgcagatgaaccaccataccaagcacagttgttagaataagagcaagaccagtgcagagtccacactgtggtatacatctggaattgcagcattttgggcaggaggattattagtttgaggccagcctatgctacacagtgaaaccctgtcttagaataataaacatgccatggtgcctcacacatgtgaaccccaacacttggtaggttgaagtggttagaggttaacatgggttacgtagtggtgaattntaggcaagactgacctagnccnaaaccctatccaaagagcaantccttcccccatggcttcccgatattgtaccntnttccatgacaccttnttcaaggtgtcaccagagatgagcatgaagaagaaggtgatattttcctgaacctccagaattat

SEQ ID NO: 2558 - DNA, 290 bp, Mus musculus
gttatgctattgcttatctgttggagaacatcccaggttagcttccactctgtgcctacaatgttgagtttaaagatttggaataagaggaatcagtagaaaaattccttctattcttggaacaatagacgtataaagtattaatacaaatatcactgtgaccttcagctgacaggtttggttaagaccagaccatcttcaggcacactgggagtggctctgatggattgagaactgtaatgtggagacatgtgagatacgttttgctcacattgtcctgtctcaaatat

SEQ ID NO: 2559 - DNA, 465 bp, Mus musculus
gattaattagtcctcatatgtccactgactaattctggccaagagtggagttataaaaggctatcccagaattgacccttgggcaaaatctcctctgaactcttgccgtgatgtgatcctatatacatggtccaagccattgtcttgtaagctaatgaattacccattagtttacatatatatatgtatatatgtacataccccaacagagaatactttctgtatctgaccagtaaatgtattatagaaaaatagcttcctttcttttttataatcaatgaatacctcattatttcccaaaaatgaatcttgtgatttcctatattcattgagtcaaattgctttaaatctaatctcagtgtatctttatccctagatgttctaacatcattattctaaaaataaattgataatcattgtaaaagagaaaacttttaaattaagcttggtctttttctatggaag

SEQ ID NO: 2560 - DNA, 406 bp, Mus musculus
  misc_feature (222)..(222): n is a, c, g, or t
  misc_feature (281)..(287): n is a, c, g, or t
ggtgaccagtgtgggcgttcaccaccaccatcaccattctccccatcgtctccaccaccacaagcaccaccaccgccaccaccatgctcatggagcccgccgctgaggccaatagatagcatctacctggctctgccctccatccagcagcaacatgagtggatcctgatgctgccacggaaaaggatgtgcctctgggatgaaggggggtactgggacccntggtcctgcttgggtttcatttgcatatgagcccttctccctatgtgcaacagagaccnnnnnnncacctgggtggccctctacacaatgtggggcttgagcttcgagcagggctggctgagtttcctaccttgtgactgcaactcctggtgaccctggaagtaacaagggtatctggcagaac

SEQ ID NO: 2561 - DNA, 489 bp, Mus musculus
  misc_feature (388)..(388): n is a, c, g, or t
gtaggagcttagactctcacatctcacacccacaagaaggagcacaattggatatgatacaaagtgcaggttctccatccttaaggtaaatttctaggctgctaggatgtgtgaaagagcctcaagcatggccctctctacagactaatgtcttatttagggtctggcttggcttcccagggctgatcagagaaatgtgacaatggactctgtccctggttattcctgatggttgacatagactgatctaccttcacccaccccaagtgagttctgcttttctgtgacctttgaaattcaacccacactaagaatggcattctttcacttcaaggccacatccaaagaaggagctcagttaagtgtccaggcctcagcagtaaatatntgcaggatgtacccagacacacactctagaagatgagcctgtgctctgtaacagggtggggttcactttctaaagttttcttcttccttgacatggtcagt

SEQ ID NO: 2562 - DNA, 490 bp, Mus musculus
  misc_feature (270)..(270): n is a, c, g, or t
  misc_feature (339)..(339): n is a, c, g, or t
tttgtttatctttcccactttgcattgggtaactactgtgtgactcctaaagtgttgtctcgaagctgagagatttgaaaagtcttggtgtctcagcatccaaccaggacccacagcttgggcaggactggggccctcaggaagtgatgcttagggcaggctgcgagctgcccacagtggaataagcatggtgatcgtgtcttggtatttttaactggccaatagagtaaataaaaagcataggcaaagtatagaggggtaggttagccntgtttgtcagagttagaggatgaagggattattcaggggcagttgctgatgttgaatccaatgccagcnaactccattcctcagtgtctttttttttccccctctataagcaatttacattgtaaatgtattttgacatagaaaccattctgtattgaaactcttgctataagatgtttttatgaaagcctgtaagtggtccttggaattattatcagat

SEQ ID NO: 2563 - DNA, 510 bp, Mus musculus
  misc_feature (26)..(26): n is a, c, g, or t
  misc_feature (251)..(251): n is a, c, g, or t
  misc_feature (312)..(312): n is a, c, g, or t
tgtctggccttttaaattcccgtgtngtggtgtcttctcatccctaccccagttatctgtcttggtcttgccgtgtgatgggatgtgcttgtaaatccagtatcaaatcagctttgtgtatatgtgtgtctctggggtggcttcttccttttgctggtcactagactgtgttgaacaaccatgtgctgtctgagcaggtcaggggctgaccgctacaggcccctcagcggttgagcctgttggggggaccnagctgctcttggacaagtggctgagctcctgtctggcctcctcttttcctcctcctcctcntcctcctcctcctcctcctcctcctcctcctcctcctcttcctcttccttctcttcttccttgtcttcctcctcctctttctttaagtaatttgtgtgtatttctaactgatcgtattgaaaaaaaaatcctagtatttcagtgacatgcctgttgtgagatgaacctcctgtgacttctgtctgttctgtattgagg

SEQ ID NO: 2564 - DNA, 405 bp, Mus musculus
aatggtgttcactgcggctgtcatccagctcataagcgtgtacgccaggagcaagtcggtggtggtcaggaggatgcgaaccagggatatcttagcagaggaagaccagcacgaatttacaagttgtgctggtgctgagaccgtcaaatttctgattcctggcaaaaaatatgtagccaatacagtttttcattctgttcttgctgggctagtgtgtggtcttggaacatggtatttgctcccaaaccgagtaaccttgctgtatggcagccctggggcgactgctgtgctctttgtgtttgggtggataacactttgcataggagaatactcactcattgtaaacaccgccacagagacagcaacattccagacccaggatacttacgaaatcactcctctcat

SEQ ID NO: 2565 - DNA, 201 bp, Mus musculus
gcgtgtttacaagtagcccgagactgtgggactgatgtccttgacctgtggaccctgatgcagaaggacagccaggacttctcatcctatttatcggatggcctgcatttatcaccaatgggaaatgagtttctgttcttaaacctctgtccactgctggacaagaaggtctcatctctgccgtggctgcttccttactgg

SEQ ID NO: 2566 - DNA, 434 bp, Mus musculus
  misc_feature (198)..(198): n is a, c, g, or t
atgtctgtgtccaacatgtcttgacaggtatctgtagaggtcagatacctgggtcatttgaaatgatagttacagatggctgtgagctgccacgtgggtgctagggatcaaacttggcttagtcactacgccatttttccagcttcatataacctttttttgtttgtaaattttacaaggggtgtgtgtgtgtgtgtntgtttgtgtgtgtgttagtagcaccatattaagtcttgttaaaacatctgatatgcactgctcaaaaatgagtacctcagagaaatgggatttaatgaagaaaccaagaagatattataaaaacatcccccaaaaggaatataaagggggagctagagaggtgtctcagtgttaagaatgggaactgctcttacagaatgccagagtgtgcttttcagctcccagcttgggtggct

SEQ ID NO: 2567 - DNA, 383 bp, Mus musculus
  misc_feature (104)..(104): n is a, c, g, or t
  misc_feature (266)..(266): n is a, c, g, or t
agctttacctgcatattccacagcagcagcaggaggaagtccagcggctcctgatgatgggtgagccagccaagggctggcaggagctggcaggccacctcggntaccaagctgaggctgtggaaaccatggcctgtgaccaaatgccagcctataccctgctaaggaactgggctgcccaagaaggcaatagagctaccctcagagtgctggaggatgctctggctgccataggccgagaagatgtggtccaggttttgagctcnccagctgagagctcctcggtggtgtgagtgccgcctcccagggctgcctgccctggcctcatgtctttcatgggcttcctagtacttctctggcttcagcttgctgttgtggcagca

SEQ ID NO: 2568 - DNA, 396 bp, Mus musculus
agaaacattcactgaagccctcctgtgaacctggccagcacctgagacagtcatgcaaggaacacagagactggaagttatgatctgagtcctcaggaatctcatgccagccagatgtacagacaggaggaacgacacatatgggagtcagtactctggtgggtggcactgatgtgacaggtgatggggaacagaagacacaggttgctactgttctttgtgaagcagtcagcgctcgctcggcactggttgatttcattggaggtgagggggcagtgagatagaaggaaaatggcctgggagaagaagccttgagttctagtcccaggttcacaattctagttgtgtaacttggtaattccttaagtcacacaagcttcacttttctcatttacc

SEQ ID NO: 2569 - DNA, 333 bp, Mus musculus
cactgcctctatccgggtattctgactcctgggaccttctgtgtcctctattcagagggacaggaggatagatgtgaggtcacctcagcacctcccctcctgtgccagactgaggaaggtccctgggttctcgtgggcatggctgttcgaggaaaccgggagctgtttgcagccattggccctgaagctacatggatatcgcaaaccgtgggagaagcccattttcttcatctcggtggctcctcctactggtctcctgaaggcagtgacctctgcccccaagacttagcagggtctgctagctcccctaaggtcactgctctgcttctgctc

SEQ ID NO: 2570 - DNA, 468 bp, Mus musculus
ttccaccatgttggctgttgactctccctgtatgttaaacccttgaccagtttactcgtttctatcctggaagatttttaacaaagggaaaaaccaacagcaataagtcattggtgagcagctaactcgctcattgatgagcagctaactctcacacacatacacacacacacacacacacacacaccccgacaccctgcttttcatacagaactagccaatgtaaagatgactcacatgtaaatacttttttccatttcacaccgttgtattataagtgtatatggcgactccttttccagaaacttttcttacctgttggttgtcttgtttcctgggttgtttttaactgaagacaaaattgctcatttgccagaggggacagaagcatcttgtggcatttcccatgtggtggcctccatggcacccactctcccagttcctatgcaggttatcccctgtggtttc

SEQ ID NO: 2571 - DNA, 366 bp, Mus musculus
  misc_feature (90)..(90): n is a, c, g, or t
  misc_feature (277)..(277): n is a, c, g, or t
acatatgttccttgggatgccaccattatgtaaagttgctgctccctccctaagtgacatttggtgaatctctaacatggaagccttccnttatgatcacgtgcatttggaactccgttcattcataaaccacacttggtggtcagctacttgtgtgaaatgccacaaagctcactcttttcagttgccatcttttcctgttattttagagtagggatcagatgctgtgtgctctttctagcagtaagtatagcctgcccactgtgatgcctcactntgtgacctctcacttgtgtgacccccagacttctctcatgtttggtatcatttttttcttcctttaaagtcctgtcttcttgtacctga

SEQ ID NO: 2572 - DNA, 535 bp, Mus musculus
  misc_feature (113)..(113): n is a, c, g, or t
  misc_feature (276)..(276): n is a, c, g, or t
  misc_feature (446)..(446): n is a, c, g, or t
atgaagctacttcccaggcaaagccacccaacgctgaagcctgaagcctggcttatgtctgcctggattaggtctggatagctcctggctcctcccaacacaaccctcacctngttccatcagtgagttgagaagggatgcattggagaagaagaacaaatagccaaaagtctgggacacgaggtcgggatgcagctcacactgactggtcagttctagagctgcctggaacacacccagagtaggcctgagcccaggcggcatggcctccagctntgcgccaggccctggcagctctgctccagctgtgaaagggttactgtccaggagagctggcagtgttgaataaagagtctgggggaggaaacaggcaacaaccagagagtgacaatcaataaagacaatggggaattccatcaagggcttctgggaaatgtagtccattntacaccattcccaggtggctccctgatcaatcccccatttcctcggtgaatttctagcaggtattaggctccctggaagaatctgtcct

SEQ ID NO: 2573 - DNA, 476 bp, Mus musculus
  misc_feature (44)..(44): n is a, c, g, or t
  misc_feature (252)..(252): n is a, c, g, or t
  misc_feature (258)..(258): n is a, c, g, or t
  misc_feature (291)..(291): n is a, c, g, or t
  misc_feature (297)..(297): n is a, c, g, or t
  misc_feature (390)..(390): n is a, c, g, or t
tgaccggcgtgttcgcgcaactgcaggtgcgcggccgcgacttnggggacctgctcatctactctggggcgctgctggtgttcttgagcctgctgggctggattctctggtacaccggcaacatcgagatctcgcgccaggagctggagcgtgactacggcctacgaccctcggcgattgcccgcctggcgcgcaagctgtcccgtcgctggtcggcgcccgccaccgccagtccccggaccacagccggtntccgcntcagcacgcagagcgaaccgcgcgccccagccntcctcntccggctcccgccgcgtgcgcctgcagctcgccacgcttgaggcggggtccgtggcggcaggcacgggcagcgagtgagccccagaccacctnatcctccggacctgactgagacatgcagcttccctgtgcatcactaggccaccaggatatccacctgtcacctcacttggataaat

SEQ ID NO: 2574 - DNA, 483 bp, Mus musculus
  misc_feature (55)..(55): n is a, c, g, or t
tttctcacacataccagggtctcatgtcccaccctaaatggcctagaattggtgntatttaccaggcaacgctggaactcggagaaacttagggctcttcccctgagtgttggtgtgaaaggtgtggagccagtttgcctcccctgagttacttaacttttaatctctggctatggggtgtggttgttgttgttgtgtgttttttgctgttgtttgtttattttgtttttcaatcttttctattggtattgcagatggatacatataaaataccttacatagactaagctagtcaatgtagccataaaaacataagttttaatgagggaaatgaactgggggtgataagtattctagttgatataaatctgttttcttgtgtttaatgacagttatttgagaccttaagtacgatgtttttgttacattctttgtaacaggaagattttagaaacaatataatgggcctcagttaaagtacag

SEQ ID NO: 2575 - DNA, 343 bp, Mus musculus
aaacctcagccagatatggtggtgcagttctataatcttagtactcaagaggttgagtattgctttaagaatagcctgggctatccttatagtaagatcctgtctcaaaacacacaaaacaaaacaaagtagaaacccaaagactagagtcagaaattacagcttctcatggccaccaggcatttagctgtgtctggtcagaacggttgcctgcaaagcacggggcttaagaaaacccaatactctagatcttacatagggtagagaaaaacattttagttgtgtgtgtttttcaggtatatctgtgtaccacatccctgcttggtgcctcaagagtccagaa

SEQ ID NO: 2576 - DNA, 522 bp, Mus musculus
  misc_feature (254)..(254): n is a, c, g, or t
  misc_feature (259)..(259): n is a, c, g, or t
  misc_feature (265)..(265): n is a, c, g, or t
  misc_feature (270)..(270): n is a, c, g, or t
  misc_feature (276)..(276): n is a, c, g, or t
  misc_feature (285)..(285): n is a, c, g, or t
  misc_feature (291)..(291): n is a, c, g, or t
  misc_feature (297)..(297): n is a, c, g, or t
  misc_feature (301)..(302): n is a, c, g, or t
  misc_feature (305)..(305): n is a, c, g, or t
  misc_feature (311)..(311): n is a, c, g, or t
  misc_feature (315)..(315): n is a, c, g, or t
  misc_feature (320)..(321): n is a, c, g, or t
  misc_feature (323)..(324): n is a, c, g, or t
  misc_feature (328)..(328): n is a, c, g, or t
  misc_feature (337)..(337): n is a, c, g, or t
  misc_feature (349)..(349): n is a, c, g, or t
  misc_feature (373)..(373): n is a, c, g, or t
  misc_feature (376)..(376): n is a, c, g, or t
  misc_feature (384)..(384): n is a, c, g, or t
  misc_feature (390)..(390): n is a, c, g, or t
  misc_feature (413)..(414): n is a, c, g, or t
  misc_feature (418)..(419): n is a, c, g, or t
  misc_feature (429)..(429): n is a, c, g, or t
  misc_feature (441)..(441): n is a, c, g, or t
  misc_feature (460)..(460): n is a, c, g, or t
  misc_feature (468)..(468): n is a, c, g, or t
  misc_feature (472)..(472): n is a, c, g, or t
  misc_feature (496)..(496): n is a, c, g, or t
gcacaggaaacctttctcgggacctcagccccagctgacttggcagggcctccaagagcatgggtgacatgccttgggcaaacattgcctttatgaccaagtgggtcacatagtcaatctgtccattctggacagggacacagcactacctggatggctgggtgactgcaatcacatgatcttgttgagtgccatgtgctgtggagagtgacaccactgtctgtcaccaggtggcttgagagcctctgtaactncagcnggcatncgtgncacaancatgagatntccctncaccancccnngancccacnctanccccnngnnattntgctgaggntccccaatcctntccttcccagaggacttgtttctncantcaccatntccttntgcatcctgctggtatcaggatnncccnnctggcgacanccgtgaaacaantcactgaaacaaaccagantcatggantcgncaatgtgtatattacaacctgctncctagctcccttgtaaactttagagt

SEQ ID NO: 2577 - DNA, 411 bp, Mus musculus
agcagttcgctcctttagtaattatgtttgtgcttcctgcactggaagtggacccgactggcaccatgggcctcctcaacagatccactccatttgtccttccatccttgcctagaaaagttctgtgaggaatattcccgtgggttctgatgggccctcccaggagtgacttaaattgtcctctgagggtcaccttagtagttaagtatctactgcagtgtgtctgcttttgatgacagctttgtttcagagctccctccaaggctactgaaatctgtatgtttatacttctaaatctgcctgagtgaccttgaaaagggaaccagtgtgtttaggagaaaaaagcaacaggatacaaaccaaagtcttataatgtggcagagttgaacatatgttagtgtctccttccca

SEQ ID NO: 2578 - DNA, 554 bp, Mus musculus
  misc_feature (32)..(33): n is a, c, g, or t
  misc_feature (83)..(83): n is a, c, g, or t
  misc_feature (85)..(85): n is a, c, g, or t
  misc_feature (97)..(97): n is a, c, g, or t
  misc_feature (103)..(103): n is a, c, g, or t
  misc_feature (139)..(139): n is a, c, g, or t
  misc_feature (144)..(144): n is a, c, g, or t
  misc_feature (157)..(157): n is a, c, g, or t
  misc_feature (178)..(178): n is a, c, g, or t
  misc_feature (188)..(188): n is a, c, g, or t
  misc_feature (204)..(204): n is a, c, g, or t
  misc_feature (260)..(260): n is a, c, g, or t
  misc_feature (271)..(271): n is a, c, g, or t
  misc_feature (290)..(290): n is a, c, g, or t
  misc_feature (297)..(297): n is a, c, g, or t
  misc_feature (302)..(302): n is a, c, g, or t
  misc_feature (309)..(309): n is a, c, g, or t
  misc_feature (316)..(316): n is a, c, g, or t
  misc_feature (328)..(331): n is a, c, g, or t
  misc_feature (335)..(335): n is a, c, g, or t
  misc_feature (337)..(337): n is a, c, g, or t
  misc_feature (347)..(347): n is a, c, g, or t
  misc_feature (361)..(363): n is a, c, g, or t
  misc_feature (365)..(365): n is a, c, g, or t
  misc_feature (371)..(371): n is a, c, g, or t
  misc_feature (373)..(373): n is a, c, g, or t
  misc_feature (423)..(423): n is a, c, g, or t
  misc_feature (507)..(507): n is a, c, g, or t
cactcgccctgcatttggatctagacttgggnnaattaagacaacagttaatacaacaggggctgctgggaatgtgtcagccncncctcctcccccngctccnccgccttctggatctggcacaagtaaaatagacaantatgntcgtattctcttnccagtcacatttggagcattnaacatggtcnactgggttgtttattnatctaaggacaccatggagaaatcagaaagtctaatgtaattttgttgctatagtnatttcataacnacgatggaaatacagactntcttttnaaatntttttanaggtaantattctttactnnnnatananattctatgtnattttttcacttannnanaatacnantcagatatggagagagttaattaactcttcagtggctagaaagtgaaccntctttctttatagaaagatagctttaaaagaatctattcagtgttcaaattggatagaacacagagcattatggaaagttggancaagagaaatagagctaggagagatatgtggtacacccttttgcatt

SEQ ID NO: 2579 - DNA, 480 bp, Mus musculus
  misc_feature (191)..(191): n is a, c, g, or t
  misc_feature (200)..(200): n is a, c, g, or t
  misc_feature (345)..(345): n is a, c, g, or t
  misc_feature (362)..(362): n is a, c, g, or t
  misc_feature (372)..(372): n is a, c, g, or t
  misc_feature (376)..(376): n is a, c, g, or t
  misc_feature (390)..(390): n is a, c, g, or t
  misc_feature (428)..(428): n is a, c, g, or t
agtgctgtagcaatcaccaccatcagcactgggagccattgaccacactgcagctgtatggaaggaggtggagacaggagagagcagctatgaattagctggagaaagtatgggcaagaatagtcctttggcattttaacccagtagaagacctcacactggtggcagaaggggctttttttttttttttnctcttcagntgtctccctcactttttgtcatttccactagataaaaccagtttactagtggcctagagactcatatctgacaggggacagatatttaaatgctgatctgaatgaggtggaaattaactcagcagaataacactctttgtacacncctcaatacttttgcantcctcctctncccnttgtcattatgttnacaataaatcaaaaaagtactctttcatgcttgaaccnatacaggctgaatatcctttttctgaaatgcttgggattaggactcattcaa

SEQ ID NO: 2580 - DNA, 441 bp, Mus musculus
tctgtctctcaatgctttctggtaaaagcaaatgcccaaagccaccacccttccatctgcaaagcaccttccctgaaagcagccttagagccctctctacggccaaaccccgatctttaaaaagacaaaatttccctgtttacttgcgtttcctgccctcctctttgctgggccacatttgagcttggaaaaagcttgaagctgagatgtgttcttaagggccagaagctgtcagggcttttggtgagcaagattgatcacacccagacttccttcagagctttgtttggaataaaagcaagaaaactggaaaaacccttacattttccaaaatagcatctctatctgcaaggtaatgctcagagctggtcaaggctggagaccactttagagccaaaccccctaactgctagctagcctcagagatggagttctgccctt

SEQ ID NO: 2581 - DNA, 552 bp, Mus musculus
  misc_feature (114)..(114): n is a, c, g, or t
  misc_feature (118)..(118): n is a, c, g, or t
  misc_feature (261)..(261): n is a, c, g, or t
  misc_feature (286)..(286): n is a, c, g, or t
  misc_feature (290)..(290): n is a, c, g, or t
  misc_feature (318)..(318): n is a, c, g, or t
  misc_feature (353)..(353): n is a, c, g, or t
  misc_feature (463)..(463): n is a, c, g, or t
  misc_feature (467)..(467): n is a, c, g, or t
  misc_feature (527)..(527): n is a, c, g, or t
ggcttcttcatctgggttgacttgagaaagtatctgtgcaaaggcacctttgaggaggaggcgttattgtggcgccaatttttggacaacaaggtgctgctgtcctccggtaanaccnttgagtgcaaagaacccggctggttccgcgtggtcttctcggacaaggagaaccggcttcgcctgggaatgcaaaggatgcggcaggtgcttgaaggacaatctcaagtggtagaagatgcctctccctgtcacgctcagganccacaaagccagcccagatgagctncccnattgcctctcactgttcctgtgacctgnccctgtggggctacaggagactgagtgtggatgcnccatttgtcagtgggactcacgacttggctttgaccttgaaggactttttcctgccctctgctgacagtgggagtctgtttaaactgatattcatcttgggctgttgctncccntgtattcaacaggattaggatcagcaggatgactttgtgaacagtgtacagtttggagantcgtgactgctcctaattacagctc

SEQ ID NO: 2582 - DNA, 386 bp, Mus musculus
  misc_feature (210)..(210): n is a, c, g, or t
  misc_feature (213)..(213): n is a, c, g, or t
atttgagtgtggaaagttatgctttataagtaaagaagtagcaaatacagatgaaataaaaataaatggaagaatataaagaagaaaaaactaagaaaataaacaaaaatgtaagtgaaagtaagccatatgtgatggctactgcctgtggtcagggcttgagaagctgaggcaggaggattacaaatttaaggcatctgtggtttcagnggngactttgaagcccatctggaccacagagtaagaccggcttttgttcttcagagaacataaacaaaagaaagtatatgataattatggggaatagtctcgtggatttaaatatagacaaaaatacatttaagtttatcttttgaagacaacaaagagggcttgaatggatgtgt

SEQ ID NO: 2583 - DNA, 429 bp, Mus musculus
  misc_feature (369)..(369): n is a, c, g, or t
gcaggcctggataaagtatggtcctggaagatgtcccaaagaaattcaaagatgattatttctttagtttttgccttgtcctcaccagtaattgctcccatctagggagagggagggatattgatgtctctcttttaaacatatgtttactcttccaaggtgacttatgggactaagaaaggaagcaaagctttttaccaaaagtagacttaaactttgagtttttacgttgctgtttatatctctaattcagcactcttattgctgtagctaagccttttcgattctatattaagtagagttgaaagtggagatctttcttgagttcttagtagtggaaatgctgagctctcccataaaaatgatgtncctgaatggtttgccatatatagcctttattatgtgatgatatgatccttttattctgaa

SEQ ID NO: 2584 - DNA, 342 bp, Mus musculus
  misc_feature (30)..(30): n is a, c, g, or t
  misc_feature (37)..(37): n is a, c, g, or t
  misc_feature (39)..(40): n is a, c, g, or t
  misc_feature (47)..(47): n is a, c, g, or t
  misc_feature (54)..(54): n is a, c, g, or t
  misc_feature (255)..(255): n is a, c, g, or t
  misc_feature (293)..(293): n is a, c, g, or t
tatgacccactgtccaactactcagcccgncaccttngnnagggccnagtgctnagggatgagagggccaccaagagaccgcggggctccaggggtgctgagccatacactcctgccctcaagaagccctgtgaccccttcggtggctgtgaggccaggttctcagactcagaagatgatgtgaccagccccccaaaggctgatgttagcagccccaaggctggagctgaccctgaaagcaaggcacctgggaancctgtctccaaggagggcagagagcatgaggacggtgncctgcggggcaccaaggagatggctgtgcagtatgacgtggaagacctt

SEQ ID NO: 2585 - DNA, 561 bp, Mus musculus
  misc_feature (32)..(32): n is a, c, g, or t
  misc_feature (45)..(45): n is a, c, g, or t
  misc_feature (56)..(56): n is a, c, g, or t
  misc_feature (74)..(74): n is a, c, g, or t
  misc_feature (114)..(114): n is a, c, g, or t
  misc_feature (120)..(120): n is a, c, g, or t
  misc_feature (147)..(147): n is a, c, g, or t
  misc_feature (157)..(157): n is a, c, g, or t
  misc_feature (184)..(184): n is a, c, g, or t
  misc_feature (193)..(193): n is a, c, g, or t
  misc_feature (200)..(200): n is a, c, g, or t
  misc_feature (271)..(272): n is a, c, g, or t
  misc_feature (274)..(274): n is a, c, g, or t
  misc_feature (276)..(277): n is a, c, g, or t
  misc_feature (279)..(280): n is a, c, g, or t
  misc_feature (282)..(282): n is a, c, g, or t
  misc_feature (284)..(284): n is a, c, g, or t
  misc_feature (290)..(290): n is a, c, g, or t
  misc_feature (303)..(303): n is a, c, g, or t
  misc_feature (305)..(305): n is a, c, g, or t
  misc_feature (309)..(309): n is a, c, g, or t
  misc_feature (311)..(311): n is a, c, g, or t
  misc_feature (322)..(322): n is a, c, g, or t
  misc_feature (341)..(341): n is a, c, g, or t
  misc_feature (344)..(344): n is a, c, g, or t
  misc_feature (358)..(359): n is a, c, g, or t
  misc_feature (363)..(363): n is a, c, g, or t
  misc_feature (365)..(365): n is a, c, g, or t
  misc_feature (369)..(369): n is a, c, g, or t
  misc_feature (378)..(378): n is a, c, g, or t
  misc_feature (404)..(404): n is a, c, g, or t
  misc_feature (406)..(406): n is a, c, g, or t
  misc_feature (413)..(413): n is a, c, g, or t
  misc_feature (416)..(416): n is a, c, g, or t
  misc_feature (418)..(418): n is a, c, g, or t
  misc_feature (436)..(436): n is a, c, g, or t
  misc_feature (444)..(444): n is a, c, g, or t
  misc_feature (524)..(524): n is a, c, g, or t
cctgcaaggtccttattaaacctgactgttcntcttcttgatagncttttccaatnaaagacccaggataatantggagatttgttcaagtcctccctccactcaaaaagaggnaactgnaataaattagcttttcagaggaaaggntcaaaaaaancaactcataatattttgcttttttttncttttttcncttcttntcttttcttttttgttttttttttttgttttttgtttgtttgtttgtttgtttgtttgttttgtttttcannanannannangntttctntgtgttgctttgncncccntngaactcacttngtagaccaggctggcctcnaantcagaaatccaccnncctntncctncccgagtantggaattaaaggcgtgcgataacacncnaagcccngcntntttgtttttttttttttngttttttntttgttttttttagagaaacattttttattcctttatttatttgttgttttcttcatatgttttaaattgtgttgttttnccattgatatacaaggtttacaatggtggtgtgagcc

SEQ ID NO: 2586 - DNA, 483 bp, Mus musculus
  misc_feature (352)..(352): n is a, c, g, or t
  misc_feature (355)..(356): n is a, c, g, or t
  misc_feature (359)..(359): n is a, c, g, or t
  misc_feature (381)..(381): n is a, c, g, or t
  misc_feature (384)..(384): n is a, c, g, or t
  misc_feature (388)..(388): n is a, c, g, or t
  misc_feature (391)..(391): n is a, c, g, or t
  misc_feature (409)..(409): n is a, c, g, or t
  misc_feature (412)..(412): n is a, c, g, or t
  misc_feature (426)..(426): n is a, c, g, or t
  misc_feature (457)..(457): n is a, c, g, or t
ggcagtatcgcatggatggtcctcctgggagattgcctgcacaacctcaccgacgggctggcattaggtgctgctttctcagacggcttctccagtggcctcagcactaccctagcagtcttctgccacgagctgccccacgaactgggtgactttgccatgctgcttcaggaagggttatcctttcggaagctgctgctgctgagcctcgtttctggagccctgggactggggggtgcagccctgggggtggggctcagcttgggccctgtgcccctcaccccctgggtgtttgggaccacggctggggttttcctctatgtggccctagtggatatgctgccaaccctgnttnntcntcctgagcccctgcctgtgttncangtgnttntgcaggggctggggctgntantggggggcagcctnatgtttaccatagccctattggaggagcagntagtgcccacggttcctgacggctga

SEQ ID NO: 2587 - DNA, 549 bp, Mus musculus
  misc_feature (33)..(34): n is a, c, g, or t
  misc_feature (45)..(45): n is a, c, g, or t
  misc_feature (58)..(58): n is a, c, g, or t
  misc_feature (76)..(76): n is a, c, g, or t
  misc_feature (82)..(82): n is a, c, g, or t
  misc_feature (92)..(92): n is a, c, g, or t
  misc_feature (98)..(98): n is a, c, g, or t
  misc_feature (139)..(139): n is a, c, g, or t
  misc_feature (328)..(328): n is a, c, g, or t
ttgcctttttcaagcctttcaggaaaaaaaaanntcatgtaaccntttgtcacccttnccatggttggtgctagcntctttntgtgaagttngttgtngttgttgttgtttttggtttttgagttccagattattggantcttattttaatttatttttctccgttggaaaataaaacaggaaaaatgatttaacatccatctcacagagttgcttgactgtttagttccaaggtcctcctgttcagcttctgttgctcgtcttgttcctgctctggcttgctttgttggtaacaatgctggacctggagccgagcgtctcatttacnggagcccagcgctctgtactgccacacacttctgaagttggaaaagtgtgaagagctaggacttgcctgattcgctcatcgttatttttttttcctctttagctagaggtaagtgtgggtgtgtaggaaaacaaatgaagacacctaatgtacatctattctgaattatgcaaattagctcttactcagggtcaactaaattacttcactttgccctttag

SEQ ID NO: 2588 - DNA, 433 bp, Mus musculus
gtaccaaatgttgttcattcttcagaagaggttatcaaatcagagaggagatgtttgtgctagttaacccttccattttcaaaacatactctcccacttgaacttaaaagttatcaaaataaatagaatccttatgtgactgaagagaactcaacgtttggataataaatgagccttcttcctaggcctggatctctgacaggctcatgtgtgggtagatagggagcctgggtgctgtgactgagggactaaattgctgacaggggctggaccagaccttgttttgtgggccaggctcagcaatggctgctctgtgtgccctttgtggaccacatattaagggtctgggtatttgaaagttaggttccaggaaaacacctacagacagataaacagttccttggtattacaacttttcagacatggtgaccat

SEQ ID NO: 2589 - DNA, 527 bp, Mus musculus
  misc_feature (441)..(441): n is a, c, g, or t
agtcaggcatttgctgctcagcggggccttgcagtattaaaacacgtactgacaccaagaataaaggccactcacgttgcttttgattctatgaagagtcatttagatgcaatttatgatgtcacagtggtttatgaagggaatgagaaaggttcaggaaaatactcaaatccaccatccatgactgagtttctctgcaaacagtgcccaaaacttcatattcactttgatcgtatagacagaaatgaagttccagaggaacaagaacacatgaaaaagtggcttcatgagcgctttgagataaaagataggttgctcatagagttctatgattcaccagatccagaaagaagaaacaaatttcctgggaaaagtgttcattccagactaagtgtgaagaagactttaccttcagtgttgatcttggggagtttgactgcngtcatgctgatgacggagtccggaaggaaactgtacatgggcacctggttgtatggaaccctccttggctgcctgtggtttgttat

SEQ ID NO: 2590 - DNA, 498 bp, Mus musculus
  misc_feature (93)..(93): n is a, c, g, or t
  misc_feature (97)..(97): n is a, c, g, or t
  misc_feature (246)..(246): n is a, c, g, or t
  misc_feature (305)..(305): n is a, c, g, or t
  misc_feature (307)..(307): n is a, c, g, or t
  misc_feature (312)..(312): n is a, c, g, or t
  misc_feature (321)..(322): n is a, c, g, or t
  misc_feature (345)..(345): n is a, c, g, or t
  misc_feature (351)..(351): n is a, c, g, or t
  misc_feature (354)..(354): n is a, c, g, or t
  misc_feature (360)..(360): n is a, c, g, or t
  misc_feature (378)..(378): n is a, c, g, or t
  misc_feature (387)..(388): n is a, c, g, or t
ctggctcacagcaggaatggtccttcaactccctccccgccacaaccctcagaccaccaccaccagccttagaaagtctctgtgctctactgncaangaggccgggatcctctggcccactgtttccccagctcactctggggtgggctgaggcctctgggacagctgaaagccagaggctttcccctgcgacaacacaccaccctcagccctgtgactttggggacccacaggtttcaattctgntgttcacatggtcctgggctagggaccgctctcttatcccgggtcgagttcagttcagncnaactnctttttccnntccacaagcagagagggaagatnaggggnagngggggntggggggtgggggatgancctcagaanntcagcgagactcaggtagtgagagagcaaaaacagtaagggcaaagaaagacccagtttcttagggaacgcaaatgatttattatccagatacttggatagttccttttt

SEQ ID NO: 2591 - DNA, 440 bp, Mus musculus
  misc_feature (51)..(51): n is a, c, g, or t
  misc_feature (54)..(54): n is a, c, g, or t
  misc_feature (67)..(67): n is a, c, g, or t
  misc_feature (71)..(71): n is a, c, g, or t
  misc_feature (78)..(78): n is a, c, g, or t
  misc_feature (89)..(89): n is a, c, g, or t
  misc_feature (91)..(91): n is a, c, g, or t
  misc_feature (94)..(94): n is a, c, g, or t
  misc_feature (97)..(97): n is a, c, g, or t
  misc_feature (102)..(102): n is a, c, g, or t
  misc_feature (110)..(110): n is a, c, g, or t
  misc_feature (113)..(113): n is a, c, g, or t
  misc_feature (117)..(118): n is a, c, g, or t
  misc_feature (122)..(122): n is a, c, g, or t
  misc_feature (149)..(149): n is a, c, g, or t
  misc_feature (152)..(153): n is a, c, g, or t
  misc_feature (155)..(155): n is a, c, g, or t
  misc_feature (158)..(158): n is a, c, g, or t
  misc_feature (171)..(171): n is a, c, g, or t
  misc_feature (192)..(192): n is a, c, g, or t
  misc_feature (197)..(197): n is a, c, g, or t
  misc_feature (199)..(199): n is a, c, g, or t
  misc_feature (202)..(202): n is a, c, g, or t
  misc_feature (216)..(216): n is a, c, g, or t
  misc_feature (240)..(241): n is a, c, g, or t
  misc_feature (246)..(246): n is a, c, g, or t
  misc_feature (271)..(271): n is a, c, g, or t
  misc_feature (286)..(286): n is a, c, g, or t
  misc_feature (296)..(296): n is a, c, g, or t
  misc_feature (305)..(305): n is a, c, g, or t
  misc_feature (326)..(326): n is a, c, g, or t
  misc_feature (340)..(340): n is a, c, g, or t
  misc_feature (364)..(364): n is a, c, g, or t
  misc_feature (366)..(366): n is a, c, g, or t
  misc_feature (369)..(369): n is a, c, g, or t
  misc_feature (372)..(372): n is a, c, g, or t
  misc_feature (378)..(379): n is a, c, g, or t
  misc_feature (394)..(394): n is a, c, g, or t
  misc_feature (415)..(415): n is a, c, g, or t
gagaatgggctttaactctggtggcagccagacctcagtaggcagcagctnacnagtctggcagagnaggnagcagcngtgttcagttntntcnagnccacnagttcaanccngcanngctncaagtgatcttcaggggcaaagcatcnacnncntcntgctttccctgcntcagcctgcaatggcatctgntcccnanttnttggcatcaacagntgcacagttcaaccctgctttaanntcaanttccttggagaaggggccgaacttntttgctcctatatcnttaagtcttntcttaggtnagggtagtccaactactagtntgggatgatggcgntcctagagaagagcctgtggtgantntgnaangtggtnnagcagtaccagaggntaggccttcccaagctttctnagtctagcctagtccattctgtcca

SEQ ID NO: 2592 - DNA, 261 bp, Mus musculus
tcactaggtgggacccctccctgtataccccgtgctcctgtgactgcccccacttcttccactatggtggagaaaaacagccttccccgggactatcagccagtgtggccctctatttccttgtggtaccgagtgtccctgaggctggggtggtctttttcaaacggtaaattgcaggggcaagagcatagccccacgataggtggggcttgaggtcttcttagggttccctacgaatgcgtattgcccacgccgcagtat

SEQ ID NO: 2593 - DNA, 356 bp, Mus musculus
  misc_feature (95)..(95): n is a, c, g, or t
  misc_feature (97)..(97): n is a, c, g, or t
  misc_feature (105)..(105): n is a, c, g, or t
  misc_feature (130)..(131): n is a, c, g, or t
  misc_feature (159)..(159): n is a, c, g, or t
  misc_feature (177)..(177): n is a, c, g, or t
  misc_feature (192)..(192): n is a, c, g, or t
  misc_feature (221)..(221): n is a, c, g, or t
  misc_feature (233)..(233): n is a, c, g, or t
  misc_feature (251)..(251): n is a, c, g, or t
  misc_feature (265)..(265): n is a, c, g, or t
  misc_feature (269)..(269): n is a, c, g, or t
  misc_feature (290)..(290): n is a, c, g, or t
  misc_feature (297)..(297): n is a, c, g, or t
  misc_feature (307)..(307): n is a, c, g, or t
  misc_feature (317)..(317): n is a, c, g, or t
  misc_feature (321)..(321): n is a, c, g, or t
  misc_feature (330)..(330): n is a, c, g, or t
agggttggtttcaggcccaggctctggtgcagcccgagcatgcttggcgtctggttaacgtctccccgggcttgtgtaactctgctcataggtantnggggtttngaaatacttttcctttttttttttnncatgcaaaatgcagcagagagctctttnttagaagaacggcattcntgaaagaatgcttgnggaaaaacatgcttggggggctgcaaggnaagggtctccantgtgggccaccgtgcctngagcccagatgccngacnggaggaggaggcaggtttaantgtgacntcagatcctntgcgattaantganggacttatntcttgggactctgatagtgtcgaaac

SEQ ID NO: 2594 - DNA, 559 bp, Mus musculus
  misc_feature (262)..(262): n is a, c, g, or t
  misc_feature (267)..(267): n is a, c, g, or t
  misc_feature (332)..(335): n is a, c, g, or t
  misc_feature (412)..(412): n is a, c, g, or t
gcctcagctgatttttccagttgattccagtatctgagattctgctcaccagatctgactgcctgcacagggcaaagaagaaaagccaagaaggcggcttccatggaatgtatatatcttcagatagctgtctcacatatagctgaagctgtctgggctgttcagcttgtttcttgcctgaatgcaactgacaagtggagagagaaaagcattcagcaaaatactcaggaaacttgctgattttatgatgattcacaaccanccatnccaaggccacttttcttctgataatctactcatgttaaagttttcggggccatattaatatcctnnnnaaaaaaaaaaaactaatgactggcctttcacaccaagccaaagtgtttgctcctcatatcacccaaagcttatcatnttagaacttagaattttgaaaatgaaagaaatgatatagtcaaaacaagaataggaacagaagacaggataactctggctcgcctttttttccatctcagcaccgttaaagactttctgagcagctgctactgctcaggctgatgtc

SEQ ID NO: 2595 - DNA, 527 bp, Mus musculus
  misc_feature (27)..(27): n is a, c, g, or t
  misc_feature (341)..(342): n is a, c, g, or t
  misc_feature (346)..(346): n is a, c, g, or t
  misc_feature (354)..(354): n is a, c, g, or t
  misc_feature (357)..(357): n is a, c, g, or t
  misc_feature (361)..(361): n is a, c, g, or t
  misc_feature (381)..(381): n is a, c, g, or t
  misc_feature (383)..(383): n is a, c, g, or t
  misc_feature (386)..(386): n is a, c, g, or t
  misc_feature (395)..(395): n is a, c, g, or t
  misc_feature (400)..(400): n is a, c, g, or t
  misc_feature (409)..(409): n is a, c, g, or t
  misc_feature (463)..(463): n is a, c, g, or t
gtctcaggactgttaagtgctctaccnctgaaccatattccctgctgtcttttttacttgtgttttgagataggatctcctgctaaattgcctaggctggatttgagagcttgtaacccttgtgcttcagtctcccaggaaactggaattacaggttgcaattttgggcctggctttcttggattcttctgaacagggcaggaaacaatgtaacaataacggtgggtgttgtaggagatgagccacagctcagaaatcgccacagctcagaaatcgctgaaccggtccttctgctggggaatggtttttattgtgaatgtgatagggaaaagaatccaganncatntggaaganttngaancagagagagaagtagactgngnatnggcgaggtngtctncaagacagngtgagagagcggggatgggggggtgggggtggggtggggaaatcttgcagattntgtcacgcccaaaagaacctggacagatggccgtctgtggtgcctaatcacatatccccattga

SEQ ID NO: 2596 - DNA, 471 bp, Mus musculus
aaaccattgtccattcccatatatatacatattgatctgtttaagtgtattcttactgggcccttttctcataattaaagattccccttcattctcattccaccgttcaacacttcctgagtttaacctctgggggactcttgagttgttgtataaagcacaccactgatcatgtctaccatgggagagtattttcacaaagtatctcacagagaacctggaacatgggagccattctgcaagtgtccctcaaccctcttgtcacttgtttgggagaagtaagagaatatcacatagaacaaagatgacatcagtgtggttgttcttgaccatccccttctcagggattttgatcaaagatttgtatctcattatcttaagccccctttggataccaaactgaggctagtgtacatattctggtgaacaagtttgataacaacactgctgtctgtgcaatgtctggatata

SEQ ID NO: 2597 - DNA, 470 bp, Mus musculus
  misc_feature (308)..(308): n is a, c, g, or t
  misc_feature (310)..(310): n is a, c, g, or t
  misc_feature (327)..(327): n is a, c, g, or t
  misc_feature (336)..(336): n is a, c, g, or t
  misc_feature (338)..(338): n is a, c, g, or t
  misc_feature (350)..(350): n is a, c, g, or t
  misc_feature (445)..(445): n is a, c, g, or t
atgatcgaatcatctgaggtcagaagactcactctaaagctgggctacaccttttgatggcatcccgcataaaagcacatggaataaggaaagctttgatttttgcctgcttgtcctcactcttactggcaagttcatctagtctgctgctgtggcattctttcactggtgttagaacctacttcttcatgactgaagactagctaaggtatccagccatgtggactgaataactactaaatttatggccttttttttttttttggagcaagagatattcattgttggactagacagacaacagcctntnagccactctaataaatnacctttagnanaatattctttcnatcagttctgtttctttagagatccctgattaatacagagaggctggagtatatagatgagaaaaggactagggcaggaagctccatctatgtancctcagggaagttatcagccatact

SEQ ID NO: 2598 - DNA, 504 bp, Mus musculus
  misc_feature (230)..(230): n is a, c, g, or t
  misc_feature (247)..(248): n is a, c, g, or t
  misc_feature (256)..(256): n is a, c, g, or t
  misc_feature (263)..(263): n is a, c, g, or t
  misc_feature (271)..(271): n is a, c, g, or t
  misc_feature (294)..(294): n is a, c, g, or t
  misc_feature (313)..(313): n is a, c, g, or t
  misc_feature (350)..(350): n is a, c, g, or t
  misc_feature (357)..(357): n is a, c, g, or t
  misc_feature (368)..(368): n is a, c, g, or t
  misc_feature (372)..(372): n is a, c, g, or t
  misc_feature (389)..(389): n is a, c, g, or t
  misc_feature (400)..(400): n is a, c, g, or t
  misc_feature (421)..(421): n is a, c, g, or t
  misc_feature (469)..(469): n is a, c, g, or t
  misc_feature (474)..(474): n is a, c, g, or t
ggtgcctcctcatctgggatgaacacctgactgtggcgcccaccctgggcacagaaacctagatgggcagccagcccaaaggtcgccgttctgaaatgcttgtgtacctgcctgggccgggtaccctgcctggacagctgacagggcttgagactgcacacatggcatcccgattgctccggattcctttaagggcctcaagcttataagatggaagggaactcatgtgnccacactttcctttggnngccaaganaaatatntcattccntcccacagatccttacccagggntgccccatgcctaaggacntcagcagtgatggttcccctgactgtcaggagcactnttgtggntggatgacaantccntccagattgttgtagantggaccagctntccatcttcagccacgctttntgacagctaccttcccttatcattacccaagagggtgtctcctttttntcttntctcatagccctttattgactttccatgtg

SEQ ID NO: 2599 - DNA, 55 bp, Mus musculus
cacattgtactgttctgccttgaaaggctaatgctgccttcttatttcataggac

SEQ ID NO: 2600 - DNA, 493 bp, Mus musculus
  misc_feature (85)..(85): n is a, c, g, or t
  misc_feature (252)..(252): n is a, c, g, or t
gaccttcaagcctctcaaagctgaagtatgcaccatcatactcgactgtgagtgcctgacgtaccctcagatggcctgctccttnccacgctcattgttttaacactgtgaagttataaggtcatttccctccagtacaccaggggacaaacagcaattaattaaaagcctacaaaatacctggcctaaaccgtcactgcccctcttgtctcacacaacactgaactagcacattgggcgacagcctgtgcntagcagtgagaaatcaggatttactctaaagatttcacgagaattaaatcatcaacaatttgattacatactatcattttatagaggagatgaggcagcttgaaaggagtaaaaattggttcactttatttccttttatcattcagcttaacttgagggtgccaaagctttagcaccaagaaactttataaagtaaccaacttaccctttaagaactaaagggtagaggtcaagtccaaat

SEQ ID NO: 2601 - DNA, 467 bp, Mus musculus
gtcgccctgaatataaacgtcctgggcatcaaacaggttgtcaagtttaatcgcaagtgatcttagccactgaagcatctcacgagctggaggtttgagtttcttaccctgcccttcaccctgtcctgtgcaaagggtatgaaatgaatgtctcagaaggaaaacgccctctgttaaagattctacaggcctggtggactgattagaagttcatggttgtggagttgggatgttgcagatacagatgtcatggactatcattagcctccttcaaagccattctttgcccgattgtctatctgacttaatctccatgtgactaccatgtgaaaactttggaaatgtactgacagacaactagctttcccaagccaaaggctaaggataccatctgataccatgaggcctacagcagaggttagcctcagtttgctggaaacacctgcctgatgtttccactaatgtat

SEQ ID NO: 2602 - DNA, 471 bp, Mus musculus
  misc_feature (91)..(92): n is a, c, g, or t
  misc_feature (156)..(156): n is a, c, g, or t
  misc_feature (164)..(164): n is a, c, g, or t
  misc_feature (171)..(171): n is a, c, g, or t
  misc_feature (180)..(180): n is a, c, g, or t
  misc_feature (351)..(351): n is a, c, g, or t
  misc_feature (385)..(385): n is a, c, g, or t
gagtttgttagttcagaccccaggggcttggattgctttatgtcaaatcacaggaatgagaagggaacttaccgaagccacggtttttttnngagaaatacgtgagattggaattgaggcttgcaaaaagatggtgtatctcagagggcagaaaantgggactnagaaaantagaagggnaagcagtgctttttagatatctgtcaccaaatcccttaagtggaaaatgcagaggggtgtggctttgcctattggtgagttggcagtccgtctgcaggctctagagcaccctttggagcgacagttccaggatgtatccaggactgggcttcaggaatttaggaagtagtntactacttaattcagaaaattaaaaagatttttngttagcaaaagtggttcaactttttttagggtgtgtgtagacatattgctattgcttaactgctttctgaggctacttggcatatt

SEQ ID NO: 2603 - DNA, 499 bp, Mus musculus
  misc_feature (312)..(312): n is a, c, g, or t
  misc_feature (318)..(318): n is a, c, g, or t
  misc_feature (321)..(321): n is a, c, g, or t
ttatcaggcgcgatgaactcccttcttgtaacgctaccatccagagacagttaggccaaatatgggtgttctgtgatattaagtgctgtgaatatgtaggaaatctccttaaagaaagattatctcttattgggaaaattgatttatttgtacacaaatatggtgttatttttagtatgtaataaattttgatcatcaggaaaagaattctgaatgaaatgaatatggactgaaattgtgaaatgaataaattttattgatcattacatttttaatgacttaaattttgatgcttctttatagtatgagganataatngtntaatatggatacagtttgtgtccagtatataaatatcacataattccaaggcttgtcagtcaattcaggaacattccagattatgtttattagccttctgttaagtgagctttgatgaattactgtttgtattaaaattgaacgtaagtgttctaacctttatcccaatgatttgagt

SEQ ID NO: 2604 - DNA, 559 bp, Mus musculus
  misc_feature (302)..(303): n is a, c, g, or t
  misc_feature (312)..(313): n is a, c, g, or t
  misc_feature (315)..(315): n is a, c, g, or t
  misc_feature (320)..(320): n is a, c, g, or t
  misc_feature (322)..(322): n is a, c, g, or t
  misc_feature (329)..(329): n is a, c, g, or t
  misc_feature (339)..(339): n is a, c, g, or t
  misc_feature (361)..(361): n is a, c, g, or t
  misc_feature (370)..(370): n is a, c, g, or t
  misc_feature (379)..(379): n is a, c, g, or t
  misc_feature (381)..(381): n is a, c, g, or t
  misc_feature (394)..(394): n is a, c, g, or t
  misc_feature (416)..(416): n is a, c, g, or t
  misc_feature (426)..(426): n is a, c, g, or t
  misc_feature (433)..(433): n is a, c, g, or t
  misc_feature (439)..(440): n is a, c, g, or t
  misc_feature (485)..(485): n is a, c, g, or t
  misc_feature (492)..(492): n is a, c, g, or t
  misc_feature (515)..(515): n is a, c, g, or t
  misc_feature (521)..(521): n is a, c, g, or t
ctggcgggcttgtgagatctcctgaattgacaggtcttcgtcctgtctgttttgagtcctctgtcccacgagaatggatgtgcacagctgaggcaaaagtgcggatgttcttcactctgcatggatttaaagttagaggactccgggtttctaaacttttaaacgactgtgatgtggtgtggtgttgctgttttctgccaagattcaccaatgtaatatcattttccttataagccagacattgtttcttagaacgttctttttaacttctttttctctagtgttgctaccatggtttaganntcatgatcnnancattntnaaatttnagacatcttntcttacattttctggaggtttnaaatcatcnataatgtgnanagggttagacttnataatggttaatgtcctgtttntcaaattttntgatctnaggtanntctagaggtacaaatttggataattctttttttttcctcccttcnggttttnggggtgtttgtagcatatcattncaaccntcattttcttttcgtcattttgtgcgtgatcagtctaa

SEQ ID NO: 2605 - DNA, 426 bp, Mus musculus
  misc_feature (193)..(193): n is a, c, g, or t
  misc_feature (200)..(200): n is a, c, g, or t
  misc_feature (223)..(223): n is a, c, g, or t
  misc_feature (242)..(249): n is a, c, g, or t
  misc_feature (254)..(254): n is a, c, g, or t
  misc_feature (320)..(320): n is a, c, g, or t
gccttgtttctctcatcacacaggaagctgtgaagcctcaggatgcgcgccctatgtctctccacctccagctgagagtgttaagtttctggctgccttttcttgcacttgcccagctcagagttggcctctttactgttgctcatgtcttcacattgcttcgtctctatctagttatggaatcccatctttntgtttcnttttctattaggaaaaaaaaaantcagtcactccctcaggcnnnnnnnngagcnaatgctatgtatttcaaggctactgaaagagcttcggctattccaggaatgaataagtagagacantttctctcacagatcaagttcctccttaggggcaggattaaaggacccccaccccgctccgatccagtcagcagttctggctactgctactcttgcttaccgatag

SEQ ID NO: 2606 - DNA, 412 bp, Mus musculus
tgcttttcacctcgagttttcctagctccaagttcaaacacagggaattgttgtgaatggggggtcctgtaagtgggtgcaaacacttgcagcaaagcataacaacttgaatttgatctctggaactcacctaaaactggaaggaaaccaatcccataaagttgtgtactgactccatacgtgccacgtcaccgccccccatgtacacactgtaagcacacctgctaataataaaactagggtatttgctttcagagtccctcctactcctgaaagttcaagaattgcttttaaccatacttaaaaattgttttatgctgtccctaaaatctgagacaaagaggacaagattcatgatagcttagaaaatgactcttcatactgggaatggtggtgcatagctgtggtatca

SEQ ID NO: 2607 - DNA, 507 bp, Mus musculus
  misc_feature (84)..(84): n is a, c, g, or t
  misc_feature (119)..(119): n is a, c, g, or t
  misc_feature (293)..(293): n is a, c, g, or t
  misc_feature (307)..(308): n is a, c, g, or t
  misc_feature (310)..(310): n is a, c, g, or t
  misc_feature (313)..(313): n is a, c, g, or t
  misc_feature (322)..(322): n is a, c, g, or t
  misc_feature (325)..(325): n is a, c, g, or t
  misc_feature (337)..(337): n is a, c, g, or t
  misc_feature (340)..(340): n is a, c, g, or t
  misc_feature (343)..(343): n is a, c, g, or t
  misc_feature (356)..(356): n is a, c, g, or t
  misc_feature (364)..(364): n is a, c, g, or t
  misc_feature (366)..(366): n is a, c, g, or t
  misc_feature (374)..(374): n is a, c, g, or t
  misc_feature (431)..(431): n is a, c, g, or t
attgttctggatgacctagctgctcttcacagccgcgctaaagaagagctccgtgctctctgtccttactctgcaatcaagaanctggagtcaagacccttattccatgggtggctttncctccttcaccccctaccagtatgtggactatgcccaggaactcagtcagccagaagggctggtcttcttcgcaggggagcacacagatctgcctcatggctggatcgacactgctatcaagtcaggactcagggtggcaaagaacattcaggaatctgtggacttggctttgncaaggaaccccagnnanacnaaagaatanttntccaaaagtganctntanacaactatacggnccccaggnantaggaggnttctaaacaagtttgtccatcaggagacaatgcaaaacccactctcactcatctttnccttcgctctgagacttgacctgaggcccacgactggagacctaaggtgactgcctgtgaccttggatttatgaca

SEQ ID NO: 2608 - DNA, 492 bp, Mus musculus
  misc_feature (292)..(292): n is a, c, g, or t
acagagcagaggtccccgaggtgaagtgtggcttgctggagcagacttgcttggtgctcatctggtgactgaccagtggcacaagaccacagagttgctttctgccccagaggactgaagtggttggctccattgaggacagaggctcaaggaagacagggtagcttggaagagacatctgccctagatccagctcacaggggttaactcagaagtttccagacttaactgggagtcagacactatacagtttccagaagaagaagagcagagaaggctttgggaaacaagntagtgaaagacttctgagcccaatgctaaaatgtgctctgtacaaggggcagctcgtagggaggaccgtcatctaccttaaagctgctgtccatccagagcctacaaagagctctcagagctcagtactgacaacattcggtcaacaataggaccagacttggtaacacaggcctttaaccacagcactgggcggcagag

SEQ ID NO: 2609 - DNA, 562 bp, Mus musculus
  misc_feature (102)..(103): n is a, c, g, or t
  misc_feature (115)..(115): n is a, c, g, or t
  misc_feature (117)..(118): n is a, c, g, or t
  misc_feature (124)..(125): n is a, c, g, or t
  misc_feature (129)..(129): n is a, c, g, or t
  misc_feature (131)..(131): n is a, c, g, or t
  misc_feature (138)..(138): n is a, c, g, or t
  misc_feature (143)..(143): n is a, c, g, or t
  misc_feature (150)..(150): n is a, c, g, or t
  misc_feature (171)..(172): n is a, c, g, or t
  misc_feature (197)..(197): n is a, c, g, or t
  misc_feature (199)..(199): n is a, c, g, or t
  misc_feature (223)..(224): n is a, c, g, or t
  misc_feature (304)..(304): n is a, c, g, or t
  misc_feature (337)..(337): n is a, c, g, or t
  misc_feature (341)..(341): n is a, c, g, or t
  misc_feature (345)..(345): n is a, c, g, or t
  misc_feature (347)..(347): n is a, c, g, or t
  misc_feature (357)..(357): n is a, c, g, or t
  misc_feature (371)..(372): n is a, c, g, or t
  misc_feature (374)..(374): n is a, c, g, or t
  misc_feature (386)..(386): n is a, c, g, or t
  misc_feature (400)..(400): n is a, c, g, or t
  misc_feature (403)..(404): n is a, c, g, or t
  misc_feature (412)..(412): n is a, c, g, or t
  misc_feature (415)..(415): n is a, c, g, or t
  misc_feature (417)..(417): n is a, c, g, or t
  misc_feature (419)..(419): n is a, c, g, or t
  misc_feature (421)..(422): n is a, c, g, or t
  misc_feature (425)..(427): n is a, c, g, or t
  misc_feature (503)..(503): n is a, c, g, or t
aagaactgcaagcaactgactgctgggagaaaaagaattagcttctctcaggaatgaacccccatataggttgtccagtacagagcagtcagtcagccttgnnatcatatatacncnnacaatnnaaangntagagtntattngtgcatntacataaatttatatatttanntatatatatatataatataaatatnanaaataaaaaagttttttcaattannaaaaaagacagaggctatcaacttgagaatagaaggggaatgagagggattcagggataggtcactaggagggcctgganagagaagccagataagtgatacagttctatttnaacntatnanatgaaaatanatatatatatatannanacatgtatttanaaagacattgttgntcnnaaaatatnagncnancnnatnnnaaacatttaaccttttctttttctggtgaattaaattaactaacatttgattattgaaataacttccgagttctcnaaatactcatacagtcaaggaatttaatgtattttgggtctgaatgcaatgaaccactt

SEQ ID NO: 2610 - DNA, 531 bp, Mus musculus
  misc_feature (106)..(106): n is a, c, g, or t
  misc_feature (156)..(156): n is a, c, g, or t
  misc_feature (159)..(159): n is a, c, g, or t
  misc_feature (380)..(381): n is a, c, g, or t
  misc_feature (414)..(414): n is a, c, g, or t
  misc_feature (470)..(470): n is a, c, g, or t
  misc_feature (495)..(495): n is a, c, g, or t
tcacgagtcctctcagacatctgttccagtgaaacatcacatgccccctttccaggcagctcccagaaaaacaccacatgtctgttttcagcaaaacaccctgccngccttagtaaaacattctctcatatgacagtttccagaaaaacatcacanganacaactgtgtctccaaagaaaccagaaatgtccacttcacctgtgatcttcccagaggtttaatactgtgttgctaaactctctttaacaccagaaactgagttcaacagactgtatgtggtaactattccttcacgtcccaacatcagatgggtaaacagaagatgagtccagtgaatccttaaactgtctcatggcaaaagaccggatagaaaaaaaanntaatgtttcacctaaaaggctcattttattttntctaattttttaattgaaaaatgagggggttttccctaaaatatactctaatcatnttttcttttgtcttcatataatctntaggagaaaaaaaaaaccctcatattatctcagtag

SEQ ID NO: 2611 - DNA, 471 bp, Mus musculus
  misc_feature (197)..(197): n is a, c, g, or t
  misc_feature (201)..(203): n is a, c, g, or t
ttttgcactacgtagccaggaccacactgttcctctcccagaggatcaatctatagaacccatcttggaaagtattatgtttacagagttttgatttaatcacaccttaaactttattatgcacatgggcttgagttaattatctccaggaaaagtttgctgaattgtgctgtacttaaatatgcctaaaaaaaaanaaannngaaaaaaaaaatctacctagtgtccgattcctaaagtgtgaaccaacactgacttctgagtcctgttgaaatgaactgctttcttacctcctccaatgttgctctgctggccatggttgcagatggctctgcaataccagacattgtcttctcattagactatttttagttgtgggtatgcgttttgtattttagcttcattgaactacatgcagtactcttctgaggaaatgacaaaggggagattaatatttctcacgttcactaa

SEQ ID NO: 2612 - DNA, 315 bp, Mus musculus
  misc_feature (142)..(142): n is a, c, g, or t
  misc_feature (192)..(192): n is a, c, g, or t
  misc_feature (194)..(194): n is a, c, g, or t
  misc_feature (241)..(242): n is a, c, g, or t
  misc_feature (251)..(251): n is a, c, g, or t
  misc_feature (253)..(253): n is a, c, g, or t
  misc_feature (271)..(271): n is a, c, g, or t
  misc_feature (290)..(290): n is a, c, g, or t
tttggacttggctccgttgcacccctgaacagaaccaacgttgctaggagaacacctgtgccccagcactttggtccagcaagggcaggagaggagagctggaaactggtagagctgtgctacctgctacctcctgaggctntcagggagcaggagaatctgaacatgagtggcaagagctgggtactgatntntactacttcgccccagagcctggaagatgagattctgggacggcttnntgaaaattntnttcgttttgttcgttganttaatgtccattatgtatntcgtcataacgtcctagcaacctga

SEQ ID NO: 2613 - DNA, 432 bp, Mus musculus
  misc_feature (312)..(313): n is a, c, g, or t
  misc_feature (317)..(317): n is a, c, g, or t
  misc_feature (331)..(331): n is a, c, g, or t
  misc_feature (336)..(336): n is a, c, g, or t
  misc_feature (358)..(358): n is a, c, g, or t
  misc_feature (404)..(404): n is a, c, g, or t
  misc_feature (407)..(407): n is a, c, g, or t
ttaagcacctactccgtgcgggtaccgtgctgcacctcttctgcaggaacgggagaccacacctgtgcaagccagcgccgccacgctttgtttactttcttgccgctcatgtgtagtccacacgtgactggtccagaaaaagtgcgtgagcgaataatttgcgtgatgtgcacaggatccgtgcgtctttcaggctggccacttaattcaaacggagtggggaagcttcctggaaggagtgtcctcaggactgagtctcaagagatacagtcttgccctgggttttagagtagccactgtttccctctcctnngggnatagattgactttnagacncagcagctgattggaggcacancctcctctcctgtttctccttttattgattgcctccaggtctcttngtntgagctgctttccaggtgttcctag

SEQ ID NO: 2614 - DNA, 236 bp, Mus musculus
gctaccggtggctacctcagcaggacccccagaaaaggaagtgcccaacaagcccttgcgtatgcgtgtccgagcctcagacgacaggctgtccgttgcatgtaaggcgccacgcctgtctggagccaagagcccacgaagatctcggggttttcttctgggctacggggaaagtggccggaagatgaattatgtcccactgaccagagatgagagatcacatgtagctcattgat

SEQ ID NO: 2615 - DNA, 530 bp, Mus musculus
  misc_feature (461)..(461): n is a, c, g, or t
  misc_feature (464)..(464): n is a, c, g, or t
tgaaaactaagcctttctgcctcaactcagagatgattagctaaaatatgtcccaattttcaatcctagttgatagtttatgtgagaaccatcacacatctaccattatgcaatgattgttaaattatacgatgatagctctagaaaaacatatggtccgcgcttgtatacaaagatactgttatacacactttgttgaatattttgtcagttgtatttacaacagatactttcttaagagaatatgttgttagtttttgatattattttaaagtcaaaatggtaaagattactgaatattgtattttagtcttgatcaataaaaaataaataaagagattttttgaatttcaagaagattataaatgaaagcaagacaacaatgtattttccgagtctgcaggagaaggaagcaaaacatgttctagttttatagctgctgctttgttaagcaaatgagntgnttcacaatattcaaaatattttgttgtgtcaaactggaccagtgcattatgccttttaccttaaat

SEQ ID NO: 2616 - DNA, 456 bp, Mus musculus
  misc_feature (320)..(320): n is a, c, g, or t
  misc_feature (329)..(329): n is a, c, g, or t
  misc_feature (379)..(379): n is a, c, g, or t
aagatcatcaccttgactttcccgggcatcatgattaatgttctaggagctgcctttgtgaatcagccgctcacagtccaggtggtcttctcaaacccgctctcagagccggttgaggactgtgtgctgaccttggaaggaagtggtctctttagaaagcagcagagagttctcattggcgtcctcaaaccccatcacaaagccagcatcactctgaagaccgtccccttcaagagtggccaaaggcagatccaagctaatctgaggagcaataggtttaaagacatcaagggctacaagaacgtgtatgtagacattgncttataaantctgagacagaggctggagagatggctcagcggttgacaggatgtgacantcctttgcaaaggacttgggttcaattttccagaacccacaaggtggctcacaatcctctgtaaccccattttcagg

SEQ ID NO: 2617 - DNA, 323 bp, Mus musculus
ggctacttcgatgtcatgggccagtgggacccgccgttcaactgcagctcgggcgacttcatcttctgctgcgggacttgtggcttccggttctgctgcacgtttaagaagcggcgactgaaccagagcacctgtaccaactacgacacgccactctggcttaacacgggcaagcccccagcgcgtaaggatgaccccttgcacgaccccaccaaggacaagaccaaccttatcgtctacatcatctgcggggtggtggctgtcatggtgctggtgggcatcttcaccaagctggggctggagaaagcgcaccggccccaaag

SEQ ID NO: 2618 - DNA, 321 bp, Mus musculus
  misc_feature (32)..(32): n is a, c, g, or t
aaccgtgcagcgtcctgagctccagaggtttnccagcacgcacgatctgcggcgccgagagctcttctccccagatgaattctcatagtatcacagaagcgcgcagtcccgatcgatactggatggcagacgtgctcccgccgtcaagtgtaggcacagggcggtggatttagctgccctgcagttcgctcgcagcttctcatcagctcagtactggcggagggacgttaacccgttcccgcgcggattcccgccctgtcgcggtggccgtccctcctctgacctcccgaggcggccgagcctttcagagcgacgcccagg

SEQ ID NO: 2619 - DNA, 543 bp, Mus musculus
  misc_feature (37)..(37): n is a, c, g, or t
  misc_feature (69)..(69): n is a, c, g, or t
  misc_feature (76)..(76): n is a, c, g, or t
  misc_feature (274)..(274): n is a, c, g, or t
  misc_feature (320)..(320): n is a, c, g, or t
  misc_feature (343)..(343): n is a, c, g, or t
  misc_feature (470)..(471): n is a, c, g, or t
aatgcagaacttgccgtgtgtgtgtgtgtgtgtgtgngtgtgtgtgtgtgtgtgtgtgtgtacttttanactgaancatgtaacttgtctcaaccccacaaaaaatttcaaaggaaaactgtacattagagcagcatatgaggaaggcactcccacacagtattaagaatgaaaccaagcagcttgtattaacagaaggagcagtcttctccttacctgtcttacataaccaacctccttactcatcaaatattcagctgcacccctatgtcantgtatgggcttagtatacctcaactaagtaatacaaagaaataaanaagtgctatctcctgtaggcatncttgggacacccaatacttggtgtcaagacactgatctgagctaaatgtctacaacttttctctattaaaagaccgactttccaagagttagcaaattctccaaacagttctatactgaaaaactanntgaagttgtgtagtgtcgaattctggttgataactttagggacaaccgttggctcacatccacagtattgga

SEQ ID NO: 2620 - DNA, 527 bp, Mus musculus
  misc_feature (244)..(244): n is a, c, g, or t
  misc_feature (252)..(252): n is a, c, g, or t
  misc_feature (271)..(271): n is a, c, g, or t
  misc_feature (278)..(278): n is a, c, g, or t
aagcccaagatttcagcggtctggcgatggaactgagttttgtccagtgaacagtagatgttgtgataccgaaagcggaccaggacttggcggacatgctgggagtgttcctcctggctcattgagtagaccaggacctctctgccatggcaaatcacaaacaaccctaggatgtcttttaggatgaagtgaacaatgttgttcccttcgtcagagtatgagttcattgtgaagggccggtagnatctcatntggtgaaggccgaaaccgnacgatgntctccaagtgtcttccgtgtgtgtgaccgtgtgcctcatctcactttccttaatcccaagcagctccagttttgtgaaccatgccgctccatgtagctggtcgaatagctctggtaccatctgcgtgtagtcttgtctgtcagtcagcatgtcatacagtatccagtattcctcttgctccctggctttctcttgctgcctggctttctcttgcatcctggcgctcacaggttccaaagtctctcgggc

SEQ ID NO: 2621 - DNA, 543 bp, Mus musculus
  misc_feature (311)..(311): n is a, c, g, or t
  misc_feature (319)..(320): n is a, c, g, or t
  misc_feature (323)..(323): n is a, c, g, or t
  misc_feature (329)..(329): n is a, c, g, or t
  misc_feature (379)..(379): n is a, c, g, or t
  misc_feature (390)..(390): n is a, c, g, or t
  misc_feature (393)..(393): n is a, c, g, or t
  misc_feature (433)..(433): n is a, c, g, or t
  misc_feature (490)..(490): n is a, c, g, or t
tgaatcttgatcatgggcatccccattcccaggcactgctcttggcacacgctcctggtctggtgcgaaggtaggcacataattggtgctcctgatgtggtgatcaaatggatacgtagtcagtgctcttaactgattatgtagtcatgatgggtgcttcggtttgaacgaagacacatattagattcttatgatcttttaatacatgaaagggatttaggaagaggtcggttcaccaggagtaaggcggggataatgcccccccacccccatttcccctgtgtggataatgtcgcagtgctgccgggttnaatattanntgncagatngacccggagaaggccagctctgggacctaaagcttgcttccaggaagagnctgttaaaggnccnccgaacatcactagagtctgaggcgagggactgcaaagcnccctctcccggcatcttgaatctgcaatttagttattctgttattctgttaacccanccctagtgcagtatctcacctaagctgactacaggaactgaggcacatcggta

SEQ ID NO: 2622 - DNA, 458 bp, Mus musculus
  misc_feature (340)..(341): n is a, c, g, or t
  misc_feature (353)..(353): n is a, c, g, or t
ttacagttgcagaggcttagctcatttttgtcatggcaggaagcatggcagcatgcaggcagacatagggctggacaaggagctgagagttctacatcttgatctgcaggcagcagaagcaaatgtgtccacctggatatagcttgagcatatataagacctcagagcctgcctacacagtgatacacttcctccacaaagcaacacctattccaacaaggccacaccaactaaaagtgccacacctttggccaagccttcaaacacagtagtctatgggggccattacatattcaaacaaccacactggatgaataaatgaataagtggactgtggagnnaaaaaaaaaaancctggatgcctattcagttcttgtgcttactagatatgattttcattagtaatctatcatctctgaacctatttgctaacctctgaatttaggtcggttccctgt

SEQ ID NO: 2623 - DNA, 457 bp, Mus musculus
  misc_feature (250)..(250): n is a, c, g, or t
  misc_feature (257)..(257): n is a, c, g, or t
  misc_feature (271)..(271): n is a, c, g, or t
  misc_feature (275)..(275): n is a, c, g, or t
  misc_feature (300)..(300): n is a, c, g, or t
  misc_feature (315)..(315): n is a, c, g, or t
  misc_feature (371)..(371): n is a, c, g, or t
tctctctacagagggctctgactttgaaaatgccctgcatgctgcagtttttccccagcccacagggactcctgctggggcatcttgctaggaggtccacgtgctcccgtgctccccacgtggatagattagatgtctgtgggaggactgcccagaaactgttgcaccttctgaaatgacaatgcaaggtgccgaagggtaaaaatagccctggatcaacacatgagtcaatggctgtatttaaccaatnttctgtnagggaacaaaaaancctnaaaatgccaccatgctgaaaataangggcaattaaagcanaccgaaccgaacccatgatatgacttgtggcagccaagtgttctccagaagcctcnttcttggagagctaattgcacggggtttccagtctttagcttccccctcaggtttcctactgagccctttactcttttatatttga

SEQ ID NO: 2624 - DNA, 565 bp, Mus musculus
  misc_feature (357)..(357): n is a, c, g, or t
  misc_feature (359)..(360): n is a, c, g, or t
  misc_feature (362)..(362): n is a, c, g, or t
  misc_feature (364)..(366): n is a, c, g, or t
  misc_feature (368)..(368): n is a, c, g, or t
  misc_feature (420)..(420): n is a, c, g, or t
  misc_feature (466)..(466): n is a, c, g, or t
  misc_feature (484)..(484): n is a, c, g, or t
  misc_feature (512)..(512): n is a, c, g, or t
aatttcccctaagccagggcagaaggcaaatcaatcgaaaggttcgtttcaaggctggcaaggtccctcggtggcagagaatcttgtcactgaggaagctgccctaagtttaattctcaggatgcatgtggtggagagacctgactcgtgagtagtcctttgacctacacacacacatagacacacatacacacaaaccatttaaaaaaaaaaaaagcttgtttcggaaagaataggaggttctgagtgtcatgggagaaggggagtcccacagtcctgcatggaggaaaggtcaggcctaacaaccaggctctctaccctaggcagatttccgaggccttcaacaggccttggtgnanncncnnncncccttaccccccccaccaccacagcaccacagggatcccgttcctttttttntgccacagggtaagaactgagattcttgaccacccgcttaggcatntcacagggagaaaggttntcaaagcccagcaagggcttgctgtaantttccctacagcaatgcaggcgccaattcccaccttattcctggttacgatga

SEQ ID NO: 2625 - DNA, 145 bp, Mus musculus
  misc_feature (29)..(29): n is a, c, g, or t
  misc_feature (33)..(33): n is a, c, g, or t
  misc_feature (39)..(39): n is a, c, g, or t
  misc_feature (50)..(50): n is a, c, g, or t
  misc_feature (63)..(63): n is a, c, g, or t
  misc_feature (117)..(117): n is a, c, g, or t
ggacctgtacgtgccgcggaaatgctccncaancaaccncatcattgctnccaaggaccacgngtccatccagatgaacgtggccgaggttgataggaccacaggccggtttaatgnccagtttaaaacctatggcatctgcggg

SEQ ID NO: 2626 - DNA, 489 bp, Mus musculus
acagagatagccactgtgtctgcttagcctcatgttagaaaacgttttccatttgccaggaactcccacataattatcatgggagtctcaataacatgagagggagccctcttgtacaaatgaagatatcagcaaacagcaagcagtaatcactggaaggtgggagagaggtgggggacccaaggagaaagccacactctccgcccctggaagacagacagggagattggggtgtgtattattataaaagaagatattgaccatggtatgaggcagacttgcaatggtatcttgcacttttgcctcatgccagctttctgcacttcagtgtcctctcctgcaaggcagcgctaaccataagacctcctcgaccatgagtagtgtactttctacacgtgaaccttttgatgcacttgcctgcaactgagagttcagctgagacttaagagtgactaaggaagcattagtgacagtctctaagccagcctg

SEQ ID NO: 2627 - DNA, 459 bp, Mus musculus
  misc_feature (268)..(268): n is a, c, g, or t
  misc_feature (309)..(309): n is a, c, g, or t
  misc_feature (330)..(330): n is a, c, g, or t
aatgaatctgtccattttgtcctggaatctgcattaatggacaggcatggctgtcacatagactaggaaagcctcagaatggctgagcatgttcacaggcacagccgagtagtagtgcctagtgactacagtggctgttggctgcatgttgacactggaggtctcagtagcagtgtgtctctctctctcatgatcttgacatttctttctagccatgcccttccttgccctttacctacctcactggggtctatgctctagctgcttnagcctcagtaccctgaccaggcctggtgccttaggagcctntggctgctccttggctgttcntccccacggtgcactcctgccattgttgcattgttgtgccattgttgcagcccctatgctggcatcagtggcatcagacgctgtccagtccatgtggccttcaaaaggaccagcactaagtttgccagt

SEQ ID NO: 2628 - DNA, 502 bp, Mus musculus
  misc_feature (327)..(327): n is a, c, g, or t
  misc_feature (335)..(335): n is a, c, g, or t
  misc_feature (346)..(346): n is a, c, g, or t
  misc_feature (350)..(350): n is a, c, g, or t
  misc_feature (353)..(353): n is a, c, g, or t
  misc_feature (365)..(365): n is a, c, g, or t
  misc_feature (367)..(367): n is a, c, g, or t
  misc_feature (371)..(371): n is a, c, g, or t
  misc_feature (387)..(387): n is a, c, g, or t
  misc_feature (394)..(394): n is a, c, g, or t
  misc_feature (398)..(398): n is a, c, g, or t
  misc_feature (413)..(413): n is a, c, g, or t
  misc_feature (416)..(416): n is a, c, g, or t
  misc_feature (421)..(421): n is a, c, g, or t
  misc_feature (427)..(427): n is a, c, g, or t
  misc_feature (429)..(429): n is a, c, g, or t
  misc_feature (436)..(436): n is a, c, g, or t
  misc_feature (463)..(463): n is a, c, g, or t
  misc_feature (475)..(475): n is a, c, g, or t
gcccctccaggttgcatttgtatttggggccacagtggtgtttgggtggctcacgtatttattgtcgagattgggtcgtctttgagatttctggtgtggttgtgtgtgtgcgcgcgcgtgtgtatgtgtgtgtaggaaggggggagccaacgcggatggcggtggagaaaggcaagctgagaaggcttgtcttattgtatccagaggcagtatgcctcgggttcttggaaaggtggctggttagagccggacaggcagcttttccaagtgcctttgcgatggcccttcccctccccctttggtagctgtgtaattacacacccatangacttttncaaatggtatncctngtntggtgggaattntncagngggtttttgaagaccntttcctncctnccaagaagggagcanttntggtnttttgntntggactnttcgtgtgagtggcaccttggccaccntcgaggattgcntcagtgctgctgcgacccaggcagaga

SEQ ID NO: 2629 - DNA, 417 bp, Mus musculus
ggctgtgttacttaccatgttttcaggattcattcatgttgcagactaaattaaaatttcattctttttaagactaaacagtactccattgttgtatttgctacatttttgcttatatgttcatctcttgaagggcccttgcactgcttgcactttgggctgattaaaatcgatgtaaaattgtctttaaaaccttgcattgtctgcatttccttggaacatatgcctaatagtgaaatggttggtggtttttctagcttcccggggaactccaggctgttttccatagactgcaccattttacatcccattaggagtgctgaggcagcttccctgcatccttgacagtgcttgctctttctgttttcattggcagtgggagtaaaaaaggagtgtccaagggcattcatggttttt

SEQ ID NO: 2630 - DNA, 435 bp, Mus musculus
agtgacttatcttttcacccaaagaagagaagttggatttctgggcttcctttttctgtgtagaaacactccttgctattcttcaggactcagctctgctgctatctccaggaagagacctggcgcccccaggttgggccacagtcccttttctgagtgtgcatgcaccttgtttctcgcttagtgccagccagccagtgctgtcgtcacctgtgcttccccttgagagtttggagtggagctcagaggtagaatattcacttagctcacacggtatgctcagccccctgttctgtaattcgacaacagattgtccatttaaacagctatcctggactggagggatggctcagtggttaagagcacttgctgcttgggttcaattccagtcagggtggctcacatctggaattccaattctgactctggactggc

SEQ ID NO: 2631 - DNA, 539 bp, Mus musculus
  misc_feature (429)..(429): n is a, c, g, or t
  misc_feature (446)..(446): n is a, c, g, or t
  misc_feature (453)..(453): n is a, c, g, or t
  misc_feature (457)..(457): n is a, c, g, or t
  misc_feature (471)..(471): n is a, c, g, or t
  misc_feature (474)..(475): n is a, c, g, or t
  misc_feature (480)..(480): n is a, c, g, or t
  misc_feature (486)..(486): n is a, c, g, or t
  misc_feature (492)..(492): n is a, c, g, or t
gtgccctggaggttcttggaagacttgtaagaagatacagaaggtagaggaaagagatcttctgagctttactggccctaaatggctacagaaccaagaaagccttcttcagccccatctccaccagaccaggctcctgaagaggatcttgtcattgtcaagatagaggaggatcatggttgggatgaggaatccggtgtgcatgagaacaacacacctggccaagaactgtttcgtctacgcttcagacagctctgctaccaggagacattaggacctcgggaagctctgatccagctccgtgcattttgccatcagtggctgcggccagacttgaacagcaaggagcagatcctggagctgctggtgctggagcagttcctgaccatcctgccaggggagctgcaggctctggttaaggagcaccanttacagaatggagaggnaggtggntaanccctattggagganctnnaaagncaaatnaatgtnctagggcggccagtaagtagctgtgcatgctgtgactgaattcctga

SEQ ID NO: 2632 - DNA, 366 bp, Mus musculus
  misc_feature (228)..(228): n is a, c, g, or t
agcaaactaagcatcctaaccgggagaacgtgagtggggtccagctccatgggaatgcactaactatctgtgcaggtgcccactaagcccagaacagctcccctggagctggaataaagcagctgtgagccaccaaagtcgagccctcttcaagaacagcaagtgttacccaacccagattcatccctctagccctggtgtatatgtgctaaggtccggaaagtggtnggtaaagaaaggctaatggggccggacatgatggcccacgtgtttaatctcaacactaaggagatagagacaggcagagctagcctggtctataggaagtttcacgcaagccagggctacttaataagaccctgctaa

SEQ ID NO: 2633 - DNA, 517 bp, Mus musculus
  misc_feature (72)..(72): n is a, c, g, or t
aatcacttctggagtatacactgtccaaagcaggataaactggcactgcagtcctgaggctaattatgaaanggtgcagaaactttgatcgggcaacactctgcttcttaggccgggtgttagctgtgaaatgagggatggactcgatatttaaggtccttttcagctgaaaaactctgattctaagatgtacttcaattctgtcaatcgacagctctgcagcttttgaaggacttgctggagtccctcgaggaagaaggccaactttaatcccttagagggagatgggagttaatttataaaacacacaacactagctgctatcaggttccaggtacagcgcagtgcgttacctaagcaactgataacggcttgattcctccaaatgagtgctagggagacgatgatataagatgggggccagaattcaaaatgaaaaaccactgggctaagagaaaaattaattattagggtagggggctacttgccctagatgctaggtactcacaaactggat

SEQ ID NO: 2634 - DNA, 509 bp, Mus musculus
  misc_feature (441)..(441): n is a, c, g, or t
  misc_feature (448)..(448): n is a, c, g, or t
  misc_feature (472)..(472): n is a, c, g, or t
tgcccagttcctgtgtaactacaggggccatgtgtcatgtctcaggatggggtactacaaacaagccatgggacccattcccagaccggctccagtgcctcaacctctccactgtctccaatgagacgtgccgggctgtgtttcctggaagagtgacggagaatatgttgtgtgcaggtggagaagccgggaaggatgcctgtcagggtgactctggaggccccctggtgtgtggaggggttcttcaaggtctggtttcctggggatctgttgggccttgtggtcaaaaaggtattccaggagtctacacgaaggtctgcaaatacacggactggatcagaatagtcatcaggaataactaagtgactccctcagcctgcatgcagctctgcttagggaccgctctgaccctcggagcaccaaggtctcctccctcaccantccaggntcccacccttgtgagcttagaacntcttgaaacctcgactacacccatggcagcggagagg

SEQ ID NO: 2635 - DNA, 434 bp, Mus musculus
  misc_feature (153)..(153): n is a, c, g, or t
  misc_feature (245)..(248): n is a, c, g, or t
  misc_feature (327)..(327): n is a, c, g, or t
  misc_feature (329)..(329): n is a, c, g, or t
  misc_feature (342)..(342): n is a, c, g, or t
  misc_feature (356)..(356): n is a, c, g, or t
aatagttttaagcagccacatctacatatttctgagtatttcgagtggtacagatttctatgtgtttatataataaagtatatttattttttcatgttatttaatttcataagcaatgttcaaaaactagcatgtgtaagctgactatggagncaataggctacatgaattagaaatgaatgtatgtttcttttgattaaaaatatacatatatatatatatatatatatatatatatatatatnnnntaattttgtaaactctgtcttgttgcccactcctaaattctgagcagccgtgtattaaacttcgtgtcgttgactaggntnaagtgtgcatttngaaaggttactttnaaagaattccgaatcagaagtgatgatgagtttgataaacaaaaatttgtgaggcctaacattgtgttcggtagctct

SEQ ID NO: 2636 - DNA, 535 bp, Mus musculus
  misc_feature (29)..(29): n is a, c, g, or t
  misc_feature (116)..(116): n is a, c, g, or t
  misc_feature (135)..(135): n is a, c, g, or t
  misc_feature (150)..(150): n is a, c, g, or t
  misc_feature (256)..(256): n is a, c, g, or t
cattgttttatgttgggctgagtaaagtntgaggcagccctgagcgactggcttgttgagttgctacctatagtaaccaagtctgtggcttggagcatgttggttattggaaagtntgaaggtaactaaactgcnacttaggcttagacngggcctaagcatggttgtctttggtcctagacagttgtccttggactgggatctaatgaaagggaaagttgatgagttttttttttttgttttctttttttttttnaacctcacaaaatgctgagggaagctttgttcctgtgtgtgtagtatggtctcccccgcagcactttcagtaaagaggtggactgaagcctgcagtggtgcccacacctttaatcccagcacttgggaagcagaggcaggtggatttctgagttcaaggccagcctggtctacaaagtgagttccaggacagccagggctatacagggaaaccctgtctctcttgaaaaaccaaaataaaataaaataaaataaaaagttaactgcctatatctggcaa

SEQ ID NO: 2637 - DNA, 561 bp, Mus musculus
  misc_feature (238)..(241): n is a, c, g, or t
  misc_feature (387)..(387): n is a, c, g, or t
  misc_feature (394)..(394): n is a, c, g, or t
  misc_feature (403)..(404): n is a, c, g, or t
  misc_feature (406)..(407): n is a, c, g, or t
  misc_feature (420)..(420): n is a, c, g, or t
  misc_feature (426)..(426): n is a, c, g, or t
  misc_feature (429)..(429): n is a, c, g, or t
  misc_feature (441)..(441): n is a, c, g, or t
  misc_feature (455)..(456): n is a, c, g, or t
  misc_feature (458)..(458): n is a, c, g, or t
  misc_feature (469)..(469): n is a, c, g, or t
  misc_feature (471)..(471): n is a, c, g, or t
  misc_feature (475)..(475): n is a, c, g, or t
  misc_feature (482)..(482): n is a, c, g, or t
  misc_feature (491)..(491): n is a, c, g, or t
  misc_feature (500)..(500): n is a, c, g, or t
  misc_feature (510)..(510): n is a, c, g, or t
  misc_feature (517)..(517): n is a, c, g, or t
  misc_feature (527)..(527): n is a, c, g, or t
agataataacccttgaaggcacggggatgggaggtatttgtcatggggcttacaggcacagggggacgtgttttcagaatggttactccccgcaaagctgtcttatctcaagcctggtgatatttctaaggcgtcatttgtattattgtttgtgtgactcctggctccttttccctctccctgcacgggtgactgaacctagctgctcacataagacagacaagcctttcccaccaannnncttcctaactctcttttaacttttgttttgaaataggaggtcaccggccgtgaactcatggctcctctgcctcagcttcccaggtagcctgggtgacaggcctgtgccaccgggcctggctatgactctgcttccgctttctcaanggtcccntttgctcanntnntgatgacacaggncaaccnatntcacagaggacntgggggaggggganntntcagttttgantnttgnctcaggntctggctgncacctcggncctccagatntctgctnctttcagatntctgtagggacctgaccagacacagagggcacgg

SEQ ID NO: 2638 - DNA, 435 bp, Mus musculus
  misc_feature (94)..(94): n is a, c, g, or t
  misc_feature (151)..(151): n is a, c, g, or t
tccctcctgggaaatgctggtgcagggtctcaatggccttaccctcagcttgggagccaacagacccgtccccctgccagaggaaccttggcancagcaggagccagaggacatgcgccagctggagaggcagcaggaaaacctgaagatnttccagaggatgctcaagtagaggatgtaagaaggcggaggtgctgactcacagatgataaatacatttagaaggtgctgcattggtgtcttatgggtgtgaactcctctgaggtcaaagcagtccactgccagtggatgtgtcccaacacttgtgctatgatgtgaattgtccttggaaagatctcaactaccctgcctgtcttttagcatgcctttttggatgtggtgctaagtgttagcctatacagaagaaacctgggtacacgtgatccccaaatatgt

SEQ ID NO: 2639 - DNA, 544 bp, Mus musculus
  misc_feature (113)..(113): n is a, c, g, or t
aaaccctcgctgacagttggcaggactgagttgtgatgcaaagatctagaaatccctccagatcactatgaaaaacccacagatctgcaagcgctacctttatacagtgcccngcccctcctgccttacccttaaatatcaatggattccctcttacccaaaagctgggcaataaacacataaagcaaagaaagataaactttgaagaaaggggctgggtgttggagacaggaggaacacatgttataaggtaaaaacaggaaaataactccctcagattagaaaggcaagaaaaattctatgatgaaacaaaactatatccctaattaacttaggaatcttcaaaatatgagctagacctcttggaggcagaatctgtaggtagaaataaaaattcagtggaagggaagagacattaaacatcctagaaccagcacacatatgcacactgcacacgcttgaaataacaaaaagaaagccaggcatggtggcgctcctctaatcccagcactcagaaggcagaggtaggcctgtctctgagttt

SEQ ID NO: 2640 - DNA, 530 bp, Mus musculus
  misc_feature (336)..(336): n is a, c, g, or t
  misc_feature (430)..(430): n is a, c, g, or t
ggctagcctcaaacatgaggtccttctgccttggcctgcctgttgctgagactgcaggtatacattacccctgactgtgtgccgatggggaagctatgtggcacagcatggagcagaaacacgtaagggaaggttattcaattagcatattgatatcacccatatcacataggatgaaatgaatttctgacatttgtttttaattaataatttccacttgtttttggcccaggactcctatgtgtttactgcacatggctttccccaccccccaattagagggtagatttcaccctttatctttgcaggtaacagatccaagacatttttatgtanatggactaattaattggtagccttcatttgaagcttaaaataaaagtaatccttttggagaggcattagctatttctaaagccacaaacaattntcccttaagcaccttgttacaattagaacttaagttaacagcagcagacataatggaaggcgttaccccttacctaagaaccttgttttcccagagtgat

SEQ ID NO: 2641 - DNA, 512 bp, Mus musculus
  misc_feature (287)..(287): n is a, c, g, or t
  misc_feature (295)..(295): n is a, c, g, or t
  misc_feature (299)..(299): n is a, c, g, or t
  misc_feature (306)..(306): n is a, c, g, or t
  misc_feature (314)..(314): n is a, c, g, or t
  misc_feature (329)..(329): n is a, c, g, or t
  misc_feature (332)..(332): n is a, c, g, or t
  misc_feature (338)..(338): n is a, c, g, or t
  misc_feature (350)..(350): n is a, c, g, or t
  misc_feature (353)..(353): n is a, c, g, or t
  misc_feature (361)..(361): n is a, c, g, or t
  misc_feature (385)..(385): n is a, c, g, or t
  misc_feature (398)..(398): n is a, c, g, or t
  misc_feature (423)..(423): n is a, c, g, or t
  misc_feature (425)..(425): n is a, c, g, or t
  misc_feature (462)..(462): n is a, c, g, or t
  misc_feature (464)..(464): n is a, c, g, or t
  misc_feature (472)..(472): n is a, c, g, or t
aattgtttaactgggcttacttctgttgtttaccccacttccccctctaaaaaattatgtgaacatagccaatggtaatagtttcatctttttatataaggctctcaagagaagctatcaaaaatttaaatatgatgccatccaaatatcatttcatttgtgttttaaatgaagacagcttttaggagttgaaacttctacgttataaaataaaatgcattgagtttctttctctctttttaactttctcttgtacttaaaaatatgtgtcttcatgactgtatggnagatggtntgancagattnttcctttnagctccctgtgtgtnagnaaaaanatcagagacatnttntactgcanagctcaggcacaggacccaagctnacatggtgacatntttctgccagaaggactccttcagntntttaggatgttcccccagaatccttgtgatcatgttntntgccactntcatcctttttagcagcccactttctgtacacagtcatgg

SEQ ID NO: 2642 - DNA, 483 bp, Mus musculus
  misc_feature (329)..(329): n is a, c, g, or t
  misc_feature (333)..(333): n is a, c, g, or t
  misc_feature (341)..(341): n is a, c, g, or t
  misc_feature (347)..(347): n is a, c, g, or t
  misc_feature (353)..(353): n is a, c, g, or t
  misc_feature (362)..(362): n is a, c, g, or t
  misc_feature (372)..(372): n is a, c, g, or t
  misc_feature (381)..(382): n is a, c, g, or t
  misc_feature (390)..(390): n is a, c, g, or t
  misc_feature (411)..(411): n is a, c, g, or t
  misc_feature (430)..(430): n is a, c, g, or t
  misc_feature (433)..(433): n is a, c, g, or t
agaggagtacgtcctgtccaaggctccgaccaccactgggagcgagcagcggctgaaggaggccgccagcagcaacaacaacagcaacagcaacagcagcacctcccgggcttctgtgggctccatcaacgccaggaccaccagtgacattgccaaggagctagaggaacagttctacacgctggtcccctttggcaggaatgaactactatctccgctaaaggacagcgatgaggtcaggtctctctgggtcaaaattgacctgaccctcctgtccaggatcccagaacacctgtcccaggagcctggggttttgagtgctccttcgnccanggacactnatagtnccccanccagtcatncattagacgntcctgctgnnaagacttngccaaaatccaagaggaaacncaagtgcgacaacgaagangantacagggagataaagaaggtccagggaaggaaggagagtgcctcacgcct

SEQ ID NO: 2643 - DNA, 292 bp, Mus musculus
  misc_feature (193)..(193): n is a, c, g, or t
attattagggtatcagtctggcggagggagtgcgggtgaggaccacgtgaggaggaaactgtatggagatgccgtgacagcttctctgcatagtaacttccctctcctgctacagctttcagaagaattgttagataaatggctgtcctatccagagacccagcacatacctctgagccagcatatgctcggntttgctttgaagtttgtcacaaggatggtactgggtagcacctttgaagatgaacaggaggtcatccgattccaaaagattcatggcacagtgtggtct

SEQ ID NO: 2644 - DNA, 358 bp, Mus musculus
atgatcctttctttcttgtattactatcatgccttgtatgtcttaatcttatgctaaagaaaaaaaaacaaacaaaccaggagccaatcataagtgaggctgcactcaaatgcacaatatcttgtctcaatgagaaatactgcacacaaagtaaatacttcattgttcttagaaatgtttcctggtaataatctcaagtgtttgctagagggaaaatgataatttctggttgcatcctttgtttacatgtggcccacatataaaaatcaaataaattcattatgttcgcaaccagtacaaaagaagaaacaaacaaacaaacaaacaaacaaaaaacaatcagtgacccgtggcagca

SEQ ID NO: 2645 - DNA, 501 bp, Mus musculus
  misc_feature (272)..(272): n is a, c, g, or t
  misc_feature (274)..(275): n is a, c, g, or t
  misc_feature (316)..(316): n is a, c, g, or t
  misc_feature (321)..(321): n is a, c, g, or t
  misc_feature (360)..(360): n is a, c, g, or t
  misc_feature (362)..(362): n is a, c, g, or t
  misc_feature (381)..(381): n is a, c, g, or t
  misc_feature (431)..(431): n is a, c, g, or t
  misc_feature (433)..(433): n is a, c, g, or t
ggcaaaacctgcttacatttccattctggcttcagggcaagatctctacaggttttcccagagtcctctttgggtagggtcagtatcagtgggcaaggggcagcagctggtatgggacagagtggagccttctgttgcctgaattctggaagcgcctgtgggtgtgttccccaggccctgctttcttctgtgcccagtcagctgctgggctcctcatgccttctgtgtgctcacggagccccatctgcatgcagtgaacatgtgaacaccantnntcatttgagaaggcaacacgggcctagatcccagtcctggnctggntggaggtaaccagctccttggcctaacctgtgcgctgcntntggcctatgaaaaggtttnttttttcctttgagccaggcaggaagacccatccttttcagacccaagtntntcccttcctgttggccaagagtcatgttagggaactgaggagggctgctgttcaccaaagtctgtttg

SEQ ID NO: 2646 - DNA, 521 bp, Mus musculus
  misc_feature (290)..(290): n is a, c, g, or t
  misc_feature (295)..(295): n is a, c, g, or t
  misc_feature (298)..(298): n is a, c, g, or t
  misc_feature (317)..(318): n is a, c, g, or t
  misc_feature (327)..(327): n is a, c, g, or t
  misc_feature (330)..(330): n is a, c, g, or t
  misc_feature (345)..(345): n is a, c, g, or t
  misc_feature (364)..(364): n is a, c, g, or t
  misc_feature (427)..(427): n is a, c, g, or t
  misc_feature (486)..(486): n is a, c, g, or t
tatagtccccgtaggcagcagctgctaagatgggctatcggctctgagagctgcacccttctgtaaacaccacaccgactcctctctcctgctgccctgccccaacctatttaagctttcatctgcttccaagtccccagtggttcctgaaaggcgagtgcctagtccagcctgtgaacaccccatttctggaattttttctgagctacctgtagccaggcatgacatgtagatggctggtccagccccttctcatagcatagcaccctcagcagccttccaaccttctncttanacngagaagccccctcaataanntttgggcanatntagtgactaaggggnacttactttgtcagatcgnaacaggatcccaaaagacagagcagttgctcacaactccatccacacctggagggtggctttntcccacctgaagtgacatgaccatggacccagatcagattatttggtggaatctgcctntctgaagtgtgttcattagttgctttcctgtgact

SEQ ID NO: 2647 - DNA, 113 bp, Mus musculus
gagagaggaggctgctcccctggaagagccattacatcgttgggagaacagcacacagtattacctcgtcagagccctccactcagccctgctgtagggtgtgggaagccgcc

SEQ ID NO: 2648 - DNA, 191 bp, Mus musculus
agtgctccgttcctcagctcgagatggacagccgctacaccagcgccacgggcatcggggacttgaaccagctgagtgcggccatccccgccacacgagtggaggtgtcagtgtcctgcagaaatctccttgatagagatacattttctaagtcggatccaatttgtgtcctatatacacaagcagttggg

SEQ ID NO: 2649 - DNA, 389 bp, Mus musculus
  misc_feature (155)..(155): n is a, c, g, or t
  misc_feature (165)..(165): n is a, c, g, or t
  misc_feature (167)..(167): n is a, c, g, or t
  misc_feature (182)..(182): n is a, c, g, or t
  misc_feature (195)..(195): n is a, c, g, or t
  misc_feature (206)..(206): n is a, c, g, or t
  misc_feature (208)..(209): n is a, c, g, or t
  misc_feature (211)..(211): n is a, c, g, or t
  misc_feature (221)..(221): n is a, c, g, or t
  misc_feature (244)..(244): n is a, c, g, or t
  misc_feature (247)..(247): n is a, c, g, or t
  misc_feature (249)..(249): n is a, c, g, or t
  misc_feature (255)..(255): n is a, c, g, or t
  misc_feature (267)..(267): n is a, c, g, or t
  misc_feature (272)..(272): n is a, c, g, or t
  misc_feature (294)..(294): n is a, c, g, or t
  misc_feature (308)..(308): n is a, c, g, or t
catggcggtccttttttggctaccgtccgccttccagagcctttttggccactgtcttacccttcgcccgagctggcaccaccacatcccctctgggggcatgcgcgcttcctgcaagctccgccccctagagggcgtgtctccctctagtggcnttgatgggtntntgcagagtgcaggtntgcatttacctgngccgcttccantnntngcccccaagntactggctgagatcactgcaggntgntntttgcntgggcaacctgntcccntcatgtttgtgggatgggattntcgctttctttatntgcaaaacaaacaagagacccacctttcttaagagctagtttgggagttccgtatattgggtcagttatagggtttttcag

SEQ ID NO: 2650 - DNA, 276 bp, Mus musculus
agtccagggtcttaggtgaaagcctaatattgctgttttgctgaagatccaagttgccaatctgccttctaaatatatgtttagacccattggtaggtgctgccctcaacctgggtcagagaagatgtttcctgacatacaaaaaggtcctaacagtctgtaggataggcaggagtgttatgaaatgttgtcttcttgatatgacgtggctatggctctcatgaactcacaacagctgtggttacctgcatgagacttctaaaatattccatcatg

SEQ ID NO: 2651 - DNA, 65 bp, Mus musculus
tgcagatggaaaaagcttcttgctggacttgcccatgggtgacgtccccatggatggaatgtctg

SEQ ID NO: 2652 - DNA, 413 bp, Mus musculus
agagccctgcttgtaacactcctttctcagagagtctttcctgtgtttgcctaaattgtcgtacttcctcttcactgactaggtttctttgcactcgtgcgccaacagcttgccatatcagaactaaaatgctaaaggtgccaacttagggcttgagtccaagggagatgagtcagagcaccacttggggactgaggaattgccttttgtcatatgctgtgaccaggcagttggtgtcaggcggagctggtgggattcatttcactaaacattgtttaatccttgagtcccaggtggcctgggttatataacaagacaggaagggaaataaagacagctgggaaggcaaaacactggtttctcattacccgaggactaaatgatcaaaggtgagctagaaacccctgattggg

SEQ ID NO: 2653 - DNA, 291 bp, Mus musculus
aatatatgcagattcacaggtacctgcgcacattatatgcataatgtggaagccagaggttgacatggggcatctgccttagttgcttcctaacttatacattaagtatggtctctcctttgaacctagagcgcactgattcaatgagtccagctatccagctttctctgggaactccctagctcctcttctccgatgctagaatttcaggcaggctccatcacacttgcctgacatttatgtggctactgaagatcccaacttgcactgtcatgcttgtccggcaaacaa

SEQ ID NO: 2654 - DNA, 313 bp, Mus musculus
  misc_feature (119)..(119): n is a, c, g, or t
  misc_feature (136)..(136): n is a, c, g, or t
gaggttcagagctgagcaccatcagccccatccaaacgggaattggaagttccatggtggggaccagatgggacctttgcccatctgctgggtaaagtggattctggtgactaagtaantcttgtgcgtctcaagnatggcgtttccccaattttccttgtgagctctttagaaaagacaacctgtagactgttaagccctcttctggccttctcagggcctttttggatccctgaaacaacacattccctgacctttctgtcctcaggaggtcactaatactcaagcatgaacgaacaccagcttgctagaa

SEQ ID NO: 2655 - DNA, 490 bp, Mus musculus
  misc_feature (342)..(342): n is a, c, g, or t
  misc_feature (352)..(352): n is a, c, g, or t
  misc_feature (381)..(381): n is a, c, g, or t
  misc_feature (383)..(383): n is a, c, g, or t
  misc_feature (389)..(389): n is a, c, g, or t
  misc_feature (403)..(403): n is a, c, g, or t
  misc_feature (412)..(412): n is a, c, g, or t
  misc_feature (452)..(452): n is a, c, g, or t
gttgagcggtctatagcagcagtcaggggtatccaagggaacagagacctcggaacctgagtgtgtcagtgacaaggcacggtggccctgggtgagacatgaagcttgggtacatacaggcctgagcggccatcagcagagaaagtatagccagctgcctttacagggccagggcgggatagggcttcccatcctgggtgatcctgtggcctgcatccttaccacacaaccccagcagctatggggtctgcagggcagcctgtggtcctaggcaggtcaaagccatgggacccagcctaagctcagcagtacagatggctgtgggttcgtggtcctgtctgntcacaggctnccttgctttccggtcagtgtcacttcatntntgttgnttcacatttcactnagatgtatntcctggttctcagccaggaaggacctgtaccctggccagntccaccagttcaaagccagatttcctttgagttgtttg

SEQ ID NO: 2656 - DNA, 455 bp, Mus musculus
  misc_feature (72)..(72): n is a, c, g, or t
  misc_feature (195)..(195): n is a, c, g, or t
gaagacattcactttggttatcccaggaaggggcacagacgctcctatgtcactgctgaagaggccgcaggnatcggcatcctgatcgtggtcctggggattgctctgcttatcggctgctggtactgtagaagacgaagtggatacagaaccttgatggacaaaaggcgtcatattggtattcaaaaaacctcnagggaaagatgctcatgtgagagccctgatcaccaggacagccgactgtcttctcaagagaaatcccatcagcccgtggttcccaacgctccgcctgcctatgagaagctctcttcaccgccaccttattcaccctgagagccgggaaactcctgagaacgctgaacaacttccctcacacttccgctttaaggctgagtagacgccggtgtttcgctttagaatgctgcagaatatacagctccactaacaggccagtg

SEQ ID NO: 2657 - DNA, 329 bp, Mus musculus
  misc_feature (208)..(209): n is a, c, g, or t
  misc_feature (216)..(216): n is a, c, g, or t
  misc_feature (221)..(221): n is a, c, g, or t
  misc_feature (225)..(226): n is a, c, g, or t
  misc_feature (233)..(233): n is a, c, g, or t
  misc_feature (244)..(244): n is a, c, g, or t
  misc_feature (251)..(251): n is a, c, g, or t
  misc_feature (259)..(259): n is a, c, g, or t
  misc_feature (263)..(263): n is a, c, g, or t
  misc_feature (281)..(281): n is a, c, g, or t
  misc_feature (292)..(292): n is a, c, g, or t
  misc_feature (295)..(295): n is a, c, g, or t
  misc_feature (298)..(298): n is a, c, g, or t
  misc_feature (301)..(301): n is a, c, g, or t
tgtgttgtcagcacctttttcttatcatcatagctgaaagcaaaatcagaggggaagcttgccaaacagctatgcagagttgtgttggatcagtttgacaaacagtattcgaaagaacttggggattcctggagtacagtaaggtcagtatggttcgtctcttgatattttgtgagaggaaagggaagtatgtagcaaatacctcctnnagagtgncacantccnngagggangaggtgactgnacatttnatgtgtgnaggnatcacctggcatgtaganatgtggggcanatngtnatnccctctcaagcacttggcttttatctgt

SEQ ID NO: 2658 - DNA, 109 bp, Mus musculus
  misc_feature (33)..(33): n is a, c, g, or t
  misc_feature (57)..(57): n is a, c, g, or t
ccgtgagcttcaggttcatggacacttatcccntcgctgcagacccgcccctccacntcgtgtttagttgctctgtagtgtccagcttcctgtactgttttccgtgttt

SEQ ID NO: 2659 - DNA, 484 bp, Mus musculus
  misc_feature (28)..(28): n is a, c, g, or t
  misc_feature (34)..(34): n is a, c, g, or t
  misc_feature (400)..(401): n is a, c, g, or t
agcaactgtgcaggctgccacactggcncgtggntctggtcgccccgccagcctgtacctggcacggtctaagagcatcagcagcagcaaccctgacctggctgtggtccctggctctgtggacgatgaggtgtcccgcatcctagccagcaaggccatcgaccgcaactctagccgggcctcctcttacctcgaggcctcatcctcggccctgccagcccctcagtcgagacacactgtgcagaagctgctgcacgaggagctggctctgcagtgggtggtgagcggcagtgcggttcgtgagctagtcctgcagcatgcctggttcttcttccagctcatggtaaaaagcatggagctccatctgcttctgggccagcgactggacactccccgcaanntgcgcttccctgggcgcttcctggatgacattgccgccctggtggcttccgtgggcctggaagtcatcaccagagtccataag

SEQ ID NO: 2660 - DNA, 415 bp, Mus musculus
  misc_feature (315)..(320): n is a, c, g, or t
gaagatttagctatacctagtggtacatcttaagattctagctactcatcgaggcaaaagctagaagaggtaggactacatctgtaactgttttaacttaacatgccatgaagaattaaaaaagcttttgtaccacttgttcttttattttcacggtctctgagaacaaaaatagcaggacagtaaaagtcagttaagttgatgtatggttgacacattacacttttaactggtattccacagtcaatgtgtagttttgaaaaaagtttgcttttaccttttgaaataataaaaataacatggtagaaaatttannnnnnggaagtgcttcagaattattaaagacaagcacagttctttcagattttcctccttttagaatggaagctccctgagggcagggaatcttgagtaa

SEQ ID NO: 2661 - DNA, 543 bp, Mus musculus
gaagcagatattcccagagtgccacccaagaacacttgctgtggccctagtttggtcttcaggaaccagaggctatgaagagagtggaaagccatgtgtgggaacgatatggcttcagtcaccagctctgttcccctccaccatggtgtggtaactcagagctccaagctaaacctggatccctgctgtgtcaaatgaaggaagctggtgaagagcctgtgccagatcagaagcacatgtgagcccaagttacagactgtatactaagctagtgcttgtttctattaaaaaaaaaaacaaaacatatgactaataaagtcaggtccaaatacctgcctgttcaaacaagttctccatgggactcaggaggggagacgctcatgacccttggaagccctgcatgacctaaccttccacagcctttctgattccatcttttccacttacccctgacttcttatttctcacatggtgtacactcctgcctcagagcctttgttttagctccttaactccttagtcatacgcatggcttaactgttc

SEQ ID NO: 2662 - DNA, 381 bp, Mus musculus
  misc_feature (184)..(189): n is a, c, g, or t
  misc_feature (191)..(196): n is a, c, g, or t
  misc_feature (198)..(200): n is a, c, g, or t
  misc_feature (202)..(207): n is a, c, g, or t
  misc_feature (209)..(212): n is a, c, g, or t
  misc_feature (214)..(216): n is a, c, g, or t
  misc_feature (218)..(218): n is a, c, g, or t
  misc_feature (222)..(230): n is a, c, g, or t
  misc_feature (232)..(241): n is a, c, g, or t
gggatatctctgctatatgccttgctgagtcatggagagcagctggtatccctggatccttccctccgatccagcagtgactgtgcaacctggacagacttggtgattctgattgcctgggagatagctcagttgcctgcagcatccttggcggagcctctagccttccccaggaatctgcttnnnnnntnnnnnntnnnannnnnnannnntnnntncagnnnnnnnnngnnnnnnnnnngcttgcctgtatctactgatgtattagttaatgtgagaagctgaaatatcagaaacggaactccatcacctgtctacagtgacagttgaggccatttcctatactttgttatgttggaggaccctgccacattgtcatat

SEQ ID NO: 2663 - DNA, 546 bp, Mus musculus
  misc_feature (212)..(212): n is a, c, g, or t
  misc_feature (235)..(235): n is a, c, g, or t
  misc_feature (242)..(242): n is a, c, g, or t
  misc_feature (251)..(251): n is a, c, g, or t
  misc_feature (253)..(253): n is a, c, g, or t
  misc_feature (287)..(287): n is a, c, g, or t
  misc_feature (293)..(294): n is a, c, g, or t
  misc_feature (316)..(316): n is a, c, g, or t
aaaactgcatcctacagggaagctccttaaactcagttagtaaacaactcaataacttcaggaagtcactgtggctaatcagtcaccagtccctcctccaagaggcatatataaacagtaaggactgcaaagagacagtcacagaccagcacagaagcctgaagaggtacatcacccaagctacctacgaaagaaaaaaaaaaaaaagaaantagcccacttgcctggaagagtntcagatnaacagagcnanctggaaaggcctcaaaccagctgagctgtacagnacactnncaggtttctagattttgtgagntgtcatccaggcttgggtggttttttaaagtcatgctgcagtcatttctgctgttagtaatctctcacccaaattcctgtaaatacgttcaataaagctcattggttcacaaagtgagactgatctgtggtcagttccctggttccttatctggggtgagtacaggtgtgctcacacctccccatagaacagtgtcacgtaacaatgacgcacgcatctcaaggtttcag

SEQ ID NO: 2664 - DNA, 463 bp, Mus musculus
  misc_feature (106)..(106): n is a, c, g, or t
tcaggttgttttgtcacagtgaccaaaagctaacacacttactaattcagggatggtgttcgtgtgtgtgtgtgtgtgtgtgtgtgtgtgtgtgtgtgtgtgcccnccctgaggagggaggggatactgacggtggccccatcttgagagtgtctggagcagaaggagaaagcagttcttatttgaggggtcattggggaactggggatgaagccaaaggtcccgtgtgtacaaagcgcatgctctaccatgcagcacacgctgatctggcaatttcttcctaatgctcgctctgtcggtctgttcattacatcatggtgtgaggacaactttaattctttctcaaacactgcattgtctcctacagactctgtccccgtactgaaattaatgtactggatagagagattctgcctgacctagaacttgcatcaatctttctgccaccgccatctggataatg

SEQ ID NO: 2665 - DNA, 510 bp, Mus musculus
  misc_feature (235)..(235): n is a, c, g, or t
  misc_feature (255)..(255): n is a, c, g, or t
  misc_feature (351)..(351): n is a, c, g, or t
  misc_feature (467)..(467): n is a, c, g, or t
  misc_feature (476)..(476): n is a, c, g, or t
acagaacaaccttgggtgtccaccaggaatactgtctccacctcttgtctgtgtgagacagtgctgggattatgctcacatggtgtgtccagctttttacacgagttctgggaattggaactcatgttctcatgtttcccccactccaccacgtccctgtccacatacggggaacacttagtggacctgcatacgcatatgccagtctgttgtgttggtggcatttggagctgcnacagatgggtgaccctaccnatcatgtgagcatcactaccctcgcagatgtggacctaggattccagatgtgcatccctgcacctgtacaccacacatctggcagtaattgacacntctttcttattgttttgttgtgttaaaacgcacatataaattgaccatgttattcactgtcaagagaattgagacaggtgagaaggctcagtgggtaaaaagggcccactgtcaantctgatgantcccattctgttcctggaacccacacagtggaag

SEQ ID NO: 2666 - DNA, 560 bp, Mus musculus
  misc_feature (373)..(373): n is a, c, g, or t
  misc_feature (378)..(378): n is a, c, g, or t
  misc_feature (394)..(394): n is a, c, g, or t
  misc_feature (398)..(398): n is a, c, g, or t
  misc_feature (504)..(504): n is a, c, g, or t
  misc_feature (506)..(506): n is a, c, g, or t
  misc_feature (519)..(520): n is a, c, g, or t
  misc_feature (525)..(525): n is a, c, g, or t
ggctcattatttttcagtactgtggctggaacccaggccctcatgcatgctaggcagcactctacttcggagctacacccccaaccctcatcttttaaaattcagttttgagagaagagcactctggctttgaacttgcaaacctactgcctctgcttcccaattagctgtgattacagggatgtgtcaccataccaggttaactcggatttataaccttgtctgtcatggctactcatttgggaaggtcaaatgaaccgacaacagggaacagaagcagtatggataactgcacaaggacaagaggcctttagcaacctttgccaaactaagtctttctttttgtgttcagcatcttttgcaccagcatctnttttntgcttggcgtggtatntganttgtggactgttactatggagttatcattccctacatttctacgtagctgaggagtatgcgagtgccccagtgctcacagtgagagacataaccaacccctttctntntttggggactatnnttttnttctaggggtgttacccatgggattacctttgcct

SEQ ID NO: 2667 - DNA, 507 bp, Mus musculus
  misc_feature (65)..(65): n is a, c, g, or t
  misc_feature (70)..(70): n is a, c, g, or t
  misc_feature (75)..(75): n is a, c, g, or t
  misc_feature (159)..(159): n is a, c, g, or t
  misc_feature (343)..(345): n is a, c, g, or t
tacgtaccagcaccaaaactctgggggtatgtgagggtgatgaaatcatgaacttgtcttgtttngtttngtttngtttgtctcacgttttactttgttacagtagctagcagcagagataggacagtgaccaaggggacaaagatcagaaaaaggaanatttgaaggaccctggatctcaatagtcctagactcggatgtttactgggatcactcagttacttaaaatgcgtacggaagctggagagatggctcggaggttaagagcatttgtgcctcgcagaatctggaatagatccccagtctccacaccgtgtctcacagcctccataattccagttcnnngggatcggatgcccccttctgacctccacaggcaccaagcatgaatgtaatgtgtattgatacatgcaggcaaaaacacgcatacacataaaataagataaatctttaaaaagtgaatgtgtaaggaagctgggcatggtatctcatgtttgtaatcccaac

SEQ ID NO: 2668 - DNA, 460 bp, Mus musculus
  misc_feature (333)..(333): n is a, c, g, or t
  misc_feature (341)..(341): n is a, c, g, or t
  misc_feature (343)..(343): n is a, c, g, or t
  misc_feature (353)..(353): n is a, c, g, or t
  misc_feature (373)..(373): n is a, c, g, or t
  misc_feature (381)..(381): n is a, c, g, or t
  misc_feature (386)..(386): n is a, c, g, or t
  misc_feature (397)..(397): n is a, c, g, or t
  misc_feature (400)..(400): n is a, c, g, or t
  misc_feature (427)..(427): n is a, c, g, or t
tgggcctggctctgaagtgactctcacagatgttacttttggagctggggactgttgggttgtctcccctggtgcagcactgtaatataactcttgaccataggaatgaaccggggctttctgaaacccttcagtgttgcacactgtggtcttggtaggaactcactctttcatactggcgtaaataggacgcctgccataatctttgttctaatgcccggtcttcacccgtggattggttaacactcatgtggtatttatagtatgtgctgtactaatcagtaaaacattcagtgactcatttcatcttcagagctaaccagggaggtaggnatgttttnanctggggaaantgaggcacaagaatggtctngggccttnaccanggttctatagntantaagcctacgtctggttccatatattntatccatagatagttgttgctgttgctacggct

SEQ ID NO: 2669 - DNA, 546 bp, Mus musculus
  misc_feature (383)..(383): n is a, c, g, or t
  misc_feature (385)..(385): n is a, c, g, or t
  misc_feature (408)..(408): n is a, c, g, or t
  misc_feature (414)..(414): n is a, c, g, or t
  misc_feature (422)..(422): n is a, c, g, or t
  misc_feature (434)..(434): n is a, c, g, or t
  misc_feature (437)..(437): n is a, c, g, or t
  misc_feature (442)..(442): n is a, c, g, or t
  misc_feature (468)..(468): n is a, c, g, or t
  misc_feature (501)..(501): n is a, c, g, or t
catttcttccccttaagtctgtgagagatgtgggaaaggacactttcatgtctgtttcaccttcccttcaggacaccaagcagggctctgattgccagtttctaagttaatgtatgctgaggcacagatgcaggttctgttcagatgttcaagtcgctcaccggaagctggccgaagctggccctacccaagtcatgtcctgtagctaatagcttaaacgtttgaagtatcctggcatggttcttttgcaaaatatcaccacatgagacctaaatcaagagcaggtggtaagaaataccaaccggaaagtgaagccatgcaattgtgcaaatggcttgcctggcacggattggaaatcatgccttttcaacgacaagaagaancntaaggggagttcaggactggtgnggtggntcagtggntaaaggagcttnctnccaancctgagtccaatcctcaggacctgcntgatggaagtgaagaaccgactccagaaagttntcctttgacctccatatgcttactgtggtgccttgcatggacaga

SEQ ID NO: 2670 - DNA, 423 bp, Mus musculus
ttctgtcagagaaccctgtgcctcagccattcctggaaaagatggcttttgactggcactgttcttagccaagattttggttccatagaatatcctgtaaatgtggttctttgcagcaaaaattgtatactcccataagaaatatttcaacatgtgaaacaacaatatttcattatgtttctgattttcttaccctttgtctgttcaaataaaaagggaagagaattcttgacagaaaggcatctagtaaattagtaaccaaagcatatcttaaataaaaactttagtagactgataaaagtatgctttggtttctatgatttgagtcttaaatctcaaataaagatctatttctgctgagggaacaactttaggaattggcacattggctgcactgtggctactaatttaattgccaggttg

SEQ ID NO: 2671 - DNA, 421 bp, Mus musculus
  misc_feature (251)..(251): n is a, c, g, or t
  misc_feature (268)..(268): n is a, c, g, or t
  misc_feature (275)..(275): n is a, c, g, or t
  misc_feature (288)..(289): n is a, c, g, or t
  misc_feature (291)..(291): n is a, c, g, or t
  misc_feature (301)..(301): n is a, c, g, or t
  misc_feature (361)..(361): n is a, c, g, or t
  misc_feature (391)..(391): n is a, c, g, or t
aattgcagtcttacttagaagcctgcatggcgtcttcctaggatgctgctatgctgggctcctccagatgttcctctgtgcccaccagatgttcctctgtgccctccagatcttcctctgtgcacagctcacctggcccctcggccactgtttcgatgcctcaagataggccctgaccttgctcttctaactcttcccttgaccaagagccaaccctgaagggccccctgtccgctgccagagtggacaanccatgttctttcctgcntcttatntttgcacatgaanntntattggaaanacatttgtcacccggctgactcacaaatgtgttgcttgctcaaggtaaccagaagtcacntttgcaaagccttcactggcccacgtaggntggattaaatggtccttacccaagtccttg

SEQ ID NO: 2672 - DNA, 422 bp, Mus musculus
  misc_feature (313)..(314): n is a, c, g, or t
  misc_feature (321)..(321): n is a, c, g, or t
  misc_feature (330)..(330): n is a, c, g, or t
  misc_feature (335)..(335): n is a, c, g, or t
  misc_feature (345)..(345): n is a, c, g, or t
  misc_feature (395)..(395): n is a, c, g, or t
aggaaagactcatgcttccactcacagttccttatcagacaggacgtcagagcaggaacatggaggcaggagccgatgcagaggctatgaagggtgctacgtactggtttgctccccaaggtttcttcagcctgctgtcttataggaccctgggctcacagccccggtttggcaccacccatagtgtgtgtggccctccaccatccatcactaattaagaaaatgctccaaagacttgcctacagccttatgaaggcatttttttttcatcgagcccccctttccctgatatctctggctttgtcaagttganntaaaacnaaacagcanactantgaggcagtntattttctgtgtctggcttgctagttttcataaagtcacatcttattgtnacttggagttttcccaacatgctctgg

SEQ ID NO: 2673 - DNA, 341 bp, Mus musculus
gccccaccagtgttattaaaggatctggtctcctgaaatacgtcccagcagccgtctatagcgaaccagtgaggaaaccgaggctgaacaaaggttattgttgagaaatcacacaggcagtgaatggtagaatggactgagactggagccccagtgttgactcagccattgacacgcaagcctgcttatactgtctcacttttacaaatcatgaataaaaataagaaatgaatatttcaggcaggcactggaattcacaacttagaagacaaacgtcttctcttatgatgatccacataataaaaaagactcaagaagaagatccactgtcactcttactg

SEQ ID NO: 2674 - DNA, 463 bp, Mus musculus
  misc_feature (144)..(144): n is a, c, g, or t
  misc_feature (278)..(278): n is a, c, g, or t
  misc_feature (312)..(312): n is a, c, g, or t
  misc_feature (333)..(333): n is a, c, g, or t
  misc_feature (375)..(375): n is a, c, g, or t
  misc_feature (377)..(377): n is a, c, g, or t
tcagcccaagggtagtctcctaatttatcgtttgctgtcatcttccccgcatttcccccgcagtcatcccctctgcacccctggttgtgcgagactcccccaggtgctccgagcagtgtttacaactagccagaacatgcagancctctgagcccggctcactcacctgtcacccccatcttttctccccaacttccctctcctctctttagtttttgtaaggctgtgtccattccctgaggcctcagatcctgtcagccatttctagatcctccacntgtctccagttctcatgatctagatagtagctgntcaaggttagacttcccccantccgggagacttgcactactcaggccctgggttgtacatttntntggactggttagaaatagggagtggactaggtctatctacaaccttttcccggccctgagttatctttaacttctgtccactggag

SEQ ID NO: 2675 - DNA, 507 bp, Mus musculus
  misc_feature (46)..(46): n is a, c, g, or t
  misc_feature (53)..(53): n is a, c, g, or t
  misc_feature (121)..(121): n is a, c, g, or t
  misc_feature (340)..(340): n is a, c, g, or t
  misc_feature (349)..(349): n is a, c, g, or t
  misc_feature (364)..(364): n is a, c, g, or t
  misc_feature (405)..(405): n is a, c, g, or t
  misc_feature (407)..(408): n is a, c, g, or t
  misc_feature (444)..(444): n is a, c, g, or t
  misc_feature (446)..(446): n is a, c, g, or t
  misc_feature (463)..(463): n is a, c, g, or t
  misc_feature (470)..(470): n is a, c, g, or t
  misc_feature (475)..(475): n is a, c, g, or t
  misc_feature (480)..(480): n is a, c, g, or t
tggtggtcctgctgccagagagcaatgcatttctcttcaagtgaancaattgnttcttttacattgtaccaaccagtctccgggctcagtacggcacagaaatgccttttaatgctgtgcntggaagccgggacagagaggacgccaacagagagctggcgctgctcttccccagtttcaagttctcagataaagacaaggaagctccaccgggtgctgaggctcaaactatggtgggccccgtggaggacccttgcatgtctgagcgtatctgaggactggaatgccgtgttgtcttctgccggaatcaaagtcacaaggccaccagaggagccctcantacacgccngtcggcacagaaggntgcagaggtgattccagagcgccaatatgtgcttggtttancnntattctgtggacaacggaaacaactgtccatacgtntntgccttattaaacagtntgtagancacanccaantctagtcacggcattctgctgaggcat

SEQ ID NO: 2676 - DNA, 335 bp, Mus musculus
  misc_feature (134)..(134): n is a, c, g, or t
  misc_feature (137)..(142): n is a, c, g, or t
  misc_feature (145)..(148): n is a, c, g, or t
  misc_feature (152)..(155): n is a, c, g, or t
  misc_feature (157)..(157): n is a, c, g, or t
  misc_feature (159)..(168): n is a, c, g, or t
  misc_feature (171)..(173): n is a, c, g, or t
  misc_feature (176)..(178): n is a, c, g, or t
  misc_feature (180)..(180): n is a, c, g, or t
  misc_feature (182)..(182): n is a, c, g, or t
  misc_feature (184)..(185): n is a, c, g, or t
  misc_feature (213)..(213): n is a, c, g, or t
  misc_feature (251)..(252): n is a, c, g, or t
  misc_feature (274)..(274): n is a, c, g, or t
tttgccttctcagtcttggtggtagcctgtgagttcacaaagcttcacagctgcctgcgcctttcctggggcaacttcacagcagccttcgccatgttggcgaccctgctgtgtgccacggccgctgtcatctnccnnnnnnacnnnncccnnnngnannnnnnnnnngannntgnnngntncnnggtagccccatgtcaaaggccagcaccnagaatctccgtggaaagatgatgatgtcatgacagcgnnggaatatctgtccagacacccnaacatagaccatgacccagaagcctctgaggtatctaccatgggttctggcaggctggctt

SEQ ID NO: 2677 - DNA, 357 bp, Mus musculus
ggctttgctgtgttggttgagattaagccagataaaacttctgcacccccatcccatgcctttggctccttggttctcttctcttcacttttcccaagaattctttctgctttaacaaactggatcctactctgtatttaagtagcacgagtcagttactataattacaaatcttatcataataagaatcaattatttgccacacagtgcgcccagtgagaaccgagcctgctgttaaagcccaagcaaacgtctttaggaagcacttcatctgaccgtgcttgcctgcccatggcccttctgtgaccgagtgcgctagaaaaatctcacacagatcctaggagtcagccactgggc

SEQ ID NO: 2678 - DNA, 511 bp, Mus musculus
  misc_feature (361)..(361): n is a, c, g, or t
  misc_feature (383)..(383): n is a, c, g, or t
  misc_feature (388)..(388): n is a, c, g, or t
  misc_feature (402)..(402): n is a, c, g, or t
caattactacaagttggcctgtgacatcaacatacccagcatatgtttgtaccctcacactaacaaaaataaaaccaaccaaccaaccaaccaacccaaaccagacaaatcgatgttaaataaagatgaagtaatatggcatcagtagcaccctcagagttcatagttaaggaatgtcatttctactggagttacagagctccaagtggatcagtgtaacatcatggaaaattgggtccttccttatttccagatttctctataagtgaatagaatcagagtctacagtcatgtaagaggcacaaaacataccatgacactgtatctgtgaatacagggcatttgaaaggatgtcatttgnaggttatgcagtttcatagtanacttntctagttcttactnagtattcaaccaaatgagaagaactgtgatagtaggtagcaagggacaacatgaatacatattaggcaagtaaccagtatatatctcagctcactttgcatcagtttat

SEQ ID NO: 2679 - DNA, 515 bp, Mus musculus
  misc_feature (313)..(313): n is a, c, g, or t
  misc_feature (316)..(316): n is a, c, g, or t
  misc_feature (319)..(319): n is a, c, g, or t
  misc_feature (340)..(340): n is a, c, g, or t
  misc_feature (354)..(354): n is a, c, g, or t
  misc_feature (430)..(430): n is a, c, g, or t
  misc_feature (464)..(464): n is a, c, g, or t
  misc_feature (466)..(466): n is a, c, g, or t
aggagccccaatggcccaagaaagtaaacgcatgactttgttcatagctgctccctttgggctccaggggacagacacgggcacactggcttcccagtcacaactccacgaaacttcggagcagagaacagggactttgatgggcccaagtccctgaaaaccttcagtcttacttgacccctcccctgcaggcacccagaagactgaggtgtaaagaccttgagttcgaggtcagcttcgggttcaggggcgttgtatacctcctgtgaccacaggtcctacacccaatgttatatccccttggatcccaagnttntcntttcggatttgcatcccaggnttctgagagttcancaatcttcagttttttaaaattatcattaatgtaacaattttaattattttttgttcagaaagggaggggtcttgnctgccattgaactggtaattcccctgcctcaggntntgcagtatgatgattgcaggcgtgcaccaccaagcctggatgatttatt

SEQ ID NO: 2680 - DNA, 436 bp, Mus musculus
  misc_feature (43)..(43): n is a, c, g, or t
  misc_feature (55)..(55): n is a, c, g, or t
  misc_feature (71)..(71): n is a, c, g, or t
  misc_feature (205)..(205): n is a, c, g, or t
ctaggcacacaggactctaaagtatgctataccttgcctgctntgagctacaaanatattctattttcttntgacaccacctttacaggaagacttctcgctgaccccatatgcttgatggctttggggtcttctttccagggcttcacatagctgctgtcttcctaaggctaaattgcctatttgacagtagaataatgaaagntcatttcaaggttgcttctgtcaaagccactagggccagcattctggggactgctctggatataaagtgcttaattgaaagtaatcaatgccacaaatcaattcaggatttagcatcaaacactgtttgctgaacaggaccaggaaggaaatccctggtctcataaaacacaggaaaaccacaaagtggaagcttcattctagcttattctgccttccttaaaaggtggtg

SEQ ID NO: 2681 - DNA, 484 bp, Mus musculus
  misc_feature (364)..(364): n is a, c, g, or t
  misc_feature (372)..(373): n is a, c, g, or t
  misc_feature (377)..(377): n is a, c, g, or t
  misc_feature (386)..(386): n is a, c, g, or t
  misc_feature (404)..(406): n is a, c, g, or t
  misc_feature (408)..(408): n is a, c, g, or t
  misc_feature (420)..(420): n is a, c, g, or t
  misc_feature (423)..(423): n is a, c, g, or t
aggcagcaacgctggatcggtctccccacctgtgagcagagaacaaaagagttctgactgctttcgaagcgaaactgggtgcagacagcaactttctctgctccacaaattccagtcttgaacagaacaagaaaatgaaatggagagggagggagcggagacaaacccagtttatgcggagggcgccttaatttaattaactcttcgggaaggcagaggcacggggaaggggcagaaacttcgtgcccccccccacttgaccaaattctcctcccccaccatgatcgtagatctctttctactatagctctctggcttttacacagttctgctgtgtttgaactgaaaatcagcgaacataacnattcatcnntctntcattttantcagaagcccatacacannntntagcagataacnccnaacgatattattattattattattattattcaatgtaacatcactattaccaacgattgga

SEQ ID NO: 2682 - DNA, 291 bp, Mus musculus
taaaagggttgcgtgagttgcttcggagtatcttcacaagagcaccacagagtccaaggacatttgtaagaattcccaaacatccagggatcaacagcttaaactctgcagtagctaaaatctaatcagtttactgagcttgcaaagaggcagaaaggatgatctgaagtgaggaggaaaagattgaagccaagtaaaaactgacacaaagcagcagaggaagactgtaaaaccatgaccatgctgttgatgaccaaagtaagacaaacgctaaaggtaaaacggcatctg

SEQ ID NO: 2683 - DNA, 430 bp, Mus musculus
  misc_feature (189)..(190): n is a, c, g, or t
  misc_feature (192)..(192): n is a, c, g, or t
  misc_feature (197)..(197): n is a, c, g, or t
  misc_feature (224)..(224): n is a, c, g, or t
  misc_feature (295)..(295): n is a, c, g, or t
atacaccatactttcatgaatcagatgacaattagatttatgtatatctcaaaaccacaatgcatatcctattaaaaataaggaagggggagatgtgggaacacggtccaagaatggagtgtgtagattttctgagtgcttctgagaatactcccagtaaagcaagaatcttggacctcagattcttgnnanatatngaattattcttggattatgctttcgtncccctcccaggtatagtgaatagataggagtgaatttacattatttagattatttattaaatataggttanttattaaaactggctattgttacttgtttatatacatctgtagaatttttccatgtgagacttctctgtcacatatggcttgctcttgtgattaaacactttaatcatgtgacttctctttaactctcaaggtat

SEQ ID NO: 2684 - DNA, 499 bp, Mus musculus
  misc_feature (317)..(317): n is a, c, g, or t
  misc_feature (319)..(323): n is a, c, g, or t
  misc_feature (331)..(333): n is a, c, g, or t
  misc_feature (336)..(336): n is a, c, g, or t
  misc_feature (343)..(343): n is a, c, g, or t
  misc_feature (345)..(353): n is a, c, g, or t
  misc_feature (356)..(360): n is a, c, g, or t
  misc_feature (363)..(364): n is a, c, g, or t
  misc_feature (366)..(367): n is a, c, g, or t
  misc_feature (370)..(370): n is a, c, g, or t
  misc_feature (372)..(374): n is a, c, g, or t
  misc_feature (376)..(376): n is a, c, g, or t
  misc_feature (378)..(379): n is a, c, g, or t
  misc_feature (381)..(386): n is a, c, g, or t
  misc_feature (388)..(390): n is a, c, g, or t
ataggtgtttgcttggcacgcaggaggcattggggtctccacatggcaggagacaaagcagcgataaaaacatctttaaaagactttgcaaatggaacaggacttcctgacacagaggacaccggaaatattaattggagaggagcaagcaggaggcccagtgcaggcgagggtgagagtttgctttcctggtaagttaactcctcaagaaaaccaggatagctgcatgatctactttctggattaagccagtgctgtcccatggccaattctgcagttcctgacccaggtaaggtctttgtgggtcatttcaaaanannnnnatgtgaannnganatggatntnnnnnnnnnggnnnnntcnntnntangnnncncnnannnnnncnnncgcagcacccaagtcagcaccatggacagcatcccgggaccgcagtaattatggacctttaaacacctttgtagaaaaatctgatcggtgggaacgtacaagagctttt

SEQ ID NO: 2685 - DNA, 90 bp, Mus musculus
aggtcttcctggtggcaaatgagctatcctcttagttcgtaaaacctaccttattaacctctaacactgcctcatactaactattcctga

SEQ ID NO: 2686 - DNA, 465 bp, Mus musculus
  misc_feature (91)..(91): n is a, c, g, or t
gttttggtgaactgtctgtctgacaatcgtcacatgagcgtatgacttactgtcttcccttgtacataggctgtctgtgtttggcttttcntagtactgtgaggtttcccacagggattccatgtagtactctgtgctgtgacaatgccactcttcccccaagatcacacatcatccccacaaatggttctgcctttctctatgctaacacatggagccactgagatgcagttgggtggttaggctcttggattttattttgcaattttatatatatacatatataatatatatatttatgggttggttttatatggttttctgtttgaatctatgagcaacaaagcttcccttcgattttcatgagaactttccaaaggccttttgctgctttggtgtctgactgtgtttggggtggactctgcttgtgggtttctctgtgtgtgccgttatttcacctgcaga

SEQ ID NO: 2687 - DNA, 331 bp, Mus musculus
  misc_feature (106)..(112): n is a, c, g, or t
  misc_feature (130)..(130): n is a, c, g, or t
agactccttatcacagaccacatctggtgccgaaacctgggacttcaacatagctggcaccaaggagaccccctggagacagggcagattcagaactgcagtaggnnnnnnnaggaagataatccctttnggattctagagcgcctcacttgaaggattcagctcttagacggtgaatcacaagaacaagatcccaagacgtcgctggatcatacttaattggactatggaatttgaacaaacgcttcgagaattgagagttgctattctacaagtgaattctacgcgtctcaacctttcactgacggagggcttctccacctagatttcc

SEQ ID NO: 2688 - DNA, 515 bp, Mus musculus
  misc_feature (176)..(176): n is a, c, g, or t
  misc_feature (238)..(238): n is a, c, g, or t
  misc_feature (255)..(255): n is a, c, g, or t
  misc_feature (367)..(367): n is a, c, g, or t
  misc_feature (411)..(411): n is a, c, g, or t
  misc_feature (416)..(416): n is a, c, g, or t
  misc_feature (428)..(428): n is a, c, g, or t
ataagctctgagctccagtgcttctgccaaaactctggacagtacacctttctgtgctgtacagagagcttctggcaaaataatggaatcgtatcaagatcaaaataatgtttggcaacatcagattaaacctctttgaaattcaagaggtcagcaatgcgctaaaggactttggncatcatgtctgaaaccagcttctctcaagtgccctgttgtgtggaacacttcacatattggnccagcatatataaggangtcttatatgctaacattttttttaaaggaaccatctttgtgcaaaacagtatttctttttgactctgtgaccactattttagaaacattatttaatgctttcagtcatcantttgcttacagattgaataagcttttgtgccctgtttttcttcnagggntcggaagtgttntctcaatcaccagatttttagaaaggctttctttccactggcatttctcactcgtgacacacatccacttacctgctgaagcacatt

SEQ ID NO: 2689 - DNA, 526 bp, Mus musculus
  misc_feature (121)..(121): n is a, c, g, or t
  misc_feature (162)..(162): n is a, c, g, or t
  misc_feature (202)..(202): n is a, c, g, or t
  misc_feature (222)..(222): n is a, c, g, or t
  misc_feature (257)..(257): n is a, c, g, or t
  misc_feature (265)..(265): n is a, c, g, or t
  misc_feature (282)..(282): n is a, c, g, or t
  misc_feature (324)..(324): n is a, c, g, or t
  misc_feature (335)..(335): n is a, c, g, or t
  misc_feature (382)..(382): n is a, c, g, or t
  misc_feature (417)..(417): n is a, c, g, or t
  misc_feature (437)..(437): n is a, c, g, or t
  misc_feature (459)..(459): n is a, c, g, or t
  misc_feature (486)..(486): n is a, c, g, or t
  misc_feature (500)..(500): n is a, c, g, or t
tagtccaatctgtcgcaagtttcacatccaccatcagtgggagacgaatgtggtagccacagtctagggagcgtcccaaaggcaggtccatgtccagtgctcacaggacagttgttaccancgactgaaacggaggtttgaagcctaaggtcaagacacctnctcccgtactctcctgtcctgtttacaggccagcctttancacacacttcctcccaaganctttgacccacccttccagtggaccacggtgtttngtggtttnggttcaggttgacctgngatggacgggccgcgagtctcaagatttcctatcggggccanatggaacacanctctttgtaccgtcaggatggaatttccctctgctccctcctgcttnctcttgctgttcacatcggatttgtattctctcanctctacagaaggacaaactngactgtcagttgctcccttgtnctgtcttgccatgctgggatcgaaccnaggactttgtgtgngatgggacgacttgcttgttcctgag

SEQ ID NO: 2690 - DNA, 558 bp, Mus musculus
  misc_feature (283)..(283): n is a, c, g, or t
  misc_feature (490)..(490): n is a, c, g, or t
gagctccattcctcacattgaggagaacaggtaccgctttcctcaagtgggcctcactagcacagccttcacgggcctgagctgcagaaccaacaagaccctgaacatctaccttttggattccaatttattttggttatatgcagaaagactgggtgccccgagctctgctcctgtgaaggagtttgccacaattgttgatgtgaaagaagaatctcactatatcctggatcccaaacaagccctcatgaagttcactctaggtactgtgggtggtttgccntcctccgcataatcagctttacttagcttaagagctgtcatttgcactgatggtctcattattcctaatcatgggggtgacaccagcttcagagctcatgttaagtcttcagacaactgatggaaaaactgtctttatctgttggttggtcagtttgaaaagaagctagtttgtccaggaaatagagcagaagcttctgtctatcanaatttggtgcagtttgtcagctaacctgtaggggctaagagtctaagactggcaacttctgtcacctt

SEQ ID NO: 2691 - DNA, 410 bp, Mus musculus
  misc_feature (122)..(126): n is a, c, g, or t
  misc_feature (128)..(140): n is a, c, g, or t
  misc_feature (142)..(165): n is a, c, g, or t
ttttcaatcattctgcccttaaccgcctccttagggcaaaatggaacaccctccttgctagaggctggatgtatgtaaagactatagttcattgtttctctattaaattattttccatactnnnnnannnnnnnnnnnnngnnnnnnnnnnnnnnnnnnnnnnnnctcataccaggagaagctgggggagcctgactagtgtggcccagagggaagtgactgtacacctgcctcttgcctttagtctctgggacccagaagtcctgctgactgccactattcctgccaaccacctagtgtgtgttgttgggagcagggcgtcagatggatggatagacctgggagcccaatgaggccttatttctgcatacctcggcatagtggcaggtggtagccctctagaacagtcc

SEQ ID NO: 2692 - DNA, 517 bp, Mus musculus
tttcaatctaccatggcagctgctcctgcgcactgaggcctgagagtcaggaggaacaaatcgaaaccttgctgtctttaaaagaactctcgtgggctagggcgagcgctcagtacagcgcttggtgtgcaggcaccaggacctgagtttgctccctaaggcctggaatgtgtgacaccccagtgctgggaagacacaaaggcaggtcccagaggcttgccacccagacaggctagcttactgtgagctgcaggacagggagagagaggccttctctccacaaaaagtagacagtgcctgagggttaacaaccagctttgttctccagcctctgcatgtacatgccacatacatgactgtacttacacatgcttacacacatacaagagagttgggggtgagagattgggcttaagataagactttactttttaactttttatgcaaattaaagatttaaagaaaaaaatcacaagcatagcaaggaacattggcgtcttcttaaccagcatgtatt

SEQ ID NO: 2693 - DNA, 252 bp, Mus musculus
ggctctttagagcagcaggacacctgctcaaaaccaaggctgtgctgatcacctacgggccctatgccgtcaatgggaagatctctccccagagcaacgtggactttgacctgaccctcagatgcaggaacccagagtgggggcttcgtgacacagtccttctggaggaactaggccaggccagtggcttggtcctggagaggatggtggacatgccagccaacaacaagtgcctgatttttcggaaagaat

SEQ ID NO: 2694 - DNA, 508 bp, Mus musculus
agggcagtcattcccaggagacacacagcaccaaccaacagcgcgatgaattggtaatgttgttttgctgttaaataaaaatcctttttattcttgctctcttttcctgtaaacattgtgtgcatgaggctacatcattccttaaatcacccttccaccttgctttaacaactcctcagatgatgtggaagggcaaagctcatatgctcctgtcacttgagaccctggccaacctcatttgtattttttcctgctggcatgaaaagcagcttgagggtaagtagtgctgtgccagacctaaagagctgtgcggtgccacagttgtgcagccatcaggttgccttgatcacatggaatcctcctttaatcattcatccatttgggcccactttgcatacagaggcaagcagaaagcttgagcacttgtgtcctggaagataccaagtcagtgtcaaggagtgatcgttgtcaacggaaacaagctggtaaatcctgtccagctaacgtc

SEQ ID NO: 2695 - DNA, 165 bp, Mus musculus
tgtggtggaggcatctgtgaaaccaggttcctgcacacattcgatgggatctctgtacagccaggtcagccgactggcccctctgagtagcagccgcagccgcttccacgccttcatcctgggcctcctcaacaccaaacagttggaactgtggttttccagcct

SEQ ID NO: 2696 - DNA, 520 bp, Mus musculus
  misc_feature (93)..(93): n is a, c, g, or t
  misc_feature (98)..(98): n is a, c, g, or t
  misc_feature (127)..(127): n is a, c, g, or t
  misc_feature (130)..(130): n is a, c, g, or t
  misc_feature (169)..(169): n is a, c, g, or t
  misc_feature (275)..(275): n is a, c, g, or t
  misc_feature (278)..(278): n is a, c, g, or t
  misc_feature (280)..(281): n is a, c, g, or t
gccaggcgcagggaaaccttagcattgtctggcactgtgatagattaaaactgtagctgtatagtgtcaaattccccaatctgaaatgcttgnaaatntgaagcatttgagtgtccacgtgaggccncanagtggaaaattccacacctaacttcacttgatatgtgtncaaaatgtaggcccatttaaaaaatattgcacagggacttgaaaggctgaagcaataagactgcccccaagttcaaggctaactacggctacatatttagatcctntcncnnaaaaaaaaaaaaaaaaaaaaaaaaggccaaacaacaaattggaatgtatctcattgatatagcagctgcttatagtgctgcagacctctgagctttatcccaaaccccggaaatgatagggaattgcccggagctgagtgtgctcatgcagttcggaagtagagcaaatgtgtcagtttaagggcagtccggatactaagcgagaccagcttgggctacggaaaaccatgcctgtctca

SEQ ID NO: 2697 - DNA, 401 bp, Mus musculus
  misc_feature (132)..(132): n is a, c, g, or t
gtcagtccaggctttccggtaaggacactcccttccaactagttccttctcgacacccctgcaacccatcgtcctgactatttaaacttcacaaggtcttcgctacaggctcaggttcagtgaggcagagtnttggcttccctacccagttatcccagagctactggtatcggtttctacccacaacctccgagcaaggctcccctttcaacctgtagacctcgcctcccgattctcgggagatcttgctgactgtggaatccctggctgttccgaaccccctggaaagaagcggctgttcccaggtttctgcaaggtaacgaatctgaagagtcaacagaattgagcggctccattcattcgactctggttctctcaaccaggcattccccatattaaaa

SEQ ID NO: 2698 - DNA, 563 bp, Mus musculus
  misc_feature (269)..(269): n is a, c, g, or t
  misc_feature (295)..(295): n is a, c, g, or t
  misc_feature (341)..(341): n is a, c, g, or t
  misc_feature (453)..(453): n is a, c, g, or t
  misc_feature (496)..(496): n is a, c, g, or t
  misc_feature (508)..(508): n is a, c, g, or t
ggttgacatcttaggacttctcagttgtctcccttctccatcattctaatttttatgtcctgtgagtgagcctctgctttttttttttaatgttgctataaaatgctcttaccagccatttgcttcctcagggaacatttagcttcatcttggtttctatatagctgtcttggtgtgttgagagatctagtcagaagtccctgggcaggttaacagtggccatgttcatgggctccaattgagactggaggagggaggtggtaatggtntggttgtaaagctctcattactgatnttcctctttgtcctgatgctactagaagcttccatctgtcaagcanttatttgtatccctcttaatgttgtgttctttactatatatcatttaatcattacggcagcctttcggattgatacccctacattctttttatagtttggaaaaaaaaaatntcaggatacctatctttatcatttctcaatataaatatatttnttaatttatttnaattagtctttgagtttctgtttggtgcattgtatcctgtttattgctttcgtat

SEQ ID NO: 2699 - DNA, 429 bp, Mus musculus
  misc_feature (143)..(143): n is a, c, g, or t
  misc_feature (177)..(177): n is a, c, g, or t
  misc_feature (181)..(181): n is a, c, g, or t
  misc_feature (197)..(197): n is a, c, g, or t
  misc_feature (263)..(263): n is a, c, g, or t
  misc_feature (267)..(267): n is a, c, g, or t
  misc_feature (319)..(319): n is a, c, g, or t
  misc_feature (370)..(370): n is a, c, g, or t
  misc_feature (393)..(393): n is a, c, g, or t
tggtgttgggccagttccttatgcattctgcattcatgtgtataggattcaaagacgttccaaatattgatcataaaccaagtgtatatgaattaattaaatagcatatttctggcccaaatatgaggaaaaccataactttntactgtaaatcaggagagattgttttatccccanatanactaggatgtttcaantcatgtttcagcaatttggagacctacaaactatctgcaagcaagcacaacaaccatactctaatntacnagatagtagtgagaatttagtgcttgaattcaggctgcttgaattcagtatntccttctctatgctgattttcaagtagatattctgtagctcagctagatantcttttaaaagcaaaaaaaaaanttaagtttaaagtgtagttgctaagagctgctcttc

SEQ ID NO: 2700 - DNA, 395 bp, Mus musculus
  misc_feature (96)..(96): n is a, c, g, or t
cccagcttgtggcactgttttgaaggctgtggagtttttagaagatcggggttggactggtagagctgggtcattaaagccttccatgcttgtgcncactgtggttccagacttcttttctgtgcttctcggttagacatgatgtgagcagtcgctgccacgtgttcctgctgcctcttcagcctccacgccttacactgtaatgggctgcactctctcagaaactgcaagcaaaatgaacccgactctcaagttgcattgtttggatgcttggtcacagtgatgtggaacattcctatccaagaactataggaaaggggccgactgaccaggagtcggtcagagagtgattatagaaggtgcactatcagagcagacatcttcttaagccagat

SEQ ID NO: 2701 - DNA, 515 bp, Mus musculus
  misc_feature (44)..(44): n is a, c, g, or t
  misc_feature (88)..(88): n is a, c, g, or t
  misc_feature (210)..(210): n is a, c, g, or t
agctggcgtgcggatttcaggcaaacgtttacctttttgctgtntattgcaactgcgccgggctgactttagaagcaattctgtgctntgtgcaaaatgttcatggaacggttcctcattaaaaaaaaaaaaaaaagccagcgagagagacgacagaggcagaaagaaaaaagagaggaggggtgagggggacgcacataaacccagttncaaaaaaaaaaaaaatcatctcttcactagagactccggaaacgtagaggcagcgagatcccagcacagtccaaccaagccacaaccaaataattttcaatcctgaagaattattcagattaaaatgtacagaagtttcattctcctatgcctacgtgagccccaagtcgtttccctttaagggctccttttcttttaaagttggattttaggcagcaaggactcttacactagggggcagacagatactgcacttacttcaatcttaagcaattttttccctcccagcatatgctctgatttag

SEQ ID NO: 2702 - DNA, 384 bp, Mus musculus
ttgcaaagatttctcaagccggcccccttactttttcaactctttaacaacatgtcttccactgggggtggggaggaatggtttttaacttgagtgaagtctgatgtttcagttttatctctgtgaatcatgcctttggtgtcacagctgagtactctctaacccaagtcattaaggtcttgtttctgccaggcctgggtgacacagatctgtagtccagctaatgtggaggctaagcaaggaggatcaaaagctcaaggactgcctgggcaacttagcaagaccctgtcttagatgatgaaaactaaagggctgggaacagaccacagtggtagaaggcactcctggttcagctgtgagccgttcaaggctcagttctgggaa

SEQ ID NO: 2703 - DNA, 535 bp, Mus musculus
  misc_feature (85)..(85): n is a, c, g, or t
  misc_feature (90)..(90): n is a, c, g, or t
  misc_feature (92)..(92): n is a, c, g, or t
  misc_feature (109)..(109): n is a, c, g, or t
  misc_feature (114)..(116): n is a, c, g, or t
  misc_feature (118)..(118): n is a, c, g, or t
  misc_feature (212)..(212): n is a, c, g, or t
  misc_feature (269)..(269): n is a, c, g, or t
  misc_feature (280)..(280): n is a, c, g, or t
tggctttatcaaggcagactgaatgaatgaagtcagcatgtcatccagatggcctgtcagtaagtaacatgacgatcaacaaccnagacngnctcctctcatgcagctntgctnnntncatcccattgactgtgggttaggtatacttacacttccacctacggggtacttgaagatgagacaatatcaggatgttctcaagataccttctncatacagacctcagcaaaccaaattaagtacagttgatttctttacaaagaaaacangtatatgctancaagaattccaacatgatgggttttaagcatcgattgagtgaaatacaacaagattgtttgaagaaaattggttagagtgatgctgtttcccagattatgaaaatctgttctaagggattctgtaaatgttcatttcttgatagtcatgtgaccttgatggggccaagtggcctctgctgccattgctctgcatcagagcctttcctacaaataaaatgtcctgaaaacagttgaggccacattaaataaccatg

SEQ ID NO: 2704 - DNA, 493 bp, Mus musculus
tatcttgttctgcttgctttatttctcctcgtttatatattttgcatccagcaatgttactaaagagagaaaacagtgtaaggaggtcatgaaagtcatgggtctacaagactctgcattctggctgtcctggggcttaatctatgttggctacatctttattatttccatattcattgcaattatcataacatctacccagattataatgatgactggtttcctggtcatatttacgctgtttttcttatatggattatccttggtaagtgtatgtgtttactaccatcatttacacattatatcttagctatgtgtaattctcgagaatgttaaggagacactttgtcatgtccagtgtgtgtatatatgcatgtgtgtgtgtgtgtgtgtgtgtgtgtgtgtgtgtgtgtgtgtggtgtgtttgagaaaatgccaatgactatacgaaacgaatgtaaacccaagtaaattgggtctctgcagtttcaca

SEQ ID NO: 2705 - DNA, 569 bp, Mus musculus
  misc_feature (171)..(171): n is a, c, g, or t
  misc_feature (176)..(176): n is a, c, g, or t
  misc_feature (190)..(190): n is a, c, g, or t
  misc_feature (263)..(263): n is a, c, g, or t
  misc_feature (340)..(340): n is a, c, g, or t
  misc_feature (343)..(343): n is a, c, g, or t
  misc_feature (349)..(349): n is a, c, g, or t
  misc_feature (355)..(355): n is a, c, g, or t
  misc_feature (383)..(383): n is a, c, g, or t
  misc_feature (391)..(391): n is a, c, g, or t
  misc_feature (407)..(407): n is a, c, g, or t
  misc_feature (428)..(428): n is a, c, g, or t
  misc_feature (431)..(431): n is a, c, g, or t
  misc_feature (435)..(435): n is a, c, g, or t
  misc_feature (445)..(445): n is a, c, g, or t
  misc_feature (470)..(470): n is a, c, g, or t
  misc_feature (475)..(476): n is a, c, g, or t
  misc_feature (500)..(500): n is a, c, g, or t
  misc_feature (530)..(530): n is a, c, g, or t
gcactccagggctcctgtcagcgttctctctgtggtccccagagcccccttgtccgtccctctctttctacgcctctgtcctcaaccgggacaggcagccgctccctcctttcctagtcgccagctttgtgtgtctgctgccaccggctcgtcccctctgacctcggtcantaccnctctgcaccttagnatgagagaaccagagggtgtctgcacttcgagagctccccccaccccggggtaggtgtgggaccttggaggcngtccccctagtccgcgatcagggggtaccgggcttcccctcaccttaagatccccgcccgtggactgcagactgttnaanttcganaaaagngaccgagctggaggacagggaaaagtgncagaagantcggaggaaaagtgtntcagaaagcgcataacggctnctnccancggcgccctncaaaggacccagagacataggggantcttnntctttttcaagatgaataggaagntcagcggcgtgaagtagcttcactgcttcntcttccttcagctcaccttggctgtgaagtagccagtac

SEQ ID NO: 2706 - DNA, 496 bp, Mus musculus
  misc_feature (363)..(363): n is a, c, g, or t
  misc_feature (365)..(365): n is a, c, g, or t
gaaagcttatgcaattatgcctctaaggaaattttactatgatattgaagctctaaatcaaagcatgagtgtaaaatgtcaatacttaaagtgtaactatgattacaatatttttttaatatttatttatttattgtatataagtacacggtagctgtccgcagatactccagaagagggcatcaaattttgttacagatggttatgagccaccatgtggttgccgggatttgaactcaggaccttcggaagagcagtctgtgctctttaccactgagccatcacggcagccctaattatactattcttataaaattgtactgcctagatatagttatctgatttatctatcaaagcattccntnttaaaaaaaaaaaaaaaggaggaggaaacattgccttaagggatacctttattcaatttgtacctctactagagctatgctgatctgacaatgtgtatagacttacaagacttagatattgcacatcgaat

SEQ ID NO: 2707 - DNA, 314 bp, Mus musculus
aggttgaactctagccatggccaggactggcatccaataacccctcctgctggtacactctctcagcagggtcccacatgccttccatagtccaattcttaggtggcgaccaagcacacagtgtcctaggcagacattggtcttctgaggtgggaagagcaggggatactgttgttagttaacaaagaaaaagaaccaaccagtgacacagagaaaatgaagccaagcccaccttacttagatcagagaaagctctgaagggaggtggcaggcaacacagtcctgccaacataaacctcgtggccaagggcagt

SEQ ID NO: 2708 - DNA, 531 bp, Mus musculus
taggccattcggaacttctgggtgcctgctcgcctttctagccaggttggaaaaggggagcctggcgtaggtggagatttcagtttcagtaaggtctaacttgcccgggtgtgtttaaagcaaatgtgcgaggtctgcacagttgcagaaagggatgcgattagggaaggttctgaggcgggtatttacagtggctggggaaaagaacgcttgtaaagagttacattgaatgtcacccatttccctgagcaaggctgaattctgaatcctaccaagcactggattaggtgtatgaaatggaatttcgcccctggtgccgattgcttcctttctgcaatcctagcaggtggactctccagaaagaactttgctacctctgggatccttgccactgagagtcatggggtgggtcatggtggagggaggactaagcacgcgcctacttagctaaaggcatcaacagtcacctgtggaattaagactgaaagagccaagtcaacccattccgtcccactcttttggaatggcagt

SEQ ID NO: 2709 - DNA, 465 bp, Mus musculus
  misc_feature (51)..(51): n is a, c, g, or t
  misc_feature (90)..(90): n is a, c, g, or t
  misc_feature (245)..(245): n is a, c, g, or t
  misc_feature (281)..(281): n is a, c, g, or t
  misc_feature (293)..(293): n is a, c, g, or t
  misc_feature (312)..(312): n is a, c, g, or t
  misc_feature (321)..(321): n is a, c, g, or t
  misc_feature (323)..(323): n is a, c, g, or t
  misc_feature (334)..(334): n is a, c, g, or t
  misc_feature (339)..(339): n is a, c, g, or t
  misc_feature (350)..(350): n is a, c, g, or t
  misc_feature (359)..(359): n is a, c, g, or t
  misc_feature (375)..(375): n is a, c, g, or t
  misc_feature (381)..(381): n is a, c, g, or t
  misc_feature (391)..(391): n is a, c, g, or t
  misc_feature (394)..(394): n is a, c, g, or t
  misc_feature (411)..(411): n is a, c, g, or t
  misc_feature (429)..(430): n is a, c, g, or t
agataccctgtctcatgttttccacagatttaacactagacagtgagcgtngactctgataattgaccctggtgttctgcagggtgattngtatttcctgtaggtgtttataagttagggctctacagacagtacatgttcttccctctcttaggtgtactccattattctcagcatagactcagaggcctggtcttaggctattctcagtactgggtcatagcatgactagcattgatgttgtngatgctctgattctgtactcctctatactgtcgttnaagtattttctntattttctggcctgaccangctcaactntntcctgtacttntcctnggcctgcagtnagctacttntacagagaaccctggntccttnactggagatntgntatttacaaccaggttngtgggtccaagactatgnnggtgagatgtatatactaggttctcagtggccagt

SEQ ID NO: 2710 - DNA, 541 bp, Mus musculus
  misc_feature (45)..(46): n is a, c, g, or t
  misc_feature (54)..(54): n is a, c, g, or t
  misc_feature (61)..(61): n is a, c, g, or t
  misc_feature (63)..(63): n is a, c, g, or t
  misc_feature (91)..(91): n is a, c, g, or t
  misc_feature (93)..(93): n is a, c, g, or t
  misc_feature (157)..(157): n is a, c, g, or t
  misc_feature (247)..(247): n is a, c, g, or t
  misc_feature (257)..(257): n is a, c, g, or t
  misc_feature (262)..(262): n is a, c, g, or t
  misc_feature (287)..(287): n is a, c, g, or t
  misc_feature (352)..(352): n is a, c, g, or t
  misc_feature (357)..(357): n is a, c, g, or t
  misc_feature (359)..(359): n is a, c, g, or t
  misc_feature (393)..(393): n is a, c, g, or t
  misc_feature (413)..(413): n is a, c, g, or t
  misc_feature (415)..(415): n is a, c, g, or t
  misc_feature (437)..(437): n is a, c, g, or t
  misc_feature (456)..(456): n is a, c, g, or t
  misc_feature (458)..(458): n is a, c, g, or t
tatgatttgcctcgttctctggtgggcatgattttgccagctgcnngatagcanaatgtgntnttgtgacgtttggaattctggggacttntnagagagtgtacaaatgctaaggccattagaggcagggaaggttggtgttgctgttgctggttgntgttggtcaccattggttaaggagatatgcacaaaccagaaagaagaagaaattagatgtcctgactgtgaagatcaaacttgcccttantccacactgntaatnagcaggaaatagccctaataatatngcctgctttcctttctagcgttttgttttttgttttgttttttgttgttgttgttgttttttgtntcctntntagtgttgggttgggagggtggagataggtggtntaaaagaagaacccacagantnttaagaagcccggctataatantatttcacaaggagcctantnttgcattttgccaccccaattttctaacgatagcaataatcttctcatgaaggcacagtccctgggacctaatcacccattaa

SEQ ID NO: 2711 - DNA, 509 bp, Mus musculus
  misc_feature (321)..(321): n is a, c, g, or t
  misc_feature (323)..(323): n is a, c, g, or t
  misc_feature (326)..(326): n is a, c, g, or t
  misc_feature (331)..(331): n is a, c, g, or t
  misc_feature (337)..(337): n is a, c, g, or t
  misc_feature (354)..(354): n is a, c, g, or t
  misc_feature (409)..(409): n is a, c, g, or t
  misc_feature (413)..(413): n is a, c, g, or t
  misc_feature (432)..(432): n is a, c, g, or t
  misc_feature (458)..(458): n is a, c, g, or t
  misc_feature (463)..(463): n is a, c, g, or t
  misc_feature (475)..(475): n is a, c, g, or t
  misc_feature (482)..(482): n is a, c, g, or t
  misc_feature (484)..(484): n is a, c, g, or t
actgctggatgactgcagtgtttctgggaacctgagtgctctggcacacagatgacactcaccactggcagcactcccctctcgtttgctgcgagaacccccgctgctgtctctgcccgattttatgcgctacagcaagaaataagaagataagtagaggagagtaagtgacatcctttcagaatatacagccaaagacagtaaattcaaagccagcattaccacatgtctctcaggaccacatcatcacgagctgattcaacatgaaaagggacagaatccttttgaaagtgtgactacctggaacttacagagcacacntnggncattncactcnaaaaccaccacctttgnacagccaatcaattaagaagtaaaacaccattttcttgatgagaaggatcaggantcanacataatatgagtttgagnaaagtaagtggaagaggaaaaaaatnatgtntgtgccaaaggncatttcntnccctatccgtactgtgtaatagttt

SEQ ID NO: 2712 - DNA, 392 bp, Mus musculus
  misc_feature (177)..(177): n is a, c, g, or t
  misc_feature (180)..(180): n is a, c, g, or t
  misc_feature (182)..(182): n is a, c, g, or t
  misc_feature (207)..(208): n is a, c, g, or t
  misc_feature (214)..(214): n is a, c, g, or t
  misc_feature (216)..(216): n is a, c, g, or t
  misc_feature (218)..(218): n is a, c, g, or t
  misc_feature (228)..(229): n is a, c, g, or t
  misc_feature (237)..(238): n is a, c, g, or t
  misc_feature (242)..(242): n is a, c, g, or t
  misc_feature (245)..(245): n is a, c, g, or t
  misc_feature (248)..(248): n is a, c, g, or t
  misc_feature (263)..(265): n is a, c, g, or t
  misc_feature (267)..(267): n is a, c, g, or t
  misc_feature (275)..(275): n is a, c, g, or t
  misc_feature (285)..(285): n is a, c, g, or t
  misc_feature (311)..(311): n is a, c, g, or t
actttgtctccatatttgctcctgtgagtattttgctcccctttctaaggactgaagcacccacactttggttttccttcttcttgagcttcatttggtctgtgaattgtatcttggatattccaagcttttttcctaatatccacttaccagtgagtgcataccatgtgtggtctnttntnactgggttacctcactcaggatgannttttcnantnccatccattnnccttcganntctnttnttnttcatcctccttggnnncnccacccanttacccatgnccgcacattagggaggcagatggcangtgtaggagctcaggggaggggtctctaccatgaatatgaacctgagattcatcactacagatgacactcaagcccgtatg

SEQ ID NO: 2713 - DNA, 329 bp, Mus musculus
  misc_feature (252)..(252): n is a, c, g, or t
  misc_feature (255)..(255): n is a, c, g, or t
  misc_feature (280)..(280): n is a, c, g, or t
  misc_feature (282)..(282): n is a, c, g, or t
  misc_feature (284)..(284): n is a, c, g, or t
  misc_feature (292)..(292): n is a, c, g, or t
  misc_feature (304)..(304): n is a, c, g, or t
ggtatatctatgaaccacctgcatatgttatctacataggccagaagagggcagcagatctccctggcactactagagtatagaagattgtgagccaccatgtgggtgttgagacccaaacaggggtcctctgcagagcagtaagtgctctcaatagctgagcccctgccccatcccctataaagaagtgattcataattcaataaacatgtgtgtgtatatgtatgtacacatatatgtgtgtgtgtatanttntacatacacacacacacacacacanananatatgtgngtatggacaagntgctaaaaaccatttattttgcttt

SEQ ID NO: 2714 - DNA, 517 bp, Mus musculus
  misc_feature (319)..(320): n is a, c, g, or t
  misc_feature (325)..(326): n is a, c, g, or t
  misc_feature (329)..(329): n is a, c, g, or t
  misc_feature (333)..(333): n is a, c, g, or t
  misc_feature (337)..(337): n is a, c, g, or t
  misc_feature (339)..(339): n is a, c, g, or t
  misc_feature (341)..(341): n is a, c, g, or t
  misc_feature (349)..(349): n is a, c, g, or t
  misc_feature (353)..(353): n is a, c, g, or t
  misc_feature (359)..(359): n is a, c, g, or t
  misc_feature (363)..(363): n is a, c, g, or t
  misc_feature (369)..(369): n is a, c, g, or t
  misc_feature (386)..(386): n is a, c, g, or t
  misc_feature (390)..(390): n is a, c, g, or t
  misc_feature (396)..(396): n is a, c, g, or t
  misc_feature (407)..(408): n is a, c, g, or t
  misc_feature (414)..(414): n is a, c, g, or t
  misc_feature (421)..(421): n is a, c, g, or t
  misc_feature (437)..(437): n is a, c, g, or t
  misc_feature (447)..(449): n is a, c, g, or t
  misc_feature (456)..(456): n is a, c, g, or t
  misc_feature (468)..(468): n is a, c, g, or t
  misc_feature (473)..(473): n is a, c, g, or t
  misc_feature (483)..(483): n is a, c, g, or t
ggtatcaggcaataagcagcaattttaatgtctcacatttcttgtacgttatgtatatttacattttctgaaaaaaaatttagttcatatgggctgtagtaaactggtgtccttgtttcactgtgcgaataagagtcagtgtaatatgaaataaatagctctttgctatgttactccactaacagctacacagatgtcatacactttatatagacttctcatctttccaagaagtcttgtattttcattgttttgtattacatagaaagatattttatagtctatatgcaaactaaactgcctattttcacataatttnntgggnnatnatanagtnantnaccatatntagnatattntctnattttnttttgtctttttttttnaccngtcacnacactgatatnnatgttnttccagnaatgtacagcagaatnatagacatgnnnaactatntactataatatnatatnagatgtaagnaaagatgtaaatcacagtgtatttcattatccca

SEQ ID NO: 2715 - DNA, 355 bp, Mus musculus
  misc_feature (304)..(304): n is a, c, g, or t
  misc_feature (317)..(317): n is a, c, g, or t
  misc_feature (319)..(319): n is a, c, g, or t
gtcacggctatcatcagaactgcttccagcccatcagatgccagacttcccatgtggtgcacagctcctgccagcgtccctgctaccgtccaagtgtgtccagcttctgcagtccttgcagggccacatatgctggctttcttggttttaggtccagcagctgccattcccaggtctatgggtcaaggagagtctacacttcaggctgtggctctagctgctttagacctgtgagttaccgagtctgtggctatccttcttttggttatggatctagattctgtcacccaacctatgtgacttntagaaacttccantnttcttgtcacagacccacctgtggatcaaccaagtg

SEQ ID NO: 2716 - DNA, 437 bp, Mus musculus
  misc_feature (54)..(54): n is a, c, g, or t
acacgctttagctattacccgatgtccacgccttagctattacctgatggcatntatttagcctcttagttgatagatagtaaaggttgccgagctaatgcattcagagaggtttttatctgttaggtcggacacgggcaagtgggcaaaaggaatggctatttaaggaggctgaataatcaaaaataggctctctttaggctctgcatctgcaaccttcccacaatatcgaggctctgatttgtcagtcagcaccgcacaaggttctggagaaagcacaagttctttgtgaaagttctccttaaaagactgttggagctggagagttggctctgggattaagagtacctgttgttcttgcagaggacctgggttcgattcccagcacccacctggaggctaaccacttccgcaagcaccaggcgtacatgtggtac

SEQ ID NO: 2717 - DNA, 422 bp, Mus musculus
  misc_feature (376)..(376): n is a, c, g, or t
aattgtatccagcaatttccccatccttagattctacattttagagattaaagacttgtacggacttgttttctttgtccctagactgtttggggcagcacctgtcaacagagttgacattgcacttgctatagtaaaacactccagatgacttcaagtacaccagggaaggcagacatgaagacactttcctgtaatcctgacactggggaggcagaggttggaaaactgggacaaattagaggctgtcctaggccatcagggatatgtaggtgagattctacctaaaaagcaaaacgaaaccaaataaacaagagcaacaaagtctttcaataaagtatgtgtgatgtctggcctgattagatgcctgccttgntgggtaggtacaagctaagactcggagcctggagttcaatgcctag

SEQ ID NO: 2718 - DNA, 359 bp, Mus musculus
  misc_feature (188)..(188): n is a, c, g, or t
  misc_feature (193)..(193): n is a, c, g, or t
  misc_feature (328)..(328): n is a, c, g, or t
tcatcttcaggtaactcctgtcacgtcctgcgagaaaagtcatcttcctcaagggctttatgttaaatgtatgcgaagctatatgagtcccacctttcctttctgtcttccttctgtccatccttccttctggtgtatgtaaagcctggggtcctctaccctagagggaaggatggaccaaaagaccntgggntttatatacatgaggccagtgcttggccactgaactgcatccgtagccctagagaatactgtggcctctgtaaagccatccctgcaccttagcagccaccagctgatccagccagtcctattttacctttatttntccctctcttcccgccttcagtattagtgaa

SEQ ID NO: 2719 - DNA, 345 bp, Mus musculus
gtcaggccaaagatgctccttcaagtgcagagtaatggcacggtttcttcccgttttccctgaagtcccatctggagtcagcttcttccgagctgagtcctaccatctatcacaagaaagcacgccacagtctcatccctttaacagccaccgtacggctatttctgtctttagcctgccagcacagagccctcctgggggccgtctatgttcttctgggtctccaaggactctccaccgtaaggggcatggtggctcatctccgaatagaaagatcccagctgtttactcaggaaaagaccaggtgaatcgctgttatctacaatgatacgaaacccctggaga

SEQ ID NO: 2720 - DNA, 532 bp, Mus musculus
gactctccacatgatcttaggacctctgaaggatttatatatgataactggatctgcctggaataccagaagaggagaagtaactgactaaggaaacccattttcactaattatctaacctactgtctgaagataagaaaaggaagggaaaggattgcatgttaactggggcccttatctcctcctatcctcagctatgtcagtcagactcaagtgtgacttgcaccatgtgtgtttcttgttttctaacctgtagaagatgggttatgggttattgataatcatgtaagacatttcctgcaataaaacttcacttgttctttcttcccatctctgtctctatgtctgtttctttctcgagttctgcctcttttctacatatatatattctttacatatacaaatatatatgtacatatcttatttgttccttacatatatgtatatttgagtgtatgtgtgtatttgtgtatgtgtttgatatatgtatgatgcacacacacatatgtacacaatttgttcctttctctag

SEQ ID NO: 2721 - DNA, 452 bp, Mus musculus
  misc_feature (351)..(351): n is a, c, g, or t
  misc_feature (372)..(372): n is a, c, g, or t
  misc_feature (376)..(376): n is a, c, g, or t
  misc_feature (379)..(379): n is a, c, g, or t
  misc_feature (389)..(389): n is a, c, g, or t
  misc_feature (391)..(391): n is a, c, g, or t
  misc_feature (409)..(409): n is a, c, g, or t
tttctttaagactgtggtttcccagttggttgaccatgctccagtggatagccccacacccagaagtatgtgggcagcacaaatcggaccccatggattatttaaaacccacagaagacagggagtatatgggctaacctgagaggggtagggagaagagtggagagtggatatgaccaaaatattctgtataaaactgtcaaggaattaattataatctatatccctgtataaaggaatctttatctatatccatgtccatatctatataaaggaatagtccaggtggaggaggtggctccttgcttaagcttgcactgcagtctccccaggcagttcacaattgcctangacttcagctacagaggattngacntcntcttctgctntntttgtgggcatttacatntatgtgcacacacagagagacacatgtatgtactcatttttaa

SEQ ID NO: 2722 - DNA, 481 bp, Mus musculus
  misc_feature (344)..(344): n is a, c, g, or t
  misc_feature (351)..(351): n is a, c, g, or t
  misc_feature (404)..(404): n is a, c, g, or t
  misc_feature (408)..(408): n is a, c, g, or t
aaagaatccctttgccaagtgcattcactggcagagttctgaaagctgtggtctcaatgccacagagtgttaataactttatacttattaattaatctcagaggcaagagttgtcctgcccactgaagacggcaccaaaggaatgaagattgttcaggggtcttgcatagatcaatgaccaagcaagtgacagaagatgttgggctcaaaacaccagaacacattcagtcatcagcctgtctctgtgctctctcttcccatccagccaatgaggaaacagaacagaatatggcttgctgggccatccagctcttcacagatcaatcccaatcctactacaaatngtgtccntaccaaaaccagccagaagagcacatgtgaccaggaagccccagtgactgganatgntcagggtaatgatatgattgaggtttatattcaacattcatggaatcagatgaaaacccaagtgggacccatt

SEQ ID NO: 2723 - DNA, 523 bp, Mus musculus
  misc_feature (64)..(64): n is a, c, g, or t
  misc_feature (68)..(68): n is a, c, g, or t
  misc_feature (87)..(87): n is a, c, g, or t
  misc_feature (114)..(114): n is a, c, g, or t
  misc_feature (212)..(212): n is a, c, g, or t
  misc_feature (293)..(293): n is a, c, g, or t
  misc_feature (412)..(412): n is a, c, g, or t
tctggaatctgtctgtcatgcacactcgggagatcttgacttcattcccctgtcccctgtcacnttgnaaataattcttccttcttnccagctcttgccttccacctcggcttntccaagagtggaagaacaggtttcttttacccttcccaagcacaataaagcccaaaccaccatcccattgtgttcttggccttctcttctgtcagggnaggataattatagtccctttctccttgtattctcgtagggatgaaataagatcaggcaggcttccagaattggcacctggncaggttgctttatgccgggttgctcaaaacctattccgactacaattccttggtagctgtttcctagggctgcagaggccaccttttccataactctcgaagcgatggctgtatttatntttctcttctgcgtgtagagggagaaggagggagggaaacacctgtttcgttggcgctgatggaggcagaagcaatggtattctgggatcaggagctctgacgacaagctt

SEQ ID NO: 2724 - DNA, 425 bp, Mus musculus
  misc_feature (294)..(294): n is a, c, g, or t
  misc_feature (298)..(298): n is a, c, g, or t
  misc_feature (322)..(322): n is a, c, g, or t
  misc_feature (347)..(347): n is a, c, g, or t
  misc_feature (396)..(396): n is a, c, g, or t
aagcagcggctgactcttgggaaacagcaatcagagcaggcggtgaatggcccagctctgcaaggcagcatccagcaggtgggagtgtggagttgtggaaggctggcaatcctgagcagaaccggttggttgctgggacactgtgcggggagatcaactctagccactcctttgctctttgtcagagccctggtgattcagggcagcagaggaagcaaaagggtcatgtggcctctgctcctctctcctctgtcctcaagcttgcagttctaaggtcctgatgatggggaccgnttcntaatggagtgtgtgccctgttgtntctgaatccaggcacaacaatatcntcacagacagacctgtcactgtgagtggtgagggagttctgccaccttntccagcttcagtcctcaaataacgcacgt

SEQ ID NO: 2725 - DNA, 437 bp, Mus musculus
  misc_feature (409)..(409): n is a, c, g, or t
  misc_feature (411)..(411): n is a, c, g, or t
gagctggcttaatctagactgtggggatcatgactagttttatttattcaggaagacagggagccttgcgttggggaggatgcacagtcccacgggccttgagagctttgcatcagtcagagacgcaacaatcctgtggcatccttcatgcaataatttatgaccatgaatattatttatttctgaattggagctataaattcaccagggatttctggcaaagaggaaaagctactttccgaagtcaaacgccagtctccattttacaaaaagaacggactgaccactcaagtgatgaagatgtcggggaagattgtgcaagcttaaggaggcagatccttgctggagaaagtggatcactggagaaaagtcccatgtcctctgtatgtgtgccactccacctggtcantntgcagacattactctagcattgtagt

SEQ ID NO: 2726 - DNA, 466 bp, Mus musculus
  misc_feature (257)..(258): n is a, c, g, or t
  misc_feature (270)..(270): n is a, c, g, or t
  misc_feature (309)..(309): n is a, c, g, or t
  misc_feature (325)..(325): n is a, c, g, or t
aagatctgacatcctttctggcctccacaggagaaccataaaatgtctatcactaaagcagccggatccctgcgtatctctaggatggggcgtgcacaatgcttgactactgagatgtacgagccaggtgtgttgaggcagaagtgggcacagttgtgttccaagacgctgcacatgtggactgctgcaaaggaagacaaagaaggctttcttggagcccccaggcagacccaggtgctctttgggatgaggtcctnntctggaaagctntcctgggctatgaaggacacaccatgtccacacccattnttctataaggagaacntctttccaacagtcctgaggctcatgcgtggagaggaagtacttaggctctgaatctcggaagctggtgtttgaactatttatttttctccaagcctcagtttctacttttgtacttgggcaccacaagaatacctgtctg

SEQ ID NO: 2727 - DNA, 430 bp, Mus musculus
  misc_feature (236)..(236): n is a, c, g, or t
  misc_feature (256)..(256): n is a, c, g, or t
  misc_feature (258)..(258): n is a, c, g, or t
  misc_feature (311)..(311): n is a, c, g, or t
  misc_feature (348)..(348): n is a, c, g, or t
ggagtttgcatctcatttacatggaaatcatttcctgggccctcaacagagaactgtcctctctatccatcaggcatactgtgcccagttcgacccatctacagagtgggacagaagggggcctgtctttcggccagtgcccccctccccagtctacccactgggagtcccggaaaggggggcggttggcagagcacccaccagcaaggaaccctgcctgcgccccaggtcctttnggaagtcctcaagtgctggntntgcagaaggacttgccctggccagacagtgggaattcagtgacctggtcatantcaggaggaaattgaaacctgtgaggatagcttgctntcccagactgtattagagctggtttctgtcctggtccttcatgtatgtagttaagagagggcttccagcgtgttccatgtga

SEQ ID NO: 2728 - DNA, 438 bp, Mus musculus
  misc_feature (51)..(51): n is a, c, g, or t
  misc_feature (343)..(343): n is a, c, g, or t
ggctaccggcgatactttcgatggagggagacactcaggccttgtttcggnagcatagccctggcattctgcaaggcatgcagaaagctgcaatggaaccagaggtaccagacagtccccagtgtagcctcttggttccagtgaggtggctgaccacggtcctgcaggcaggagtggctaacccagaagacatcatctggaggccctgagtgacagacatccttatctgggacccctctgtgtgtatctcagctgcccagagccttggttctgggatcttcacatagaactttgcccaccaggaacatggggagccagaaacctgtgcgacatcaagggaacntgctcccaacacacactgctccaggaccactgacttcccagtaccactcccactggttggtgatgggtctgcctcaattgctcgtggtgtctatg

SEQ ID NO: 2729 - DNA, 525 bp, Mus musculus
  misc_feature (187)..(187): n is a, c, g, or t
  misc_feature (213)..(213): n is a, c, g, or t
  misc_feature (225)..(225): n is a, c, g, or t
  misc_feature (234)..(234): n is a, c, g, or t
  misc_feature (255)..(255): n is a, c, g, or t
  misc_feature (258)..(258): n is a, c, g, or t
  misc_feature (261)..(261): n is a, c, g, or t
  misc_feature (283)..(283): n is a, c, g, or t
  misc_feature (291)..(291): n is a, c, g, or t
  misc_feature (293)..(299): n is a, c, g, or t
agaaatctgactgagggcctgtgagccttgtgggagcccattgtgctaagccagtcccctccttatctcactctgggtcagagttgcccttccttccttcctggagcctgggctctggctgatagctacaaccccagggacctccttgtctggctagccctgagttgcatgcctgctgctgaggccnttcttcctgcctgcctttcctggggnccagagaggggnaaggcaagntcctttgcaggcctctgctgnctngtnctaagggtcctgtagtccttanggagaaancnnnnnnncccggaggtcagacctgtcctcctcccacctcctcctttgttagaagggaagtggtgggctgggaactcccttcttgcacagtataatggcctagggtgctggccactcagagctgggacctcgcctgcctgggtggaaattgctcgggctagggtggaaaaggagttggactaatcctacaagactagggtgatccacctaccctctacgaagtctgtgtggcaa

SEQ ID NO: 2730 - DNA, 534 bp, Mus musculus
ggaaaactcctgcaggtcgccaaaggcttgcacaagctgaagcctgcaacgcccatcgccccgcaggtggtcatccgacaagcccgagtctccgtcaactcggggaaactgttgaaggcagaatacatcctgagcagcctgataagcaacaacggagcaaccgggacctggctgtataggaatgagagtgacaaagtcctggtacagtcggtctgcatacagatcagagggcagattctgcagaagctaggtactgactgacgtcaatcgtcagcccctgcggagctcacggcagaggctggctacaagaatttactaaggagttttcttattatgtttggttaaagctgtgacacccccccccctttcccatagtagtcctcttgagaagaaaatgacattagatacctggagctgaactgagtgtgtctgtgcacacttgtgtagcctgctgtgtagactgaggagaaaagagcttgaggctggaggttggatctagcctgggcagcatagcaggagctcatgtctttaaaa

SEQ ID NO: 2731 - DNA, 525 bp, Mus musculus
  misc_feature (51)..(51): n is a, c, g, or t
  misc_feature (69)..(69): n is a, c, g, or t
  misc_feature (86)..(86): n is a, c, g, or t
  misc_feature (110)..(112): n is a, c, g, or t
  misc_feature (116)..(116): n is a, c, g, or t
  misc_feature (148)..(148): n is a, c, g, or t
  misc_feature (226)..(226): n is a, c, g, or t
aatgcaaccatgagatgccacctctcaaacataaggatgacgaaatgcagnagtcaagtgggtgaagcngtgccctcttacagaantagataaagacattgtgaacaccnnncggncgcgggggcttcgtagaaagctaaaagtaggnttgccgtatgatccagcaagctcacttctggatagagcaaaggaagtgaagtcacagacaaccgctttatgcttatangttgcagtgttataattggtagcaatttgcctgagatgtgccaactgatccagatgaagaaatcaggctacacacgtacaatagaagggaatgtgcttcagccttggaagaggcagtcctgacgtctatgagtgaacatggaagacaaatgtgcccctcagggaaagcgacacatacaagtttgtctagagaactagaatattctttcttgtggaaagaaaggccatttcccacgagagctgatgaccaggatgcgaaatgacatctggtgaccgcgcagctgcggattgtcgaatcca

SEQ ID NO: 2732 - DNA, 549 bp, Mus musculus
cacggtacctttctgtcaagctgggggcttgtggaacaacacctggcagacctatcagttgtcatggacaacttgctggccatgatggtaccaggacacctgcatgtctaagcacagcatggtatttgatatggagacctccggaatcccacccatccggcttatgctgagcgctaagatggcagttatgttggaacggaagtagtcagtggcgcatcaggactgggtcagctagcgctggtatgtgaccatccacatggcagccacaaagcagtatgagctgtgcttcaagctgttggagcccaggtcgcagcaggagtgtaagcagtgtggcatagtccatgtggatgcatgcgcctttgatgtcctcaacctgtggcccaacggtacgtacaagttctctatctagagggcaggtagatacaccctggtatattagccctggcgggaaagcctcaccttgcagattacgccaggaccccttgaggggcctgcccccagtctgggtaaggccagcctgcccctgtccgcaccttctgagagatgatt

SEQ ID NO: 2733 - DNA, 89 bp, Mus musculus
gggaggcaggccctggcttggcttcaggacctccagctgtcctaccccaactccaaactttctctttgcctacagaccacattgctcat

SEQ ID NO: 2734 - DNA, 395 bp, Mus musculus
aacaaacgtactgaccgctgagctgtagcccagacctctttttgcttgttatttgtatacagggtctcattacgttgcctgggcagtccttgaaattataatgtagcctcaaaggttttggatttccacttcccctgcctcagttgtccaaaactggatggaattagaatccacactaggtctcatctccatgccaagagtcattatacactctgaagaaagccggaatgctgggcatggaatcatgactcgttttaaggaaattgttgttctgtctcaggaggtattttatagggcttgtagtgagttttgatttcacattatcaagagctgaacaagatgccatcagctcccactaatggttaaatcagagccatttagaaggctgcccattc

SEQ ID NO: 2735 - DNA, 378 bp, Mus musculus
cagccagtacaacatctatacatagtcttccaatgttattttgtagaagagattggaaataggagaatgggacagttcagtgaaaggaaacaatgcaataaataagattagtttgctcgtcttgtgtatgcttgtgtgtgtgtagtgtttgtgtgtgtgtgtgtgtgtgtgtgtgtgtgtatagtgtttgtgtgtgtgtgtattcatccctgaatgtgtgtgcccacatgtgggcccgcactgcagggtacaagtagagtttggagacaacagtgtggagctcacatctttatgtgcttcccaggcaaatccacctctcaccctgtggttccagaaatctaatacaaggttcagatgcgaggctctctcagatgcaaa

SEQ ID NO: 2736 - DNA, 503 bp, Mus musculus
aaggagagtcccttccagccagagggagacatggaagtttggattcagatctagatcatgaagtaagggaggttttgacatccatcactcagaacaatgtggaccagaaggaccacatgagaagaccatcagacttgtagaagcttcaagcacctgagtcccacactcctacccaagagctatcccaggatggcctcctgccactctgctctcccaggggtcagcctgcagggaagcagctacaacctacagtggggaaatgggaaatgggcaccatcgtaccagcagtgactcgagagtttagctgcctggggtaagaggtacagggtggaacagggagggtaggttggatttggaatccatccgcatctgcaagcccgagccacctttcaccctgcaggggcctaccttctaccccatgcacacagtgctctgtggagtgatgctaacaagcacgggagctagtactttgttttctgttttcaatgttctttcttggcaaa

SEQ ID NO: 2737 - DNA, 528 bp, Mus musculus
catagttcctgctaatgggtcatcatgagtgcaatattgcctgatatagtttctatcagttttgcttaatcaaaaggcttctccacacaaaactgactcagagagaagcagagtgtaatgcatggggacctatctacaccaatgtcatctcttcaatggagcaataccttgaaagtggagaaattgttctgtttatcccaaagtaggctagcaaatacaacaaggttctcccattgtgaccaaccagattttgcctaactatagtgactacaaaaaatatatgggtgttacatgattaattcttagagttatcatcagttcatcacagttcacatttttgtagccattcttagtgtttccactgctggataatccaccaagcacagttgtgtttttatctttctcatttcagagatgcttccctatgactacctgaaccgatggacagcaaacaagcttgatgctgttgttgtgggaatagagtaagaaaacgtaattttcatgctatggtcatagtcttcccagaat

SEQ ID NO: 2738 - DNA, 508 bp, Mus musculus
gtcgagtggctcacagtgcttggaattaaaaggttaagtgaacataaagcgcacacccaggttcttgacagcctggtgtatgaagaacagattggttcgcactgtgcctgagaagcccgttagagccctgccacagaagtgggtaccgcgagatggatgggatcgccctttccttcaggaagtaggaatccctgtattacaaggactcaaattctgccgctagggggcagtgccccacagctctgcaactggaaggcactgcactggggaagatttatccattttgtaccctcaccaactccctctccttcatttctcaggatgacaacaccttgcaggtttatggccgtcaggagaatttactgctaagccatatactgatgtaatgaaatctaatatatgccgtgccatgaattatgagttgttatttagtttggggattttattacttcaatcacttatgaccatatttccttttatatgattgctcactctttaaacataccag

SEQ ID NO: 2739 - DNA, 417 bp, Mus musculus
ggcccgaggcagtaggagctcttatctttacaatcatccatcaaagtctagactgactccacatctgtgagaaacagtaaggataaacagagagtgctgctttcttcaatctaccacaccaagctgggtttctttgtttgtttttgtttttattttcttttagcttttgtttttattgagagaaagcctcacatagcccgggatggcctcaaactctctacatagctaaggatagcatagaactgttcttcccatctctaggtgctgggtttacagccatgggaccaccatcccttgcttgtctggtggtaggatttaaaccatggcctagtacaaaactaggcccaaactctattgattgagctccctccctagccccaagctatctaacattctatttctttcatagtctcccca

SEQ ID NO: 2740 - DNA, 424 bp, Mus musculus
gaatgagtgactctcatgctatagcagggcagggacatttctgtattgagatgtccacacctacccacccctgccagttacagatttccattctttctcatggccagttggccatttctcctatccctccccacacctgatcctgaacccctccattttctcccacatcccctctcctacccaattccctccttccatctgcttccacttattattttccccccttctactttagattcaagcatacacccttggccttccaaattgtttaacttctttgggtcagtgcagtgtagtgtgtgaatcttgtattttttggctaatatctacttataagtgaatacataccatgcatgctatcctggtactggattacttcattcagtatgatattctcaagtaccatccatgtgtcttcaaatta

SEQ ID NO: 2741 - DNA, 404 bp, Mus musculus
atgatctatgagcaacacagtccctctttctgggccaactgctgcttctgtctactcaacaagagggggctatctgagaaggtctacagatgtttgagtttgcaaggctgcctttctctttggtgatccttcaagatacatgtcgatcataatgccaaatagcccctaggtaaatagtttcagagtctgtcttccaaacaaaacacagtatctaaactgtgtcatagttaaagctatggtgatggctggcatggaaatgtcctccaaaggcttagatatttgaaaacttggtccccagttagtgcatcttgggggaggcttataaggtgtcatgttgctggacaaagtgtgactccagaggagtgttttgcagttttaaaagtcatgtggtactcctgttcact

SEQ ID NO: 2742 - DNA, 440 bp, Mus musculus
gtgccaataatgtccctggagtcaataaagtcatgctgaagtttcagaaggcacaagacaagtaaagccaccaacaaaaggccagctggctgcctgagtcgcacagagtgacatatcatggattattttcgcctttttgccttgatccctacattttacatattgtatttactaatattatttcatgaagagcttgtaatttgcctcatgatttgagttttcttggctctgtatctcaggtacatttttctccaaacctgcagcatcaagatatctgacctattgatccagcagaaaactttccctggaaaccatttgtgagatgtacctgtgacacaatgcctgccaccattgaaccctgggcttctaaataattaccttaaagaccttaaggatgtccaaacttccatcctccagacttctggcaaggcacgtttgac

SEQ ID NO: 2743 - DNA, 352 bp, Mus musculus
cattgctccacatggtggcagctgagtggcttgatcacaaggactcctgggttcatttccaagatggctgcttcccaggaacgacaaatggatgctgaactatcagctgaggattcttctccacgggtatctcttgggctccctcaaagagacaaaacaggattccaagagacagaaagggatgatgtcacacatctgagatgtaaggggttaaatcccatattctgaggaggaaagccccaaaaagactcaaaggggcaatgaaatgactttgcctctccaggcagaatgacaaagaatgtccatctgtctttaatccattctctcttttctattgttcatttctctcttg

SEQ ID NO: 2744 - DNA, 392 bp, Mus musculus
ttcctcctctttcattcttctgaatgctgagattacaggtgtagttattgtcagtttccaaacctgaaaagtagcagtctgggctcagctcaagcaggactctgatgcagtaaacattcagcatcttcagatgacacccttgtaaagtgggttgctgtttcccagacaaaaagccattattttcttgctggatcctacagctctcaaatctggagagagcatctagttttctagtcactcaaacaagcccccaacagatcaaagctccatactagttcccagacagttctaggtaactggtgtacctcccactgcaacgtaaccccttaaaactactaagatgccccacctcctaaacagaccatttctactattatctgtggtcctgggag

SEQ ID NO: 2745 - DNA, 482 bp, Mus musculus
tttgaccagagacacaactccagtggggggtgtaatgcccaaaattagcccgtaagccccatctgcccaaggaccaagtaacttcctagaatgctgggaattgtagttcttggaaaatactaaagtctcataggaaagtatggtggcctataggtttgtctttattaacccttgcaacctgtgtctcaggaccactcacctgggaaatcccagggagtgggcctgaccaaagtccaccttgctcagtatttaatatttagtaagattacttcgaatttggcccaaaatggtggagcttggttttctctggtgaatctcagcattaacacaactttctccccagtatatactcatggcaaagtatctcctttgcccccattatcaaggaaagaggcaaggcctggatgtggaccttgtgaaggaaaagtagactgaacaagatcagctacacaaactaggttctagaaagctctctgatctta

SEQ ID NO: 2746 - DNA, 438 bp, Mus musculus
tagataaggactccaagattcccagatgttgcctaacttcaccaggattatttaagtaatgctgttttgttttttgtttgttttgtttgggtttgtttgtttgtttgttttggtattttgttgttgttttgttttgatattatgatactttccctggggaaataggaacagatgccttttcttcctggacagaaagaccaaagaaacacttccacaggaaaccctcttggtctcttagggaagaaaacagccaaaggaacctgatactttcctcaagtgttctaactaagaaaatgcctcagatggaatgaaaccgtcaatgggaactgaggaggcgcacgtgtgaggtccagcactgccacagagaggaaactactggtcaaggattgcctcgcctatgtcagagggagtgcgcgagcgcgagaaagtagctgttct

SEQ ID NO: 2747 - DNA, 437 bp, Mus musculus
aattccacactatgtcaagcttgagctaaatgacacacttcctccaataaggccagaccttctccaataaggccacacttcctaatagtgtcctcactatggccaagccttgaaacacttgaatctatgagggccaaacctattcaaaccactacaggcaacaagaaacaaatttaaagacctaaaatcattgactgtatctgataaaaaatcacatagactcccactgtcttcgcactgtctttcagtgtccaaggagcagttccatctatctgtaacaaggctcccttgacaaaggatcaaattacaatgtggatttgtgtttcctaaaagcttctttaatttggagttagcttagcacatgccatattgcatggccattctcttccatgtagaggatggctaagtcgccaaccctactcaactgttatgcacac

SEQ ID NO: 2748 - DNA, 539 bp, Mus musculus
aaaacatacagtactctgcgtcccagcactggccctttcccaatagctcactcatgatcgcttgtcacgcaaccgtgaaaccaggacacacagagattcaggtgaacttgaaggaactagaggcagccgcctggttcagtcttgatgaggtgaccacagccctgaggagaaagggctccttggctctgcagccgagtgaggcttccccactgttgctgcctcccaagttagccattgcccaccacttgattaagaagtgggtggagacgcggagctgttcttccctggctgcttagctcaaatggagccgtctggatccctcctgggcattgctgcagggcactctggagatgacctgcgaagggaggtgacaaagccttcccgggcagaggctctctgagaagttccactgcctaaagccttctaatgctccaccaaaaatgttggtgtgaactggatagagcagcttgtacctgtacttgtcccagctaccatggaggcggaggcagaggcgagagcgtcacttttgcccaggacaa

SEQ ID NO: 2749 - DNA, 467 bp, Mus musculus
atattgggtctcttgtaacaacactataatgtcttgctgcaattgaggtcatggccttgcacagcccttgaagcacaggtgcttgtgggctggggcttgctatatgatgaactacatctctagccaactaaagagtagtctcatcttacagcatctgctagcatctcctcctgcttcctctgccacaacaaatagcagaaccattgcttcaaatgccacctgtaatatcctagtccatgaagcagctgcttcttgctaggacacacggtgctttcccatcaagccctgcccccaccctcccctccttctggcacagacttctgagccttctggctctgctgtcatctgttccaggatgcctttcctgtccctgagcaacacgaacagcttttctcagggtccacagggaatttcctgtgctttcctcacaattttgctcttcaatgtggtttctccacatctggtct

SEQ ID NO: 2750 - DNA, 399 bp, Mus musculus
gatgtgttctatacaggagcctgcatcccactgtcagaatagtaaaattccttgtcttctctagaaaatagcttttctgactcttgatagaggaaagagactaaggttatctccccaacattaggagtgattttggtcttggaggcccataggacagatttagtcaggagtcccagacacactagggacctgctgccacagtcacgtagagctcctagggcattagctcccagagtccgaaactgggctccacactgggggatgctgcaggtgtcttagcaactccatatctttcctgaagtgctgtccaaaggattagagacaagtcaggcaagagctctttaaaccacacccagagtctcttagagaatctggttccatcagaactccagctcaggg

SEQ ID NO: 2751 - DNA, 455 bp, Mus musculus
gattttttccaattagcaactcatgtatattttgtgtgtttttaaacatcttaacagtaagaagccttgaaccatatggctcttttttattttttgaaaagagatttgaattctgaatctctattgttatggttttaagtttaaaactgttcttgttcaatgaagtggaaaatgcttgaataatttttaggtattagcgttatagtaggcaatatgataagtaaaatgaagataaaaatagggagagcgagtcagggtcctctgtgaacatagaaggtctactagctccctctgtcttggcagagctaagctgtcgactgtcccacattgggtgtccttttctgggcagtattcttttgcctaaggatgaattagagcaattcttgcccagtggctaccttgtcacaactagagcaactctctctggaggttatgaggttcactatgtctcctgg

SEQ ID NO: 2752 - DNA, 376 bp, Mus musculus
gtaagtgattctctgtgatccttcagtgctgggtggggcttctaccaggagcactgtaactgctagcattgactacctcctgtctgcacttttatcactactttggggtttgaccactgtgtacaggtcacacatgcaggagagaaatgcccatgggtcagactcagctttctgacatctacttgtatctcagaggacctaagattccagactgctctgtctgttgaggtttttgcaatgcacacaaggaaagtgtggattctacacagagtggtgagcaacaggaaactcaggtcccgtagtctgtcccaggcttgactaaaaatgtcttgggttccaattcatcaggacttgacacatacttctgctctgagca

SEQ ID NO: 2753 - DNA, 358 bp, Mus musculus
atatacacagcaacttggctttggttatttcctggtgttgtcaagttgacatccaagaatggccatcatgacttccattattatggaagccaaaaatccctaagacctgtagttagcaagcatgaattccataagtggtgatgacataagttttgatctaagaacaaatgatttcagagcaatgagaagacaacgttttagctcaattctaaatgcaggaaaggcgaaagacctaaatgctccactttgaaagtaatagagaaggaagaagaaagaatcttctttagcccatatagagagaatcccttataagcatcacctgtctataaaaaagcatatggccattgagctgaaatta

SEQ ID NO: 2754 - DNA, 336 bp, Mus musculus
tggacccctctctttagaatgagctcttccaactccacatgactccctcccctccaggctcaagaaagcgtttagcaacaaaaggtgctctgatgtcaggcgctttgcatggaaatgagcctcagcctggccaacaaatcgccttttgaaagcgccaccgcgccacgggcccggggccctgcacaagtccccaatcgcgccattcacccgcgccttccgccactgaaactgcagaaagttaatctttaagccgctcgctgagttcgagtttaagaggagtccgtatggtgacaacccctggaattacagtcctgtctgtcaggcttcttggaaaac

SEQ ID NO: 2755 - DNA, 495 bp, Mus musculus
gagcgcctcacctgacgaggagtaggcagagaggctggaggcggccggccccgggcgtgggaggacagcacgtcctgcttcactcctaccctagcgcagcccagccagaggcggtcgactcccggaacgcaggcggatctccggccataggaccgagctggcgtcaggcccgctgctgccgccgccgccgcacccgctccaagcaccccattcagaagatggagcctgattcttatgcctggatgtattggaggtatttagtgactcacttctgaaaaatacactgtggcagaaatgacagtgtgtgacttcttcaagtaagatgtaagagggactgttgatatggtaggatttgctctgaaggaagccagctgccgaatgtgatactcaggctacacagtgggcaaggccccgtgatgagaaacagcttctgtgcttgattgagatttcgttcttcagatgctgaacctctagctgtgcttggccacctcggga

SEQ ID NO: 2756 - DNA, 548 bp, Mus musculus
ttacgccgccctgtatgataaggctcctgactttgatccttatcattagatgccatttgccaaaatgcccttagagctgtgcttataagactgagtttccttcccacttagcttgctttttatacacatacacattttaaatctaggtcccacccatgagagaaaacattgctctctttagtctggcttatttcatgtaacatgatgatttctagtcatgtccaaacatcatgacatcatgattggtttttttgtttttttctaaatgtatatgattacgctgtgactgtcttcagacacaacagaagagggcctgggacccataaagatggttgtgagccaccaagtggttgctgagaattgaactcaggacctctggaacaacagtcagtgctctaaactgctgagctatctctccagccccgattccatttttccttgtggctgtacaaaatcccattgtctgttgtatgatgttttccttgtcaggtcatctactgacagacgtctaggctggttcctttccctggccaccatgtagcaataaa

SEQ ID NO: 2757 - DNA, 352 bp, Mus musculus
atcgccttccatagggtcaagttgtacgactcctcctaaaccagaattctctgccggtgagattagaagatgcctgaccgaccctaagcaggagctatccctgggctagtcgagtctccgagcctcctcaaggggcccagcaaggagcactctggctagctctcctcgaggataggagtgcagtgacacccgttgcgcaccccaactgcaagtttactacttctggttcttgtggaagtgtgatcccactttttttccggtgtggcgggcactcgccctttcgtgctagcgtgaccattacgctagctaggcctttgtggacctgaaaagatccgaagtctctcagaacgcc

SEQ ID NO: 2758 - DNA, 247 bp, Mus musculus
gaacaactcaagtatccacgtctccagcccatggtgtgacagtgatgtctccttccactgatatctttgacatgattccattttccccaatatcacatcagtctccaacatctgctcgcaatggcacacagctaccacccatccctagcagatctgctgagaccaaacgggacctttttggagctgaaccttttgacccatttaactgtggatcaggggactttcctcctgatattcagtccaaatt

SEQ ID NO: 2759 - DNA, 533 bp, Mus musculus
gtggtgtgtgacttattactcttcctatgcgcatagtatgacaggcagaagtaataatggccgatgcattcaaatgctcaaagtagctagagcactgagatcagctgagatggacatgaagcaaagaagtgaagaggagccaaggggacaggagggaagggaacaaaattcaagagagatgaagatcatgaagaagttgaagcaccacattgagagggctcggtttaaaatctactttatcttagagctggacatgacaggctcatacctgcatacggaacagcccactctactgagcatggagaatccaccaggaatcccctttcaggagagaaagaacgtagcatgtgctgagcttggtggccctggctaagcagaatgtgcccatttgaaagccaaataaaggtcacccagagtctttccttaggtgtcctaaaactctggagctgaactcccagctcccactttccagatgttcatctacctgtacttgatgtaagaggaccctgttcctcctcccaagctattgaaaa

SEQ ID NO: 2760 - DNA, 487 bp, Mus musculus
atgctatgtcgcaggcaaacgccaagcgccacatgtatttttactgaatttccacagagaccgtggtaagagaccactgacccgcacctgaggtgcgcgatcccacgttcagagtcccacgtcatccatgatcctccagttttggccacagagactagacttgacctgttctcaggcttttcccaagagagacttatgtctttttttgatggactgagtctcactctttggccaagctggcaactcagacaatcctcctgcctcagtcttccaaatgctggaattataggcatgggtcagcatatttggcaggtgtatcttccttaaaaacaagacattagggctggggctgtggctacgtttgtaacatgcttgcctggaatgcatgaatcctgcccaggctggacttcttctgattagtgagtgtgaggccagaccacagcagactgcatctcaagcaaaacaaagtaagctgtttgcctcacct

SEQ ID NO: 2761 - DNA, 500 bp, Mus musculus
acagaaaggtctccagggtcctggctagcctagtcctcatcggccctaccattcttcccttctctaaattccaccaatgctttttcatgggttctctaagccagtggttctcaacttgtgggttgtgaccccttgggtggggatgttaactatctcttcataggagtcacatagcagatatccatcctatcagattacatttgcattaccattcatatccgttccaaaattacagctatgaaaataactttatagtcaggggtcatgacaacatgagcaacttttaaagggtcacagcattatgaaggttgagaaccactgctctgggctctaagactaagggtgcctggggatctgcatacttctctctattccattcttctactagttcattcttcctgaagcttcagaactcagccagagtgtcactgtctcaaagaagccttccctgtctccagctaagtgggatgccctgtgaagtgcaccctgagcatcgcaag

SEQ ID NO: 2762 - DNA, 517 bp, Mus musculus
aggctcagtcctctataccataagacaccttacagggcagaggactaaaggtgataaaacacacaaaatcttattgtagtgcctaacataaaacgcccaagacaaggtctttgctactgttattcatctttctaaatgaaatgagctggaagtgttctgacatctctgggacacgtgcctggtgggtgagtttagggaaagaccacctcagatgacctctgtgaaaaggagggttttcaaggcgttctgaacagtgatggctcgcactctcagagagcgcacaagatcttccagtcagcccaagggaaaaagagctcgaaatggtcacccagtgtcacccgtggccttgctgactcagagccaaggcaagtcaaacttagagtcagctttcaagaaggacttccaatcatgtgcagtataatactgtgcagtttaaatcttgaagtcaaaaaaatctgaacccacaaggagaagggcaggggacacaggtaatctgctatgatcctgagggccaatg

SEQ ID NO: 2763 - DNA, 502 bp, Mus musculus
ggccctaatgggttttgagcttacagggtaccattcacttttttgcttcaaacctctgcagatgctgtgcctgccaatgatgtgatgctatccaaggctgtttcctcagaagatgctgatttttaaaacctccccattctgtgcattctctaggagttaaaggaagcaagaaaatgaaaatcaatcaggctacaggatgtatcaaaaatgccttttctcacatcttccttgcaaacaggactccaggatagaaaattcattcccatcagaatgagacaggtaacatgtgtttctcaacttggtggaacaacagacagcatcctggagagctgcagtatttcaatccagtcactaaaccacacattggacttccttcgcctctgcctctctctgatagctattagctaaaggatcacataaaaagcagaagaggccttggacagtttgctgtggttgggaccagatatcagaagtctccattctgttggcatccttgatagga

SEQ ID NO: 2764 - DNA, 537 bp, Mus musculus
gaaacttcccatgaagcttgtcccgggcacccgatgggtctgaagcacagtcattgaccccagggactctgcattggagggaaaaccctgaaaggtcacaagttcagccacccccacaaacactctcacttctcagccccttctgtgttatgtcatctctctttgttccccatggaatgagacgtttaaattacaatacagagcagctgccatttgagctcttgagaactggtgtttgagagagggttctgtatgcctgcttcactccagaaaattattatagatgatgaggttgagtcatgttgcacatggtataaaagtaaataaataaacaaccctcaggttgacacatgagttaaagcttatacagaaggctttacattaatgggatgaaatattgatttctaagaaatgtcgcttgccttgtgtttttgttttatttttatttatttttttatttattttggtaaggaaagtcaacttttgtttttatattagactgaatctcacatggatgaaccttgtgatacctcaaat

SEQ ID NO: 2765 - DNA, 491 bp, Mus musculus
caagttctctctgtgcagcagcaaatttatcaatcttttcacctgacaatactttgaaatatatcattgtcatcccaagttgtttgatagattaactgtaggaacacagccttttccaaggtcaagttgaagattcttgtttgctgtttaactaagttgtttaaaaactcagaacaatgcctgcctgttaaatttccacttgttctcatgggatattggaaagcaaagtttcctgttgactgagtgtgtggacacgtcatctttttgagttaaattcagcaaacgggattagcaatgagatcaaccccttgcagacacagaggaaattaaagccctctcttatcctttcaatctgtgtactaatgtttatgtgtgtcaggggctggttacagccacacatatcacgttcagctttctaattttaccccagtgggaaggtacaaatgtgctcttctaaagcaggaaggcacagaaattgtggccactcctgt

SEQ ID NO: 2766 - DNA, 184 bp, Mus musculus
gatatttatcaaagccctctttgactacgatcctaaggaagacaaggcaatcccgtgtaaagaggcagggctgtctttcaggaagggggacattcttcagattatgagccaagatgatgtgacatggtggcaggctaagcatgaaggagatgccaaccccaggagcgggcctgattccctccaa

SEQ ID NO: 2767 - DNA, 444 bp, Mus musculus
ggattacaaaagctgcccttaccactccccctgcactgaagactcagccactttagcgtcctcaaactttgatgtttatcaggatcttctgggcagctcactgagctgagccccagcttccatagcatagataaggacctgaactctgctgggaacttcccaggagctcagcagcagacacaaggtgggatccatggcgttttatattgtggaatcaacccactaggttggacggttaacttccatcatgacttttcacagcctcctgcaccgtcctaacccaatctggtgtggtcctgaccagttgacagctcactgtcccctctctctctttcctgctcttatgcccatgacaagggctttccttgctgagctctgaccttcctctcaagccaatagtttcaggaaactaagctctgtcctgcccacctacatgtgatttat

SEQ ID NO: 2768 - DNA, 560 bp, Mus musculus
cacaaggccttgtctagtgtcacaacccctttaggcaactagatccttgtctttgagtataaatgcttcaggagaaacagcaatgataaccagctgcagacttgacaagaataatgctgctgtatggatcggggaagtggctcagttggacggttcttgccatgcaagcaggagaagctgagtttggatcccagcacgcagagaaaagcaccacagcgtacgtgtatgacccctgcactggggcaagcggtgaagcacagagaaagaagggtccctggaatgtgttggccatgcaggcaggccaaactgctaagcttcaggagcagtgagcgtattggttacttctctgttgctgtgaccaaaacaccataacttaaagaaggaagagtttatgtaggggctacagtcccagaggaggagaaatggtatcagaagaccaaaacaggaagctaagaaatcatagcttcaactgtaaacacaaagtagaaagcaaaaatgtacggatgaagctatgaaccctcaaaactgtccccaatgacatatttcttccaacaaggctg

SEQ ID NO: 2769 - DNA, 406 bp, Mus musculus
aatgtcaacgatgatgcacctctcctcctggagcagagcttctggagtccaggcagctactttcccagctgaaaaatgccggtgaaccagcacgacaaggctgtcatgagtaccagcttacggttactggcaaacagcaagcacaattaaatttcagtattgagtcacctgtcaactgatcagacttcaactccgactcctactgctgagttttcaggctgcgtgggatttttgccatattgagcttagcttgcattaattgatgtgtgctgttaaattctagaagagccacattgtttttacagaggatatatgctcgtggtttagaacatgtgtgatgcacacctttcttgtttcttagctgtgagttcttcagcccagaaaggtcgactacaggcgttgattt

SEQ ID NO: 2770 - DNA, 505 bp, Mus musculus
gacttgcagtcactgggtcccttaattgttcttctttccactgccgctccactgaattactcgatttttctccattccctgtgcctttaatcggcatcctggagatgggcgaccaagcctaactcgtcggggctgccagagcctcccaggcttttactctacaaacttgagctccatctctgaagcagatcatgttctgtgggatgggaaagggcctctgtgctctctgtaggagtcagaagttgagcatcaccaacccagtcttggctggatgagaggagtgtctctgaagagaagcggggctctgattgggcagtagcctgagccaattaaagcgcagggaggcctaaagtcaaggagagggactgcctctactcaggcagggtatacaatgttatgcttggaagagacaaaaaaaaaaaagtgtccctgaccttcagctctgaaatgtggtgagcacaaggcccagcgcagaaaactgagcctcagagagaagtgacccggc

SEQ ID NO: 2771 - DNA, 529 bp, Mus musculus
catttgtgatgcttgggtccctgaacttgtctccaagatcaacccttgactctcagagacagcaagaggctacgctgcagaatgagcttcgtcctcagactctgggtgctagttgtgccccacgctttgtatttgggaccttcagttcgtttaactgttcagcttcctgggctgcctccagaccttgtctctggctgattcacttttctctcaggcccaccatcccaacatcattaatccagcccctctgaggctgtcacaaggttcattcatatgcatattagataatacccgttagtgatgcccattaattaagcagagcaatttgtttataattaactggagaaatttatggcttcagaaaacaattacaggagccgatataaacacattaggtagcgatagcaatgccaagtctaattgctttctagaagaatcattgatagtaatgccacagccattatgtcttaagtctgacaggagcttgtaaattcatcattgcttgtagaaaccaacatctcaggcgatt

SEQ ID NO: 2772 - DNA, 319 bp, Mus musculus
aggctcggtgactcgggaatcctgaagactctgggaagccaggcgggaccgcctgcgctgtgccttgcttgtcctcggccccgaccctgctccagcgtcccccgtattgggcgtgtgtccggaagtggcagcgacccaggctggacgccgcgagagtaaacccgtgtcaagccgtgtaagctctggggctgacagctgggaggcggctggcgcagtcggcgcccctcaacgatgtccccacctcccgcgtagaaccgccagagttgagtcctctcccagtgccggaacctcatctacctctttgaggaactttgatgtt

SEQ ID NO: 2773 - DNA, 484 bp, Mus musculus
tggttcccagcagcttctaattaaaagtttattgatttgagccaaggtattcatcaaaggtgtgatacataacaagtggcaaagatggagcttgaagtcacacttaaatgtagctgtccatcaatgctgcttatgggcatttgtaactaagacacatgggcatctcagtggaattaatcagcatgtggattcccctcaactgagggtagagtgaagtcaccaggcatactcgtgctgtctgccttcccatattcggaattcgcttttgcactggtttcgagtgaccacactgactgtgggcttttgctgactttaagtgacagaagagaacagatgtctctcctttgcttttctcagtttgccttgatcagaagcaatcaaggcaatggggctgctgctgggctctgtggggaaatcaagcttccgctggccttcgtgctgcctgagcccagaagctgctgcaatcctgaaggcggtctgcatc

SEQ ID NO: 2774 - DNA, 441 bp, Mus musculus
gtcttcatgctgtccaatgagctgctctcttcccatttactgccaaagggagatttgagattctgctcagaggtccaaatcatcctatctgtttgaggtttctggggatgagtctagactgcacctcaaagccctaaagctctaatctcactttgtgatccagaaggtgtttccttgatctacaaagctggacatccatttgtcaggcaatagaggagtgcacagtcctcctgcccatcacctctaataggaaacccagatccttttcgatgccacctaggatggcagtacttttctcagcatccacaggccccttagagccccatccattcttccatgccaatagcaggaaggtcagccctaccataaggtatgttcaccacaggcttctatgtctgctttctttctttttgcttttcttttcttcgtttggcccaaatg

SEQ ID NO: 2775 - DNA, 335 bp, Mus musculus
gaatttggaagagccctgagcattgaaaaggagtcatttgctcaagacacgggttggccatacaggagagagaggaggcaatgccgagcgaacgatttggatccctgctggagaaaattccaagcaagatgaaaaatgacttcagcctggcctttggcctgttgctgagatgtaggcccgaggactgtctctggttaccttgtcaaactcagcagcaccattaagaaggacactgagcagtggagccattaaataaatctaagagaaatggcagctcatctgcatctgaagttacacagctgagaaaagcctccctgtgctctaatatgtgtgta

SEQ ID NO: 2776 - DNA, 352 bp, Mus musculus
ttgctgataccaagacgtactcccagacaggagcctagtatggctgtcctcggagaggctctgccagcatctgactaagatagatgcagctcctggattctatgatgttcttttagaagtatgtagctgcctcttgtggaagatagacatgcatgttctgacagctcaaagaaaaaattatttatggagaattgttgccaaacagcctgctgtggctcttagagcatttctgtgtatctgttgagccaggcagctgccctgtcatgcagactgaatgtttaagtgcattgtggttggctttggtggtttgtatgaaaatagcctttgtaggctcatttggtgtggccaagct

SEQ ID NO: 2777 - DNA, 532 bp, Mus musculus
ttgccaaccacttgactacgaggacactgattaccaagatggctcggcatgccctggatgcccacccgaggtccattccagctgtcctggcgatcccgtccaagaagcatccctacgatgcagccaaaagactccatcctgcacagtgccaagggactgcaggcaaataagcaatatcctgcctctttggcaaataatggatcgtttggcttcctgaacttctgcatagattgtgtgtctctccctgcgtttacttaacatcttgagcagaaatgatggaattagagtgatttcttactggaaaccaagcacagagaggagcaagtgctgactactttggccacggtgcaagataaaacagatgtccagaaaagtcactccctgacattactttaaaatatatgtttcaccgatcttctttatcgcagaaaaaattctttccaactcatcctttctgttgctgatcttataagcacccatatcaaattatagatttgaaatagaagagtcaccctagacctctaatgtcaag

SEQ ID NO: 2778 - DNA, 455 bp, Mus musculus
cagtaacaagcacttcctgttcttccagaagatccaggttcagttcccagaacccgtcactgctgtctgtaaatctaatgctacgggatctgacacccctttctggcttccatgagctccaggcgcacatgtggtggcatcttaaggccatcagcaagacaactttgaggctgcctctgtgtgtgaccctggctttgacaactgtttccagcaccattgctgagcacctgcaggcctgcctgtgagcatacactagcatctggccgaaaccttctggagtctccataagtgccatccttctgccccgtcacagctggagaattgcatggcagacatgggttaagtcaccaagctcccagaacaacctaactagagcaaagtccccatcagaaccatgcagcaggttatctgcccagctgttccccacttggtgagtgtcctgtgtaacctttata

SEQ ID NO: 2779 - DNA, 391 bp, Mus musculus
gttccacttgatgaagctacaccttgatggcagcgggagacaatgttaggaggcggggtctgcctggaggggacacacccagggacacaccttgcacacacacaccctctctccttcctagatgccttgaggtgagcaactttgctctgaaaggaactgtgactttcatcagggtgttctttttcactttgagcctgagacaatgtagccctctgaccatgcgctgcacctttggaagctgtttctgttcagcgattccttggttatcggctagtgatgaagtatgtcaccaatgtcttctctggatgctggagcccttgtggcaccatgggttccatggctacactaaaatactgttattcatcagcattgctagagtacagtcctgggt

SEQ ID NO: 2780 - DNA, 487 bp, Mus musculus
aggaggaacgtttggccactctctttggtgatgtggaggacttaacggatgatgaagttgctacatcgaaagttggaaacagtggcccccctcctgctcccagccaagagaaaaccagcgaggagctgcaagatgaattaaagaagttgcaagagcaaatgaaatccttacaggagcagctaaaagctgcatcaattaaacagcctccagggacagcacccttgcaggaaccacctggtaatgtgactgtaattgtagcagtaatttgcatttttgttaccaagaaacaatagcgttagtattttcacccagctcctgccaaaactgtagcattcctaatttctttcattttcaatcgggaagattcatctctgcagccactgcttaaggagaagagaattcggagaattcaggagtcagcgtgcttttctgcagagcttgatgtccccactttacccaaagccaagcgggttgctcggaagccaaa

SEQ ID NO: 2781 - DNA, 482 bp, Mus musculus
agctgtggtgctgccttcaggagaagagcataaatacacatgccatgtgcaacctgaggggctgtctgaacctctcatcctgaaatggagtaaagagccatctttttctcccaccacacccatcacggggatcactgctggtctggttctccttccagttttggtcactggaggtctgtctgcaaccatacccctggaatattgcctgaggtctaggactaagagtttcctctggaaccaaatcgttctgcattctgttctctgcctttatcctcccagagatggagaaggatgttaactttattatttttatcattttatctccaccccttaacctcaagtcccagcactgaaagtctcgaaaggaaacagagacctagtccctccctcattctgttaaacaacccagcagctgggcacagcctgatccttggctccactgtggcgggagtcctgtatcttgcatcggatctggtggtgtt

SEQ ID NO: 2782 - DNA, 357 bp, Mus musculus
ggaagctctgtgagtacatcaagacacacaaccagtatctgttggaggagtgctatgcagtcttcatatcaaatgagaagaagatggtacctatttggaaacagcaggcaagacctgagaatggacctgtgatctgggactaccatgtggttctgcttcatgtgtcaagggaaggacaaagcttcatttatgatcttgacactattttgccatttccctgccctttcgacatttacatagaagatgcccttaagtctgatgatgacattcatctgcagtttaggaggaaatttagagtggttcgtgctgactcctacttgaagcacttcgcttctgaccggtctcacatgaaagact

SEQ ID NO: 2783 - DNA, 498 bp, Mus musculus
ggatgaggtcacatgatctcctggggcttccaagacttctacctgccaggtaaaactgagggtactcagtgtcttggctcagaacttcctcaaaggaatcaagaggcctgtttcaaaacatgctaacagatcttaggtaccaggagggaaaggccagcgaagagacagaaataaataaatgtggtctgaatgttaatgaccccacaggctcatatatttgcatatttagtccccagttagaggaagtatgttgccaggggtgggctttgatgtttcaaaagcatgagccaggctcagtcagtctctgcctctctcagtcagtgtctgtctgtctctggctgccgcctggggatcaggatgtaaacttctcagctactgttctagtgccatctgtcccagcactcttcatcataacgatcagggtggagtaaaacctctgaaactttacgcaagccccagttaaacccttttccttcctaaaagagctgccttggccat

SEQ ID NO: 2784 - DNA, 454 bp, Mus musculus
catggctgtccactgagaggatctacccagcaactgactccgacagatgaagaggctcacagccaagcattggatggaacttgaggactctcatggaagagttgggggaaggactgagggcccgaagcaaattggaactctacaggaagatcaacagagccaactaacctggacccttgaggactctcagaaactaaaccaccaaccaaagaacacacactggctgaacctaggtaccacccccccacacacacacacacatgtagcacatgtgggtcctgaacaactcaaatggggactattcttaaagctgttgtctgtctgtgaaatccattaccctaacttagctctcttgtctggccttggtgggagaagaagtgcctagtcctgcagagatttgatgtgccagggtgtgggaatacccaggaagtgcctctactctcttggaggagaa

SEQ ID NO: 2785 - DNA, 540 bp, Mus musculus
  misc_feature (405)..(405): n is a, c, g, or t
ggatcattcatttcatcgcaagcgaggtaacctgtgcactgagcagtcagtcgatggtggttctcggggaaaccaagcgaaggaacgctcccccacccaccttgtcccggtggctaaacgcagacgtggactccccacccggccccctccggctacacatcagccaagcgtaagctcgagggaagaactcttctctggaggcgttcaccttgccaacaggtgtggcacccgaaagaagagccatcacatccccacgagggtcgctcagtgccgcgttctctttgcagcagaaaattcttgaagaccagtaggtgtcaggccagcatctgacctctttcaggtgcttagaactgagagtctggaaactcgatcccttggtctcgctggaagccactactatttatngactctaagccggatttgagagaccttttggctccgtttacgtatgacccaacaattagtcactgtctgaagcagcgtacagaatcaccaagagaaacgtgtgcgcgtttaaactactgtattgtggagccggca

SEQ ID NO: 2786 - DNA, 530 bp, Mus musculus
ttcaagatgcactacttctctgggcctcataaacccccacagggctgctatgaggaacaaatgggctaagaatggtgctaaggatttgtgaactgagaaacaaaaggggacgtgactgaatataaagtcacagtcctggccccaactgaagggcgtatggtgtgcacggttgtctgcccgcacgtccgggtggtattcctcctcaggcgatggaggtatggtgctgactggtccttcagcagctcccagcccctgtatgctcctgcaaattaccatgctcactcatcactcccacgccccacccccagaggcgtccttccccaaacaacacacatcctcaaaccaaggatcccacccacactcctgtgcagagatgtggcttcaaataagccagctgccagctgctccttggagctgagagaatgtcccaccaagacacatttcccagagaatgaggaagactccacagctgctgaggaggcaagagacccgtgccgagatcctctcatggccggatccgctaaagcaaa

SEQ ID NO: 2787 - DNA, 357 bp, Mus musculus
tgggaacccgaggactgcgcagaacctttgcagaagcacaagcccagcacctcgcggtgccagactgtgcagaggacccttctttgtcacgtggttcccagacgcgggtgcaaatctctctgaggactgcgtacgtgcctctctgcgtgggggagtggggaatgctgggctcatcctctggaacccagaaggcctagcttctagaaccgctgctgacaggtgtctgcggaggaggctccccatctgctggaccaaccgccggcttccttcctctccccaggactgagtcactggagcatctatctgcacgctgcggtttcgactttcccccaagtgcatagcgagagtcctgacgtt

SEQ ID NO: 2788 - DNA, 219 bp, Mus musculus
aacttttacaaggtgagctgactgcctggtcccagcctgggaaggcctatgtggccggagacagggttgccttttcagagttccaggggcagaggcaatccagggttttctacagctctgtctcgctcattcacatccaatgtaactggggagtcttcaagtatgtcccttaccccttccttctgcttcctgaagtctttgtgactctatagctttgtg

SEQ ID NO: 2789 - DNA, 409 bp, Mus musculus
atgatagtacatctggtgtccaaccaatacccagccctgcagagaaaacccaggactcagagttaggtccttctgctgctgctgcaaatatagggaatatccaagaatcatcaccattagtaaaagtggatccttcgtccaactctgggaatgaacagcaagtagaaccggaggaatcacaacaggcagagagtcaagagcattgtgactccactggaaaacaagagaaaaatcaacctagaaaaagaaatgtagtggaggttaaaaatctttcttcatctcctgaaaactcacaaggttcaccccaacaaatacagtcaaagcagaaacctttgattgagggaggatctggtcaagagagagtacctcctcctcatcctcttaaattgctccgaccacgagtagttaa

SEQ ID NO: 2790 - DNA, 381 bp, Mus musculus
gatcaacttcttaacagacgccggagacatcgccttccacgtcaaacctcgattctccagcgccacggtggtgggcaatgctttccagggaggacggtgggggcaggaggaggtgtccagcatattcccactgactctgggagagccctttgagatggaggtgagtgcagacgcagaacacttccacatttatgcccaggaacaaaaggtgctccagttcccacatcggcaccgaccgctggccaccatcaccagagtgcgagtgctcagtgagcatcggctggcccaggtggagctggccaagcggagcctgagctggggcgatgggggctactgagcagactggaccacagcctacaagagccagccttgaccatcctg

SEQ ID NO: 2791 - DNA, 386 bp, Mus musculus
gtttttcttagcttcatcttcttttttaattgaaaaaaattttttttgttgtttttttgtttgccttctcaacagatttcaatggaataaaatttccaggctacttggtcctagcccctttctctcctccaaaagctctctttcaatcatatcaagcctgctgcagccagccctttataagcaagcgagggatggaatggacggggtccaacgcccatctgcccattttatggcttcttgttgctacacacagcgatgcaggctttgtcccagatccccaaacactggtattgggtgttttatggacagagtttttaatgtcaagagcccacatgtttcttatctctttctggcaattgaaactagaatgtcgttgctggagggca

SEQ ID NO: 2792 - DNA, 294 bp, Mus musculus
tctgccagttgggacgttctgacagtggattccttcccaggctttctttgcttagggccatgtcaagaccgcatgggatccagtctgccctgacttggaaaattggaattccacccgagcttgagtccagaatggcagcaagggcattcaccctgacgggttactggaagaagagcatgagacagaagtgcgaatctgtggcatgcaatgggaaaggattttatccagattcaaagtgtgatttgaaacagcttgtgttggagttgtttatggtcgggatgtaagtctctcttc

SEQ ID NO: 2793 - DNA, 407 bp, Mus musculus
aaatccccaggatgacttctcattggctctatcagtgagcatgtgagcaggctctaaccagtcagagccttgattgttttcctgtagggactgtttcagcatgaggatgaatgtgatttctgggccagaggctactgttctgctgagaacactgctttctagggacagcacagagtaaggcaacaccacacaatgctgaatcaaaggctgagtgaggggttgagggaggtaggaggacaacaaagacgcggtgatggtgagagtgagactccttatcgctgtttgattgattttggcagccagcttttctaggagccagaagtgtgtccttggcttcctgttgggcaaactggttatttgattacagccaaagagttttgactcgaggtcaggagttacaggccaaa

SEQ ID NO: 2794 - DNA, 443 bp, Mus musculus
  misc_feature (301)..(301): n is a, c, g, or t
  misc_feature (328)..(328): n is a, c, g, or t
  misc_feature (330)..(330): n is a, c, g, or t
  misc_feature (333)..(333): n is a, c, g, or t
ttggtagccacatttctgactctgagtaaaaggccctttgctggttactctaacacatttggctggtccaacagcacaagccatcttcttctcccttcatctttacatggtacatcagaccttttccaatctaaagtatcttataaaacgtcaaaggaaaattagatttcatagaaagatatatttttaaataaaattctgtgtcctggctaaatctagagaggtttcttttattcccctaaatatttgattcccctgaaacttctaagtcccgaagctacagctttcccttagattatangacactcacatacttctttaatatcantnttnccatcatttttgaggtccagtcatagacatgtgcatgtttatttggaaagcacttccatcactccaatatatgggttagaggaacagagcccctccatggaagtttgctt

SEQ ID NO: 2795 - DNA, 374 bp, Mus musculus
  misc_feature (64)..(64): n is a, c, g, or t
  misc_feature (323)..(323): n is a, c, g, or t
  misc_feature (342)..(342): n is a, c, g, or t
aaagttctcctcactggctgctggtgtgaagtttaagaagcccaacttgcactcagaatgttanctcttctcttaatgaaccagattatgtggaaactaagtctgagaagtgaggattctactggagaagagatgccagaccctcttactctgtaaattggaaacgtgccccccaatattaactagatgacagtagactgacttttacactgtaggaagccattgaattttgattaaatcattgaattggtaaaagctagaataacacaggggaaacttatctgaagagtaaatattccccagtacactcattaaggtggatngtaacccaggccttccagntttgtgccatgaaatgttgatcaagcactccc

SEQ ID NO: 2796 - DNA, 559 bp, Mus musculus
  misc_feature (69)..(69): n is a, c, g, or t
  misc_feature (94)..(94): n is a, c, g, or t
ttcagtcttcagttcaaggcaacagtgaatgtagggaggaccttccaagaaacaattaggaataggtanccatgacctgtgattaggacgtctntagcccgcccataggtaactcttaattttgtatgaaattcagctattctcttctccttatccatggatttgtgttcctgtctaccacacgagggagtctaagactgacatgcactcctctctcctaggaacagctcacttccttctggaacttagttcaattagaacacttggccaggaaaatggctcaatgggtaaaagtgctgcctagggctggagagatggttcagtagttaagagcaagggctgttcttccagaggtcctgagttcaattcccagaacccatgtaaaacactgggtgcagtagtgtccatctgtaatctcagcacacctaaggcaagatggagtaaaacacgagagactcaggtctgtggaccagagcgtggggtagttttcttagcagtaacaacaggagaccctgcttgaccaaggaggaagatgagaactaactccttccaagttgcc

SEQ ID NO: 2797 - DNA, 527 bp, Mus musculus
  misc_feature (213)..(213): n is a, c, g, or t
  misc_feature (261)..(261): n is a, c, g, or t
  misc_feature (273)..(274): n is a, c, g, or t
  misc_feature (292)..(292): n is a, c, g, or t
  misc_feature (305)..(305): n is a, c, g, or t
  misc_feature (310)..(310): n is a, c, g, or t
  misc_feature (317)..(317): n is a, c, g, or t
  misc_feature (321)..(321): n is a, c, g, or t
  misc_feature (325)..(325): n is a, c, g, or t
  misc_feature (363)..(363): n is a, c, g, or t
  misc_feature (391)..(391): n is a, c, g, or t
  misc_feature (418)..(418): n is a, c, g, or t
  misc_feature (422)..(423): n is a, c, g, or t
cagaggccctgagctaaataaccagccaccacatatggctcacaaccatctataaggaatctgattccctcttctgacatgtagacagaatattcctatgtctgacaaaaaaaatacatacataaataaatcttgctgggcaattgtggtgcatacctttaatcctagtacttaggagacagaggcagacagatccccgagtttgaggtcagnatggtatacagaatgagttctaggataggcagggctacataaactatntggaaaaaaaannaatttttttttttaacanccagatatgttgntacanactttcnttantccnaatatgcaggaggcagaggtagccacatagtgagttanaagccagccagaactacatagtaaggtntcaaaaccaaataaaaatgtaaatgangaanntacctaataaaaatatagaatacaaaacacaaaaacaaatacaaacacttttaaagcaagatctgtgttaacacctctggagaaaaactcacgtattaggcttt

SEQ ID NO: 2798 - DNA, 505 bp, Mus musculus
gtttgccaggcacttacatagccatgattcttatgtttcccccaagtggagcatttcaaagcttgctccagttcctataacatcttctttctaaatggctacaagtagacacaagctaacaacgggggatcccttgcacaccccaaaatataatatgaatctgaatggggtaaaatccccacttgtttctcatgcccataccactgtaccacacacccttgacctaggctctgctctggaatcttcaaggcctaattttggatatggttcctctactttttaagagcccaagtcagagagcaacattttattctatttgggaaggagcagagaaaggaaaagtgtggtaaatctttgagtaaatcttctggttgtttctctgcttatttgtttgcttctttattatagattttctttcataaaatatatcgtaattacagataacttgcgtctactccttccagctcctcttttcttccactccctttctgtcgcttatcaaaaa

SEQ ID NO: 2799 - DNA, 328 bp, Mus musculus
  misc_feature (259)..(260): n is a, c, g, or t
  misc_feature (264)..(265): n is a, c, g, or t
  misc_feature (267)..(268): n is a, c, g, or t
  misc_feature (270)..(270): n is a, c, g, or t
  misc_feature (272)..(274): n is a, c, g, or t
  misc_feature (277)..(283): n is a, c, g, or t
  misc_feature (285)..(285): n is a, c, g, or t
  misc_feature (287)..(295): n is a, c, g, or t
  misc_feature (298)..(298): n is a, c, g, or t
caaagatttatttacccgctgagccatctcaccacccctttgtgaacacttaatttgcaccgactcgttcacacatgtggcttgccctcacgtacagtgtgcctgcacatgtgaaggtccaaggactgtctcactgtcatttcctccactttttgtttgagaaagggtctcactggcctggaatgtcaccagatggctagttggccatccacctccaagattctccacctttcatctcaccgttcctttggatacaggnncccnncnntntnnnttnnnnnnnangnnnnnnnnnggntttccaaattcaggccttcacacttctaag

SEQ ID NO: 2800 - DNA, 484 bp, Mus musculus
  misc_feature (310)..(310): n is a, c, g, or t
  misc_feature (319)..(319): n is a, c, g, or t
  misc_feature (326)..(326): n is a, c, g, or t
gagataggaggctccatatccctctgtggcagcagctgttagaatggcctcaacttctctgggatgatttcaaacccagtggggaatcacagcaaagcaggactttggtgaagtctggggtataacaaatgctgagtgaccacaacaaaacaaacaatgccagaggactggagttgaatgcacagtgcttcctaaatagtacctgcttcgagtcctggctgggaagttggaccatcatcctgggtaactgggaggaaatgaagcctagggagactagattaaatcctgagcgtacgtactgttgacatgnacaggaccnacagcanggacaccgatgcccgagacccatggggaatggcagggctttctcctggtctgtgtacccatattgacagtcagtatatgcggaagctatcaactacagctttccctcttcctggatgagtgacagctccctacaatgtacccctaccaagatttgcta

SEQ ID NO: 2801 - DNA, 486 bp, Mus musculus
gaactagtagtgagctcatcagaatttcaaaggatagccataaaaatgcactgtgatgttagctcaagtggaaaacaggcttagtcaggtaagaaatgcacatcagacattcttagggcaattttactatgtgatacattttttaagaagagtaggtatttggagagcaagtgagttcacttctattacagggtttaaaagttcaaaacaagctgagttgggtgggtggttttacaccagtaatcctagcacttgggaagctgagacaggacgattgctaagtttaaggcctatctaggatatggtgcattgcagatcagtctgagatgaaatataggatgagaccatgtctcaaacaaaattgaactaaatgagtaatgtggactttgatggattttaaagttaattaaggtacaatatcagacagctgagaaacggatggatggtggcatgtactgaatgattaaccagaattccttgtgagat

SEQ ID NO: 2802 - DNA, 509 bp, Mus musculus
  misc_feature (278)..(278): n is a, c, g, or t
  misc_feature (288)..(288): n is a, c, g, or t
  misc_feature (305)..(305): n is a, c, g, or t
  misc_feature (328)..(328): n is a, c, g, or t
  misc_feature (330)..(330): n is a, c, g, or t
  misc_feature (338)..(338): n is a, c, g, or t
  misc_feature (372)..(372): n is a, c, g, or t
  misc_feature (374)..(374): n is a, c, g, or t
  misc_feature (466)..(466): n is a, c, g, or t
tgaagtctaggtctttccttatatcatattttttttaggattctaagaaagataagtgtgagattaagttagatacttacttgcctcacagattcacctggttcatacacctccttttcatcatttaaactgtagcataacaaaatatttagaaagctttgctcattctaaagcttcaatttatatgcggggggggggatgtcctaataaaaattacacaaagaaactttgtccagatttggttattgatagttaactggagaaaagggtttctcatntcatagaagntactagaccacaaaatntcaacatcacagcagagtgaatntnctggaggnatgggcagataagaggaacccccatacctcagantntggtatttgtcagagataagcaataaggctaggctttcagttggttgcgccctagaagaaaataaaaggaaaggccagtctgtgtgtaaatntatacccttactaattcccccacttctaagatctccagagatc

SEQ ID NO: 2803 - DNA, 449 bp, Mus musculus
  misc_feature (348)..(348): n is a, c, g, or t
  misc_feature (360)..(360): n is a, c, g, or t
  misc_feature (369)..(369): n is a, c, g, or t
gaacaagtgtcctcacggtatggtagagcatcctttgggtatatgctcaggagtggaactgggtcttgagatcaagtcccagttttctgagaaactgccaaattgatttccaaagtgactgtgcaagttaacactcacaccaacaataaaggagcactccccacaagtttacactcacacgaagaatggaggggcgctccccacaagtttacactcacacgaagaatggaggagtgctccccacaagtttacactcacacgaagaatggaggcatgctccccttactccacatccttgccagcatgagctgccacttgaggttttgatctcagccattctgacaggtntaagatggaatntcaaagttnttttgacttttttccctgatggccaaggatgttgaacatttctttaagtgtttcttagccattaaagattcctctgtcaa

SEQ ID NO: 2804 - DNA, 493 bp, Mus musculus
agagctgcaggccagattatgcctagggaaaacaaacaaacaaacaaacaaaaacaaaaacagattctagcatccaccgagtcacaggtggagctgaaacacccctcggggacaagggtctgacctttggcccctgcacacctcccaactccctctcacatcagtcctctgggtttacttcttcccactaagcccatcgcccaggccgcttcgcccaaccgaaggacccttcctccttattcttgatggcaacgtcaggaggccctcacgacgctggaactctaagaagagacttcgctgacctgtcagcggatccaaaatggcggggcctagtcccagaaccggcggcagccgcagctcatgtccagcctggccccggaggcgtctcccggccgctctcccggcgccggcggcgagtgagagaagggaaggatcctgtcttctggaaggcaaccctaacttcagggtgagacctcactgcaggctggagtaa

SEQ ID NO: 2805 - DNA, 533 bp, Mus musculus
gggctcctccaaaggactgataccacttctccagctctgtactctgtagcactctaagctcaggttgatccactccactgctgatgctgttcttggtgatcatcccattgtactggcatctacaatacactggagtcttccactgctaggcttcaccaatagctctcataggctctcttcacagtgctaagcctcaacttctttgcatgaccccttcagtcctgggctgtcaactgcaactgaggctgcaccttcaccaacagatcttccatggcttctcacaatgccaagcctcagctgctcttcatgacctcttcatgcctttaaaaccagtaccacctggatgactcttagacattatcgagtacagctgcagcacgaggtacaaccttggctatcactggaacacagcttctttgtgctctcagaaaacactttccagaagatttcaccgcagtgatgcaggtctcttcttaatcaccactaatttcttagctccagctaatcagctatccattgtcctagtagtctcc

SEQ ID NO: 2806 - DNA, 483 bp, Mus musculus
ctgcgggcgacgttccgattggaaagagagctgtccgtcaagcatacgctccgccctgcccctataattgaataaaagagcgtgaagttgtctcaatactggggacgcgagttcattggttcggcattctctcattccagcaaagaccggaacaggagtgaggtttcggttagaaacagggagatgtcagtcaagggatgagcagtgctttcgccaattagcgcacactatctgcggaggctccaccagaatggggcgggacataagggagagcctactcttgattgggtgagagggactaggtcccgccccctcgacctagtagatttccaggccgcgcccccttcagccggtagcccttggtacgcgaagtgggccggtctggccccacttcacagccgatcctggctgcgtccggtggaaggacgcgcagattccacagagttccgggagagtcccgcgctatccttacggtgagggaac

SEQ ID NO: 2807 - DNA, 550 bp, Mus musculus
atatgttctcgcagctttctagatgttctctttatctttagatgccaatggatgatatatgtctaggtgctgtatcatttgaattgaattttattgtaatccctcatctttccaggaccaaaatatctacatatctacagatttaggaagtgctctgatacaattcctctatgtaagctctctggcctgtcatctttcttctgtctttctaataatctataatttgaaacttcagtcttttgctttcattatttttcttcattgcttttccttttgttcctttccctgggtaaatttggggtttgtcttttagctttctggttcattcttctacttgatcaacgttcaagttcattgtgggatttttatgctcagtccttgtgttctttagccccagagtatctatcctgttttcccccagggcttctgtctctttgctaaacttcccactttgttgatgagtcctttctctggttttgttcagttgttgatctgtagtctgttgtaacccacttggtttctttaagtgttgagttctctgccagttagc

SEQ ID NO: 2808 - DNA, 511 bp, Mus musculus
  misc_feature (409)..(409): n is a, c, g, or t
  misc_feature (430)..(430): n is a, c, g, or t
  misc_feature (454)..(454): n is a, c, g, or t
  misc_feature (471)..(471): n is a, c, g, or t
  misc_feature (483)..(483): n is a, c, g, or t
ttctactgtagtctctgctgcaaagagaagtttccttgataagggatgaaaactacactcacctgtgggcataaagacaaatgtttatagattgttgttagggattgtgttggtttagtagtgggcggatgtaggttctcctccaagatccataacttcactagccccagataattggttaggtttccagcactaggtggaaagacctaaagtccagaccttaagtccaactagagagctgttggttacccccaggtgtacgtgccgctacctcagccttagggttactgtgccacgctggtcattgatgtggttcactggcatcatagctaggtaggattgttgggtctctcatatggaagttttcgtggtatcttatggtaccataaaagctagtcctcagggaagnagacttcatgtcagttccagntcaagggcctcggggtcttgtgtntaaagtgcaccatgacntcagcaacaggntcttctctcctagctttggtttaaccag

SEQ ID NO: 2809 - DNA, 402 bp, Mus musculus
aaattactcttttactgtccacagcatgtccttctgctgaatttgagttctagggttctcctggaactttctctgtgctgggtgggaagatgcccgggaaaaggctcttgctctgagcagcaagagcctcagactcaccgtgcatctgtttcccaggggcccttgtgtcagaaggctcccactgtgtaactgtgcgcagggctctgagaactggtgtttctatctgacaacgctgcctggacagctcaaagtggccagagtgttgactctggtgaccatgtccatgtcccaatctgagttacagagagtacagtccagtatgcagagcagagtggtatatacctccttcactgtggtatatagtttccttcactaatacagctcaaaccctggatgttgtga

SEQ ID NO: 2810 - DNA, 440 bp, Mus musculus
taggtctgcactctgggtcatcatgccctcaggtagcatatgtcgagtgctccctgctgtcctagccccactttgtcatggctggtcctgccctcacctactctctttttcttgatactttccacacccctcaaaggtcaccagtacttttttctgatttctccaaacaggaaaaaaaaaagtgatagatagaaacacaaaggaccggagttgtttaaggcccttttcatcccaggcaccaagccacacaccccacctccaaagcagcccgtttccacagagcagacaagagggttttagaaggaaacaagtcccacagttgttctgctctgctcccttccttctacttcggtcatcagaatttcagcttttgggggagactcatagttcccctggggatatctatgtgctcatagtatatgtaccatgtatctgcaata

SEQ ID NO: 2811 - DNA, 546 bp, Mus musculus
atagtgaggactctcccatcaatgccgaaaatattaccttcggcccagtttaacacctgatgctgacacacaagaaacccaatggcagcaatgggtgagcactgtgaagcaggtgggacaactcctcacaccggccccttcccgtgagcagaaaaagatgccattattcacctccctgggcacaaaaggcaactgaagcttcaagagatgtcatttgacagtcgtgtgtggcagatccggggactccagaatactgcctccctaaggcttgtctccaccatggaatgtccccctacgctgagacatgcaagcagatagatctctggcgtgagctggcctggggaagctatggaggggcctgctatgtactgctttcttcaccagagaattccttctggttccctgaggtactctggtagctggcaagcgatgaaagaaagtggaagttccgaaacaagggaggggtggggacctcaggatgtcagtagtccccaaagcatcaatagtgctggcaaatctatcaggtcagcccttctagaatctaga

SEQ ID NO: 2812 - DNA, 432 bp, Mus musculus
ccagggtctcttgccatttgaatatctatcccatgacaaaagtcaacacatgtgtgacctccttacagaccaagcaagccaggccacagagtcataggatgttcccaggatctggatctggccagaggagtctagactgtctattagccatgcactccccttaattatcgttggataattaagatcgcatctcacctaaaaatccttagcagagcacacagagacatggtccgcaccgggaagagaaatggcatgctctatctcaagttcaggactttgtttagtttaaattaaaaaaaaaaaaaatatgaagtccagaaactgctgaattgtctattagtgactttaactccaggagaagagagggtgagcttggctctttaactacagtagaaggaagggtgagctcggcccttcaatgagttctctaag

SEQ ID NO: 2813 - DNA, 500 bp, Mus musculus
tcaggcctggaaattttgttgcaatatctttcttttaaagcaaatgtggatttttgtttagttaaatgctgaatgtcagcaaagggtatggagacaactcccagcatgattcactgtgcaggaaggttctcgaagctcagaatctctaacatgtaaaatacagccactctgagtcccttatctatgaccactttgggtccctgccaacagtgaggtagtcattaacacaactgcgtgagctcctgggaaaacggaaaaggttcttccctctgagggaaaccatctacttcctataacattgtgggtagaccataatttgttttaggtagaaaagtcaatgacgaaattgatcatatctgccagtagctgagaactgggcacgagtggacacggcgggcgcgaggtgaagaatgtgttttcagagtcactgagatacttgctgtgtgttgttgttgtctctggttattccttcctcctctttcccactcagatagtttgta

SEQ ID NO: 2814 - DNA, 462 bp, Mus musculus
  misc_feature (412)..(412): n is a, c, g, or t
  misc_feature (419)..(419): n is a, c, g, or t
  misc_feature (424)..(424): n is a, c, g, or t
  misc_feature (436)..(436): n is a, c, g, or t
atagtctctggtacttgttaagtcattccagacttgctagaaaattctttttatctccccaggaaaagtaaagaatttctacttgttattaacaaatgaatgcccagaaactttgaaagaatccagtctaaaaatgttaaatttcatttggtctttcaaagccgcagtcaaaatcactttccaggccacaagtatgcttttgaaagcatgttgaggtgcttctgtgatgtgtgattggtatattgcacaatataccacaatagggtgggctttgtctcttttgcaagtaagatatgccaacttgagtagttctgtgtggttttagtgttattataggggagctaggatgaaaactgcttctttattctctctttctctctgtctcttatgttcatcatgtgaaattgtaagncgatttnctttntttctgacaatnatagctatttaaattatcccttcctt

SEQ ID NO: 2815 - DNA, 537 bp, Mus musculus
  misc_feature (346)..(346): n is a, c, g, or t
  misc_feature (364)..(364): n is a, c, g, or t
  misc_feature (390)..(390): n is a, c, g, or t
  misc_feature (394)..(394): n is a, c, g, or t
  misc_feature (407)..(408): n is a, c, g, or t
gaattgtgacatcagcactgctgggatcaaacaggagaggactgtgacatcagcactgctgagaccaggcagaagagaagatagtatttctattataatgcatggagtgtttttggaatgtcacataaataatatgttttaggtaaatatttattatatttaataatgatgataatttaatagcagtcattttatttaagcggtcattacgtgatggattctactaaattctcttatccatgtagttttacataccagattaaattttaaagtacatgtcattagcttcagtttatatatgaggaagccgattaaaaagataaacaatataatcaatgtgttttgntctattatgaacagaagnacggggttttacatttgaatctgttngacnaaaaaattctttnntgataattgcttcattaggaaaactgatcggagtgctaagattagaatcattattttaaaaagagaattgaaatggcagcatccatcattagatgctgtgttatgtatattattccaattatctcactt

SEQ ID NO: 2816 - DNA, 458 bp, Mus musculus
  misc_feature (332)..(332): n is a, c, g, or t
  misc_feature (355)..(355): n is a, c, g, or t
  misc_feature (363)..(363): n is a, c, g, or t
  misc_feature (365)..(365): n is a, c, g, or t
  misc_feature (380)..(380): n is a, c, g, or t
agccttatgcctagattgacaccactacccccatccccgaagcagtgtttctcacgttgagggatggctgccctaaaactcacaggctggcatcgaacttaatgaaatctgcctgcctctgcttctgcttctaagtgttggaattaaaggcatgagccaccaattgcaggctcctaaattgactttaatgcttctagaatttgcgagcacaggggctctcaaaatatatccattttcattcattagccagtgtcttatattttgccttaaagtcgtgtatttcccagattttgtcctcttcctttaaccacttaaatcactaaattttaatntctttcagtgaccatggaagggntaaagtantnttaaagatatttgtntctaaatacatttggttaaacatgcaggaagttgtatgcttgggctaagcgttgagcaggctttccactaaatacata

SEQ ID NO: 2817 - DNA, 515 bp, Mus musculus
  misc_feature (342)..(342): n is a, c, g, or t
  misc_feature (420)..(420): n is a, c, g, or t
  misc_feature (424)..(424): n is a, c, g, or t
  misc_feature (435)..(435): n is a, c, g, or t
  misc_feature (451)..(451): n is a, c, g, or t
ggtgcatcacaggtatctaaaatgaaggtctacacatcattccttcatagaactcttcccctcctctatgtggagtcatttcattagtttttctatggatatatacatttctagtatcctcctcacaattctttccttgttcatattctggtcctggatcaaaataaaatcctaggcatcacaggtgttgattacattattttgatttcttatagagttatctagtttccattacactaaaaccatacaaaacagtgtgctgaatcgcctatttatgtcatttgtaccatgacttgatattttgtttatgtcttagaagaacttttagttttgttaataatntggaagaatttcccttagctttggatgctaaaaagtttcggttttccttggacataaaggaattagattttgtgcttntgtntgcactagcantgggaaagctcagatntgaaaactgtgtgaggttattaataattgcacatcacaaatgagcatatcactactgtcctttg

SEQ ID NO: 2818 - DNA, 431 bp, Mus musculus
  misc_feature (372)..(372): n is a, c, g, or t
  misc_feature (382)..(382): n is a, c, g, or t
gaagcaatggctctcagtcatttttttctccacatcctgacagccataaaaatatttgtgtgacacactgggtaagttaaaaagagttaaagacttggtatttggggaaaaattcattttctttctatcatatactttttaaaaaacaacagcaataacaaaaccctcaaaacagggtctctagtagcccaggttggtcttgtacttactttgtgtctgacacctgcagtgcctggtcctcctaccttagcctttcaaatactgcaattactagcttatgcaccatgcttggcttaatgatgtatactattcgtaaaagataaaataaatgatgtatcaaggatattaaatatttaatttgtataagtttcnaaataaaatntttttaaatttttggagtatccgagattccttctgtaaacatagcatgt

SEQ ID NO: 2819 - DNA, 484 bp, Mus musculus
aaagtcaacctattgggcctgtcttcattttagaagttaatcagtgactgtaaaatcactttttacagaaccacacagccatatcagtatggtaacaagcaaacctactacaaagagtggaaaatttcctttccctttcaaagactgccagtttgctccctatagcttactaacagttatgttcttccatctgttttgtacaaacgcaaaaaccacctagataattacagcctctttcagtttgtaatgtagctactgctataccatctcaactcatgagatcaaaatatatgctccccatatatttctctccttttgctatcttttccacaataaccaggtattgtaagtctccattttcttcatgttaagatttctctacagtgtattctttcccatgcaagtagcacgatgtagaagacattcagtagatggtaaagcgccttgtttattttgagaaaatattcctctactttgacctgat

SEQ ID NO: 2820 - DNA, 379 bp, Mus musculus
gacactctgggcgtgtggagtctcaggtttcctggaggtcctgcccttggccctgtgcccagacgtagggcgtgttaaaatgtggctccgtagcaagttctgacatctgcctcagctggacacttgtaacttacattgcttcaggcttccccacctctttcttggcggcattcctttcccgggttggttgtcctgtcttcctcttcccctttccttgcattcttatccgtcttcctcctcccggtgggccccagggcaccgttgcttgtttttggtctgaggaagctttcagttggttatcttataggcgctctccactctccactcaccgtttgcaaatgttgcccaggttacagtgcctccctgttaactttgtaga

SEQ ID NO: 2821 - DNA, 455 bp, Mus musculus
ttacagatagaacccagcttgccctctgcttcagcttcttgaacactggattctaggcatgtgccaccaagccagacataacagttctaagaatgttaggcagaccatgcattttactttcgtacagtaatgttctttagaacacgactaccaggatgtgaataaaacctgactcaaggaggtttctctgaagcccatccttatgggatctgcacttgatattttgtcctctccctgaaaacaagacagacagggactctactgtccaacagtcagactgattgactttcagatgtgagtctgaatttatttacgggcatggtcagctatgtttgccttcagtgttcacttggaaatggaaaggaagacaatattctttccttaaaaatgctgtgtctcttcagtatggaattatgatgcacactcactgcactgccagtggctcatctttaaca

SEQ ID NO: 2822 - DNA, 333 bp, Mus musculus
cctttctgtagtcactgtgcaggttatcaaggcgttcatctcacaagtggaaagaagcagtagccgtccagtacttggcagatgcaggaaattaaattttatagcggtctagtacatctagtgcattcatatttagcttatcttgtgctatgagaaacactaatgcatgcaagtgaagttagtcagctgtggtggtcaaatctgctccctactgattctttgaatttcaaatgcattttctggacttgacacttgcctgctagtgtcctgggttagccatgagggaggcaaagagatagcatagagtgaggaatgctgccaggaggtcataaa

SEQ ID NO: 2823 - DNA, 421 bp, Mus musculus
aatggcttttgtggtgttctctagtggatgccaacaaccatttgtagaatgaagaaaaagtccttgaattttcactttcattttgcatctgtctggccacttacttcagcagaatgcctggacccaaagccactcatctcagtcactgcctcgtgtttcatctcttaagtgctcaaacatttcctccatgctgaaggtcattgatccaccacagaggactgactccccagcatcttatcagatcctgtttcaagaatagatcagatttgtatggtttctgccactccgtctaatctgcatttgaatgctaagacacattttaattgttttgaggcagaatataaacatatacatcacatctgccgaagaagacgaagtaggaaaaaatttacaactgtcagcaacttttcaactatctcaa

SEQ ID NO: 2824 - DNA, 433 bp, Mus musculus
  misc_feature (305)..(305): n is a, c, g, or t
  misc_feature (330)..(330): n is a, c, g, or t
  misc_feature (371)..(371): n is a, c, g, or t
  misc_feature (402)..(402): n is a, c, g, or t
gacgacgtttacttctgttgagcctttcgcagctcacaaagggtttgagaagtttgggttgagcctgtgtgaacaactgtatctgatccagctcctaagctagtgtgagtggaaaagctctcatctgccagtgccttcccatcatggaggggggagtcctctgaactggagagttagccagtcttcctcttgggttgcttatgtcagactctgcctaggtgttgcaaagttccttcctcaacagcatacttcactcctgattctgagtttacagccagaaaagtccttccaacgtcttacagatncctctgcttcaaaggtgttactgtntccagtaatcccctgggaagcagggatgtggctaaacgctntcagctgcagatgctgataagatcctatcanttcaagttccccggccattcaagaactgaaa

SEQ ID NO: 2825 - DNA, 357 bp, Mus musculus
cgggtcaagcagtgtttccaggtcagcattagaagggaacttggacactgtcatgctactgtgacctctaattttcttatcccattttcatctaaagtgactgaaatgtacattaagcctttttctcacaatgtaacttaccaagtaaactcattttccacagtgttctggatatttccttaagagttctggacacctaataactcacaaatacatgtgggatggaacaattcaaactacaatggggcttcgcttccctgagtttctaattttattacttgtgtttagggcaacgcattgttcacccatagatcacatttttgtttgaaagagctgttggaagattcactgcttgtg

SEQ ID NO: 2826 - DNA, 258 bp, Mus musculus
aagttcatttatgcttttatccaagagtgcagtttgtctcctaccattatgtaacgtattttggaaattagactgagccccttgacttgtataaatcagacctatacagctctccactctaccagccagtcctcagacccagctcagacccggtcagtcctcatacccagctcagacccagccagtcctcagaccagctcagtcccagccagtcctcagaccagctcagtcccagccagtcccagtgtcttagtcagg

SEQ ID NO: 2827 - DNA, 522 bp, Mus musculus
  misc_feature (106)..(106): n is a, c, g, or t
catcctgatttacagtttcctacccctccattcctctcagtcccccccccccttccctcttttcttgcccagatccactccctcctctgcatccctttaaaaaaantaaaaagaacagacctcctagggacatcaaacaaacatgacatgaaatgctacaataaggttaggcacctccccttttaaatgcttgattacccttcctctagctagagtttggctgtgggtctctgcatttgctggcattagtttctggatgacaatacttgataataaaaaacaaaaacagaaagaaaatgaactacctgataatgaccctaaccatggtgataaaagaactctaccaaaagaatttatctgtgaagagggaatttaggaaagacactaggaattagaaagatgttccatgttgatgttttggtagaatgacttaatatcgtgaaatgactattctaccaaaaatgctttatatattcagtgtaactccaattaagctccctatctcattctccacaaacatag

SEQ ID NO: 2828 - DNA, 462 bp, Mus musculus
attaactggctgtggtgaccgactttgacttgaaatgccccactggggcttatgtggagcttggtgcctgctggtggtgcaattgccaaagattgtagaaactttttggaggtgggggtcaatctagagggagaaggatcagggatgtccgagggtcttacctggtccaattgtccaagtctccttctggcttcctgcccatcatgaagtaaataacctaccccatatactgctgtcatcctgatgttctgctcaaatgcgatggccaagcaaccatgcaataaaccctcagtaaccatgaaccaaaataactcttttccctttaagttgtcaacacagtggcacaaaattaactcatatgtggccctgccaaatacttactagtattgtgaggctgtaggatgctctgtgaggttacctaggtctatccttaaggctgaaatcctgatggcccttatctgt

SEQ ID NO: 2829 - DNA, 480 bp, Mus musculus
ataagtttgtgtatccccagttccaggagatctgatacccacacagacatatgtggaaagccttctggggtaccgcttatcaggagtctgacattggccaaggacaaggaaaagggcttcaggcaggaatctgacattagggcataataaggaaatgcaagaatataactttaggctgtaatagagaagtaaagtaaggcaagaattttagttttagtgtggaacagaagaactgggcttcaggcaagatttttggggttggatgaggaaatgggctcaagtatttcagccattatgacaagcccttttaaacaactgtcatgggagtggacttagcttgctgctttgttagttccttattatactgcttgcccaaaatacttgcatgtaattaaaatggtataaaaagtagcttggaaaataaaaatttgccttcagtctcagaattgtctggggtcatgctacaatgttgtctgtctt

SEQ ID NO: 2830 - DNA, 549 bp, Mus musculus
atagagtcctctgagcggattggctcttctcatctggttgggcccaatcatgtgaccttttggggtggtcaggaagccttgcttcacccatttctcatcctctttgtggcagaagcctagctcttttcatgatgatggaggaagagtcagagagcaggctcagtcctacttacattatcagttaagccttttgacacgtctgttaacatctctgtgggcaaagcaattcacgtgacccagcaccgaggagagcaggactgtctcccctggtggtctggtaatttctcaacaataaccagtaacaatctgttcttctgtaaaggcctggttcacaaggatgctgttgagatacacagtgtaacagaagctaaagacgtggctcaccacttaagagaatgaagtgctcttgcagaggacctgagtttgagtcccagaactgatgctaggcagctctcaatgaccagctctagctcccggggtccaatgccctcttctggtctctgtcaccatttacactcatgtgtacaaacttcctatacacgtgacctt

SEQ ID NO: 2831 - DNA, 377 bp, Mus musculus
tgttttgaacatcacccttggcagtctacattccaagattttccttcagcctctttatagtcaagtgcgcttatttatcttcagggggtctttgtttagtcagcctttagtaaaagcaaaagttataaaatgtactaaagaaataatccccattaatgctaggagacagagtcatttgaagctgcaggaagttgtcttgtcttgttttaaaacaggatcgcactatgtagctctggctgccccggaacttcttatatggaccaggctggcctccaagtcacagagacccccctgactctccctctagagtgctgggattaaagccctagtctatgtagccagccccaagccagccagcacaacatattgagccccaa

SEQ ID NO: 2832 - DNA, 366 bp, Mus musculus
caagatgtggaacaggactgccagtaaatagtgggaaataggaaacctccccctctagcataaagaagtgctcttatataaacaattcatcttataatgactggagtttgttttaaagatttatttttatttatgtgtatgcctgtgtgagtgactcccgtgtgtgtgtgtgtgtgtgtgtgtgtgtgtgtgtgtgtgtgagagagagagagagagagagagagcgctcacagaggccagaagggggtgtcaagtaccctggagctggagttccaggtaacgtgggtgctggagaatgagctctggcctctggaagagcagcaagggcttgtaactgctgagccatctctccaacattagctttaa

SEQ ID NO: 2833 - DNA, 503 bp, Mus musculus
gtgtgcgcgctacatatgtctatatatacatatatgtgtatatatacattatgtgtgtatatatacatatacatatgtgtgtgtgtatatatatatgtatgtatgtatgcatatatattgaaggatagctttgctggggtattcttggctacaagcttatttttcttcgaacactttgtcatttcatacttttctgaccttgaaagctttccgggctctgatgacagccactctcttctatatgcactctcttcttttgccacactcaagcccctgccagtgattcactgcttttcatttagtatgtatgtatcatgggtgggtgttcacatgccacaagacaagtgtggtggtcagaatgctgactgttggagtccgctcgctcgctcactcgctcgctctctttctctcacaaagactccaggaatcactgaggtccttcttccctgcaaagccatctcactagcctgccggtagtgtctgagcttgtctttgtgtagtgc

SEQ ID NO: 2834 - DNA, 485 bp, Mus musculus
agctcagcgctttctattgcgaaaattttaaccaagtgagcaggtgagtaagtgattcaggccaaattttctttgggtgcttccgggaaagtaaaaagtgcaggatcaaagaatgttccggcctcttagaaagcaagggacacactctgctctccatggtgccttccctgagagtgtccggggatcctacggaagaagtctgtgtcttgcaggcatcagtgaattgcagcgctctcttggggtttgacgttttctatcctagtctgggtaacaaatcagggccattttcgaattaagacaagcgacagagtgggtactgcctgtttagcccctgcctcttcctcccggaccctcagcccttggtcaaggctcagcttggcaacagctgggagggacctcggccctgatcttccttagagcccaggctgtagaggatgctcaccgtggcgtcgcccttgccattcagcccacaacaaggtcaggtc

SEQ ID NO: 2835 - DNA, 453 bp, Mus musculus
catgcttcctatttcttagtgccagaatcccaatggcatttgggactgcaaatactcagataaaattccaaattttattcccagtctttcttacaactagctatctggcatgcatgtgtacttggtaaggtgtgaaacactgaacagggctcccaagcaagttcctttaaacttttgcctaaacttttgccttatccacactttcttcctgcttcatatacaggaatgtaggctgggactccaacaatcatcttagaccagaaatgaccttaaggatgaaagccatagtcatgttgataaagtggaaagaatccaggtcctggagtctccatgagccttagactgatgacctccaattccacttgagaaataaaccaccattagaaaatgttgtttgacctttcctgttacatgcaactaaacccactatcgacccactgaccactttaagga

SEQ ID NO: 2836 - DNA, 500 bp, Mus musculus
gataaatccatctttcaccccaaaaccagcctgcagcttcccagctgcaaagagcagcttagaggcatgtaggagtgcagggcctggccgagggtgtcaccagtcccactgaggtctgctctcatgatgcaaagcaaatgacaaaacagggcaagaaggctgcacgatcgtctgaggggggatgccgttctacaggaggcctctgatggcctgtgcattgtcttttttgtggggtcactgtctcctctctcaactcttatcaatcaatcttggtctccactgaggatctacagtctctgggtttgagtgaattttggccacctgctaggtggtgccttttataaccctcaggtgaatccttcacctagaagaaccagtctgaaagtcaacagagctttaacaaacaattctcttgttttgcagagagaggatgcaagccatggagaagcagattgccagtctaactggccttgttcagtctgcgctttttaaagggccca

SEQ ID NO: 2837 - DNA, 374 bp, Mus musculus
agggatgtcagttgtttttagaagataggaaaggggtttgcctcttttgtaataaatcctctgataaggtgagactcttaggattttatttctaggttttatacatccttgtctacatttggattgtgtgtgtatgtgtgtgtgtgtgcacacatgcatgtacacattcttattttaaaaagacttttttgaacagaagttattccccttaaaacaaagcccaaacgcagaataaaaacctgtgagtgtgataatatgaatcatttcttatgacttgtgtttttcaaggagtttaaacacagcgagtacaggtctagtgtttctactgtgagtttctgctcattaagtgcttgacagatgaaaggagtctctag

SEQ ID NO: 2838 - DNA, 532 bp, Mus musculus
gttggttagcactttttgtcttccttctgtggaatcctcaaaccacacagtacagccttaataactgttaatgaatgaaaagtcagctcatcttcaaataggtagcacacaatataagctggggaatgccaccaacttgggaaagtgcttttcctctggaagttcacaggcctgggttcgaggcctcagccctggctgccattaactagtctgctttgttcccttttgttttggtttttcttcagttctttcttagccctaatgggtttcttcacaaggctcagggtagacaatgacaaaagaagcaaagctagaagtatattcatatagagagacaataggaatcaagtagagcattaacaagcttccaagaagttgcatactgtaagcaacagcttttgaaaggtctcctgaactgcagctgctgtggagacctctaataaatctgaaggagcaaagctgtgatacagtggggaaggacttcagctagtctaacaaacgttctgcagaatgcagacacttatctccctat

SEQ ID NO: 2839 - DNA, 541 bp, Mus musculus
tcatggttgctttcggctttgcaagggaggcagcaccatgcaaaccacccgtctgtctgtcctggagcccttcacaaatgtgtagcctccgtctcaggatgtgttgctctgtgacagcctggaggccaaccctgctgcagcctggaactctgttctgttttgtcctgcagactgatagccagctagccagccagccagccagccaaccagacagacagacagacaggagaattcactggacatcaacccagaagtaaggagaagcctgggatcttgtgctagtttctctgtcttttgtcctcgggccactagcctgaatattgtgcttatgtcctagtatttgaaaaggagagaggtcaaaacggggcaacataaaaatagctgcaagattcctcttcttgctgtcagtcctgtagtcaaatctgctcccggagcactgatcattgtgtagggaaatgaccgtcgcagacatgtccctggtattcaccttcaagtgattcttttaaagagcaatttcagatgtatctcaccttcatattca

SEQ ID NO: 2840 - DNA, 480 bp, Mus musculus
gggaaactacccgtgtactcagtgttggcggcacgtccctttacctgctgagccaccttgctggccttttattaattttttttttttgaaacaagatatcacctttatagtttcagctgtcctgcactgcttctgagtgttttttctttctttctccttcttttctcctttttttctttttgtattttacctgcttgcatgcctgtgccagaggagggcatcggatctccggacattgggtcagttatgtgggcgctgggaatcgaacctgtgttctctgagaacagcaatcatattttgtttgttttgagacagggtctcactatgtagctctagctgtcctaggactcattttgtagacaaggctggcctctgcctccctagtgctaggattaaaagcgtgagccaccgtgctcagctacaaccgctgagctagctaattaatgtattccgtatcccgctgtcatcccataagagtta

SEQ ID NO: 2841 - DNA, 429 bp, Mus musculus
attccctgcctagcatgaaggcttccatacccttgttagacggtgtgcggcaacgatggcaagctccattcctcaccacgagcacaaattaaacagccgctgggacccccacctcagcatatcaccttaaatgacttctttccaaacaattaattttttacttttttctttcctttcctatcttaataattatttatttttttgcagcgaagaaaaaaacattttgagaatgaatagtaaatgtagaccctttaaaaaccctcctgcaggaaggaacaggggagcaatgtgacgccaccttttaatcttttgtaagagtgaaaaggcagaaaaggaacgctcgatcaagctgagctgcacacatgactaaaactcgcaggagacgctgctgcttgctgcctggcgaaagcaccgccaggcttgagtgta

SEQ ID NO: 2842 - DNA, 449 bp, Mus musculus
tatagtgctgttcccattgctgtaacaaaatatctggctaagcaactgaagggaggaagggcaagcttatgttggctcacagttttaagagacacagtctgtcatgctgggaaaggaacagcaggagtgtgtggtagctggttaagtcacaccagctcaggagacaggaatgctagcattcagcttgctttctttccctttcacagttggagacctgggactgggatttctctcttcagtgaaaactctctagcaacattgccacaggcaccccagatgggtatgtccaaggtgaatctaaattctgacaagttgacaaagttggccattgaagaaggaatctgccctacatattttaggttgagcacagcttgggcagtaccttggtttccaagtctagccttctggaaacaggaagtgagagagggtatgcctagtcttgcagtgac

SEQ ID NO: 2843 - DNA, 557 bp, Mus musculus
ttaacccctgatgtacatggcctaggattccattcatctgaatttacccgaatcttcaaggctacgttatacacccaaatcctagaagaatctacactaaacctatgtccatgtccatgtccatgtccatgtccatgtccatgtctatgtctcactgaaatgaaagcctattagatttatgtgcaacttgacttcttaaagatcctgcatgctgtccaagaaaaagaatagggcaaagacattcatggtggagatcactacttgacatattagaagatagagtcacagaaattaaatatgacactaatgggaaataagtgaaccagtactggcaattgtcttatgctccagctgtcctcatagatagagtcttgctggaacagccaccttctttgattcccatatgctctgcaacagttttcacactgcagcagtaacatagactggttgtgacaggaatcttatggttctaaaagcttacaatgcttgctatctggctgtttacagaaagtttactaaccagtgactgaaaacataggttcttcaagtctgtccat

SEQ ID NO: 2844 - DNA, 481 bp, Mus musculus
agctgaacttcatctaccaagaggagcttctatgaaggccaggctgtgtggacattactgggtagatgattgtcactggtgcatgggccctgcagctgctattgctgcaaccacatgtcccctgtcacttacacaaagccaaccccacttgtctaaggtctatgaacatagatgacccaggtgtactggcttgctctgactcattatcctctgtggtaagatgactagtgattagtcctagaaaatccccagacacacacacaccacacacacacacacacacacacacacacacactcacacacttgctgaggtcccagacaggaacaggctgtggccaccaccaagaggcccaagggcagaatgagggacacttctagggaagcaaaagtctttctccagggacagtgaacagccctgcagtctgcccccacagagagccctgctgcagggcgggggctcaggaatgttctctgcatac

SEQ ID NO: 2845 - DNA, 470 bp, Mus musculus
gaggccaggtttgactttccaatgagaatccacaaaaggaatcacagcatacatgcctaatgggattccgaacctactaagtgcttagtacacagcaggcactcactactcaggagccttcgatccctgctatccctggttcaaacccaagagaccaccaaacacctgcatggctctaggtccctcaacaccagtctcaactctaaccaacagctgtctgctaagagttccgagcctgaaaaactcaggcttcacgtccgttcagcgtggtacctatgtggaccctagctttgaggctgaaccaactggaactggaattctaattctaatattcactccccatggacatatgtaaaacactaataaaacagtgacctgccaagtgcttcaagtttcaggtgtatagaaattattcttacagctattctgctgttccagcaattgaactccattgtcatctcaatttccag

SEQ ID NO: 2846 - DNA, 511 bp, Mus musculus
  misc_feature (395)..(395): n is a, c, g, or t
atgctccacagacgccaggtaattaacccccgtagcatcttcagggacattgtttcagatggaacacaggtaaagtgctcagggaggccgctcacatctccagcttctgctagccccggctaaacaacatggagggcccagcaattgggaacctcgggcagttaaaggcaaaggataatgggaagtcagaaaggacaacttaaattttagaggaagaaagggacatggggagatgacttagaccacttgctgtacaaatctgaggatctgagttcagattgcccacactgtaaaaaacaggagatggtttatatttggaatacgtgtacaagggaggcagagatggaattcctgtgcctcactggccaaatcaatgttgcaaaccagtgaggttnaggttcagtgaaagatgttgtttaaaaaaaattcagatcgcgagtgctaaataaacctgatgctgatctttggcttccacgtatacatgcgtgacatacacacatagacgcataga

SEQ ID NO: 2847 - DNA, 423 bp, Mus musculus
tccctctttcctcagctatatataataaccctacctccttgtttatatttaagtggtgctcttgcctccatgttcaactgtatacaataaatacactgagcttcctgggtgatgcagcttctcgaccagagatcccagtccacctgatcgcagctcttctgtatctccatgtgtttgtcttttcctcattcactcaccgccctagttaggtcagttccccaaagccatgcaaagcatggcacacaaccaaacctacccagcacccactctatctatgtctcttacttcgtcctcacaaggtgtgcagaaagggaggctatttcagcatgtgataacatctgaggacacgctacatgggagttcaggtctctgttcatacccctcactccaaagatcatgagcctgttctgctaacattgctta

SEQ ID NO: 2848 - DNA, 529 bp, Mus musculus
aagtggcatagtcctcctggaagtcacacactttaaactgctttcactatgcagaaccatttacagtggctttgtatggatgaactgaaaggcatgtagatgtgtccctgaagtctcattcatcctcaaagagatgttttgttttgttttgttttataaaagattttctgagggcggtacctatagctatcaagtctttaccattgagattctcctgagtccagatctgattctggcccagtccctctgcccactgacttcccgttggcttttacagcctctcttgggcctcggggcctcccagtatttctgcaagatggtgtctcaccttccctttactgcagcaggcatttctgacctattctgaggccacatacctcttgcctctttctcaggacactgagaaagcatttaactttctacacattcccgtctacttctccaaagggcaccatggcagcctgctggcctccttaaccagcagcctccaattatctctttgttgacctgactctcttcaaggacttga

SEQ ID NO: 2849 - DNA, 312 bp, Mus musculus
aagctgcctgagaactcctgattgtcctgcctcagccttctaaatgatgggatcataggcctgtactgctactcatattagtttgtgttcatattagtgtgtgtgtgtgtctgtgtgtgtgtctgtgtgtgtgtgtgtgtgtctgtgtgtgtgtgtgtgtgtgtgtctgtgtgtgtctgtgtgtgtctgtgtgtgcctgtgtgtgcaggtgcacatgctcacacatgatgggggtgggcatgaatgcatagcacacaagtgcagatggtctccccttccacctttacatgggttctggatatcaagaagcca

SEQ ID NO: 2850 - DNA, 411 bp, Mus musculus
cctttcccagagtcgtttacatatttacatttacatcccatatgcagagtcatttataaatcttactctgctttgtcagtcctggaagaatgacagcaaggtcgtccaggataggcacagaagtatcttcctggcttctccacccctgtcttggttctgaacttgagcataattccaacagtccatagctggctcgctgactctgaacctcagacctgagccttagcctactctaaagatcaagccaaaactgataaggtgtgtgtctgcggctgctcatcaaataattcctgcagctcccctgtcctgctgtgctaccccagttctgtttaattggcaggtcctgaatcctgtcccaacctcagtctctccctaccctccacagggcatcacacacaacctattactttt

SEQ ID NO: 2851 - DNA, 452 bp, Mus musculus
tcagcttcacttatctctcaaacaggagacagggacttgagaaaagattttacactaagtagagtccttgtctagcatgcaccaaaccctgtacacatttagtccctagcaccacacagaccaagcgcaatggcagatgagtgtctataatcccagcagtcgagagactaggcctagcctacgagacatgaaacctgcctcaaaaaaagagtcaagcttggtgtattggcacatgtctttaatcccagccctatgcggtggaagcaggcggatctcttcgaatttgaggtcagcctggtcttcatagttctaggctagccacagctatataatgagaccctgtctcaaaagacaatgacaaaaaggtggtgactctcggttgggtgtggctcaaaggtaaagcatgtactcagtgtgtgcagtgcagtgcagtgtatgcagtgccctgggtt

SEQ ID NO: 2852 - DNA, 420 bp, Mus musculus
atagttcattatttatcccttccctttattcctttccaaccctcttattcatcccttcttttggattagtggcctctttgatcattaatttttctcatgtacatacatatgaatatatgcatatgtattcataaatacaaaatggcaccctgctcagtctgtgtaatagtgcctgtacatgtgaatatgtttttaaggatggccatttggtattagataatcgtttgctgtactcttcctagggaaaactatttctcccactctctgcattctttaattttctgtatttctttgtgtgttttcatcacatctatatccactcctctttcaactccactggaacattccctccatcttcttccctactggaacctgccaggagccatatccctgaagaaaactgactaaccatctcaaaga

SEQ ID NO: 2853 - DNA, 515 bp, Mus musculus
ggtggtcatcactgtctgtcaaagaggaggaagctgaggtccccagtggtcccactgcagaccttagatctgaggttctcctgtagggatcctgctggcccagaagaactagacatcagactttaaaagtagattatggccttcatcttcctcatctcaggccactggacatgtatcctattctggtcccaggccctcaatctggcacgcagaaacagaactttggtgatgttgtgagaatgctgggctgcaccctgcagctgaagtgccccccttgctcaagatcatcaatctcacctcataggttttcaccatccttgagggcaccacgaagatgggctggatgttgttttcagccagtttgcttgccagctggaccactgactggtagtcctgtggagaagagacattttgtcaggatgcccatccaaagaaagtgcctagcgttctgaggactctggtgtcagctcaagtcagggctgtccttgtcccgtggcagtactttctctgaacaa

SEQ ID NO: 2854 - DNA, 494 bp, Mus musculus
gaagcctgccgtgaagtaacaccagccatcagtgtgtttttgaaacagcgaattcaaaacgatgaaaacccttttactccaacaaagaacttggcctcctctggaagcttgctatgtgtcaggcatatgtaatggcgttgagcctcgcttcaccctggcactgccatctgcatactgtaagagaggcagaagctctaaggagcagtagctttagtaagtaacatggtaaagatacaagtcagacatctctgaactccctctctgactaatccccaacagtatcccttctatcttacttcaagccttggcttcctttttggcttttctgatactgcccttgatatcctaatagagcctcctggacccaaagggatttggcaggaactgtggcaacatgtggtctcctgatatggattttttctccgatagtagctaagcatgggacctcttgttcatctgtcaatgtcctgtgactcactttgtggtcctacaac

SEQ ID NO: 2855 - DNA, 500 bp, Mus musculus
aacagaaatctgcactgctagttatatttttagaagagatataaaatgtaaagtacagttaaatattaaacaaattaaacaattaaatattaaaatattaatttataatgtacaactaatatacatatacataaaatatatcttagcaaaataagacaaagataatggggcaaattacaaatacaaatatactaggtctttaatctgatgttgtagtttttgttttcctcaattttaaacagaaaacaaggtttttgatttaatgaattttagtctgaattttaagtactagttattgatttaatttagcatctatatgcaggagttatttttctttagaattgtctcatatttcacacatttctgaaaaatatgatgtaagattgacattggctttctattgatactgtttttattattcgttgtactaaatataaataatttcattaaagcaatcaatatatctacttatgtttgaaggaacctttataatattttct

SEQ ID NO: 2856 - DNA, 426 bp, Mus musculus
agatttgtcgtcactcagaggttatgagcactggctgcatctgtatggcacctgtctgggttccatccagaaggttggctcagtagcttctgttacttcagtaccccaggaactcaatgccctctgctgggctctgagggtacacgtgtggtacacatgcatgcctataggcaaatgctcacaaaatagcaatcactgtaaacacacacaaagtggtgcctcccactgtaaccctagcatttaggaggctgagactggagaatcgccctgagtttgagacaaacttgagttagagagtgagattctgtctcaaaacaaacaaacaaataaataaaataaaacacaatgaaagatggggtgaacaaaagcaatgtttgccagcctgttttaaagccctaaaaagcttcctatgggacagttgtctcc

SEQ ID NO: 2857 - DNA, 423 bp, Mus musculus
attttcgccctgtaatgcatttcaaatatcctccccatctctttgtccccagtctaagccaccaacttctctggaagaaagcactgacttcctgtacccaagtcaccatccacattgctcttggacaactgagaagaaaagcaggccatgacattgtgcttgggatctgcatcaaagtctccaatggctttccaatgctcttgttagcaactggagtttgtcttgtagcctgtaaggcattacttggccaggagcaggctttctttctccagatacatactgaagccactagtctcttttcagcatctggtttccatgttaaagttcttcccaaatgagacattggcctggtttcctcttgatcccttcatgtgctctgtctatcactttacgctagcatccaggacggcacattgataccca

SEQ ID NO: 2858 - DNA, 485 bp, Mus musculus
ggcaggaatcccaggttggcagtcactttggagttcacaaatatataatatataatatagatggtctcagtcatccctgttcctagcggatatgtcccctagaacaatgaaattgtagtgtgcgaatggtaaatgtatgagtgttggcggtggctctactaataattgccagtaactgatacagcctaaatatcccaggattggataaacaagtacaattcatgtataaaatagaacactgtcaggttggggaagggtgttctactgtacagtgagaaaaagaaagggtgtttagaggagtaaagaaactgctgttcctggatggcgtggttacagtgtgattatgtgtaaaaacggatgcaattatagtacaccctcacatcaacttttctgtaagcctacgataataaacagagatttgaaaagtcttatttgaatctctgatgccagaaacttgaacatacgtttgaagctgtgtgacctct

SEQ ID NO: 2859 - DNA, 526 bp, Mus musculus
gggaatatttcttggtacctcactttaggaatataatctaatggttttcagcaagacagagggaatgggaagaagagcaaggcctgctagagccgcatgcttaagcaggctagtatcccttcacatgtatctgtccattcctctctgatcttcactcatatttaatagacaatcatatttaaaaacactgaacataataaaaccaataaacaagcaattctacaaggtagaaagaaatgtaaagaagcaaactgcctcaaagaagccatgaaagggcactaaggagttcctgggacctacatcgctttcttgtatcttttatatactggatgcgatcctggatatcctacattatgcaattatcaacaggcacaaacaagccaaacccctaaatttcacattttctctccaaactaaggtctgggagaaggatgagttagcaaggaaggagggtggttatttttaattttttttcatacaatatattttgatcatattctttaccgtcccctaagttctgctagat

SEQ ID NO: 2860 - DNA, 460 bp, Mus musculus
gatctttgggttatcctgacactgatctatttcttggacatgccatgctttgcatatgaaacaggagtgcagcatttctgggtggttgctagctcacacatccctcactagaatgtgtactggagaccagacataaagcacttcctgagcacagcaagagacttgataatcaaaaggaacacagaaaagggctactgagaaaatggacacactcccacagtgatttaggacttcacttcagattataattatttatgcacatgtcttccctcctttctaggattttaatcagagattgaaaactgcataaacaacagggatggtaaagacagtctaagaaagtgaagtgggctgaagaaggattgtggctaaagagtgctgtaagtagctaactctagatgatgacttcaaggaggaattgtctcatttgaacactgcccagtctccagattcttttaaa

SEQ ID NO: 2861 - DNA, 378 bp, Mus musculus
gggattaggcgcgtgctaccacagccctctttaagacctttaaggctttaaaaccttgtgcttcagcccgtgtctctcggtttctgcatctgtagtgtgtagctggataacacacataacagctgtgtgacagcctcatcagtgcccggcacgtaggagaccgaggctgcatctctgccactgttaaagagtcacgctcggctttgtgtcttcaagatctttgcatcagtttgaccaacctctgaggctgagaggagagaagctgatgccaagtccaggcttccaaccttcgtcatatgtagcaatttggatgaagggggagggggggctagagagataactaggcagttaaaaacagggactaactgcccttgcaga

SEQ ID NO: 2862 - DNA, 553 bp, Mus musculus
ccctgcaatgtggtggatagctctcaagagggacttgagggtcttgtgaaccatgggtctgtttccatagtaacccaaccggagactctccaccagtaagtcagtctttctgggctacacagaagtcactagtccatggacagcagatagggatgcaggcagctgtaggaagggagaccaaaatcctggagccaggctgcggtaggaaagctggcctcactctgtgtctagttgctggggttgggggagactgccccagcagtcagctgtacccacttctcctcagggacacgtttcactgaggaggcagatcacgttgggtccctgacttctgcagcggggaggaccgagcaggggctggaccacctacgtcttgatggacacagcgctggcgttcctcccaggctcagaatgagccttttgttctcgggactcgctgcctttctgaacccaggctaaaaattgcttcagttcttcctggagttactcattgcctggtgactaatgcttcggggtctgtcaatcttaaaatcctgtcgttagttctcagtgt

SEQ ID NO: 2863 - DNA, 348 bp, Mus musculus
gggcacttccaaccgcagaaatttaggcttggaccctgcgcctccgcccggctgtgaggtgtgcgagtctggtgcgatgtatccgatgtgtcttggtggcttcaggcgagcggaaggcacgctcccttctggaaatcacctcgtgtcggccaccctcgcggtccattcatttgtgtttcattcatttctcgccataacgaccccccagtcccggttgtctccacacacagcctggcgcttccctgtgggcctctgcaaaatcagctcctctcctctcctctccactcccagcgggatctactcttaggagcacactcggctgcttctgaggcaacgtggagctgtccc

SEQ ID NO: 2864 - DNA, 486 bp, Mus musculus
ggttgagtccactttgtgcttcacatatatgcacgggtgtgtgatcatccgctagagcatggttgactcactgacctactagaggctatacccctcgtagaaaactgactgggtttgtacaattctaatttcaaagtacatattaaaatatctaataaaaattgaattgaaaaaaaaaagtcagactcggagcaaaacggaaaagtggagaaaactcaagcaaaacagaaaggtaattctgcctacagtaacaacatttgaaatcattttctgatctccattttcagtattatcagggtgactctgtatcatttgacaaagtgcaattgttcgcgagagtaaaattagcaaaacgaactctttatcccccaagtagagttactgtttcttccacttggtaattatacttgctgataagaaggcaatgtaacacatgcctgtaatctctgcacactagaagtgaattcaatgccaacctgagagaca

SEQ ID NO: 2865 - DNA, 384 bp, Mus musculus
atcacagctaacactgcattcctgagacctctgaaggcagagtacctcatggcagcctcccttctcctcatgaggccaagggggtggcatcagaactcatctggtcctaatttgtgccattttgcagtcctcaaactctggcgaacatggctgggcctctcaaagctagagctcagttgaattggcctttagtaccccttcatattgaaggagctgttccctcagacagaggaacaccacagtgacagtacggaccccctcacaaggacaaactgtttacaaggggagcctgcaaaagtacccctgacctcagaatggcaggtaactagtagatggcactagggcgtttatgaactggctctgcacacctctagtgagtaccta

SEQ ID NO: 2866 - DNA, 385 bp, Mus musculus
gaattaacttagaataccaggcaacaataaaagcaagtgatgtatgaagataccaaaagatctgcgtgagcctaaagttcatatggataagtgaaggcagccagtttgagaatattgcatacttcacagttctactaacctcactgtgggaaaggcaaaaacggtaaagcaggaaaagcatggttggttagtaggagtttgagggaagggggggggggtaagattgactagataaggcaaagaagaagtttatagtagttaaactatcctatatgccaaacactgtatacttccccaaacctatgtaactttaaaacatagagtggatactttgaaatacataaacaaaggttaactaggacacgagcacttgtctgctttacta

SEQ ID NO: 2867 - DNA, 538 bp, Mus musculus
gtctttcacttgcttagctagagttacccccaagagattttatattatctaagactcttgtgaaaggtattgtttcccttattttttctaatcagtgttttatttgtatatagaggaatgctactgattttgttgaattaatttgacacccttctaccttgctgaaagtatttaccagctgtaggaactccgtggtggaatttttaggatcacttatgtacgccatcacatcatctgcaaatacagatactttgacttcttcctttccaattgtgtcccctcgatcttctttaattgccttattcctctaagacttcaaattattgaataggtacagagtgagtgagaccatatatcctgggggcctagggtaaaaccaaatactaatgttctaaaaaacaaacaaacaagagacaatggagcaataaaatgactccaaatgccattcttctatacttttagatcagtaccttgctcagtcatcagcagagacacttcctcctgcaacagatagagattcacagccagacagtatgca

SEQ ID NO: 2868 - DNA, 543 bp, Mus musculus
atgatggtgctgtccttgcagaggacctaagttcagtttccaacacttatatcagatgccttgcaaccacttgtggctccagctccagggtaatctgccctttgtggccgtcacaggaacccaagcatatgtgcacagacacacatgtatgactatgggagtgcgtgcgcgcgcgcgcgcgtgtgtgtgtgtgtgtgtgtgtgtgtgtgtgtgtgtgtgtggctgccaggtaggcagtgtctcattggcagatatgaagtctgttaaccttgctgtactgtagtctgaaactgcctttgtcccttttggtcagtgtggcactcttccctctgcaccatctgggactcttggcccccaaccctgggcctcccagtaacacagtaaagatccacaactctatgaactggtttgtcaccagggtaccacccttgtcaccaggataccaccccttgttaagtttctactacactttcttccatgttaggcttctttgtcttttaaactagaaaaactgtcttgacttctcaagatgctaactgttgt

SEQ ID NO: 2869 - DNA, 529 bp, Mus musculus
gaaggctggtgctacgattcacactcatcattctaaagagcggctctgacccggcctcctgaggaacttgtatgctggctgaagccaaaatgggcgatcacctatattatgaaattctgagatcaaaatcacttaattaatccatttgtattttgtaggcagcaatcaaagcctaattaagtttaccacaaacagcaccttgctggacacgtgttcaagcctccctcctaacagtgcttcatttggcactgcaatctagctttgcctaataaattaaatcagtgagtcttaactacctgaattatgcatgaaccttttggtgtcaatgcaagtttgattatttaatttgtgttactatattgagtaattcacccttgaatttcccttgcatacacaatatattgtgaataaagaccattagaaggaaagtgggatttttaaaacggatgctgagaaaatggctttctgcaatgcaggcgctaactggctgtgccatagtcccttgtacaaagaagtgtctgccaggccc

SEQ ID NO: 2870 - DNA, 546 bp, Mus musculus
gtgtgtacacaaactcaactctatataaacccgtcttcttggtttcctactgccttttgcccaagcagaggcagccaccctcttgtgtctctcccaataaaatattttgtgtcaggtttgtggtggggtgtgacttagtggtatttcttggctcctacagccaggatacctctcccctcagatattctatagacgcattgggtaacttctccccttagagctttaacaatcctccagggctccaacatcaccccagtgcactggaacaagaaattcctcttgctttttgcattgatcctggctccatgtggttcactcagggggtccccggtaatctatggctccctggagttttacacctggactccttacattcctggcttggaatctctatggagacaaggatggcctagagctctgcaagatctacttggctctacttcaggaacactagaattaagtgcatgggctaccacacctagtgctttgttcattggtttttgttttgttaaccaggggttgctcttcaggtacctggtgactcaa

SEQ ID NO: 2871 - DNA, 410 bp, Mus musculus
ctctggctatccttagcctgggaaatgctccctccccttcattactagctcccaacttaccgagaacagtcagtctggttcctgagccaaaatacagcgtttctgccgcgcccccccagtccctagctgctggcacagagatacacagcagagtcctccggctctacagacttgattcgaagattcaaatgagctttatctgaagactgaggtgagaagcgccttggaactgtttcgtttacaatgagttgcttattattgtagctaaacataatcttcagcaatttcttagagtcttgcttgtaccaatacatagtatcgtggcccagagtttgcttacaattgaaagacacttcatttcccacctgtgtgacatgatagtttggagtctggaaaacagccgtctccaa

SEQ ID NO: 2872 - DNA, 497 bp, Mus musculus
aaggccaacccctcagaatgactgtctcccttccttgtccctggcaggatcagcccattacatttaatgaactttgatgccttctcactgcagtccataaaggctattattaaaatgaaagatggctcagttaagtacccaagccccggttctctccttttcagagatacccaaagcagtcggtgtcaggattccatatgccttttccatcttagctgctgctgccaccgtctcctgaggagttcttttaaagattttattgatctaatttttcccaagtctggaaaagtgtgcaaggcccctgcctcatagagctgccgtgtttaggaaacaagcggtgcctcgctctgaacagtttgctccgacactgctgtgcccatcgttgctgtggaatgaagccattggtccctggacttgatctacagagcattagtgacaacagctgtagctgtctgcatgtcctttccacacaagctccttctgcaagggacttgtca

SEQ ID NO: 2873 - DNA, 181 bp, Mus musculus
aaagtaggccaccataaggctgttaagggagaaaaaatggaatgagtaattcccagtggtctttctcccttctaaggtccatgctttgcctgcaacgaatgcacaaggtttaaagctaaaaaatgctgtgataaatgatttgtgctactgaacacgatgggctaagacacaagttgagttc

SEQ ID NO: 2874 - DNA, 543 bp, Mus musculus
ggtagagattccacagctcctttactcctgtatttcacgactctagagccagaaccacgtggacaacgctgccaggtttggctgcctcttgggatgaagcctggcctccttgacttatgtgtaattgattcgttaccgttcttcagcagtgaactggctggttttgtgtgtcagcttgacacagctggagttatcacagagaaaggagcttcaggtgaggaaatgcctccatgagatccagatataattgataaatctttggaccagagcgagcagaggttcaattcccagcaaccacatgatgtctcccaaccatctgtacagctacatatacatactcatatacaataaataaacaaatcttcttttaaaaaaatttttaaaaattaaaagaaagcaggctgagcaagccaggggaagcaagccagtaagcagcacccctccatctcctgcctccaagttcttgccctatgtgagttccagtcctgacttcctttggtgatgaatgcaatgtagaagcctaagatgaatcaaccctttcct

SEQ ID NO: 2875 - DNA, 477 bp, Mus musculus
ctttactagcccgagatggagatctgtcttgcaggcagcaggctggaagggggcagccctcgaggcccttggacgtcacacaggacttggagttagctcctgtgctgtggtcttgctttggtccacaaagcctctgctttcttcactatgccccagttcctccctttggagtagtaatgtatattctgtgccgttgtaagttggaagcaagtagctcacctttggaatatctgggggttgcgattaagagatggccttgggattcagaagagacttgggcttttaaacagttaagactgtaagagactgtgtggacacttttgaagttggactaaatgcattttgcattatgagatgtgcctagcctatgggggccaggaagtggaatgtggtggtttggatgagagtggctccctttgacccaacctctgagggtcagcaagctgcagtggctatggcctttatagggcagtcagc

SEQ ID NO: 2876 - DNA, 485 bp, Mus musculus
caatgggcgggtgaggtctactttagccctgctgctaacaacacaaaggctctggagtgaggaagttcagtgctcatttacactccactctctccaatgggatcaagctatcgcttggttttgagtatgcggaggtggcctaagaggttatttctttaaacattttactgtttctgtggcgtgtgcaggcacccgtgtgcaggcacccgtgtgcaggcacgaggacaatgtggagagttggctctttccactctgacttcggggatttaattcagttctccctggccctcttcattttttgagactggatctctcataaccggggctggcttaagacttgctaatgatgccgagtccccaccctcctgcgtctctctgacaggatgaacctttcctgagggttggacgtggcagtgtacatcagtgtgttaggaagagctggaaagcacgtcacagttgcatttgctgtaggctgctttctgcgt

SEQ ID NO: 2877 - DNA, 504 bp, Mus musculus
taaccatgtgttcctttgtttgggtttatcacttcccaagggctgatacctctcctatagccatggttttcacaggcagggagtgctaagagctcagaggtaactccatgcaaaagcagaggtccaaaacctgaggcacagtgacagcaggtgacactcacacactcagagaggacattgtaactgcaaagtgccaggggagcctagccagagtgctgtaagtatgagtgagagtgagccagctagcatttgaacagctatctaggaaaagccccttgccagccaagccctctgaagcagacccaggcttctgctttctcctaggagcaccaggaatctccctgctttgtttctcctgccttcttgcctcctgtaaagcacagtatggttgtcaatgcatgttatgtccttgaatattgcaagagcagccaagcataaccgcgcatgcaggaaagtcactacaagagcagcctggttgacatagaattctagccagccagcact

SEQ ID NO: 2878 - DNA, 460 bp, Mus musculus
acatgctgacatggtgtcgtagacataagaccctgagggttgctcttcagcgggtgagaagtttccattccctatggtaagctctagatacctgctactacaaactttgtatccataattaatacagtatatagaactgtatgcttacagtttttgattgagtagacctcatgctgactgttctcaccatactttgtaaatacaaaatgaagaaagatattttttgtatgtgagcacactgttgctcttggtcttcaagacacaccagaagagggcatcagatcctattacagatggttgtgagccaccatgtgggtactgggaattaaactcaggacctctggaagagcagtcagtgctcttaaccactgagccatctctctagctgtactctttttccatacagtacaccctggacacagtttcccctgcctttatccctcccagttcacaattaaga

SEQ ID NO: 2879 - DNA, 526 bp, Mus musculus
ctttctgaccttccttaggtaccagccatgcccagagtatacatacaggcaaaacaccaatacacatacaatgaagccttaaggaagggtttagaataaataaaatgctcataaagccaggtgcagtggcacacatctttaatcccagcactcgggaggcagatccctgtaagtttgtttgaggccagcctcgtctacagagattttctgacagccaggattacacagaaagaccctgcctcaaaagctaagttagatagatagaatgctcatgggtttgtggttgcgttcagacaggtatgaacttgctctgttctacgatgcagctgggcggaaaaagggagtgcggcacccgcactcaccattccctgcttcaccacatctgactgtggatgccctgtgaccagctgcttcatgctcctgtcctcacaccttcctgccgtgatggattgaacccttacgcctgcagctaaaataaacctttcctttcttcagttgcgctggtcagagatttttcacagcaaca

SEQ ID NO: 2880 - DNA, 448 bp, Mus musculus
agtcatcgtcctcccttaaaattagaaaaaaagtgggggtttctatgtgcaggtggtatcctgacaggaatagttggggaatacaaggaataacctacaggccctccttgggttgaaatccccaggacagttaaaactccacccctttcctgtggactgggaactgctgcttccggttccttctgggactgagttctggtccaaccttctagacatgagagcattatggctctctctgtgccccaagttcactgacgatgaagaaagcagcacttcctatgcttaacatttaactctgaaagccagacaatgcccaccacacagtttaccttcttacccattttaggtataaagtccagttgtgttaagtacacccacattgtgtgtacttttgagaactttacctgacaaaatgaaagtctgtcaaacaacttctgactcctggtac

SEQ ID NO: 2881 - DNA, 545 bp, Mus musculus
tctgtgcaagtcttaacctctccgagccactattcaactattatactgtccacagagccacgaggctgagcccacatgcgcaatccccacctgtggaggtctctagtccccgtagtacattaaaaatgtgctttgatatctgaggtcagaatctagatttttctatcgcttctccctcatttaaggaaaattcctttaaacgtcaacgtccaggaatctcctctgtcctcctgtaatctagctacaaactccatcggtgtttgtgaacgaaaggatgatatgtccctttgagtacgctaggtcattctctggttttggtgaggttggacactctggtaagagccacacagaaccagactagactgctgagatcgatgtgattgcttgtgtttcgtatttcatttcttgagtggagtagggacagagttcaagagctaagccctgattaccggcttgacctgacagagaagataccatgtctggcagtggccagaagcttaagcccagtggccattctgatttggcggccattctgatttggcatc

SEQ ID NO: 2882 - DNA, 561 bp, Mus musculus
cagtacggtcttcagagatggctctgtggtcaagggcacttggtgtccttgaagatgactcaggtttgattcccagaacccacatggtggctcaaagtagctccagttccaggggctctaataccctcttctggccaccccaggcaccagggaaacatgttgtatacataaacacacacaggcaaaacacttatacacaaaataaaatttcagaacgttagaacctgggatatacgactctgctagctatgcagtacatctgtggggcagtggaccatgccaggaaacctggtaaggtcgagtaggttcagaaaccccaacacctcatacctaaggacagggaatatttcacctactcccaaccagatttcctggcctggaacagatgaccacaactccccacacaaagaacatgacccctggtcacgtaacacagaacagaattctccatgctaatgagatatctagatgggttctaggggttaatcaataagcttcccttccaggacactccttcctgaaaagacctttcatctctggtccaccctgaggaggttgtaa

SEQ ID NO: 2883 - DNA, 449 bp, Mus musculus
ataacacgagggttctgcggctttagaaacgtggaattctggaatgtgaaagtgagcggggcctctgggaccctttgggggtgatgctgtctttctacagacacagagcccagagggataactaagcttaccaaagccagacaacagcccgcaaggatggggctcctctgttccctgagcagaggaggcctttttttcgcagtagtgtctgtgaggtttgaaaaccttaatgcgtcctgggcaaaggtagtgtggaggagtgaggggcaccagatggccttttggagagtcgttcccatttctgagagttttggctttcattcaggatcacggtcactgggtccagttgccccagagcttgtgcaaccgttggtcaaataagcagaggagcttggtggggtcctagaaaatgagagaccttcacacccacagtgtttgcagcggttttt

SEQ ID NO: 2884 - DNA, 449 bp, Mus musculus
cttgcttgtgggtttgtgtttcaaatggtccactgacctctctcctgcccagagagtgagccgccatgtagagcccggaagggcgctggctccctgtgggtggtgggtctgcagggccgcctccgtggttgtggttggcagtttggaactttaaggacgctcttgtctgtctccggtgactcagcctctgggaatccacactgagggaggacaaggctcccatcctactggtaaaggggaaaacatgtgggatgtggctgcctgaggatgctacggactctgggtcctaatgctgccgtgggctgctgctgtccagtgcaaagcaccgatctgtggttgggacagaggttcgtggcccctggagtgggaacgttttttcacctgtgcaggggaactactggtttctagtctgtggctgagggtggttggtttgcatgagctgccacaga

SEQ ID NO: 2885 - DNA, 497 bp, Mus musculus
aagcaggattagaccgttgcatgcaagctgtgacaccctccctcactcccacctccccatgattttctcagccttcgtcctcattttttgtttctgcatgctctgtcatgtcttttcaactgtcttaagtggttagagttcacgggtctcaggttggtattcactgggccatttacacctttgggtttcagaaccttctctgaaaatgccctaattacagttgttaattttaaaaggtcatttttttccttcctgtttcctcctgtgaaaatgaactctggaactctttttaaaagctgggcaagtggaaacacgtgacctggtttttgatttctgtatgacttgagattcagctatcaaaggcaatttagtccttggtgtggaagttttctgggaaagtgcagttactgggatgaaaacggagtttctgaaatattttagaaggtttaagcagattagtgagcttccagctgttagccactgcagcctgggaggaa

SEQ ID NO: 2886 - DNA, 460 bp, Mus musculus
tgagtttgatcccactttgggcgcgctgctggaccttcttttcctcagactcttctccatttccacccctgtagttttttcagagaggaacaattatgggtcagagatgtgactgtgggatggcaaccccatccctcacttgatgccctgtctttctgctggaggtgggctctacaagttccctctcccaactgtaggacctttcatctaaggtccctccctttgttactcaattgattttttgctaaaaatgttaggatatcttaagtcttagagaacaggtaaaacaaaattaaaaaggaaattaaaatatagttagggatctgctatatttctcaaattagacacatacacacacacacacacacatacacatatatatatatacatacatatatatatatatgcaaatgccttaagatcaatagtttctatgcacttttcccactgataattgtct

SEQ ID NO: 2887 - DNA, 521 bp, Mus musculus
aaagcattgacgctttcctggtccagctttgtcacaggagaaatacatcccttaagtaaaaactcttcaaaacaaaaaaaaaaagagctagaggagtattttactgttttatggagttaagagaaagctaggcgtatagagtttagagtttcttgtttagaagtaatgtcatattgccttttcatttagaatcactagtgtcactcaaaggcaaccctctcactgttgaaaagcaagacctttctaattctatgttgtaatgataaagtttgaattaaaccaccatgtgatcacaacctggtctttaggtcgatctgatgtaataaaggaaagtgtaaaggtgtggctaaaagtgtaaactagaaatgaacttgcacattaactctgggattgtaaataagtgtaaatctcaatgcagtatctcttgttagggctctatttgtaataaagaattgtccacctaattataacattccatattcaaactggaaaattcttctgcatctctttgtttctagtac

SEQ ID NO: 2888 - DNA, 562 bp, Mus musculus
gcaagcttggagtcccacatcttgggacagggctgacccagggaacccagagcaagagcacagaggctagggggtcccagaacttggggtgcaaattgctgacctggggagcggtagcactgaacgcctgtcaaggaaagactatctcttcctacccaaaacaaatatataatctacctccgagcagaaacccaacattgcaacctatccaaaacctgagctattctacacatgctccctctgaaactttgggcttttccactgtttttttaagtcctccctccagagtgctgcttgttcaccatgtggttgaccttcaagtcaccgttagcacaacatggtggctttctctctctctctccttttccaatctcctcctccaggcagctgccgagatttgtagcttgtctgcccgggggttggttttcttttaaactctaatataaactgtccttgagttttcttctcagattgtctgtccttgaattcttttattaacaggtctaagagctagagagggaaatctcaatttccctggtaacgtgtgactttacctccaagt

SEQ ID NO: 2889 - DNA, 467 bp, Mus musculus
aagcttacctcgaacctgctgtggacacctaccttcacctacagtgggcttaactgatgataaagtattggccatctcatctggctggctgggagctatggaccactgctcaatgcagcaatgcaaaaagtcttcaactctatatcactaagcaagggaaagatcacaaatcacaatccagagtttcccctgaatgtgtagcacttttacactatcataaaacacgctgagttgggagctggtgagatggctcagtgggttaaggcactcataaccaagccttgtgacctgagatccatgctcaggacccacatggtagaaggaaagaactgactatccacaggctatacctttccacacgtgcatcatggctcatgaaaatgcacaggcacataataactttcttatttctactgcaaccagatatggtagcacattcgtgtaatcccagcatgttcagtgtagaa

SEQ ID NO: 2890 - DNA, 461 bp, Mus musculus
aattatcctcttctttctgttgacttggcaagctacttccaagcaattttaccacacttttctgcacgggcacggtcgctttctgagctatttttcactcttttttttatgtatcacaaaggaaatgctctatttgttcaactattttccttccctgctagactgctaaattatgatgtttggggtaaagttttattcatccttgccttttcagtacctaatgcagaacctactaaatagtagacactaaacataggagaattaactcatgaagaatagattgtatataatcaaattaacaaagtaacaatttttttcacaggattctagattagagcctttgttctgacactctctcatagtatcatattcttagatgcccaaagattacttggccaaatttacattacatatttgcagggttaggattatacccaggtattccatggtctattttctac

SEQ ID NO: 2891 - DNA, 349 bp, Mus musculus
gctaatctaatactggctgtcttgtagttgttcagttctaagtctggctgtctcagctggtgctcagtcttcattggaatcctaagaagtaggctttactattagaaaagaagggtctcagcagccggataatgaacttgccaggaagaaaaaaagggcaagcaggaaaaaagcaaaatacttccttctttcatatccttgtatatgggctgccaccagaagatgtgtcccatatttaagatgcatattcagacctcagatgatccaggtttagggtgttcccacatcaagttatcctatcgagaaaatccccaatgagactgcccagctgcttgggttgattgtagat

SEQ ID NO: 2892 - DNA, 546 bp, Mus musculus
tgacagaccgtcttgattgatggttgatgtgggaggggcttagcccacagtggttaacactatccttagccaggtagactttgtctgcatatgaaagctagctctgagtgtgagccaaaaagtgagctagtaatctggattcctccatagtttcttcttaaatttcttcctgagttcctgacctgagttccctcagtgatgaactatgattgggaaatataagctgaaataaacccttcccacctttacatcactttggctaaggagtccatcacagcaccagaaaaggaaactagaacggtactttttttttttttttttgagctattacaaataaaatgctttccttaattttatcatcattggtacatgtgaaaggtcatcattttttatatgttgactttgtatcttgcaacttgagtaaaagtgtttattagattaaagatccatttattcctggtttcccaggttttggactataagttttcagcacacttcccaaagataatctgaattttactggagtttcttgtaacaatgcccttt

SEQ ID NO: 2893 - DNA, 517 bp, Mus musculus
aacacttcaaaatactcttaggcataatcttcattagtaccacccaagatattttgttgtctgggtactatgcatgtgtacacaaggcatattttgatgaaatcattctgtgtatctcaaaatatggagttgatgtgagattatacaagtggcctcccatttctctacttgtataatttctccacgtgtaaaaggtgagaatcatgacaaatgacacagtctgagtttcctgtgctagaatactctggaaagtgtgtgggaaaagaatgaaagtgtgaaagaagcaatgtgcctgctgaaagcctgcaagaaagcccccaaatgagtgaatgtaacttaaaggcaaaagtatcaacagacttttctcacatcattgtctccacaagtcaacactagttgactttcaactttactctgtactccagaaaaatcaagccccataatatgctgaatattagacttctgaatggtcataaggcaaattttaaaatcaacaccttggcctgaatttgtcctt

SEQ ID NO: 2894 - DNA, 513 bp, Mus musculus
tgcaaggactcccagtgagggacatggtgtttgtacctttcagtctcatctttcccttctgctccacaagaacacagctaccgtgcatttttctgcagggtgaccctcactattaagacaaaatgagaaacttaacaaaactcagagacaaacaagggtagcagttcatattctgaccaacaaagctcaaatcccccccaccaccaccttttctgctcttcttatttttctaatgattttctttgacatcactggggatttttcaggctgagagcattattttaaaattcagtgctatctatgtattatctgttttcttgctatggttttatttggtgtggaaatactaacacaagactgcttagccaagagtttcctgacatgtcagtttagttgcatgtgtctgaggggcagggtgaacatgggtggggacacactgtcatgtgtgggtggcctggatccattctcatgagctggtctggatcattcagaaagaccttttactaaccatgt

SEQ ID NO: 2895 - DNA, 502 bp, Mus musculus
tctgggtggcctgggaaatgtccctgttctggttgagttacctgtagaggattatagtcacaaaatagctctgggcctggggggcttgtctctgctgcagccctgtgtttttgagcactgcttggctgcctgtaacagtacatcatcctgggtgatgaattctgtttgcttttttcagaaaggatctcacttggtagccaggggctggtctggaactcatttcactgaccatgccggccttgaacttgtggcaatcctgcctcattctcctgtgtgccaagaatactggtgtgtgtgtgccatccatgcctaagattttatgggtccactaacaactgaaggggggggggctgtctctgactctgttgcctgccattggatccccttcccctaaccagactgcctggttgggtctcagtgggagggaatgtgcttagcccgctgggactggatgtcccagggtggggtggtgcccaagagggactttgccttttctgagaag

SEQ ID NO: 2896 - DNA, 451 bp, Mus musculus
gagttcagctcatgtgacccgtgtacacatgggtacatagaggctagaagaaaggctaacacatgtaatcttataagctgccaggaccatgaggaagattaagagtttcaggcgacctggcgcaacactagcacataaacaaagacacacatataaccacacataaccttagggaatcagtgtgttggggctaggcctttgagatgccagctactgtggacatgttagcaggaggctaccatgcatcttccatggcctctgagaaactgggtctggaggctgtgaagggcgatgctattcttctccacaggccgcgcccctagctcctctgtgctccatcatacagctcaggggcttgacctctcagtctggtctcctaaatctgtgattatccatcacacttctcagagctcaaaacctgccctgggttagaacgctcctgtctacagag

SEQ ID NO: 2897 - DNA, 431 bp, Mus musculus
gaagtcaattcctgtgaccaatacaataggaagagcaaatcaactactgcaagttgttctccagcttttacatgtatgttgtggcatgactcaggtacatatacatttatacacaaaataaagtaagaattgatagttcagggtgtgtgtgtgtgtgtgtgtgtgtgccagcaactgctccactcaaattatagatatctttgctttctttctctagatataatgtagttagtgcaactatctccatttgaacataatttgagaaagtgaagttttagagagaggatgaataagtttgttgggatgattttggtatggaactcagtggtagcaatggccaacttttcatgtaggctatggcttcctgccatagtcatgctgagacacattcaggtctgtttttactggagcagtcagaaacttttacttta

SEQ ID NO: 2898 - DNA, 522 bp, Mus musculus
aaggatttggtttcactccaccaagatttggctacttaacagattattctctatcccagctttggggcagacatattttgctgtaccagggggatgttccattgagactgaaaaccaagtacatctgtgtagcatcttcattttaagtagaagaacctcggattggtggtccctaattcagagtcgctcagaaacatgtgccctgttttttccactggacgctaacgggggctctttccttaaaggaaggcatgtggaccacacactgatacttaggaagcttctttgttccacatgacaaatgtgtagagaacgcactaattgtggaaattggtttctggatattccagtctccatacccatccaatgtgatgtgatgtctgtctgtctctgtctctttctctctctctgtatatgtgcaagtgtgtattcacacagtgctcagtacaaggcacacctcatatgttcagagacgtggtgacagagtcagtggtcagtctcagtgcaggcttactaagggct

SEQ ID NO: 2899 - DNA, 547 bp, Mus musculus
ggttggccctgaacttgctatccttccatctctgcttcctcagcagctctgattatgctctagcttcctgtgtgaaatgtttacttttcttttgaaatgtctctgtctaaaagcataaatgagccgggcgtggtggcgcacgcctttaatcccagcacttgggaggcagagccaggcggatttctgagttcgaggccagcctggtctacaaagtgagttccaggacagccagggctatacagagaaaccctgtcttgaaaaaccaaaaaaaaaaagcataaatgttatgctttttaaaaatctttaaggggttgtggatttagctcagtgttagagcaagcatgaggccctggctgcaggaggtggtggtgatggaggtagggggagtgggaacaaaataaaaaatgtttaaaccatgaatgttttaaaaggtattattttatcatttgcataatcaatcaaatttggttccataataacctggtcctataaacttttaaataatttttaaaaggaaaactaaagaaaagggaatcttggcatgctg

SEQ ID NO: 2900 - DNA, 432 bp, Mus musculus
tagcctggaggcctgaacagcctattctacatgggggcccttctgtgatttcagcttaacactaatctcccacacccttcctcatgccccgtgactccacacaccaagtagggctgtccagtgccattcctgcgacttttacatgtctttcctccagggcacctcaagttctgggacatttttgtgctagctagtctcttctggtcctatcggccagtctatgtaaccaagttccgtgtaactggcactcatgctcacaaacttcatctgcctaagtgagctaggaagggcctcaggccaggtgctggggacagggtagccagccccatccagagggcctcaggcgacccaacaaggctgttgcccagctcagattagcagggatgaaggaagagcttgtggctgacatggttttggcccacttaggatggc

SEQ ID NO: 2901 - DNA, 558 bp, Mus musculus
tcttgctttgaccatgtgatgagagtatggacatgggcccccccattcaacttggatgtttttttaactctataacatgcatctaacaaaatcctatactaagcacacgtaatgggagacatcggagtatctttggaatgaggcctgtgatgaggatcttcccgactgggctacatgagccccaagccagcctggcattattttgtcatcttagccagtacaaaagttttcccagtaaagagatgcacaaagatgaatagagttatgtaattcaaactggttaaaaggaaaaaaaaacctcaagggtctggagacatggctcagcaatgaaaagcactgctgcttttctagaggacccggctgggttttgattctcagaacctgtaggcagttctcagccattcgtaacttcatttctgggggaggagatgccttcttttggcctccacagctactaggtacgcacttgtacctagtacatgctaacaaaatatccacaagaataaaattatttaaaaaaaaagctagacttggtggcatagcctacatagacctaca

SEQ ID NO: 2902 - DNA, 455 bp, Mus musculus
aactttgtccttatcaccaagcaaggtttttaaaaaaccttttaccactcccaaatgttttgtgccgccaataaaaaagaaccaaccaacttgttaccaacaagaaacacctgtccagaccggcttttcaaaagcaaggagatagtttccaagactataaagatctttgtcccatgggatggggtcttttggtttgtttttgcctttttgaaaaagggtctcactatccatggctggtctggaactccttaaacttgtagccaatcctcctgcctctgacccaaaagtactggaattataggtgtgtgccgccatgtttgactaaaaacgaccaaatgttgtatactaatttagaaatgaaaataaagctgaggggtccatttaaaagttgcacagaatcaagttgggtggtgatgtggtacacacctttaatcctggcacttggaagtctgaag

SEQ ID NO: 2903 - DNA, 493 bp, Mus musculus
gaacaatagttcttccccgtagcaatgcgctgagcccagtgggtgtccccagaagtgtgtgtgtgtgtgtgtgtgtgtgtgtgtggtgatgagtggatcacctgtgtgtgtatatgtgtatttgtgcgtgcccgccagagtcacaggtgtgtccgcggcaggtggatgacgggtgtgggtctgagcgtccgtggtggctgaaggcttcgtttgttggagtgtgacgagggtcaggctatgtcgcggactcggcatacagagtctgaactccaggaccacggatggcagccactcttccagtccttggagaccgggtccgagcgatggctggcggggatcggctaccgggagctcgcttctggttgccaatgtttctagggattccaggtgcggctcgcccaaagcgtgagaatgaagctcacggtgccccgagatgggtcctgggtggcggttgtgacaagcttcggcgagtctatctagagcttagcgcaga

SEQ ID NO: 2904 - DNA, 426 bp, Mus musculus
gtctctaacctcacttcaatatttctgactcattaatagttaacatcaatactgcctttgattttccttcctcctcaatttttctgagatagggtctcaggtagtacaggctagcctcgacctttctacatttgcgagcttaactttggactcttttaatttcttgcctttgcttccaaagttctgtggttataaatgtatcatcacacccagtgaattttttaaatctcgattactctgagcaagaaatggaggtgctgaaactagaagggattattattacatgtcatgaaccctcgtagtagctaggtgctttgaaggaagttacaaggtttgtgcactcatctcccaggcccttatatttccatggtatattattccagggatgacctctggtctgcaggatatcaattctctgcccaaaag

SEQ ID NO: 2905 - DNA, 346 bp, Mus musculus
tggtagctcacaacccatctggaatgagatctgacgctctcttctgctatgtctgaagacagctacagtgtacttataagtaaatctttgggccagagcaagcagggtcaactggagcgagcagaggtcctaaaaattcaattcctaacaagcacatgaaggctcataaccatctgtacaactacagtgtacccgtatacataaaataaataaataaataaatctttttttaaaaaagagagcgagagtaagtataaaatacttctacttctgggctggagagatggctcagtggttaagagcactgagtgctctgccaaaggtcctaataagttcaatttccagc

SEQ ID NO: 2906 - DNA, 497 bp, Mus musculus
aatacttgcaacctgctacacatcactctttatgaatgtctttttaataaaaagaaccttgtgcattataagtgctaattactaacagaccagagctaattacaggaaactgtaatgtatgcttttgagaacggttctttcagacccaaacagaagaagcattcataggtgaattggctcctgaataaatttcactgagaaatctttaccactgacatatgtgatactgcactaagacctcagccagcatttgaggaatcacctttacaatcacagcctcctgttggaaatagttttgaaatttgcccagtaaaatgtacactgtgctaccttgggaattttcctaaaaatgcatgggaatttggtactgtgttttggatgagaaatgtctcccacggtctctggcatttggatacattacttccagttgaggacactctttggagctttaagtatcatacccttgctgaaggaaggttttcactggttacagactt

SEQ ID NO: 2907 - DNA, 273 bp, Mus musculus
aagagcatcacttccaaatccttttgcaaaccctctgttttctctgccagccacacctctgaagatcaagcagcatcctgccttacctgggttccaaatcggaaatgctttctagaaatcctgaatttcccaaactcaaatctcctgggttcagatcggaacctagcatttcagcaaagttcccaaatcagtcttagctcccagacggccttacaatctggaagcagtggcttggacagtcattagttgccccggtaatctttctgcatacaa

SEQ ID NO: 2908 - DNA, 457 bp, Mus musculus
aatttgactgtgtacttgatttcccaaaagatgaactgttttgctttcctttttattaaaaaaaaaaaaaaaacaaaaaacaaaacaaaacaaaagcaaaacaaagaaaaccagaacaaaagagaaaaaaaaaaacaactttaattttgaatgtcacagacgtaccagccagaagcacagtgccagctttttaattccctagtctcttagcagggagacccaaatggaggagttaggggaaggactaaaggagctgaactggtttttaactccataggaagaacaacaatatcaaccaaccagagctcccagggactaaaccaccaaccaaggggtacacgtggagggacccatggctccagccgcatatgtagcagaggatggccttgtctggcaccaatgggaggggaggcccttggtcctatggaggcttgatgcccagagtacaggaatgcta

SEQ ID NO: 2909 - DNA, 489 bp, Mus musculus
tgtttggatttctttggctgcttttcgccttctgtgtcccctcctggtctcagttgctttcctcttcttctaattagaggttgcccaggcatctttgttgatccttggtgaagagagagattgaagagccagtctggagctctgtgtgctggtggggggcgaagcgtctgcttggggcttccccaatactggcatggataggtcctttctcctcaactgggcagagccacggggcccgtgtctttgaggatttggcattagcgtttgcgtattaggacgggctggtgtgtccccatgtttagtatttggatatacccagtaccttttggtctagagctgctcaaatctttctattcatcctgcttgtatagattccttcagtaggtattggggtctcttgtatcgttggccttgacccttattgactttgtctcccttcagaagagtaaagccaaagttatccagacttggtcaggtactcaggaggct

SEQ ID NO: 2910 - DNA, 500 bp, Mus musculus
aagcggaaagcaaccgtccattcggctcttttttaaacgaaaactggaaaaaggatgtggactaaggctgccaatcccatgataaagccgaggatatccacacactagctctggtgccagggagagcttaactctcacacacagctgtggggcatgaaccaggacagtccccattgcagggtatgggatgccatttatgttggaaatgctctgctcatgtcttgttcagacagaccttctctcagaagggtttttgcagagcctcgctgtttataacagttccgggttagcaccaacccacacacccactgatgggctgactggccaaccaggagaccaccaggacgcatggcccaatgctgaccctgaaagaagacctctccgagttccccgattgaaaaagttaactgtacattgaagaatacctgccacagccaggcgtgcaaatcacaagcagctgtctggaccctcacatgtgtatgcgcctgagtgagcactgc

SEQ ID NO: 2911 - DNA, 274 bp, Mus musculus
tcggtttccgggattgaggctccaagtctcacttctttttcttagactccatccactggaggagaaaagcgccttagcgccttgagttttgatccctagctaccggaggctgacatttaagaaagaagttggacaataacttccaggtttccactgaaactatgccagactcctgaagtctcttctctgctcagccaggatgcagaggtctgaggagaggtacactattttgaaaggattggacttcttgagccgcgactccaagtatacgaga

SEQ ID NO: 2912 - DNA, 443 bp, Mus musculus
taggacacgtaggacatcttgacaaggtcgatatgtgatgctaaagtagaccttgtatatagtaagcaactctccactttatgcaggaaggaacttgggctctgagattttttctggcccaccgacccacagctggaaacaattctatccagactctgaactgcaaaggcaggcgtctcctgggatactgtgagcacactgatgccagtgctctcaacaggccgcatcgctaaggggccgaacgttccaaggatggataggcaactgatgtgaaacagataactgtagccaggcagcggtccaggacacctagagataaagccaaatacagaccagaagaagcctagcccggccctcgcgggagcgagaccccgccccgggcgcgtccgcgagcgtggctgtagctcccgcagaaccctcaccgcactgagagaccttagggc

SEQ ID NO: 2913 - DNA, 227 bp, Mus musculus
  misc_feature (74)..(74): n is a, c, g, or t
  misc_feature (89)..(89): n is a, c, g, or t
  misc_feature (94)..(94): n is a, c, g, or t
  misc_feature (98)..(98): n is a, c, g, or t
  misc_feature (108)..(108): n is a, c, g, or t
  misc_feature (144)..(144): n is a, c, g, or t
acgactgctgctggtgtgtatttttgtaaatgttatgcactctgaaaggaaaacacacaaaagaagagattttntcgttttttgttttnccaangccnagtgttgctncctaaaaaaaaaaataaaataaaatacaaaaatacnaaaaaaacattgatactataaaatggtaaaaagcgtcttctttctaaacagccccagtgttgaagtctatacttaattttgtt

SEQ ID NO: 2914 - DNA, 492 bp, Mus musculus
  misc_feature (38)..(38): n is a, c, g, or t
  misc_feature (60)..(60): n is a, c, g, or t
  misc_feature (68)..(68): n is a, c, g, or t
  misc_feature (70)..(70): n is a, c, g, or t
  misc_feature (138)..(138): n is a, c, g, or t
  misc_feature (279)..(279): n is a, c, g, or t
  misc_feature (284)..(284): n is a, c, g, or t
  misc_feature (299)..(299): n is a, c, g, or t
  misc_feature (305)..(307): n is a, c, g, or t
  misc_feature (315)..(315): n is a, c, g, or t
  misc_feature (323)..(323): n is a, c, g, or t
  misc_feature (343)..(343): n is a, c, g, or t
  misc_feature (349)..(349): n is a, c, g, or t
  misc_feature (362)..(362): n is a, c, g, or t
  misc_feature (369)..(369): n is a, c, g, or t
  misc_feature (373)..(374): n is a, c, g, or t
  misc_feature (377)..(377): n is a, c, g, or t
  misc_feature (380)..(380): n is a, c, g, or t
  misc_feature (383)..(383): n is a, c, g, or t
  misc_feature (388)..(388): n is a, c, g, or t
  misc_feature (396)..(396): n is a, c, g, or t
aagtggacgtctttatcctgtgcactccgcagtggggnacaatagatgcctcactgtggncagcatgngncatggagagggaactctcatgctgctagccagaccccttgtgatagagactgtgtgcaaagacagtgncttcccttaactccctggagaacctgaacagatgccaccattaggaagtgccttgcggctccattgactttgcaggagcagagccagcctgcaaggctgtttgtggaagatctgctgctcctgcagtctttatcacttccnagctntgatgtgaacacaancaaccnnntgggctcnaaggtccngtggctgctctgacaccttntgaatnagcgatttcagtncaaatgncctnnccnaanctncctcncagggctncttggaggatgtttcagttgataaaactgtttgaagacaggatccttggcactgtttaagaatatacactgctcagcttaaccatctcattgaaag

SEQ ID NO: 2915 - DNA, 114 bp, Mus musculus
  misc_feature (89)..(89): n is a, c, g, or t
agggaaggaaaaatcacaatcactgatctcagttctttttaaattgtaagtcggatgcggctgctggctgagtgtttacacattgcttncctgctaaagtatatgattaaactg

SEQ ID NO: 2916 - DNA, 435 bp, Mus musculus
  misc_feature (80)..(80): n is a, c, g, or t
  misc_feature (119)..(119): n is a, c, g, or t
  misc_feature (131)..(131): n is a, c, g, or t
  misc_feature (307)..(309): n is a, c, g, or t
  misc_feature (311)..(312): n is a, c, g, or t
  misc_feature (314)..(316): n is a, c, g, or t
  misc_feature (318)..(321): n is a, c, g, or t
  misc_feature (324)..(327): n is a, c, g, or t
  misc_feature (352)..(352): n is a, c, g, or t
  misc_feature (359)..(359): n is a, c, g, or t
  misc_feature (364)..(364): n is a, c, g, or t
  misc_feature (380)..(380): n is a, c, g, or t
cagcctcttagccttggtttgttggtcacatagcactgttaaatttatccgaggcataagtagttcctagaggagacagnctatcactccccctagaccaggcgctttgcggtgacagnctggagctatantggatgggtgatgagagacgttcccccatcctgtgtctcctgctgtgtggacacatgtcactcctgctccacatgccaacatggttcatttccaagggcaccctataaccagagagcacattaattcctgtcctataagagggctgtgggaaactgtgtacctggaggtggtccannncnnannncnnnnttnnnnccttcagcttcataggcagcatacncctgctnccccnattgtgggtgggggtnccccactgcgtactgtgtttttaatttcatttaacttctagcagacacgctcagt

SEQ ID NO: 2917 - DNA, 502 bp, Mus musculus
  misc_feature (271)..(271): n is a, c, g, or t
  misc_feature (275)..(275): n is a, c, g, or t
  misc_feature (281)..(283): n is a, c, g, or t
  misc_feature (293)..(293): n is a, c, g, or t
  misc_feature (308)..(308): n is a, c, g, or t
  misc_feature (311)..(311): n is a, c, g, or t
  misc_feature (350)..(350): n is a, c, g, or t
  misc_feature (419)..(419): n is a, c, g, or t
  misc_feature (422)..(422): n is a, c, g, or t
  misc_feature (440)..(440): n is a, c, g, or t
  misc_feature (444)..(444): n is a, c, g, or t
  misc_feature (453)..(453): n is a, c, g, or t
  misc_feature (456)..(456): n is a, c, g, or t
gttcagctgggtgtcaacaatcacatgtggggccacacaggggcccagtcatctgatgacaagactgagtgttcggagaacccctgtatgggccctctgactgatcagggcgaaccccttcttgagactccagagtgaccaggttggaccccacctagatggctagagtgacaagattggacttcacctgggtccttaaaatgatagtggaggaagggaacctcgcctgggtccccagagtagccagaggacttagcttgggctcccacantggnctattnnnttggacccancttgagaccccagangcnagggaagaccacacctataaatcaggcctgggaaacatncagaaaccccatttgaacagactgtgggactccaatctgaatcctctatgtggacagaggatgatgggnccnagaggcacctctgaggtncccntcagcgcanccntcgtaaacttcattcactgtgacacatgctgttcatagggtctctc

SEQ ID NO: 2918 - DNA, 407 bp, Mus musculus
  misc_feature (147)..(147): n is a, c, g, or t
  misc_feature (189)..(189): n is a, c, g, or t
  misc_feature (203)..(203): n is a, c, g, or t
  misc_feature (253)..(253): n is a, c, g, or t
  misc_feature (262)..(262): n is a, c, g, or t
  misc_feature (265)..(265): n is a, c, g, or t
  misc_feature (278)..(278): n is a, c, g, or t
  misc_feature (286)..(286): n is a, c, g, or t
  misc_feature (296)..(296): n is a, c, g, or t
  misc_feature (336)..(336): n is a, c, g, or t
  misc_feature (351)..(351): n is a, c, g, or t
  misc_feature (359)..(360): n is a, c, g, or t
  misc_feature (365)..(365): n is a, c, g, or t
ttgtagccttggatggaatgtcagtgagtgttatgcaatgtatctgggttctcaggtattgacttttccttttcatcatggaggcttaaccctaattgaatctttgcagcttttaaaatagctcaatcttggttgatatttttgatntttcacttccagattttttttctgtaactctacttgttcttngtctgtgtaaaggnatgtgttctgggtttgtcgaggggaaacatttgatagaaatgtccatctnatagacagnatntcttattttctgnagacactnatattgattnatatgaacttttgagttactacattgacttgtgatggttncccatgagatttatnaaatttgnnaaatntcaaattttaattgacctccacctgagaattccttctttttt

SEQ ID NO: 2919 - DNA, 509 bp, Mus musculus
  misc_feature (109)..(109): n is a, c, g, or t
  misc_feature (261)..(261): n is a, c, g, or t
  misc_feature (285)..(285): n is a, c, g, or t
  misc_feature (307)..(307): n is a, c, g, or t
  misc_feature (316)..(316): n is a, c, g, or t
  misc_feature (332)..(332): n is a, c, g, or t
  misc_feature (340)..(340): n is a, c, g, or t
  misc_feature (378)..(378): n is a, c, g, or t
ggtactatgttttcactcaaaccacttatcagataccactgtgtataatatgaattcaatatgacagttactgtatagaacagattgtgcctcttaaaaatgtgtgtancaggtaattcatattttgttgtaaatctatagcagttttgcttttaaattgtgtactttattttccacccatgactagcttggagtatatttttgatgtatataaatacaaaaagagagagagccgatgtgatgcttacagacattcactangcaagtgataaaatttcagaagtntcacatcttactgcatttactncatcccgtntctcctggcatttctncagttttntgcatagttctcatttagaagagctagttcttatgtgnacagtttctttagaactttgattaacaagctatggcttgtaaccagtggagttaaatgctgacttgatccacaaagttaatgaggctgtgtaccccccctccaactgtaatcttttcagttgacagtactt

SEQ ID NO: 2920 - DNA, 264 bp, Mus musculus
  misc_feature (84)..(84): n is a, c, g, or t
  misc_feature (116)..(116): n is a, c, g, or t
ttaatcaggaaatgcagtggctaaaattcctgcaggccctttgtatctcacattgcacataccgaggcccttagacttttatgnccttcctgaatatgaggcaacattgtttgtcnccaaataattcctgacgtatagtgtaacaattctggctgtgcctcagtttgcactctcctggggtcatctgggttatcttctgtttaaacagccccaggggccatctgttctccccgtctactgtacgagtgctggagatggctctca

SEQ ID NO: 2921 - DNA, 527 bp, Mus musculus
  misc_feature (110)..(112): n is a, c, g, or t
  misc_feature (117)..(117): n is a, c, g, or t
  misc_feature (331)..(331): n is a, c, g, or t
  misc_feature (335)..(335): n is a, c, g, or t
  misc_feature (392)..(392): n is a, c, g, or t
  misc_feature (394)..(394): n is a, c, g, or t
aaaggaaaccaactcactgactctctttaatgacaacacagtccgtggctcccttatttggcagtatcccttcacttgccagggtgacaaagaagcaatccagcaagttnnnccggntcccagggagcactgagtggagaaccagccaagaggcacatttaccatgttaaaaggcctacgttcccaagaacactgctttcctgctaataccttcaccaatagtgcatcttataggcgtgatacagcagtgaattgttaggtgtatatctaacacacagaaagtctatgctctccactactgtgcgatatcccaacccaacaccaacgattncacngccccgcttttctggattgtaaacgttacaaagcactcatgtcagcatttaccagantnccctacaggggacttttaaattggagttctgtgttgtttatttcagaaaacataggcttaaagtcactttgactgcacccattcaaatccatggtaaaaccatgtgccttttccccagctgacaaaggttaga

SEQ ID NO: 2922 - DNA, 377 bp, Mus musculus
tgtgccctttgccatacgtaggaatgagtgagtggctttccgatgttctgatgcgtctctgtgtgtcacatgcatccctgacacaggaaattccaggcatctgaagcaaactgccctttgtcctcaaagaaaatgtttaaaaagaaaactttttaaaaggctattttgcatattatctgccttgttcttatcacacttgagatgttgacattttctgaccctgtgtctttggctacaatcattcagtatttgtgtcaaatttgacaagtgccctaatagaatgtgtttgaatgttatccttgcacaattctttaaattgaaagacaaaatgttttacctcactgttggacatacattccaggcttttcgactttagg

SEQ ID NO: 2923 - DNA, 472 bp, Mus musculus
  misc_feature (140)..(140): n is a, c, g, or t
  misc_feature (142)..(143): n is a, c, g, or t
  misc_feature (175)..(175): n is a, c, g, or t
  misc_feature (298)..(298): n is a, c, g, or t
  misc_feature (302)..(303): n is a, c, g, or t
  misc_feature (306)..(306): n is a, c, g, or t
actgattattcaaggccatggcactgttaccagaaaaatggtgtttgctgtctatatgcaagtctatttagctgctggggagaggacagagctcacactttgtatctaatacaaaaagaagatcaatacaaaaaaaaaananntcatcttcctctcaagtggaaaccaaaccaangccaaaccctttgtttaagtggctcagttaaatgattaattgaaaggaaatcatgaattgcatgtcattcttcatgctgatctgtagactaaaagcatgtttttctgtctccttcaggatgtntctnnccnttctaagtacagtatattcaaatggtagaaaaaaaagctgactcaaaggttttacgctttgtaatttttccagttctttttagctttcaatgttggaataaatttaagtcttgtttatggctaaagtttctgtatggaaaaatgattcttgcttattagcttttgt

SEQ ID NO: 2924 - DNA, 529 bp, Mus musculus
  misc_feature (185)..(185): n is a, c, g, or t
  misc_feature (308)..(308): n is a, c, g, or t
  misc_feature (310)..(310): n is a, c, g, or t
  misc_feature (320)..(320): n is a, c, g, or t
  misc_feature (391)..(391): n is a, c, g, or t
  misc_feature (420)..(420): n is a, c, g, or t
  misc_feature (428)..(428): n is a, c, g, or t
  misc_feature (437)..(437): n is a, c, g, or t
  misc_feature (465)..(465): n is a, c, g, or t
  misc_feature (479)..(479): n is a, c, g, or t
  misc_feature (487)..(487): n is a, c, g, or t
agtgagctgatgaggctagcccagaagggcagtgaggtgaatgtcattggcattggcaccagtgtggtcacttgtcccaaacagccttctatgggctgtgtctacaagctggtgtctgtaggaggccagcctcgaatcaagctgacagaggaccctgagaagcaaacactgccagggagcaaggnctgccttccggttcctaggccccgatgggtctttgctactggacctactgcagttagcagaagagcccccgcccaaggctgggcaggaactgagggtttggcctcgggggacccaggagcccntncactgtgaangccagcccaagtggagccattgctgcgactctacctgcaacagggacagctgtgtgagccactgccatctntggatgagtccagacgctttgcccagcantccctgancctcctccnccctgcacataagcagctgcagagcccntgcagtgtatccgntcgcactntcagagaagcttcgggcactggtggacagtttgagtgctcga

SEQ ID NO: 2925 - DNA, 563 bp, Mus musculus
  misc_feature (228)..(228): n is a, c, g, or t
  misc_feature (273)..(273): n is a, c, g, or t
  misc_feature (287)..(287): n is a, c, g, or t
  misc_feature (314)..(314): n is a, c, g, or t
  misc_feature (347)..(347): n is a, c, g, or t
  misc_feature (437)..(437): n is a, c, g, or t
tgactactccacagagcctgctagaaactcggctgcttggtccccgcaggccatgcctgcatgcatcagcacacaccgcagcccgaggtagccggtgagggacatgatttggtttgccaggtagcacaggggtggtgcaggaccagtactccctgaaccacagtccaagacctccccttagcccctcaaggtcaccctctagtttatagaggcttgccaccccctaancacccttcacactccctcctcctcttctgcctgtgtcctgagctnccttgctgcaaatncatggggtacagctcaccccagaggancctcaccagactgcatccttcacctttcaaagnccactggcaccgggttccctcgttgagtcacaactttgatttttttttaattgtttttctccttgttttcttttttaatatatatatatnatatatttaaaaggcagtatctttttgtactgtgaattttcagtagaagaggcatagtgcacttttttttttacttctgttggtgtgtactgtatatatatatagtctgcgcgcttctcgtgatga

SEQ ID NO: 2926 - DNA, 451 bp, Mus musculus
  misc_feature (272)..(272): n is a, c, g, or t
gaggttctactatgctttgtacttgaattagtctaagtgtaggcttagtatactatatgcttgcatatttattttcaactttgcttgtctttaaaatcacttgaggaaaaatggctaattaatttctgctacagaaaagccaactggtaaattttctcaattgtcttaaatgctaaagtataatgtggttcagaggggcttttacgatagcagagaactgtacaaatatacaggtagctgtagttctaactgaaatgaacttgccatttgantgatgtgtacagctatatacctgagtcccttctagtttatgtagactagcaatttgacctgttaaacaggactagtttactttgttgtatacacctggaggtatctgttattcgactccatttttgagttttggcacagtgaagataaatttgtgtgacccacttgaatgactgatcta

SEQ ID NO: 2927 - DNA, 483 bp, Mus musculus
  misc_feature (324)..(324): n is a, c, g, or t
  misc_feature (375)..(375): n is a, c, g, or t
  misc_feature (438)..(438): n is a, c, g, or t
aattcagatattcaccgtagcaggtagacagatggaggatggctggggaagggagttgtgggctgaagtttaggggactgcagacacatctgggcccagtcctcagctgttccttgctggtatacctcagaagtggaatgtcagagtgggctactagagacctctgaccccagcagcactggcttgccctcatatgtggggtgtagtcacgtcagtgacttcctgggaattgcttgtttcagatcatattgatctctttccttttgtctctcaccgtatggtatgacttgaatcagttttgattctatgtgtaagttctcatcngtttggaacctggtatttctgttgtgttcttggcagtgcataggaacccancctcctgtgttttgaccctcctgcaggcactgtgggactcgagggcagcagatccatctcccntcccttgctgcatgatggtcactagctgatctgtgatggcgtccc

SEQ ID NO: 2928 - DNA, 418 bp, Mus musculus
  misc_feature (275)..(275): n is a, c, g, or t
  misc_feature (278)..(278): n is a, c, g, or t
  misc_feature (280)..(280): n is a, c, g, or t
  misc_feature (293)..(293): n is a, c, g, or t
  misc_feature (301)..(301): n is a, c, g, or t
  misc_feature (303)..(303): n is a, c, g, or t
  misc_feature (305)..(305): n is a, c, g, or t
  misc_feature (332)..(332): n is a, c, g, or t
  misc_feature (348)..(348): n is a, c, g, or t
  misc_feature (366)..(366): n is a, c, g, or t
  misc_feature (371)..(371): n is a, c, g, or t
ggatgcaactttagaaggctctcgcaaaccctgtgtatgctcttctctgaagagttgccttcgccctaaagtgggaaactatttagcttgaactggtcaattcttcctaatgagctgaaggcaagccaacagatttcaaaaggaatgagtcaagtcaaagatttttagacacgtcaaaatatcttcttaaaattctccacttttgaacactgggtcagttgtgataagactgctcatttttaatgttgtatggtattttgcattgaaaaataaanttnanctcggtattacantccctatnancnaatgatttacatggatctctttaaagntcctggaacctgtgancctcagttacctcatttntaatnagcagaaacacctacctcacagggttgttgtgaggactccatgagct

SEQ ID NO: 2929 - DNA, 539 bp, Mus musculus
  misc_feature (59)..(59): n is a, c, g, or t
  misc_feature (176)..(176): n is a, c, g, or t
  misc_feature (280)..(280): n is a, c, g, or t
  misc_feature (299)..(299): n is a, c, g, or t
  misc_feature (320)..(320): n is a, c, g, or t
  misc_feature (335)..(335): n is a, c, g, or t
  misc_feature (383)..(383): n is a, c, g, or t
  misc_feature (388)..(388): n is a, c, g, or t
  misc_feature (472)..(472): n is a, c, g, or t
  misc_feature (474)..(474): n is a, c, g, or t
  misc_feature (490)..(490): n is a, c, g, or t
  misc_feature (500)..(500): n is a, c, g, or t
cagctgactatgaaccctacgtggtggtaccccgtgactgcccccgttatgatcctcgntttgtgggatttggctggaacaaggtggcccacatcatagagttggatgctcaggaatatgaattcctggtacttcctgaggccttctctatccacttgccccacgctccaagtctngacatctcccgcttccgctccagccccacctaccgcaactgtctccaggccctcaaggaagagttccaccaggacttgtcaaggcgctatgggtctgcagcccntgaaatacctcactgcccntgcagcaggcccgaagtcggncctgagcttaccccnctgccctagctatggcttacacattccctgtagaggctgaccagggtntccanccttactgctatttaagttatttaaaatttttgtcagaaggggcagagtggagcatttgtggggttcctggttccttctgctgntnccacactgggatccanccctcctttncctcagctggtttggggctagtctaattctcttatataa

SEQ ID NO: 2930 - DNA, 542 bp, Mus musculus
  misc_feature (185)..(185): n is a, c, g, or t
  misc_feature (263)..(263): n is a, c, g, or t
  misc_feature (283)..(283): n is a, c, g, or t
  misc_feature (292)..(292): n is a, c, g, or t
  misc_feature (305)..(305): n is a, c, g, or t
  misc_feature (308)..(308): n is a, c, g, or t
  misc_feature (325)..(325): n is a, c, g, or t
  misc_feature (422)..(422): n is a, c, g, or t
  misc_feature (425)..(425): n is a, c, g, or t
  misc_feature (451)..(451): n is a, c, g, or t
  misc_feature (498)..(498): n is a, c, g, or t
gcagacattcacaggtgcacgcatatatgtgtgtcgcccccacccccgccatggcatttcatgatatgtgattaggagctcgtgtgcaccctcatatccattccatgagaaggtgagggatacctccttggggctgtttgtatcatggactgtcatgctctatgcctggtcctggggtctctagnggatactcatctggagtctctgaagacttgacccatatttccaagaccctacaactccagccttgccctatgacatcntcaaggatctccacagaggntgactgttngcctatccacaanganactagtgatcactcttncagagagtgactctcgggaaaactgagagaaatggcttccggatgagatggacctgactggggaaacacctttgagcttgtaacctagcagctgggnccnagtgagaggtgactcagacactcctncctcagtttcttagaacagtgttgctattgatgcttaagaataattncctcttgggcaagatgattgggctcctggcaaatgttcaattaa

SEQ ID NO: 2931 - DNA, 347 bp, Mus musculus
  misc_feature (115)..(116): n is a, c, g, or t
  misc_feature (119)..(122): n is a, c, g, or t
  misc_feature (197)..(197): n is a, c, g, or t
  misc_feature (216)..(216): n is a, c, g, or t
  misc_feature (276)..(276): n is a, c, g, or t
gggctggcccttggattcaggcacacgatcaccacacaggcgtgtgttcatgcatgcctcgtgtgctcatctcacacgcacccctctcccaggtcatgcaggacccctccccccnnacnnnncacacacatctcatgctgtgcacccggaggctgctcacgtctctcacacccggtgtcggtgtcggtacacatctngcctctcacatgctgcccnttctcccacccacccagggacacccgacggctcctccctgatcctttccctgtaccccgncctcgaggtgccctgcccagcggggcgtgtgaatatgcaatgggagtcccgggctgtacaatggcaagtgt

SEQ ID NO: 2932 - DNA, 490 bp, Mus musculus
  misc_feature (303)..(303): n is a, c, g, or t
  misc_feature (341)..(341): n is a, c, g, or t
  misc_feature (414)..(414): n is a, c, g, or t
  misc_feature (452)..(452): n is a, c, g, or t
cctccagtcaaggtcagtccagtaagctgtctgtcactcacgtgtatagcaagggcctgctcagtctaaacactgaatgctgaccaaccagctaggcaggtccagaggttgggggtgggggaagggcaaggggaagaagtcttctctgcttagtaggactgccaccacgccccagtaccaccagatgccatggcttgatgtccttatgcccaagagtggagcaaggcatcttgccatcagaggctaagggctgaactattctcccatgggcaagtctgccactgtaccaccccagacccacantcctatggtccttgtggtgacacagatcatggtggtgnccctctccctcctcggtgtatgtacaagtacaaatgtcatcatggtgtacctatgaggagaccaacagcaccntcttgtatgcacatctattacccacacatgtacacacncattacgcatatccgcaccgtttgtttcctatatacag

SEQ ID NO: 2933 - DNA, 347 bp, Mus musculus
  misc_feature (30)..(30): n is a, c, g, or t
  misc_feature (83)..(83): n is a, c, g, or t
  misc_feature (86)..(86): n is a, c, g, or t
  misc_feature (88)..(88): n is a, c, g, or t
  misc_feature (90)..(90): n is a, c, g, or t
  misc_feature (92)..(93): n is a, c, g, or t
  misc_feature (95)..(100): n is a, c, g, or t
  misc_feature (102)..(103): n is a, c, g, or t
  misc_feature (128)..(128): n is a, c, g, or t
  misc_feature (134)..(134): n is a, c, g, or t
  misc_feature (142)..(142): n is a, c, g, or t
  misc_feature (145)..(145): n is a, c, g, or t
  misc_feature (148)..(148): n is a, c, g, or t
  misc_feature (150)..(151): n is a, c, g, or t
  misc_feature (160)..(160): n is a, c, g, or t
  misc_feature (165)..(166): n is a, c, g, or t
  misc_feature (180)..(180): n is a, c, g, or t
  misc_feature (199)..(199): n is a, c, g, or t
  misc_feature (205)..(205): n is a, c, g, or t
  misc_feature (230)..(230): n is a, c, g, or t
  misc_feature (232)..(232): n is a, c, g, or t
  misc_feature (235)..(235): n is a, c, g, or t
  misc_feature (243)..(243): n is a, c, g, or t
  misc_feature (268)..(268): n is a, c, g, or t
  misc_feature (285)..(285): n is a, c, g, or t
  misc_feature (289)..(289): n is a, c, g, or t
gatagaaggcagtctttctcccaagctggntggatctcctgaagcacgctgcctgggctccagcatcctgtgcggatttcacnttntntntnngnnnnnnannttgacactggggtgtgggctctgancccacnggagtttnaanaancnnaaagagctnagagnntcgagagagatccnatcaccgagaatgacaagncaaccnggggtggatgtggatcttgaaactnantanaaaggggnttttcacagtgacagcgacattctnttcatagggcacagctntcantctatggctgatccagagcgagcatccatgaattctgcatgtgcaggggtcactctaa

SEQ ID NO: 2934 - DNA, 490 bp, Mus musculus
accgagcaattcctggcactgattggccagtttattcgctccacaatggagcagtgcacaagccagaagatgcctgaaatgcctgcagatgctgtgggcgcccttctcttcctggaggattatgttcggtatacaaaactcccccgaagggtggctgaagcccatgtgcctaacttcatttttgatgaattccgaacagtcctgtgacttctttctcctgctccagtgacaggatgttctatgactagaatgaacttggacgtgagaaagatacttgactcctcatgcaacgtgcattttcctcctctgtgggaaccagccattctaaggaaagtggctctcaactgtctaaatcatggcatcgtaaggaatttttatcatgtagatgcagaactgttttgtacttgcctcttttaaatgctcagtataactgatggatgaagccattccatcttatgttctaaggatctgtttgtgcaactccagacct

SEQ ID NO: 2935 - DNA, 334 bp, Mus musculus
  misc_feature (306)..(306): n is a, c, g, or t
ggcctatagggatattgttctcactaaatgtgagtggaaacattagtgaacacagatgaaaatgaatgactaagtcccccaccccctttttttaggctggggatctatcccagagttctatctccaaccctaaacagtcagaccccagcctcagacatagatatgccacattcggtatatggttgctaaaatgtttccatggcttgcttacttcggtgtgtgatgacgtaggccagcaattgcttttgtaaaactagaggtgtggacctggagtcggctccttttgtctgcttcctctgcttcctntctggctagactctaaactccttgagca

SEQ ID NO: 2936 - DNA, 553 bp, Mus musculus
  misc_feature (75)..(75): n is a, c, g, or t
gaaggatgctagactcagctcgttttgggtttttgttttttgtttttccagatagggtttcttctctgtatagcnctggctgtcttggaactcactttgtagaccaggctggcctcgaactcagaaatccgcctgcctcgtcagcttgttttgattagtcagtctgaaaaggtgtctgaacagagtgcatgggagaactagacatgggcctgtgaacctctgcagaaagggatccagatggaaacacgccagaccctcaggtgggaatgagcaaggcagatgaagaggccaggcccctgaagctgccgtgaaacaggaggtttgctgaagctccagagccgaaggctgatgcggtaggcaccgagcctctctgctctgctttgtagagccaggcagaagaattgatctgaggtgctgatcctgtactcttagggcttcaaagatggaagctgcttcccactggaccatggaaagaagctgtaagcctgcagtgcctgccccgtgggtgccgatttcactgctgcctctgacagctggagctaggactcttttg

SEQ ID NO: 2937 - DNA, 88 bp, Mus musculus
  misc_feature (49)..(49): n is a, c, g, or t
gatgcttttctactctacctgaatggcttttgtagtcagtatattgtancctgtaatttatattaatttaccatttgttgtcattaaa

SEQ ID NO: 2938 - DNA, 373 bp, Mus musculus
  misc_feature (304)..(304): n is a, c, g, or t
  misc_feature (339)..(339): n is a, c, g, or t
  misc_feature (347)..(347): n is a, c, g, or t
ttaactccattcctttacagacgtctagaatctttccatatcgctgccggccacacttttaaacctgtgttaattgctatgtgtgcttgaagtatctgttcttttaaagatgttctttaagtcatattgtcagttttacaatctagtcttccttccatgtttggtgaaatctcactgaacaggaataatagcaataactaacaacatctgcacagcaccttacagtttgcagagaacgttcacatattcttgtctgagttttgcatagtgaacatgtcacagagatgtcccttgatgtcaatgnctaagtgttagaatgttcagtcacagtgtcactgnccttgctncggcactgattagcacactgacgggt

SEQ ID NO: 2939 - DNA, 156 bp, Mus musculus
  misc_feature (56)..(59): n is a, c, g, or t
  misc_feature (122)..(122): n is a, c, g, or t
tttttccccaggtcactttgcttcagtaacaaaggcaattgtttttgaataatttnnnncttcacctccttccggtatttgtacataatgattcagtattagtaagaagtgcgttatttctntcattgctgatctgtgttggtgctcatttgagaa

SEQ ID NO: 2940 - DNA, 526 bp, Mus musculus
  misc_feature (173)..(174): n is a, c, g, or t
  misc_feature (327)..(327): n is a, c, g, or t
  misc_feature (387)..(387): n is a, c, g, or t
agcttctcaaagctgcggtgctcctggccctcctggcaccatgggacaaggacaaccacgtgacaacatatttttttggaagcaaaactttaattttatatgacatatactatgaaaagctaagaaaatttaaggactactagtttcctttttctttctttcttttttttttnnctttttaaaatgggatccactgtgttgaagactcttgatatcatgtgcttgtctagacattttaaaaaaacaatttaaatagaattgagcgtgatcatagttatccaatggatttgtttggagaattagattttatttgtgaattgtttaaanaaaaatcaggatactgataaatttgactgtttttttctcttctcattatgttttattctntggttatgaatcaggatatatactccaggcattttctttcccagcaaattgtaggaactttaatttgattggcagttgtatgttaaatcagttttctttcaccacttcttgagaaggcggttccagtttgaaattgtat

SEQ ID NO: 2941 - DNA, 448 bp, Mus musculus
  misc_feature (381)..(381): n is a, c, g, or t
atccagtgctgggttacttgtgtagcactgtggtcttgtgtatgcggttggcttgtctactgtgtggttcctcagcgatgtaatcttgtttaaatgtaaagttcccttgattttgtcatacatataaatgagtattttcagagatcccacttcacctgttatttctattgtgttgaaatgaagtacttaaaattactgttctccgtgaactctgtagactgtatgatgtgttacatatggccaactgccttttagctggccttttttattaatatgcctgttttaagtgcttaatacagtataatgtgattgtaagtcatgagcctattttaaatcattccctcctgtgtatgtgtgctctgagagagcttcattttattntcccagcagagtaacttgtgatggttatttacattccccagagtgtgcctctggtgtgaattctgtc

SEQ ID NO: 2942 - DNA, 498 bp, Mus musculus
  misc_feature (327)..(327): n is a, c, g, or t
  misc_feature (335)..(335): n is a, c, g, or t
  misc_feature (358)..(358): n is a, c, g, or t
  misc_feature (405)..(405): n is a, c, g, or t
gtaagcttcctgtgatgtttgtccagcacttcactatttttggaaatgaaacctgtattcagaatgatagggcagagcgagctcgtctcagcctttgtcatggcatacatagatgaaccgcctttccaggccctgcctactcaggtcacttccgctctgtgtgcacgtgagcttcagtactccagaaacactcagagcatacatgcagagcaggcagacaccttgcagtaacctgtatgctacagaatcctgcatatcgatgaagtgcacactagaaaaccatgagaagcagagctcttgattgacagaacttagatgttcattttnactgggtnaactaaatacagtatccctgatnataattgttggtttagaagttgaaataccattctttattctcactgncctcaaattcgctgataatttttccctaaactaataagtgggtaagtataacctttgttgttatccactggctgctcctaaactggtttccag

SEQ ID NO: 2943 - DNA, 382 bp, Mus musculus
  misc_feature (308)..(308): n is a, c, g, or t
  misc_feature (346)..(346): n is a, c, g, or t
  misc_feature (349)..(349): n is a, c, g, or t
  misc_feature (353)..(353): n is a, c, g, or t
tcagtcgattgattttgctttgtcttgctatgttcttgttcaactaaaaatgtagttatttcttcccgaaggttaacaatactacgttcatggaataacaaagcagaattctcttcttttacaagaagccaagtttttaattctataaaagtcagctccaaagagctgtctctgtctcctgaaatagtttgcaccaggagtctgttgattgtgaagctgactattgtaagtacttacaagtgttcctttgctttaaggtgtaggctttcctacttgctttgcagaagttagcctagaaatgaggaagnccagaggaagggtgagaaagtggtagtgaactactccncgncctntcgtgaccagactggaagctatgttataa

SEQ ID NO: 2944 - DNA, 312 bp, Mus musculus
atctatggtttcatcccaggagcagacattagctagctggacaaacagttgtgacaatatttgtcacataggggcctatggtttgttgctcaacaatatagtacttttctcatgtgactcaacactatagcacaagtattatttccctggattctctgaaggagcatctaaaagacgggtttctgacagtgtttgctctttaaactatgttttctcctaccccaagttggctttgcatctattaaataagttcttcagctgccttactaggagttctacgagggcaacatcttttctgcatttcaccttgta

SEQ ID NO: 2945 - DNA, 460 bp, Mus musculus
  misc_feature (191)..(191): n is a, c, g, or t
  misc_feature (193)..(193): n is a, c, g, or t
  misc_feature (233)..(233): n is a, c, g, or t
  misc_feature (235)..(235): n is a, c, g, or t
  misc_feature (242)..(242): n is a, c, g, or t
  misc_feature (262)..(262): n is a, c, g, or t
  misc_feature (289)..(289): n is a, c, g, or t
  misc_feature (293)..(293): n is a, c, g, or t
  misc_feature (377)..(377): n is a, c, g, or t
  misc_feature (413)..(413): n is a, c, g, or t
aaaaatcaggactctccttctctgagatgaccttgctctgatgtgtagacaggaggtgcagcttccagcttggaaaccccctggacttaatgtagagaaagctttgcagacactgctttggggaaaaacaaacaaaaaaccctgaaagggacagttgtaaaacatgtataagctgctgtctttggttactntntccatggtttggtgtggctgtatttattttaacttccatntnattagtnatggtcgttgggagtctttntaaaccatgaacaccatggacattggntcantcccacccatgtaaccaacacgtgtgtgagtctgctcatttccaatactggataatgtatgttaacatgttatgtctcatagtncaaacagaaacaccattttttagggctggctcattntcaggcctaaaggttagatataaggtcatgtgactgctgcttcaata

SEQ ID NO: 2946 - DNA, 246 bp, Mus musculus
  misc_feature (27)..(27): n is a, c, g, or t
  misc_feature (34)..(34): n is a, c, g, or t
  misc_feature (51)..(51): n is a, c, g, or t
  misc_feature (82)..(82): n is a, c, g, or t
  misc_feature (127)..(127): n is a, c, g, or t
  misc_feature (129)..(129): n is a, c, g, or t
  misc_feature (135)..(135): n is a, c, g, or t
cttaagcccatggtgttcatggaattnccatatncccactgttaacatcantctatatttttaaccatttatccaaggttgnatatgtataattatctaatgatgtctattcaattgactttacatntngcattntgtatcatgtcagtatgtaataaagagagatgattttttccagataagcttaataaattgacagacatttggtttttttttaaatgggtaatagtatttcctatgtaaaca

SEQ ID NO: 2947 - DNA, 324 bp, Mus musculus
  misc_feature (52)..(53): n is a, c, g, or t
  misc_feature (57)..(57): n is a, c, g, or t
  misc_feature (62)..(62): n is a, c, g, or t
  misc_feature (65)..(65): n is a, c, g, or t
  misc_feature (80)..(80): n is a, c, g, or t
  misc_feature (104)..(104): n is a, c, g, or t
  misc_feature (109)..(109): n is a, c, g, or t
  misc_feature (135)..(135): n is a, c, g, or t
  misc_feature (138)..(138): n is a, c, g, or t
  misc_feature (151)..(151): n is a, c, g, or t
  misc_feature (162)..(162): n is a, c, g, or t
  misc_feature (274)..(274): n is a, c, g, or t
  misc_feature (279)..(279): n is a, c, g, or t
  misc_feature (291)..(291): n is a, c, g, or t
  misc_feature (296)..(296): n is a, c, g, or t
cttgctggagtatgcccacgtgtactgcctgggtcctgtcgcagggatgatnntggntgtcntcntccatcagggccacnttccccgccttttccagagaaatntgttntaccggcagaaaagcaaataccgaantcncagggggaagctntccccaggttntgtggacgccaagatgcacaaaggggagtagtggcaaagggccgtgccctacaggtgccagggcagcagccactggggtccagctgcgctgtctcactcaccgcagcttcantcgcntcctgagaggtntggtntccctgccacaaaatcatttgccaataa

SEQ ID NO: 2948 - DNA, 488 bp, Mus musculus
  misc_feature (428)..(428): n is a, c, g, or t
  misc_feature (430)..(430): n is a, c, g, or t
cccgcaagcttattcacatactgtttgcagtacccaataatgcaagatgttccaggtgtgcaacaattatcttctgatcaaagtcttgtaaaggctctaaagctccttcagaaaaataattctataattcatggaaatgtttgccacaaaaatttcttcagggtcccagtccttctagaaaacatctattctgatgtttacccttgatataatgaaaaacagttgcttcattctaatgtttgcagtagatacaatgattctactagaattccactatcatttttatttagcattttgttgtatctggtatattcagccatattcaaacattaggtctaagtatggactgtattgtatttccaaaggtaaacaaggaaactagaggaatgaaagaaactgggtagtagtttgtattcaaggagttttgntntgctgcgacataagtgttttgtttttaccttccttccttttgattcttcagaagcacc

SEQ ID NO: 2949 - DNA, 512 bp, Mus musculus
  misc_feature (111)..(111): n is a, c, g, or t
atttactgctttgtttgtgccttgaagcttcgatgggtttaaggatcacagaggggccaggatactaacgagggctggtttatttgcaaacctgaatacttgtgttgtggnttctccaggacaatttttttattattatttctactgaacatggagccattattaaaaagagttatgtgtggtttttcattatgtaaattgtatatatatttttttgcttgtttgaggttctatttttctaatagtcttcttacagtttcttataatgatgacattagattaagtccgatactaactgtaaatcaagctggtttctgctggattcccgtggattaattctattttattttaaggccaagtgcaggtgtcatccaccacccttttgaaaaaaaatgtgaaatttatgtttcccctcgttgctgaatacattgtacactggcaagacccctcccatacttatgtgttgtaaaatcaaagctgttttgtggtacattgtgtcatgctcctgcaga

SEQ ID NO: 2950 - DNA, 525 bp, Mus musculus
  misc_feature (229)..(229): n is a, c, g, or t
  misc_feature (316)..(316): n is a, c, g, or t
  misc_feature (364)..(364): n is a, c, g, or t
  misc_feature (385)..(385): n is a, c, g, or t
  misc_feature (389)..(389): n is a, c, g, or t
ggctcactcatgtctactggcaaagccatggccactgctgatctgtgtacctccctgcaatggaaacatggctggcttccgccagggcccatcctttctgacttgagcatcttatgtccccacagatagttatttcatcctaataaaagcttactgttttgttggctcccaagcattaaggaatcttaagtggggaatctaagtgccagggtgcccaccccttggggtngttggtgggtgatgcaaacagggatgtttgagtccaggtatggttgggctagcgaagggagtggccagacagagaatacatggcccnatggaactgttagagaactcagagtcagcgctgaatgtatgtcatgtnatataattcaaaccgcgtctntttnccttcatcatgagaggattgtacataaggttcctggggggagagcgagtggtccgtttctttaggcttgttttggtttgcgaaatactttgattgtcacagtggtgcaagtgaaacgtgctacactccaatgtggt

SEQ ID NO: 2951 - DNA, 565 bp, Mus musculus
  misc_feature (199)..(203): n is a, c, g, or t
  misc_feature (205)..(207): n is a, c, g, or t
  misc_feature (209)..(212): n is a, c, g, or t
  misc_feature (214)..(215): n is a, c, g, or t
  misc_feature (217)..(218): n is a, c, g, or t
  misc_feature (222)..(228): n is a, c, g, or t
  misc_feature (230)..(230): n is a, c, g, or t
  misc_feature (234)..(235): n is a, c, g, or t
  misc_feature (237)..(240): n is a, c, g, or t
  misc_feature (243)..(244): n is a, c, g, or t
  misc_feature (246)..(247): n is a, c, g, or t
  misc_feature (250)..(252): n is a, c, g, or t
  misc_feature (295)..(295): n is a, c, g, or t
  misc_feature (299)..(299): n is a, c, g, or t
  misc_feature (302)..(302): n is a, c, g, or t
  misc_feature (307)..(307): n is a, c, g, or t
  misc_feature (311)..(311): n is a, c, g, or t
  misc_feature (314)..(315): n is a, c, g, or t
  misc_feature (323)..(323): n is a, c, g, or t
  misc_feature (331)..(331): n is a, c, g, or t
  misc_feature (342)..(342): n is a, c, g, or t
  misc_feature (349)..(349): n is a, c, g, or t
  misc_feature (356)..(356): n is a, c, g, or t
  misc_feature (364)..(364): n is a, c, g, or t
  misc_feature (372)..(372): n is a, c, g, or t
  misc_feature (374)..(374): n is a, c, g, or t
  misc_feature (397)..(397): n is a, c, g, or t
  misc_feature (450)..(450): n is a, c, g, or t
  misc_feature (480)..(480): n is a, c, g, or t
  misc_feature (535)..(535): n is a, c, g, or t
taagggcctccaagagttctttctaaaagcactgcagaaggcccggatggtgctggccacattgcccctgggagcagaaggtggtttgatgagatgggaggggcttagcagcagggtaggggggagctgtggcagtgtccttgagatctgtcaacagaactgtatggaaactgtttctgttcgagctagattatagacnnnnnannncnnnnanngnnaacnnnnnnncntctnncnnnnctnncnnccnnnaggaaggtgacatttcttagtctcttttcaatgttcacgaganaccngtntctantatnagnnacaagatntggacctncgatccccggnaccacanttacagnactggggntcattttntnagtgaaactaatggaccacgttntctacgaacaaagaaactgtattgtagaaacccattcctccatgaattttatntcctatatattatgtgcatatatatatatnaggtatgtatgtgactgtgagtcaccctgatcattatgtagatatatcagtgttntctgttactgcccagaagcgattcactcat

SEQ ID NO: 2952 - DNA, 386 bp, Mus musculus
  misc_feature (41)..(41): n is a, c, g, or t
  misc_feature (74)..(74): n is a, c, g, or t
  misc_feature (293)..(293): n is a, c, g, or t
  misc_feature (308)..(308): n is a, c, g, or t
  misc_feature (326)..(326): n is a, c, g, or t
atcagctactcccacagaattttttagattatagaattgtnggctgttaactaatttgctcaaagttcttgtanaggattgcaaattttagtctgtttttgtaatgggataatattgatggctttatgacctcagagtttaaaattcacatggaattgattttcttgtcattagaaggtaatgcttgaacatttgatttttctattctgtgatacctgggtgtcatactgtctaatggcctttggtcccaattgtgaaattttatatgagctcattcattctctacaaacctnccccctttgggtctntggtgcctatgtatcatngtctggtctctagttggtggaattgcccttttttgtactgccacttctcaacatttttga

SEQ ID NO: 2953 - DNA, 362 bp, Mus musculus
  misc_feature (97)..(97): n is a, c, g, or t
  misc_feature (100)..(100): n is a, c, g, or t
  misc_feature (148)..(148): n is a, c, g, or t
  misc_feature (300)..(300): n is a, c, g, or t
  misc_feature (312)..(312): n is a, c, g, or t
aatcccgtgtctctttgcagccaggctatgtgcttctttggatgcccagagccaagggccgtctgcagtgagtagtagctggggcagtggctttganctngggccttaacacccccagcggatagtgcgcttggctgcaagactgganatcagttgccattgtctttggttctgtgacatttccacttgaaagggtgaaattccccttcccactccttagcgtctatgccaacttgtgatgtccccgcctgatctccagctcccagggtgccggggttgccatgtgaagagatgcccatntggtagaacctnagaggtgtagtttgaaagtgacccctgtgacgatgacttttctttgcttc

SEQ ID NO: 2954 - DNA, 479 bp, Mus musculus
  misc_feature (451)..(451): n is a, c, g, or t
gttagatctatgtaccctcattaggtggactagagctttgccctaatcagcctcgaccctgggcacttgaataaatctccccatggccctggcttcgtttctccatcacagacacccatcacatatggtaccccacttgaattaagttctgagatccaggtggccagagctgctatgattcctctgcctccatgctgctatgatccggacctctcggcatggaaacccgagtctgtctcccttcccaggctggggaactgcgccctcccctcctgccacagacagacctgccaaacagctctgttcttcatggagtcaggaggtcctgctggcctgcagcaactcagttgccttgggctgggactgcattcttgtgatgtctggatgggtttggggctggaggtcaggtactctgggattagctgaagggggcacagtgttctttgtcctncccctccggttaactgtgctccatattt

SEQ ID NO: 2955 - DNA, 529 bp, Mus musculus
  misc_feature (35)..(35): n is a, c, g, or t
  misc_feature (79)..(79): n is a, c, g, or t
  misc_feature (104)..(104): n is a, c, g, or t
  misc_feature (457)..(457): n is a, c, g, or t
atatagtctatgcttgctctgcttcacaaattaantctgtgcagtcaacatgatgactcagcaggtaagagcttgaagntcaactccatgagttcgattcctgnaatctcacatatggaaggagggaactgcaaaactacaagatcatctttaatcctttaatctttacttatgcaccccaccactacacacacttacaaaagaattttaaagaagggcacagaaataatgtgaactaattttactatacactctctatatacacatgctatgtagaatagtatgcataaactaaggagcacaacatttttatgtagaataatcatttataaatataacaaaaataatgttttgttgaactaagaagaaagccaagtgcctactccttgactgcagatgcaatttacccagctgcctcctgcccagaccaacacaccttctcaaccaccttagactntcctctcaaaccctgacccaaaagaaacccttccctttctaaactgttgtttcaggtattttgtggcagcaa

SEQ ID NO: 2956 - DNA, 593 bp, Mus musculus
  misc_feature (77)..(77): n is a, c, g, or t
  misc_feature (89)..(89): n is a, c, g, or t
  misc_feature (96)..(96): n is a, c, g, or t
  misc_feature (158)..(158): n is a, c, g, or t
  misc_feature (197)..(197): n is a, c, g, or t
  misc_feature (202)..(202): n is a, c, g, or t
  misc_feature (217)..(217): n is a, c, g, or t
  misc_feature (240)..(240): n is a, c, g, or t
  misc_feature (258)..(258): n is a, c, g, or t
  misc_feature (263)..(263): n is a, c, g, or t
  misc_feature (275)..(275): n is a, c, g, or t
  misc_feature (301)..(301): n is a, c, g, or t
  misc_feature (311)..(311): n is a, c, g, or t
  misc_feature (331)..(331): n is a, c, g, or t
  misc_feature (350)..(350): n is a, c, g, or t
  misc_feature (358)..(358): n is a, c, g, or t
  misc_feature (360)..(360): n is a, c, g, or t
  misc_feature (422)..(423): n is a, c, g, or t
  misc_feature (427)..(427): n is a, c, g, or t
  misc_feature (471)..(471): n is a, c, g, or t
actcctgtctgcaagtataacagagtatcattaatagtgttagggattggtacttgcccatggaatgaatctcaagntgggtcagttanttggtanggctattccaaaaataccttattttgctttcaccttttctgatatgatttaataagaattgnctggtgaggagatatgcattctgaggatttaaagtaggntctgnatgatttttctatanaaactgagatttctgtttctttnaagattcttataagaaantattngatcttttcttngtaaccgcaaatcactgcctgccagntaagagaaanctggctgagaaaactgtctngcttacttacactttgttnatctatancnagttgcttagttacaaatgtatgtaggttcttaggaataattttttttaacctgtgctaccnnaacnttatttcttgtaaaggtgttggggaacacactgtttcttcatantcatttcctggaagaaaactagatcataatcacactgtaattttatactgcttgaaaggttttgctgggatatatatgccatacaataaggaataaagttgttggaacattgttccttccat

SEQ ID NO: 2957 - DNA, 420 bp, Mus musculus
  misc_feature (316)..(316): n is a, c, g, or t
gcaaagttacgtggcatgagactaatgataagctgttgactctcttttataaatagtaccctcaaaaatgtgattagaagactactaagcctatacttggagatataatctgctgacttactgcattttagctgcctgcttattcctggagatgaaaatgaaattttgttggttgatatttttgggtaccatcaagtcgtgttagtatggtttgaacactgaagtgatctttaactagactgttggtttctatgatggttggatggaagtaaataaatgtatgaatgttgatggatccatgtatgtaaattagagntcctcctctagattctgtgtgcttttgttataaatatagaactgacagggacaataatttatgattattaataactaacagttattgggcatttactgtatacc

SEQ ID NO: 2958 - DNA, 242 bp, Mus musculus
  misc_feature (26)..(26): n is a, c, g, or t
  misc_feature (56)..(56): n is a, c, g, or t
aggtcccttttcgagctgcttgaacnctacctagtatgtctcttctcggcttccanaaaatgcaaaggaaagaatccacttgcatcctgggtcctttaaccttttaaccgatcctcacattggatggctattaatcactttttaaaaaattgtctccaaggtcccttgaggcaacgtatatagctgtttgcaaccattgcacaccaaagccccacggggaaaggaacttggccagcttaatc

SEQ ID NO: 2959 - DNA, 537 bp, Mus musculus
  misc_feature (240)..(240): n is a, c, g, or t
  misc_feature (413)..(413): n is a, c, g, or t
atctattacatctcaggctctgcaagtggtctgacagtatctttgccaagcagcttggttcaaaagaccatattattaataggatcaaggtgggccctctggtgttcacagaggaggaaacagtgtctttcatatcacatactgcttcggaaccctaaggaagaaactgatgcgtgcgccattgctctgatacttaagtgctaaccaagaaactgtcaaagcaaataccaaaagcatttngcaccctcacgccccacacatgcttccaaacttgtttgattatgaggttgttgaaagaaaatgttttttgaattttaacattttccactatcatgaaatgcttcttttatatgttaggtcatattcatgattttcttatttcttcaattatgttctaatgaattgtgtgcatnccaacttacccaaggaaaaagatgcagtttgctctggactgttaatctgttagagaggttttggctcctttgcaatcatggtgcaatatagcatgatatccatttgttttcagtccacagtttt

SEQ ID NO: 2960 - DNA, 503 bp, Mus musculus
  misc_feature (429)..(429): n is a, c, g, or t
gtgccctttagatcttgacctggaaacctcaggtttgtggactgcgcagctgagtggcattttgtgcttcctgaagctcccctttgctaggtacattaccttagtgcttcagacgtcagcctgaggccttgctacctccatttgctgcccagggaagagtttgtgctggagctgggtggagctctggccctcctcacgtgatggtctgagtctgcattttaagggacatgatcccagaaatgtacacacttatctagttttaaaggagaactgtggatctctcaggccaggattttgtgactgatttttaattacttggttaatacctagagcccattataaaaaaacaagattaatgagaactggcaagatttgatgtttttggcctaattccaaagcatggatgctttggaaggtaggaagaaaccntgttcttatgatttgtagctaccttctgcgcctgacttggtgccgtgtgagagttaagcccttagtctgctctt

SEQ ID NO: 2961 - DNA, 484 bp, Mus musculus
  misc_feature (423)..(423): n is a, c, g, or t
  misc_feature (440)..(440): n is a, c, g, or t
  misc_feature (442)..(442): n is a, c, g, or t
  misc_feature (459)..(459): n is a, c, g, or t
gatacacatgtctagattgttctaaaacccaggattatccagtggataaataagagttgattagactcttgttgactcaagggggcaggggtagaaataaaacaggtctacagttttcttgacgaaaatacattatatactttgccattcctggcttttaaaagtgggtttcaaagtacccagcataaatgcagcagaggtggctgaacttgacttcttccataagttttaaaaaaatctcaaaaatccttttagtagaattcagtgctgttgtcactgcaataagtgggttttagacaataaatgtgaaaaaatcaggtgttcataaaatactaaggataatgcattagaagctattttactacataggtaaagaaaagattaactgtaacaacgatcacaactgcatgttggattagattntcttatattccagaacnanatgtactgtatactttncctcaatttgttgtacactgtaatg

SEQ ID NO: 2962 - DNA, 359 bp, Mus musculus
  misc_feature (312)..(312): n is a, c, g, or t
gtgtccagctgtgaacttccagttctcataactccttttcctaaaggtgatattccctccaaagataacaatacataaacaatgcatgttcattgttgggaatttaaaagtgtggaaaaacacataggtcagctgaaaccccttgccaccaccctttgacaactgtgtgctgccgtaagcgtgtcagcatggccaccctgccctgtattaggaagcatggctcctctctgccctctcttccctctctcctgttgggtaaatacaaggttgtaaggcactttgtcaggctgggctcagagggagccactaagnccgccgctgcagacaagaatgaaaacagttttcagtggctccttaag

SEQ ID NO: 2963 - DNA, 562 bp, Mus musculus
  misc_feature (397)..(397): n is a, c, g, or t
  misc_feature (419)..(419): n is a, c, g, or t
aaaatgactgtgcttgttcgtgacagatgcaaacaagaaaaaagaattgggaaaggtttttggccctgggaggtctcaaggggctggaatatgctgttggcctggctctctgcttggcccgctgggaagagaaaagggggagggatgatcgtaaatgaaagaaaaaaaagtctctgaagagtttgcaaattaagacaggaaacaggtgagtggtttgaattgggtgcagagtgggccggtccagaatgatgctgactgaagaggtattctttgataagatctgaagaaaagaagagggaaagggtttctggagagtgttcctcatcccagaaccagcgatttgagaggcgctggcgagggagaactctttcttgcctggcccgtggactggctgaanccgtgtggcatggaggaaagtntctgtcctatctgtgtttctctttgcatcccttcctgaaacctcattgttcattgtttgattcgcttttgtaaattccacctaacattgaaatatttttaatttctccttttaccttaaatcctcttgctaattttatctgtc

SEQ ID NO: 2964 - DNA, 392 bp, Mus musculus
  misc_feature (226)..(227): n is a, c, g, or t
  misc_feature (328)..(328): n is a, c, g, or t
  misc_feature (335)..(335): n is a, c, g, or t
  misc_feature (347)..(347): n is a, c, g, or t
  misc_feature (365)..(365): n is a, c, g, or t
ggcggaagcagaactctggaatcaagtcatcaacagtcactggaactccaagtctgccccaggccccaaggccatccagctgctaggatatacacatgacctgatagactttgggatgctgggtgggagtgtgggtgcccacccagtgccccctttgcactccactcaaatcacatacctccccccacgtcttgagagcgccctgcagaactagctcccccccccnnaaggcagggaggcggagggggaagtacccactcctgccccctggttctttatcttgggatggtggacctcccactcagttccctttgtcagagctggactntccccgnccaatcccaggncaagcagggcccattcancctgtatcctgaaccaacccatcagga

SEQ ID NO: 2965 - DNA, 468 bp, Mus musculus
ttattctctacccatgccaaaagacttctattttgcaatgattttctgagaggaataaacaaacaaatttacatttttgacagtttcccctagtcccatcctcatttgatataaggccagtaggtagagttctttttatccattcttgtattataccaaagaatgaatttattttcattaaaaagtataaataaatgaagttaagtatagccataatgaatgagtagacttaccattttacctataagatggaaaattcatccttgcaactaattcaccaggagccttgaattattttgtttactccaaaagccttgtcaaggaagtatcatttttgttctgacttatttagccacatttacatttacaaagtcctaaaacccattctccttcaaatgttaatataactggtttgatacaatctgtcagttcactgttttctgggtctctgtaagcaagcttgcaagt

SEQ ID NO: 2966 - DNA, 416 bp, Mus musculus
cactcgtcactgctctgagtttgaagcgtcatgtttgttttaaagcctgtttgtggttgctgttgaggctgacctccctttagtttagttacagctcctctgcttctcctgccttcccttctcaaacccttagctgagttttcttctgtgagactttctctgtggatgtacacagttccctacatcaccttggtagtaaccccttggcgtttccatggctgcagtgttcgccccatctgtggcttgtattttcactggattttgtcatataaatttgtaatttcttcatttcaatggtatgtaactaccttcctggtgggtttagtttctgcaatggttttggctgtggtgaagtcacatattcctgtatacattttagaatcctcttatcaagctcctaaagaccctttgtgagg

SEQ ID NO: 2967 - DNA, 557 bp, Mus musculus
  misc_feature (63)..(63): n is a, c, g, or t
  misc_feature (352)..(353): n is a, c, g, or t
  misc_feature (382)..(382): n is a, c, g, or t
  misc_feature (436)..(436): n is a, c, g, or t
  misc_feature (438)..(438): n is a, c, g, or t
tggcttctcaactgccttggataattggggaacaggtggttgccctctttacaaatcgttttngaaataccagcagaaagggctcccacaacacttgatgtcaccatcactcttgggaaattaagagagtggtcttcccggcctaggtgtagtaccgaggtaaacatccctgcttttcttttctcttctcaccaccttttcttggtgtggcttttggcaagatttcagctcaaagcctcactaatggattgatttgttgttgttgttgttcctgtgtctgtgtgtgtgtgcgcgcgtgcgtgcgtgtgttgggccaattttagatacctgagtgcacttttttttttttttnnagttagtcctagcttttaaagaaagaaanccaagagatctagttggtgtaaatgtggagacagggattctgttcgctgtcctntntcccctcccccaccccgcagacccccgaccccactggagtacactgcacaaattaaatgctagggagtttgaataaaagcagtttttctaacttgttgctcatctgttgtaactcaata

SEQ ID NO: 2968 - DNA, 420 bp, Mus musculus
gagctaccagtgagctacgtgtccagctcttaggttttacttataggagctgttttaaagttactatgtaagttgcagcggtatgaacgggtcctctggtgccctcagcctgcctcattagcaaaggctggagctgggtcttgccgttttaggatttgaccctcactgggttggggtattacatatattctgtaagccaggctaaaagtttagtttacagataaggcctcatctggttgtggtgattggagagcccatgtccacctccaggaccactccatgagtttgaagtacctggaaaccaaatcaagatggaagacagtgggatggtcaaggatgaggagtacagcttcacaagtgtgacagagctagcctgggccagcctttggtgactctagtctgggccaaccttttgtaaat

SEQ ID NO: 2969 - DNA, 509 bp, Mus musculus
  misc_feature (36)..(36): n is a, c, g, or t
  misc_feature (269)..(271): n is a, c, g, or t
  misc_feature (277)..(277): n is a, c, g, or t
  misc_feature (299)..(299): n is a, c, g, or t
  misc_feature (304)..(304): n is a, c, g, or t
  misc_feature (309)..(309): n is a, c, g, or t
  misc_feature (314)..(314): n is a, c, g, or t
  misc_feature (317)..(317): n is a, c, g, or t
  misc_feature (319)..(319): n is a, c, g, or t
  misc_feature (321)..(321): n is a, c, g, or t
  misc_feature (324)..(324): n is a, c, g, or t
  misc_feature (334)..(334): n is a, c, g, or t
  misc_feature (341)..(341): n is a, c, g, or t
  misc_feature (344)..(344): n is a, c, g, or t
  misc_feature (348)..(348): n is a, c, g, or t
  misc_feature (351)..(352): n is a, c, g, or t
  misc_feature (360)..(360): n is a, c, g, or t
  misc_feature (382)..(382): n is a, c, g, or t
  misc_feature (396)..(396): n is a, c, g, or t
  misc_feature (451)..(451): n is a, c, g, or t
  misc_feature (476)..(476): n is a, c, g, or t
gtaccacccgggtcagtgagatacttggcatggtcnatcaggatgctgacctagagaaatgtctctaggcttccatctggtttcaggttcccttcctagagctcagaagccctggtgaccccctcatgtatgtgaagaaatagtaggaaaatgaccagggtcttgaagctctggaaagcactccagccctgaggttcctcaaaactcactggcctgtgtctctggtcccccagagttcgctggatgaaggtcaaggtgagagccagggnnntgctanccaatcctggatagacccttgntcctntgctnctgangtntntnctntctcatggantaagagnccntctnccnntcagtgtntgtggggttcaggatggagatntgagagaaggggantcacagaaaaaggcgctcacagaacatggaagagagctggctagacccagatctnccttgttctagtacaggtatggtgncccctcaggggaccaacctgatctagttgtttg

SEQ ID NO: 2970 - DNA, 394 bp, Mus musculus
ggagctgatgctgtgttatttgattaagccctctaccatgactgctgaagacatggagaccccagaatgcatgaagaggattcaagttcaggaggtgattctcagccgatgggtttcttcccgagagagaagtgaccaagatgagctttgaccttccaatcccagagtccacagttcaccaacagctctgactgtgtgccatcggcctgccccgaaggagcaccggcacatttggggatgcacaggaccccgtggtctgttgctgtaatggaaaaatctactctgtagctcagcttacccaaggacttcaaccagttacccacgtgactggaaacccattgacggtttggaaaccttgaaatactgagtgacgggtgcattctcagtgaactca

SEQ ID NO: 2971 - DNA, 385 bp, Mus musculus
  misc_feature (33)..(33): n is a, c, g, or t
  misc_feature (227)..(227): n is a, c, g, or t
  misc_feature (241)..(241): n is a, c, g, or t
  misc_feature (245)..(245): n is a, c, g, or t
  misc_feature (266)..(266): n is a, c, g, or t
  misc_feature (309)..(309): n is a, c, g, or t
  misc_feature (318)..(318): n is a, c, g, or t
aaagctgattgctggctgagagcccaacacctnccagacggacttgatctgactgctcttaaagctgctgcccgggggctctttctgttactgcgacactgggaccagaatctgcagctacacttgctgtgttacagcccttcgaatgtgtaaggctgcttgcagctctggctagcgacccccaacacagtcactgccacccagggccagtctcttggtgctggganagaataagttggtntctnccgtcctccattgcttcacanacacacacacacacacccctcccaacattcttgtcaccacagnaagtgcctncctgtgctctcttctctctcctcccactccataccccctcctatgtgctctgagctctctataggat

SEQ ID NO: 2972 - DNA, 529 bp, Mus musculus
tccctttccacttttcatggattgaactcaggtatttaggcttttgtggcaacagctttacccactgaggcatcttgttggcccctgtatcccctcccccacccataaacagtatcataactgagaactatcatgaactcatgacccttctgtcaccagttctccaagtgttggtattataagtgtggactgtgcttgttgttgttttttgttctgtttttcaagacacagggtttcttgatgtagttctggctatccctgtaacttactacagtaagttagatcaagctggccttgaacacagagatctcccccatgagtgcttagattaaaggcatgtgccacctctggcctatcttcatgctcagttactgtggtgctaaacattatgccagggttttaagcacatttggacaaccaatttaccaactgagctacaccccccaaccctatgtttatgttttgtgatgaaaacattaaatttttttaaacattttacagatctatagtgcattgttcatctgtggca

SEQ ID NO: 2973 - DNA, 368 bp, Mus musculus
  misc_feature (275)..(275): n is a, c, g, or t
  misc_feature (324)..(324): n is a, c, g, or t
  misc_feature (332)..(333): n is a, c, g, or t
  misc_feature (339)..(339): n is a, c, g, or t
  misc_feature (342)..(342): n is a, c, g, or t
cctagctaaggactgcttccttggagctgattaaaccctccctcttctgctcccagcatctcacatacaagggtgctaggggctcagccatgtgatcattctccctcccgtgaaccccagagatggtccagcatccctccctccccatcctatgctggctgggatttggctcgggcctagccctggaaaaccctagctagccctggaaaggggcacctgaaaccttccaaggtttacctatttctcactgccttgggtttgtggggtggggggangtgctaaagaaatgggtatctagtgtctgggcagggtaagtgaacctgntcaggganngtgggnggnctacagcccctaagcttttcttctaa

SEQ ID NO: 2974 - DNA, 216 bp, Mus musculus
  misc_feature (52)..(52): n is a, c, g, or t
  misc_feature (54)..(54): n is a, c, g, or t
  misc_feature (68)..(69): n is a, c, g, or t
  misc_feature (72)..(79): n is a, c, g, or t
  misc_feature (81)..(81): n is a, c, g, or t
  misc_feature (84)..(84): n is a, c, g, or t
tccacactggcctggtagactcaggcagctaccctctcccctattcacttananagagtgacctatgnnacnnnnnnnncntgnttccagacagctctggttggaaacagttggccatgtgccttgtcctctggtccctcccttggagacgcagggttgtctccttgctctgtggccgggtgcttttcactctttgagacgcaaaagctggctttt

SEQ ID NO: 2975 - DNA, 528 bp, Mus musculus
  misc_feature (285)..(285): n is a, c, g, or t
  misc_feature (341)..(342): n is a, c, g, or t
  misc_feature (357)..(357): n is a, c, g, or t
  misc_feature (383)..(383): n is a, c, g, or t
  misc_feature (387)..(391): n is a, c, g, or t
  misc_feature (418)..(418): n is a, c, g, or t
  misc_feature (439)..(439): n is a, c, g, or t
  misc_feature (448)..(448): n is a, c, g, or t
  misc_feature (461)..(461): n is a, c, g, or t
  misc_feature (466)..(466): n is a, c, g, or t
aatggtcacctcaggcaggctgggagggatgggtgggcagctctggctgtgagaagctggggtggagtcggtactattgtgtcctgggatcaaaggtgcaacatttacctccaacaagaagaaagactttgtggtctgaagcacatttcagatgatggctctggtggtcatgttaggagggatcctgaggtccctgctcttcaccatgcagagacttcggagccccacagcatcgcacatctgtacagtctggggattgtgctctaagagcgaatggcttccttnggcatgtttttagtgcttctcaactccagggaatcctttatgaattttgaacattnnttcccaaatttgctnaacaaagtaatatccttaaaagcacnaacnnnnnctttggaggctctgaagaaaccccacntgcggaggaacgagcccgagncccctgacnttctgagcatgcnccctnccaatgagctgcattggctttttatttagaggctggatctcactaagttacccaggatggct

SEQ ID NO: 2976 - DNA, 398 bp, Mus musculus
  misc_feature (107)..(107): n is a, c, g, or t
  misc_feature (342)..(342): n is a, c, g, or t
gaatgtcttcattggtagtgtataaacccatggattgaatatttaagatgaagcatagataaaagcaagctatgttcacggcagacagaattacgttcaggaaacantggttatcctcagattttcatcgatcaaggaaaaggcatcgctctctgtagcggaagtgtctggtcaccatgttactgaagaacagacaccgtccatactttgtgcatcatagagtgttcctccatacttgattccataaatactgacatgctagcaaggcttgtctgagtggtgggcaaaacaactcaaacctgcctctgcagaggtgcacaggtatttattccctgcaagggntccatttcccaagtgtgaccacttcaattgtaaaccgaggcctgatgtgaactatt

SEQ ID NO: 2977 - DNA, 523 bp, Mus musculus
  misc_feature (299)..(299): n is a, c, g, or t
  misc_feature (325)..(325): n is a, c, g, or t
  misc_feature (329)..(329): n is a, c, g, or t
  misc_feature (346)..(346): n is a, c, g, or t
  misc_feature (348)..(348): n is a, c, g, or t
  misc_feature (359)..(359): n is a, c, g, or t
  misc_feature (410)..(410): n is a, c, g, or t
  misc_feature (434)..(434): n is a, c, g, or t
  misc_feature (441)..(441): n is a, c, g, or t
  misc_feature (480)..(480): n is a, c, g, or t
  misc_feature (492)..(492): n is a, c, g, or t
  misc_feature (498)..(498): n is a, c, g, or t
agggcctctggtaaagcccaggctactactgtactctggcatggctctgccaaccttgtacgggattggggtagggagagtacctggagctgtgctggcctccctctggtttgtcgtccagaatctgccccgggagccttggctcacccatgcccagccagggttctgtgtgactggagtggaatctgtggggagcagagtggctggctggctctgggcagggcagcaatttctgaatgccctgcttccccgtggtacagagtatgcttttaaaagtgctggttccttcaaatattttnatgcagagaaggagagaaaatttatngtgncaattattccctcacantntggtgagcaancaattagaaggaagggggcttagcggagccacggcgtgaggtagagcagcncaacctcacttcccaggagcacgncccccantcccggcaacgctggctcctgcgcaggaaaattaatctnccggcatttaancctagncccctctggtggatataatcgctca

SEQ ID NO: 2978 - DNA, 362 bp, Mus musculus
  misc_feature (139)..(139): n is a, c, g, or t
  misc_feature (149)..(149): n is a, c, g, or t
  misc_feature (151)..(151): n is a, c, g, or t
  misc_feature (161)..(161): n is a, c, g, or t
  misc_feature (166)..(166): n is a, c, g, or t
  misc_feature (175)..(175): n is a, c, g, or t
  misc_feature (213)..(213): n is a, c, g, or t
  misc_feature (215)..(215): n is a, c, g, or t
  misc_feature (225)..(225): n is a, c, g, or t
  misc_feature (230)..(230): n is a, c, g, or t
  misc_feature (311)..(311): n is a, c, g, or t
gacccctttagccacacttaaatgaagcctaaagcattcagtggacattaagactgtcctgtagatcatagaaacataatgttaaaggtcacatcacctctggcctctagaatatcaaacaattttcttcactgtgatncaaagactcnanacacatgtancaaantctcacttncatacaggactcaaaatatccctgcagcacatattccnanccatttcctnatatncaaacaggtttttaaaaacaggaagacattggcactattcctattttctgcagatgctaatagcattttattcctgtgcancagttccaatttaaatgtgtcactatagcatgttcctatagttatttgtat

SEQ ID NO: 2979 - DNA, 434 bp, Mus musculus
aagttctactgcacctatcttgggaagcagggataccctcttctttaggactagagctgccattcttttcatctttagcacaaggaaggtatttaagtgagccagagacaaacagagccattttagtcttcatagttatctgctaagagagataatgagctgactgtctattttaaactcgaaggtaaaaaaatgtatattatattttttcactataggtacatgtaacagtaaaacgtgtaacagcaaagtatatatttgatgttttctgtctttcatgatattgtgctaacaagttgtgctaatatttaactcagccagagtttcactcatttgctaagcattgggaacattctgtgtatttaccttaaacataaataaattcctgagagtgtcctatatttggattgtgatttgtagactcatgctaactt

SEQ ID NO: 2980 - DNA, 477 bp, Mus musculus
gaaacaccgtcttcagtgttgcctactgtgttatcttcaatacttgaactctgtgtctgctgctactgccgccgctgctgctgctgctgctactgtaaattgcaactggcattcatcagtgaatgtgcattggaccctcttccagtcccttctttccctacggggacacctacagtatgagcttctgtgtctgcactgaatcctgccttagagatatgcctttgacgaaactttaaatatttttcatgtatttttacctatagaatactcatgactccagtaagaagcactttgatttatggttatgaactgtacaggtaacacctcactgtgctatttgcctagcgtgttgatataatcctttatgatatcccatctgtgcagagacaaatgtcatttgtcggtttgtcaatgctgactagattggtgacgtatttgtgtatcactgaagagcgcacctcttctgcagtgttaaga

SEQ ID NO: 2981 - DNA, 391 bp, Mus musculus
  misc_feature (59)..(61): n is a, c, g, or t
  misc_feature (64)..(64): n is a, c, g, or t
  misc_feature (70)..(70): n is a, c, g, or t
  misc_feature (77)..(77): n is a, c, g, or t
  misc_feature (92)..(92): n is a, c, g, or t
  misc_feature (113)..(113): n is a, c, g, or t
  misc_feature (132)..(132): n is a, c, g, or t
  misc_feature (276)..(276): n is a, c, g, or t
  misc_feature (285)..(285): n is a, c, g, or t
  misc_feature (354)..(354): n is a, c, g, or t
ttgtccagactgtgcctccgtgggcgccaagctcctggtgatttctggtggctagagannnttnttttgngtttttntttgtttgtttgttnggggggttgttgttgcttttnttttttgttttgttttgtntttcggttctaggctcctcctgacttttgtcatccagtgagctgggagaactgagggctcctctggaggttcccctcgcaagaggcaacaggtgaagctccccccccaccggaggcagggaaccaggcacccaaacacacgatncaaaaaacncaaacccacaggcgacacaccccacacacgcaattttaccttcctcttgtagcgaagatgaaactcctntcggacacccgaagtgcattgcgtgtttctgttgagt

SEQ ID NO: 2982 - DNA, 528 bp, Mus musculus
gaatgcctcggtgcctaggaaccaagccaaggaaagtgagcggttttagagactgccttctcaacacccgtggtattaaatgcccaccacgaatgatttactagagaattgagaatcaacatgattaatcaaagcagtgttctgggcttttgagtagcccagggggtcagtgtgggagtatttcccctcctcccttgtcctgggagtccagagcccgccatacagtgtctatctgtgctgagataaaaatgactaccttcctccctgagggatgctctcattgcacagctgaaaccaagtgccactccttgcccctacccccagattgccctggagtgccctgctccctctgttacctcttttccagagcctgtgctcacttcctaaggacaggaaagtactcccactccataccatagaaagaggaaattttcccttcctttctttgtagacacaaagaaaaatgtcaaataaaaagtgcatttcttcatctatattccccagccaagaactcccttcacaaagtag

SEQ ID NO: 2983 - DNA, 492 bp, Mus musculus
ggacttcccacaataaatcccagaagctaaagtgttcctccattttacacttgaaacaatctgcccaatgtatagccgtgtttcatcttgtaaacaataacttgccattgctaccctgaaggtggtatggctgtaactggctggtgtgttgatggatcaaactatggaagttttagtggtgcccaagcatgctcctgcactgatgcatttggaagagctgtagaaataatgcaaagctttagttctaagaatctactcatgctttaaagtatttatctctgtagaaccacaatcatggaaagctcaacagtgctgctaatcatgtttgtaaaatatacctttaatgtagtgcaatatttttctattgggagagacagtacaggcatcacagttgggagctccaataccctcaagcatagtaagggataaggcttcaatttaagagattgtgttatattacattactcatgtaatcttgctgccatgctatgt

SEQ ID NO: 2984 - DNA, 475 bp, Mus musculus
  misc_feature (295)..(295): n is a, c, g, or t
aactgtaatacttagcctccctgatcagtaatttaaaattacagaaattgtcatagtaaaaatcagtcttggtcagttcagataatttgtgcatctgataaatgctgtaatggagattatattttgtcttctattcattgatttacactacgatgcatgtggtttgctaaacttaagaaataataatcaatttttaccaattttaaggttagagataaaattgtgcatatatgctacttgacactctgagatgtatcttgtggcctgattgtcaatgtcatatacacttcacctnccttctttccctctaggaagtagttgttgaattgcatctcttctttcttgaaacctggattaaatcacttgattcatcctaaactattgtgaagccacagtacctcattttaactgtgaaaaaaaaaagtgttaatagatttgaccatatgatgtgtttccttgtgtttgacttgagcca

SEQ ID NO: 2985 - DNA, 451 bp, Mus musculus
tactgggaattgtcccatgcttccacttagcgtttgtgatactgtttatggaattactaatatcttagacttctaaaggacttgtggaagtctgtcattctaaatgacagtttgtcttcagtgattttttttttactgcagtttgatcagctcactttaaaacacaaaacagcaacttgaagatggaaaatacaaatggtttaaattttgttgttgccatagaaaatagggacagtcttagatttctcagtgaagcaccctgtgtatcattacatgtccagtgattattttgttaaaggcaaaggggtcatgtgatgtactaaatgtaatttgctgtttctcaatgtttaaatcatgccaaacaaatcagcccgtgccatctagcctgtggtgttaatcttctactgaggacttgggttggggttaagggcttgtactatgcactttttat

SEQ ID NO: 2986 - DNA, 562 bp, Mus musculus
  misc_feature (359)..(359): n is a, c, g, or t
  misc_feature (394)..(394): n is a, c, g, or t
  misc_feature (498)..(498): n is a, c, g, or t
gaggaccactgctctagagactgttgggcttctagctgggttttgtggctgctcgtaggttccgggtcgcatgatctaacagtcaactcctcactttggatgtcctttctgatccagaagacatcagaggccatacttagtgaattgaactaggtatcatgtaagaagtggcggagaaagcctagagtctcagtgaatgtgtattgttgacatcagataaagacatgttgtcacagacctcagaatctcagacctatggagaaaatggcaatgtctcctctaaggggagaggctcagaggaaaatggcaaagccttcctctggaccaaatgtagatattgagagtgtgcacaggaaatntccactgtagctttctctccctggatatttatagntctgaagactgttcccctataaagaccattcctactaagattaggtaaacctgtctacttgatccagctgtataccatacaccctgtctcctttgtttatctgnacctactaaccccacttccttgttcagccatatgcactcaccctgcctctctgtttatataata

SEQ ID NO: 2987 - DNA, 373 bp, Mus musculus
  misc_feature (272)..(272): n is a, c, g, or t
  misc_feature (287)..(287): n is a, c, g, or t
  misc_feature (291)..(291): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (302)..(303): n is a, c, g, or t
  misc_feature (308)..(308): n is a, c, g, or t
  misc_feature (312)..(315): n is a, c, g, or t
  misc_feature (325)..(325): n is a, c, g, or t
  misc_feature (330)..(330): n is a, c, g, or t
  misc_feature (336)..(336): n is a, c, g, or t
ggagaacgagccatctgtggccatggtcactgcaggacttggcccacaaccagcacttctagaagatagcagggccttggataaccagaaagtctatgagcaacagatgccgtcctcaagatgacttgactctgaggtgggagatatgtatgagctaggcccacagctgccctgagccctgtgatctaaggagcaacatgccagcagaagtctcatggaacccagaagtgtgatgaagcaacatggacccaaagtgcccgggggcctctcanagcctcattccttcntctnccnttngcncnnggttncccnnnngttctggtgncccancaactncagggatccataaatccagaggccaggattcaggctc

SEQ ID NO: 2988 - DNA, 308 bp, Mus musculus
  misc_feature (217)..(217): n is a, c, g, or t
aaacagttgttttccgatctctgccttcctccttccaagctggatttacacgagaagatctctttgtttactcggtcacacatgactgtcccacttgcaaagagatggagatgtctgcggtccacgcagtgctaggacgaacatgtgtcttccagttctcctcctttcaatgtatgttatcaaaataggggaaaaaaatcatgtgttttagaaaagncaaaagataaactttaaatgtattaaagatatttatgagatccttgctaatggtgtctatggagattttgttatgttctctcacttctcag

SEQ ID NO: 2989 - DNA, 358 bp, Mus musculus
  misc_feature (92)..(92): n is a, c, g, or t
  misc_feature (236)..(236): n is a, c, g, or t
  misc_feature (241)..(241): n is a, c, g, or t
  misc_feature (249)..(250): n is a, c, g, or t
  misc_feature (275)..(275): n is a, c, g, or t
  misc_feature (279)..(279): n is a, c, g, or t
  misc_feature (312)..(312): n is a, c, g, or t
taagttcctctctgagatcgaaagtgatagcctggccctgcgtcaggtccgagccatcctggaagatctggggctgactctgacatctgatnacgccttgatggtcctggaagtgtgccaggctgtgtctcgcagggctgcccaactctgtggggcaggtgtggctgccgtggtggagaagattcgggagaaccggggcctgcaggagctgacagtgtctgtgggagtagatgggncactntacaagcnnacatcctcacttctccaagctggtntcgncaacagtccggaagctagcccctcagtgcaccntcacctttttgcagtcggaggatgggtctggcaaaggcgcagcttt

SEQ ID NO: 2990 - DNA, 546 bp, Mus musculus
  misc_feature (281)..(281): n is a, c, g, or t
  misc_feature (308)..(308): n is a, c, g, or t
  misc_feature (317)..(317): n is a, c, g, or t
  misc_feature (335)..(335): n is a, c, g, or t
  misc_feature (338)..(339): n is a, c, g, or t
  misc_feature (385)..(385): n is a, c, g, or t
  misc_feature (424)..(424): n is a, c, g, or t
  misc_feature (515)..(515): n is a, c, g, or t
agaaaactcccagcagcactttagacagggcttgagtgcggtcaactacaggtccaaagacaactgcagacttcttcagcattctgtcccctctagagggtggagaaaggggaccaacccagtcagcaggttcccacagcacagggtgcacaccactctgacttgactctttgtcagtgataactgcaatccccagccaggcttctggggctttaattagcctttatgtagtcagctgtctgccttgattattagaggtgctggttctcttattagccccntactttatgggccactgaggatttttnttgtaaggncattgaatcttcaaatgnttnngagacagaacctgaaagcagagcccaaacatggctccaccattttntagctgattaggattaatgcctggggaacataagctcgntccgctccttccgttgtaaagctgctaataaaagcagctaccgattacggttatgcgtattaaatgagataatgtatgtaaagtgattagntctgtctggcacgtaataaacactcagtccc

SEQ ID NO: 2991 - DNA, 489 bp, Mus musculus
  misc_feature (44)..(45): n is a, c, g, or t
  misc_feature (196)..(196): n is a, c, g, or t
  misc_feature (199)..(199): n is a, c, g, or t
  misc_feature (224)..(224): n is a, c, g, or t
  misc_feature (271)..(288): n is a, c, g, or t
  misc_feature (297)..(297): n is a, c, g, or t
  misc_feature (300)..(300): n is a, c, g, or t
  misc_feature (332)..(332): n is a, c, g, or t
  misc_feature (335)..(335): n is a, c, g, or t
  misc_feature (432)..(432): n is a, c, g, or t
gccttagttcacagatccttcagtagcccaggtactcactaaanntcgagcttctgtgaactgtgtctgtcctcgcttgttggaaggcttttgcttctggctatacactgctagcattaacccagcccctgctgaataccattgaaattgacctctcagctcagtattgcccctgctggtcatttgctccatcccncantggaactcttcaaccctgttgcccnctcctaatgtgtgtgtgtgtgtgtgtgtgtgtgtgtgtgtgtgtgtnnnnnnnnnnnnnnnnnntttccgtgngcncttgtactaatggaacttctactttggagccnttntgagggattttgtttttctgttgtgggtagttggttgagtgtggaggcatgtattagcttcatatgctatatagaatctcttatttttgaacaaatnttatgatcataccctctctggctttcatttatgtccgtcatgtttgctttttgtgat

SEQ ID NO: 2992 - DNA, 389 bp, Mus musculus
  misc_feature (87)..(87): n is a, c, g, or t
  misc_feature (309)..(309): n is a, c, g, or t
cgcttcaggctgcatgactatgttaagagggagggccgaggggtctcctgctgtcgactctgaaccttgctgaaactcagttccacnctggaggaagcagttctgcctttgagaattgcccgagtctatagacttgtcctcaaaggatggatgccctagtgtcttctcaaagacaccagaggctaatgcttaccctttgccccagtggccaccagaaatggtcttgaagcataaaaaccaggccacagcacattgctgccctcttctgggcactcccagaagtgaggagggggaccacacgcagcacantgctcagacaggaccccactcaaggctatgtcagtcactgtccatttgttggactgcttccgactcactaggaggctgat

SEQ ID NO: 2993 - DNA, 535 bp, Mus musculus
  misc_feature (81)..(81): n is a, c, g, or t
  misc_feature (220)..(220): n is a, c, g, or t
  misc_feature (239)..(239): n is a, c, g, or t
  misc_feature (403)..(403): n is a, c, g, or t
  misc_feature (436)..(436): n is a, c, g, or t
cccctagtaagctgatccagtgtgtacagcctgacccccaggcagctatgtgtatactggagaatggctgtgcagctcagngcccacgtccttctgtcttctcctcctggtggggctgctgccatctgcctgcattagacacagtcccttccatccatctgctttctgcgggtatcatgtaattcacaaggttatttccttccccatttagattatgtgncccatttttggtttagagnatgtatttacttaattgagatttgtatactgaagtgtggttagcccttgctccagcccaaattcaagcaatgacctttggattcttttgctaattctgacttccagggccctgagttttctggaaatcagggtagtaaaaaaatgtctttaataagcactccantctttttttgtttgcatttagaatgtgcacatncaaaggattttgtaccaaacttgggatcatttaccttcttcttctttaatattggtgttaaacaacattcttaaagcaacgcactttgaaacatagcaa

SEQ ID NO: 2994 - DNA, 541 bp, Mus musculus
  misc_feature (268)..(268): n is a, c, g, or t
  misc_feature (282)..(282): n is a, c, g, or t
  misc_feature (299)..(299): n is a, c, g, or t
  misc_feature (305)..(305): n is a, c, g, or t
  misc_feature (312)..(312): n is a, c, g, or t
  misc_feature (343)..(343): n is a, c, g, or t
  misc_feature (347)..(347): n is a, c, g, or t
  misc_feature (367)..(367): n is a, c, g, or t
  misc_feature (393)..(393): n is a, c, g, or t
  misc_feature (396)..(396): n is a, c, g, or t
  misc_feature (404)..(404): n is a, c, g, or t
  misc_feature (491)..(491): n is a, c, g, or t
atccctgtagccgagttattactaatataaatcatccaaactgtaaattttgtagcttaccatttttaaatattgggtatcattaaaatgaaattttataaagcaatggttagttttatgaattactgtttttgtcctgtctctactttttttggtgtctacttttttcaagtagcctttagctcttattatatttttgagttagcatattagggaatggatttcatggtgatattttcatatgcatatatcatcatacttggttctnatttactccccacnaccttggctaccatccnattccngttggtnccttccttctaaattctctcttttgcactcntganacaaatgtttattacatctngtatttgattacctcccttatacttngtntacatccngtttacattttttcttcccctctctacttttatgttttgcatatatattgtgtattataaatatttgattgaaaaatgtgatatttntctggcttattttgcttaacacactgatcttcagttccaaaaaacattat

SEQ ID NO: 2995 - DNA, 564 bp, Mus musculus
  misc_feature (150)..(150): n is a, c, g, or t
  misc_feature (274)..(274): n is a, c, g, or t
  misc_feature (280)..(280): n is a, c, g, or t
  misc_feature (302)..(302): n is a, c, g, or t
  misc_feature (349)..(349): n is a, c, g, or t
  misc_feature (354)..(354): n is a, c, g, or t
  misc_feature (356)..(356): n is a, c, g, or t
  misc_feature (358)..(359): n is a, c, g, or t
  misc_feature (369)..(369): n is a, c, g, or t
  misc_feature (410)..(410): n is a, c, g, or t
  misc_feature (415)..(415): n is a, c, g, or t
  misc_feature (423)..(423): n is a, c, g, or t
  misc_feature (438)..(438): n is a, c, g, or t
  misc_feature (486)..(486): n is a, c, g, or t
gtatggcaggcaatattatcaaggggagaggtaatagtctctttagagtagaaagtgtaattgtgactggtgattacaggaacagcatttcccagagaaacttttggactattttctattttcttcataatcctagtatttggtgttttnactacaagcacaaacatctggaagtatattgattcctgtgaatatttaaactctagacttttagatacttacataatgccccacccaataaacatgcttcaaattttcctctcccaaataattnagagcnaaaactgatttgtacataattntactgcttctgtttttttacacttctgtccctgtttatggtgatgcncagancntnnttagactacnaaagcagatcagcactagaagatgtgagcatatttaatttntaatncaaacctnccatgtaggagtagnaaatgtatgataaaactcaagtattacatgcagatcattttacttttntactttgctttaatgcaatattgtttatttactccatgtgttgtattcagagaaactcctgtattgtttcctactttg

SEQ ID NO: 2996 - DNA, 231 bp, Mus musculus
  misc_feature (123)..(123): n is a, c, g, or t
  misc_feature (126)..(126): n is a, c, g, or t
caagctcggcccacgtttgaggaaggggaagcgagggggcgagagggaaggcgggatgggtggctgaggatcaggtagcgctggagcttggcaccaaagtttctcatgattgcatatggaggnccncttgtgatccaccctcggaagactcgccagaaagtagcagttcctgctacacactacagtgccttccaacgacgttctgtgtgaactgcatgcagtttcgtgtaa

SEQ ID NO: 2997 - DNA, 245 bp, Mus musculus
  misc_feature (131)..(131): n is a, c, g, or t
  misc_feature (135)..(135): n is a, c, g, or t
  misc_feature (138)..(138): n is a, c, g, or t
  misc_feature (159)..(159): n is a, c, g, or t
gtagctggtaagaatgtggccctgttggcttataaccgctggtaccaggacctggataagattgaccagaaggacctaatccataaggtcaagactgaactgtgagggctcccaggagagcccagggactntgcnccncactgaagataactgagatgnagcgcactccagccgcgcaggactgacgaggccacacccatgggctctgtggctttctctgctctcatggattgaacagggtcccc

SEQ ID NO: 2998 - DNA, 543 bp, Mus musculus
  misc_feature (71)..(71): n is a, c, g, or t
  misc_feature (75)..(75): n is a, c, g, or t
  misc_feature (78)..(78): n is a, c, g, or t
  misc_feature (103)..(103): n is a, c, g, or t
  misc_feature (122)..(122): n is a, c, g, or t
  misc_feature (138)..(138): n is a, c, g, or t
  misc_feature (155)..(155): n is a, c, g, or t
  misc_feature (448)..(448): n is a, c, g, or t
  misc_feature (501)..(502): n is a, c, g, or t
tgacaaatgtcccttcttcagatgggcctatgcaggactctgcttctggaacagctatctgcaccatccantttncantgctaactttactccacccagcagntgagcaggagccaccactncaaccccctccagcanttttaaatgttcacccntgcagactaggaaactgaggctgtggtaccgcacaaaggccgacctttccttcttggaaatcaaggagggcagattctccctgaaaccatcaatttcaacccatttctgaggacccatgtgtgctcaagggtcaagaccagcccaaatgcaggagcctccaggtctcagatgctgctggaaccagcaagtacccttgcccacacactttcctgcctgccccatctatctcggctaattccacccctgagtctggaagctaaggggctgtgggctccagtcacaccttttgttntaaagtgtgcagccaaacacttatccagactcttctctgggctaggattgttnntgaggtccccagcagcagcctgcagcccaagttcaataaac

SEQ ID NO: 2999 - DNA, 507 bp, Mus musculus
  misc_feature (59)..(59): n is a, c, g, or t
  misc_feature (363)..(363): n is a, c, g, or t
  misc_feature (454)..(454): n is a, c, g, or t
tcacctttacgctgacagttttccagaccactggctcaaccatgctgtgcagagagagnccttgcgtttctccttgagattcttgtgtttaccagaaaggtatctcgcctgcatttgaacatggttgtatttgttcagcttccttctgctcctgcaggacttaagcatagtgtgtctgcagagcttgtagctgccatgactttgctgcctagtttggctcttctggtccttccctcgaataccgtcctcttcaaacactgctgccgttagaaatcctgtttccttgctgtctacttgtgtaacttttaattcagattctgatctcttaagttgaaagtctatttctatgaaagttgttttccntcatggaaactgcatcctgacacttgtcaataaaatgcatgagtacgtcagtcacaagtttaaataggccactgtgttgatggaatatttntcacctttagagctttcccagtgacagcattgcttacgctgtttcccagtcaa

SEQ ID NO: 3000 - DNA, 306 bp, Mus musculus
ggcagatcccgtggaacctcaagtacctgaaagtgagggaggtgaaatacgaggtgtggctgcaggagcaaggggagaacacgtatgtgccttacatgctgaccctgcagaaccacaccttcacagagaacatcaaaccttttaccacctacctggtgtgggtccgctgtatatttaacaggagcctcctgggaccttttgcagatgtgctggtgtgcagcacgtagccagcagaccatggccaggcctctggagggcacctctcgcagctcagctttcccaggtccacagttctgctagcagctg

SEQ ID NO: 3001 - DNA, 551 bp, Mus musculus
  misc_feature (40)..(40): n is a, c, g, or t
  misc_feature (397)..(397): n is a, c, g, or t
  misc_feature (412)..(412): n is a, c, g, or t
  misc_feature (425)..(425): n is a, c, g, or t
  misc_feature (450)..(450): n is a, c, g, or t
tgaagcctctgttcgtgtttatcacatagttatccacagntgcgttccttggtgacttattaaaagtcaggttaaaaactcaaacccataaatttccagtagctaatgctaggctagtgttcaaaagcactctaaaagacatttagtccatattttgggaaagaaactatttgcatgtttaattcatcttttaggctgctgttgagtatactgtaaagtgctgtgtgatatcaagccagtaaagtacttataaatggcactttaatattttcttttgagaaatcataaaacactgttgtaaatttcactattgaatattgactggtacatagaatcaaactctgtaattaaaaagtagcctgcagctaggatagaacatttttcttgttattagagnaaaaaaaaaagtttnccatgttcaggcntttttaaaaaaaaagtgtttctgtnccattgttcgtatctataaagaaaatacaatttctgtcaggcatctctgaaacctggctttttttatgtttggttcgtgtctgtggcaatccctataaagt

SEQ ID NO: 3002 - DNA, 556 bp, Mus musculus
  misc_feature (455)..(455): n is a, c, g, or t
  misc_feature (458)..(460): n is a, c, g, or t
  misc_feature (526)..(526): n is a, c, g, or t
actttgggctagttgggtgcatcttgcaggaatagaggaatctagcggtcctcaacacggtcctcaacacaagagaacacgtatgctaaaaatgttttttcaggtacatggttttcttgtcagagaagttgggggaaccatacttcacagtgcgaaataaattcatgaccaagctaaatgtcaaataggagaggagaaaacgcatacagagccctaacagagtgtctgtgagcttcatgttttccaaatgaactcgatcacagacatgtctgagtgaccctcctgacatttcagtgggctcttcattaccaccttggaatgacggtttgtaaatcagaagcactgagctctcgcctgcaaggctggcttacagtagaagcagtattggaatgttatgatttaatatgactgacagtctcccattgacagcagaaggccagcaggcatattgaaangtnnntccctccttttctgtaagaagcaagggctttgtcatgctgggctattcttggctgggctaccacanccttcagttgtttctctgctttccaaatta

SEQ ID NO: 3003 - DNA, 112 bp, Mus musculus
tgacctgagcctggactctcagagcagtgtggtgtccttgcccagaactccactgccccattgtcataaagcctcccacctgtgacctgaactctgggcgtttcttgctggg

SEQ ID NO: 3004 - DNA, 515 bp, Mus musculus
  misc_feature (141)..(141): n is a, c, g, or t
  misc_feature (278)..(278): n is a, c, g, or t
ttaaggactatcaactctccctggatattttgtcactcagaactctttcagaggtatttcttgaaggtgcttctaatgaaaacacatgggtattacgtgatctaaatgtccctcgaattcacttaacttttcttgtccttntttcccttcaaatatgttgtctatattttctcccctaatttggaaacaatgtgactgaaatttttcccaatctcaccttcctaaacacccacccgctcagcacttcacttccctgcctgtaatggttgaaaaacatntggccagttctggacctggggttggttccttgatgaagatgatgcctcaaaacagttctaaaaatgtttacattacaaggctaggttgggaatgtcacatataaaacctggatggtttgaaaatgctgccatgaacagttatgacttgcccacatgcactacagtaaacccacaatgtatctttcaccttttctacttgcacacattgacatatgtactttgtttaaccgcagtgta

SEQ ID NO: 3005 - DNA, 510 bp, Mus musculus
  misc_feature (66)..(66): n is a, c, g, or t
  misc_feature (126)..(126): n is a, c, g, or t
  misc_feature (139)..(139): n is a, c, g, or t
  misc_feature (178)..(178): n is a, c, g, or t
  misc_feature (184)..(184): n is a, c, g, or t
  misc_feature (263)..(263): n is a, c, g, or t
  misc_feature (304)..(304): n is a, c, g, or t
  misc_feature (348)..(348): n is a, c, g, or t
  misc_feature (381)..(382): n is a, c, g, or t
  misc_feature (407)..(407): n is a, c, g, or t
  misc_feature (419)..(419): n is a, c, g, or t
  misc_feature (421)..(421): n is a, c, g, or t
tggaacatcggagccagcttaccttgcccctgaattacaagagtcacctgcctccctgtgcccctntagtgtgaaatgctgggtgcttgaggcacctgcctctgtggaacccatactctttccccntcctgctgcatgnccgggactccctgccatgacctgaggcagactgaacttnaccccntcagagggtggggttgcagcaggtggggaaatcttgcagcctggggtgccctcctccaggtgagaacgagagtctctcnctcttctctaattccaagtttctctcggcttgagatgtccncagactttctttccaaggctggtgaacactgttcccactcccantccccagtgctagccaccattccccgagccccnntggctcttggacttcaatgactgantcagacctgatntntcagaggcttctagaaataggagaagggatctttttacgccagtgtgccctagagtgttttccataggtaataactaaggctcctctct

SEQ ID NO: 3006 - DNA, 472 bp, Mus musculus
gagtgtcctccgcagagggcaaatctctctgtaacgttcactctgtgccacccacgcctaccctgaagaaaaatgagccacaaagccgcctcagcggtctcggtctgcgcctagctatgcacataggtgtttgcagagctcttccatggacggccctcggagggggagaccctttctgaggactctgcactttctgagcagctgcgtgcagatgcctgctgccaccaggcctttaaatacattgtgttcaattccaggtgggaagatagcatttcaggtttgcagaaatcaagtcacatgactgtcttccttccacactttgaggataaggaggacagcttttttgtgtgtttcgttttgtttttaaagtaaggaaatacccccattgctgatgtctatagcaagtgattcgtttctctgttgcattttgtttttttaagcagtccccttccggtcaaggtcaggactggtc

SEQ ID NO: 3007 - DNA, 421 bp, Mus musculus
  misc_feature (291)..(294): n is a, c, g, or t
  misc_feature (318)..(318): n is a, c, g, or t
  misc_feature (392)..(392): n is a, c, g, or t
  misc_feature (394)..(394): n is a, c, g, or t
tggagaccatcacagaaatccacagctggacacaatgcagacatcaacagatcctgggtagccctaccccacaactacgtcacaactcctgcatttatggctctgcaaacatcacagagaggggctaggaagactgtaagaatgaaacaccagaagttggctgtgaaacagtctttcctagaaatgcctgcataagcaaaatttgaacaatggcagtatcagtagacttgttgatgtggaaaggaaaaacaacctcacaggggcacatctgtggataaggcaactgatgannnnctgggaatgggagagctaccctcnacctgggaggagctctctatttagttatccaatacaaacagtatcaatgaaactgtacataaacaaaaaatagnantggactcggtaggttgtatttgtgcat

SEQ ID NO: 3008 - DNA, 186 bp, Mus musculus
tatgacttttccaccttgcacttgcagactcccatggttcacagctgctctgtagtgagaagagccggcagcagtgatctgcatggattacccttactggatgtaaaacttgagggaaccacagttgaggaggctaagactgccaagtgtctcaaagacatatgctgtactctctgaaaattcaaa

SEQ ID NO: 3009 - DNA, 529 bp, Mus musculus
  misc_feature (330)..(330): n is a, c, g, or t
  misc_feature (344)..(344): n is a, c, g, or t
  misc_feature (363)..(364): n is a, c, g, or t
ggtgtgactagatacccactggattggaacttcccagcttcctcccagaaaacctggagacaaggccttgcttgaccatttaatttataatgacccttaacctgtgatgtcaccaagctgctttgactcaagtccaggaatgtgcacgggggatgcagatttgtttttagcaccgaggactagaactcttcggggagatgttcggggtacccagagacacttgtactgtgttgtggttagtgttctattttattttttttaagatgcttataactgaagatatcacactggtcggtactagacccctgatgagtacttgatctgagggtntcgtgggcgtactnccttttttttttttttttnnaaacctccagtattattatatgcattgtgtgtgtagtgggggtggggactccaggggacctgaacatccattatggctgtgcttgcaatttgtgttttgttttgtgttcctgtggctatgcactttgtaaaaacactgatgccactacaccctgcaagtgtgaaa

SEQ ID NO: 3010 - DNA, 419 bp, Mus musculus
  misc_feature (46)..(46): n is a, c, g, or t
  misc_feature (55)..(55): n is a, c, g, or t
  misc_feature (63)..(63): n is a, c, g, or t
  misc_feature (90)..(90): n is a, c, g, or t
  misc_feature (140)..(140): n is a, c, g, or t
aaccctcattagtctgttgctttgtgtggatttggcgtgcccatgncccacatgnaaagccanttccccacctttcccctccagggcatntcagccctgagaaagccctcacagtagatgatatttcacttccctttcanccaggggacttcgagccagaaagactggtttccagaatgctggctattacttcggggttgaggtttctgggtcggcccggccctcttttggctgggaggcagctttgggagcagtgtgctatgaactccatctgggagatacttgatcttgctggagcagagctttgcccttgcttcacttttctggagtgttgcaaggcttgtgattccatgtagagtagaatattctcggtagtttgaatgtgggttttgcattgtctgtgttcttgtcaccggatt

SEQ ID NO: 3011 - DNA, 451 bp, Mus musculus
  misc_feature (148)..(148): n is a, c, g, or t
ggtccttctagggtgtgcccctatgcccaggactgagccatcagggacataccccccacccccaaggctgcagccatactgtgttacaggcttggggctggggcaggcttggactcagccctagacacgaagggccagcccacccctnccctgcctgaccctagaagggtgggcatgatgcacgtccccttcactccatgccacatctggggggtctgagccaccccctccgttccagttcagattgacaccccacacacacactgtccccagacccgcagcacaagctctcccagccatgcgctggcctgtcctcccagggagctgggcgacttccatatgcaactagtagcgaacagccaggctcccatgaaccctctgcactccacgtgccattctcccatgacctttttgtacctaatgtatgaaagatccacactaatatcgctgt

SEQ ID NO: 3012 - DNA, 464 bp, Mus musculus
  misc_feature (305)..(305): n is a, c, g, or t
  misc_feature (373)..(373): n is a, c, g, or t
  misc_feature (391)..(391): n is a, c, g, or t
tattacattgctcttcctgaaactaatagcgttgggcttcttcattgcccagtaacatggcatatagttacactcatccaatagtttgaagtcatttttaccatgcaatacttagctgggttctcctgatgtcctccagtgtggctgtgctttctgctgagcatgctactcagatattgttaggtactgtcctctggagaactgtcatggtaggctttttttcttcttcttgtattcccttgctgtaataaagcacaaagcaagtaagaaatccatatttgagagtatctactgcctttattacnaactacatgagtcctagctgaagttcacttcaattttcttaaatcttgtttatttattgtcctaaggnaaacattccatttttaanccccacaggttcaataatgtgttgatttttgtttctgatagctgatctgaatactatccctcaatggcaagaa

SEQ ID NO: 3013 - DNA, 239 bp, Mus musculus
  misc_feature (32)..(32): n is a, c, g, or t
  misc_feature (165)..(165): n is a, c, g, or t
  misc_feature (168)..(168): n is a, c, g, or t
  misc_feature (207)..(207): n is a, c, g, or t
acacattttaccctgtgccttaatgttgaatntactgtttgcctcacactaagttactaccagaagccttagtcatgggtgtgaggtggaaggtttcattttgtgtcagagttgctgaatgttaatctatttcataaagagtcacactaatgatctagctgctgntancggccaggcttttccctcttgtcccctccacctcacatntatcagtttgccacagaaagatgagagatgcc

SEQ ID NO: 3014 - DNA, 549 bp, Mus musculus
  misc_feature (351)..(351): n is a, c, g, or t
  misc_feature (366)..(366): n is a, c, g, or t
  misc_feature (398)..(398): n is a, c, g, or t
  misc_feature (481)..(481): n is a, c, g, or t
  misc_feature (510)..(510): n is a, c, g, or t
  misc_feature (520)..(520): n is a, c, g, or t
gatgctgccggttaaaagtactccacagcacggctccagagctcagccttctctgccccacctcctcttatgccacgccccttgcctagcatctgttcccctcctccaattagccttacccaggcctcctgcctctccagaatgtcccttacctcctcatgcctcttagcaaatcccctgtggatctgctcctgagaaatctatacttcgtctgcaacttatgtcgaagcaggtgtcttgttcccagggagttcatgtttcccagttctttggctccagctgctccatcctaagatggggtttaagggtggggggaggggagacctgggtagcatgggattagtagaggcngtctaacggacaaanccccttctcacttctttaaggacaaccccttnccaagtctcccaccaatccacaattccctgtgaccccacagacctgcttaagttctggggaaccctcggaaagttggagcacnagagctgcgaaagttcagacgctgtagantcccagtgantcagttacttcagggcacagaactagcaa

SEQ ID NO: 3015 - DNA, 479 bp, Mus musculus
  misc_feature (92)..(92): n is a, c, g, or t
  misc_feature (134)..(134): n is a, c, g, or t
  misc_feature (228)..(228): n is a, c, g, or t
  misc_feature (391)..(391): n is a, c, g, or t
  misc_feature (405)..(405): n is a, c, g, or t
attacaaatatataggacatgccaaatatattagcccaacctcaatgctttgagcccatagatccatgcatggagataacttaatagaaaanttattgtcccaacattcataaggaaacattatttaaaatganaaaattattgtcagaatttaaataatattggaaccctattatcagagaattctcataaagaaactctagattgataatattctaaaacattttngcacaaaattcaacttaaatacttatttcaaaaataaaacatcaaaaattctttcaccttctattaattatctgacatcattaataattgtatagaattcatttttaaatcattaaacagtattctaaagtgaaaggattttaaccagaataatagtaataantatgctaatacaancatgttgcataatgtttatagtttagtatgggaggtaattagtatttatgagatatattctctttgaagactat

SEQ ID NO: 3016 - DNA, 570 bp, Mus musculus
  misc_feature (26)..(26): n is a, c, g, or t
  misc_feature (37)..(37): n is a, c, g, or t
  misc_feature (39)..(39): n is a, c, g, or t
  misc_feature (113)..(113): n is a, c, g, or t
tagctcatcactgtggttaaagcccnttatgaaatanangaagtgggtgctggctgggagggtgtgactggagactgggcagaaaagtcagcatcagattcttggggtgtttncctaaggattacatcatcttttcttgcttagcattttgattctgaaacaactttctgaggagatgtagttttgtgagttgtagttgtagtaacttctcagggaatggctaatgtttatcatctatgattgatatagtgagactttatgggaggaatgcttctcctgagggcactgagcaatgccttgtgacccctctttcatcaaggccatcagctcctgatttattttggtgagtcctttaaggccccccccattttgctgttgagtctggtaatcaacaccacttgttatctactggctcagctgtagcctgatcaatcctatgccaagtatttggagaaagcactgaaaatggtagataagcctccctgactttagctgccttaatatctgcagggtatatgagcttctccaagtagtctgtctcaagggtacttaagcagcagagacccctga

SEQ ID NO: 3017 - DNA, 543 bp, Mus musculus
  misc_feature (229)..(229): n is a, c, g, or t
  misc_feature (318)..(318): n is a, c, g, or t
  misc_feature (387)..(387): n is a, c, g, or t
  misc_feature (420)..(420): n is a, c, g, or t
  misc_feature (444)..(444): n is a, c, g, or t
ttctccatcctatggaccacaactggcttcctacttaagaaggagacagcaaagttctcttgtaagataatgtggtatttactcaaattataatttactgccagtataagaagtagacttacatgtgtgcttaagactggtaaatattaaacgttattctttcagtttggcttggcttaataaacattatctaagttacatcatgaaaccagcaccttttatataactnctaataaaactgggtgactctttaatatatttcaacaataaatccaagcaattataaaaagatctcattataataaatcaatactaaanaactatgctgacttcttatacaactctagtttgacttataatggacatgctgatttttgtggcatttancctattattttaaactagtattaaattccattntactaattaacttactaaatcctntattatgtaaaaatttgcatttgggaaagagaaaaactgagtcaacttaacaatcctgatatactccatccagtttgaaaatacatcccctctcatgat

SEQ ID NO: 3018 - DNA, 468 bp, Mus musculus
  misc_feature (67)..(67): n is a, c, g, or t
  misc_feature (77)..(77): n is a, c, g, or t
  misc_feature (272)..(272): n is a, c, g, or t
  misc_feature (307)..(307): n is a, c, g, or t
  misc_feature (321)..(321): n is a, c, g, or t
  misc_feature (367)..(367): n is a, c, g, or t
  misc_feature (384)..(384): n is a, c, g, or t
aacggttgttctgttgaacctataggtcatacattgggataagatagttccaaaagtgcagttaccncctcgatgtnccttaatgttagtcattaaaattctctgagtggtgtggaaaagtaaatcgtacacatcaaagaaggggctcttgggatctaggaggggtgggacaaggcttaaacagacacctttcagtctcaggcttagtctggaggacatgaagttcttgtctgtagttttataggttaagattattttcattgttgtggganagaatagtgttattgtttttagttttgtttttcanaaaagaaaaatgantcaccatatagtttgtgggacttacttggagagagagatcaaaatntcgcttgcacttgacantcggtatggagtaaaaggctttgaaacccatggaagtctgggcacatgcgctcctctcattgagggcagtagtgtccatgtgca

SEQ ID NO: 3019 - DNA, 418 bp, Mus musculus
  misc_feature (149)..(149): n is a, c, g, or t
  misc_feature (199)..(199): n is a, c, g, or t
  misc_feature (337)..(337): n is a, c, g, or t
  misc_feature (340)..(341): n is a, c, g, or t
gtactgaaaagtctctgatgctcctactcctggaaagaagtctgggaagcccctttcgctctgcctcctgcatcctcccagataacaaaacacattaacacattcttactggataatccaatttgccaaaacatttgggcattgtgccnaccacctgcccacacataggaagtccacttcagtaagtgcaaggcgctancacccatcgaggtagaggacattgctttaagccccagtttgtttgtagggttgagtatgaaaaagcccatctcctgtgtccccattgctccttccccttagcctcgacatttcaagttgcggtgtgtgacggaggtgnctnnccgaacgagaagagatgccacagtgtatcgtgtctctagttgtattgtatacctgcttaacatctgcgacatttctc

SEQ ID NO: 3020 - DNA, 469 bp, Mus musculus
  misc_feature (271)..(271): n is a, c, g, or t
  misc_feature (284)..(284): n is a, c, g, or t
  misc_feature (288)..(288): n is a, c, g, or t
  misc_feature (296)..(296): n is a, c, g, or t
  misc_feature (305)..(305): n is a, c, g, or t
  misc_feature (325)..(325): n is a, c, g, or t
  misc_feature (344)..(344): n is a, c, g, or t
  misc_feature (382)..(382): n is a, c, g, or t
  misc_feature (385)..(385): n is a, c, g, or t
gtgtgcacacatgttcttaactcttacacatgtatgtgccagctgatgttgataagtactgtttaacctcaaggtacacttattcctccagctctggaacacagaagatctgtccctaaaacaggtactccatagtcagtgctagtattcagtagggaatgtctgttcccaagtccatgaaattgcatctgctgtggtcgcacttggctcttgtcttagggttacacatacagaagacaatgtcactttttcccaggcagcagacactgtnaccttttcccatncagnagctaatnccatagtantccactagtgcacaaagctntgtcatttggatgaaagtntatgcattcactgtcctaggaaacgatgagaagcaganccngggacttctttatgttttgaatttatgctttaaagagacatttctgttgtctggtttgtggtacttatacgatttgttctccat

SEQ ID NO: 3021 - DNA, 346 bp, Mus musculus
  misc_feature (42)..(42): n is a, c, g, or t
  misc_feature (46)..(46): n is a, c, g, or t
  misc_feature (51)..(51): n is a, c, g, or t
  misc_feature (62)..(62): n is a, c, g, or t
  misc_feature (66)..(66): n is a, c, g, or t
  misc_feature (70)..(70): n is a, c, g, or t
  misc_feature (73)..(73): n is a, c, g, or t
  misc_feature (80)..(80): n is a, c, g, or t
  misc_feature (82)..(83): n is a, c, g, or t
  misc_feature (93)..(93): n is a, c, g, or t
  misc_feature (95)..(95): n is a, c, g, or t
  misc_feature (103)..(103): n is a, c, g, or t
  misc_feature (105)..(105): n is a, c, g, or t
  misc_feature (120)..(120): n is a, c, g, or t
  misc_feature (126)..(126): n is a, c, g, or t
  misc_feature (165)..(165): n is a, c, g, or t
  misc_feature (192)..(192): n is a, c, g, or t
  misc_feature (281)..(281): n is a, c, g, or t
  misc_feature (309)..(309): n is a, c, g, or t
  misc_feature (321)..(321): n is a, c, g, or t
cccataatacttgttcctaaatgaaaaccaggacagatgaantatntttanttggtagattnttcntcanttncccgagncnngattcattantntggtaatntncccatgcttctcatnttatgnccatttcaagaaggcaagagggatagagattatgtcatntctttctaacataagctaaataatacnaaatcaaactatataattattatgaactacccagaccaaggtatttaatgaatggcatcaatgaagtatggaaataatttttgggtgtntcttgagtgttttttttttctaaatctncctgtgttatancccctatgaatgtcatgtacaattg

SEQ ID NO: 3022 - DNA, 503 bp, Mus musculus
  misc_feature (417)..(417): n is a, c, g, or t
tcagcacttcttacgtctcttgaatccatttttaatatattgtataggttggggagttatatatactcttcaagccattattatcctggctataaatttataaaataaattgaaaaatttatcactctcctgtattcaagaccaaagcacataatgctaatgtagggctcagaggggaaaatctagttctcctgcatatttgagaaaacgtggagtcctttcaagaaaatgtaataaacataataatcgtagcctgctgacactaaggaaaaaggcctcattcgctctttcttttatgcagcaatttactggtccctgctgatcttcaaattggatcactgtagtaaattatccacgctggtactggtggaagtaagccctaggatccatatttgttttgtgttctgcttaaatcancaagaatgataaattcgatggtgtgaaattggaagtatcaagggctttctttggtgactgcacaaagtcatgtctccacctggaat

SEQ ID NO: 3023 - DNA, 287 bp, Mus musculus
  misc_feature (112)..(112): n is a, c, g, or t
  misc_feature (133)..(133): n is a, c, g, or t
  misc_feature (181)..(181): n is a, c, g, or t
  misc_feature (210)..(210): n is a, c, g, or t
aagtgtattcattgccttgtctctgattcccaggtattgtgcctctgttgtgtgtttgagtacacacactcaatcccgaaagcagaggtttttggtagaattaggcttcttngagcttttgccaggtctggantattccaatttttagcagtttagagtcagtcaaatgaagcattttttnaaaggatatcattctgcagtatcctgaancctgccctttgtcagacagtgatgagtaaatgaatagggatgggggatgctttagaaatgtgcttatcgggctggtg

SEQ ID NO: 3024 - DNA, 316 bp, Mus musculus
ttctggaatctgcttacaggactttgtggggctttgggtttgtgtgaacttgtacagttctctttgacagtgtagcacttgctgtggagtggcctctgagtcacagggacccctgcagaggcccacgtggaccacagcggagtccaggcttgcctgctctatcagaaaggcagcaggactgatacctcgcagatgttagggacacgttgatgcctctctgtcctgtaccagttttgataagaaggcctgactgtcactccattgtgacagtgaatgtgacagcaggaagatgtttcttacatctccacaagagctt

SEQ ID NO: 3025 - DNA, 472 bp, Mus musculus
  misc_feature (110)..(110): n is a, c, g, or t
  misc_feature (164)..(164): n is a, c, g, or t
  misc_feature (238)..(238): n is a, c, g, or t
  misc_feature (270)..(271): n is a, c, g, or t
ctgctggttgccttgatatttggtatttggcttctatctctgtctctgcttcactgacttgtgagagaccactgtgtacttaggatatacactgtttcaggttctaagtntctaccctgggctttctagactttaaattgccttccttaagttttgcttttttngtttctgatttcaggatttatatggggcgggggagtgttattctcaattatgttattaaacatgaaattctagntatgatgcccttatgatttttgtcacaattanngccacaatctttaatatgtatgtaatttaccctcatatatgatttgaggctaaatctaacttttgtagaagtagcctgtcctgacatcttgactcattttacactgacttgagatatcagctttatagtacgttttcattctcccagacccatgcacatgcagcactaactgaacagaacaggttacttacatacacacat

SEQ ID NO: 3026 - DNA, 565 bp, Mus musculus
  misc_feature (55)..(55): n is a, c, g, or t
  misc_feature (289)..(289): n is a, c, g, or t
  misc_feature (313)..(313): n is a, c, g, or t
  misc_feature (337)..(337): n is a, c, g, or t
  misc_feature (353)..(353): n is a, c, g, or t
  misc_feature (361)..(361): n is a, c, g, or t
  misc_feature (365)..(365): n is a, c, g, or t
  misc_feature (372)..(372): n is a, c, g, or t
  misc_feature (382)..(382): n is a, c, g, or t
  misc_feature (384)..(384): n is a, c, g, or t
  misc_feature (398)..(398): n is a, c, g, or t
  misc_feature (403)..(403): n is a, c, g, or t
  misc_feature (407)..(407): n is a, c, g, or t
  misc_feature (410)..(410): n is a, c, g, or t
  misc_feature (422)..(422): n is a, c, g, or t
  misc_feature (462)..(462): n is a, c, g, or t
  misc_feature (499)..(499): n is a, c, g, or t
  misc_feature (505)..(505): n is a, c, g, or t
  misc_feature (513)..(513): n is a, c, g, or t
  misc_feature (527)..(527): n is a, c, g, or t
  misc_feature (530)..(530): n is a, c, g, or t
  misc_feature (540)..(540): n is a, c, g, or t
ctcctgctgatgtttgtgtcaggactccatggaaaaagtaaacctttggtgtttnatccagtgggtgtggttcacactaaaacaaagtttaaaaaacacaacaaaaagatctgactttcaaacaggacgtttttttctttaagaggcacgaggctgcctttgtgctaccagtgttaaaatactcagttgtttttttttgacaaagcgtgtactgtgtaagccttgcaaaaaataataataagagcaacaacaacaacaacgaagaaaaagcctgttctatggcgttcgnacttttgtaaaaggtttccttgtnccaaataagtacaaagatttaatntactatttaaaccatnaacatacnatanttccagnaattattttntnatcagtgattttgntcttnagtntcnatatttatattnagattaatttttataaatgaaatattttgatggtctaagnaaatgaggacaggaaggatgcgatctctgacggcttntcgatnccttcatntctcacacactcgnccnagaatcactntcaagagaaacgaccacggccaagc

SEQ ID NO: 3027 - DNA, 392 bp, Mus musculus
  misc_feature (73)..(73): n is a, c, g, or t
  misc_feature (285)..(285): n is a, c, g, or t
  misc_feature (325)..(325): n is a, c, g, or t
  misc_feature (331)..(331): n is a, c, g, or t
attatcggcctctgctgaagttgggctggggctgggtaacttaatcaggatctcaggaatttgcagacccttncccagtctgactggagcctaccataaactatggaagtctaaagcctgggttggtctggtgcccattttgtttttccgtgtggtcatggtctctctgtgccccttctgagaatctgtttgctctcagctcagctattttccatctaggtccttctcataggagggggctggtgctgtctcttttctggtactggtaggggattagatccattnctcacagacttgtcgtggtgttgctcatacctgagctatncctggntcaggctcctatgggcacaggtgtatgtgtgacgttacatgtatagctgtcacacggctgt

SEQ ID NO: 3028 - DNA, 90 bp, Mus musculus
tcttatttctgtgacgtatggaacccataatacttgttcctaaatgaaaaccaggacagatgaactatctttacttggtagattcttcct

SEQ ID NO: 3029 - DNA, 339 bp, Mus musculus
  misc_feature (65)..(65): n is a, c, g, or t
  misc_feature (172)..(173): n is a, c, g, or t
ttctcagcttgaattttaaacatcattttaaataatgactttagagtgtatttttttttattttntcttaggcgttagtggatgatacaaagtaagtcaggttcatgtcctggtcagtgcatcaacctagtcatttgggagagattgtttgtttgggttttttttttttttnnctgatttgctttgttcttatttctgtgacgtatggaacccataatacttgttcctaaatgaaaaccaggacagatgaactatctttacttggtagattcttcctcagttgcccgagcctggattcattagtctggtaatttgcccatgcttctcatcttatggcca

SEQ ID NO: 3030 - DNA, 517 bp, Mus musculus
  misc_feature (296)..(300): n is a, c, g, or t
  misc_feature (344)..(344): n is a, c, g, or t
  misc_feature (478)..(478): n is a, c, g, or t
ttcaggagcctgctctaaaatcaggggatgttgcctgagcagttctccggctttctggccctctcagttttggcactgctacaatgtctcccttggtttccctggcaatgcagtttgcttttcttcctttgcctcttcagaggtttcttctggttagttgtacagactcgggtgtcacctgagctttttgtatcgtgaatacatttagggatcttctgcttctttttgtcccccatatttcccatccctttatacactaggtttggtttgaaattcttttctcttcttttcttttnnnnntttttttaaatggggttttgttttgttttaggtaggagacattnatatagtcagattggcttcaaacttgtggttttcctaccccagcctcacaaattcagggattatggaggttaactaccacgtctagcattctttgctgatgttgtttgtttgtttgtttgtttttgagacagancctctctgtatagccctagctgacctggaatctgctatg

SEQ ID NO: 3031 - DNA, 296 bp, Mus musculus
  misc_feature (204)..(204): n is a, c, g, or t
  misc_feature (216)..(216): n is a, c, g, or t
  misc_feature (235)..(235): n is a, c, g, or t
  misc_feature (244)..(244): n is a, c, g, or t
ctttacgtgggttccggccatcaagctgtcagactcacattaagtgctgtcttgaaggcccaagatattatcacagcaaaaacaaataaaaatttgattgtcttctaagaagctattggtagctgctggcaaagggaaaatccgttttctccatgaactgtccctgggtgtatcaaccgtactccagggctggccgcgtgtccnaggagtagctgnccaatacagacagactccnatgttgttngttgttgttactactgtcctttcattctgttgttctgtcttactggcttatt

SEQ ID NO: 3032 - DNA, 510 bp, Mus musculus
  misc_feature (37)..(37): n is a, c, g, or t
  misc_feature (55)..(55): n is a, c, g, or t
  misc_feature (73)..(73): n is a, c, g, or t
  misc_feature (98)..(98): n is a, c, g, or t
  misc_feature (271)..(271): n is a, c, g, or t
  misc_feature (291)..(291): n is a, c, g, or t
  misc_feature (297)..(297): n is a, c, g, or t
  misc_feature (305)..(305): n is a, c, g, or t
  misc_feature (311)..(311): n is a, c, g, or t
  misc_feature (372)..(372): n is a, c, g, or t
  misc_feature (383)..(383): n is a, c, g, or t
  misc_feature (395)..(395): n is a, c, g, or t
  misc_feature (403)..(403): n is a, c, g, or t
  misc_feature (435)..(435): n is a, c, g, or t
  misc_feature (438)..(438): n is a, c, g, or t
  misc_feature (442)..(442): n is a, c, g, or t
  misc_feature (454)..(454): n is a, c, g, or t
  misc_feature (456)..(456): n is a, c, g, or t
tattggtgcaaatatgacaagggaaaaaattgcagcncaggttgattatcatttncctgaaatgcttgagacncaatgtacctcagattacaaattgnatatatatattttttttattttgaaatatttgtatagactttctactttctattagatttgagagtatttcagattttggaattagggttattcaatccgttaccaggtaaaactcacaaaactagtgtactgtgagtgatcactgttcatttgaaaattcacttggtacttnatttatactctttcctttgntctccnatttgctntaggtntcaactctgcccgctcagttcctccttcctacccaccaccacaggacccgttaaaccaggnccagtacctgntccccgatggcntcgctcantctcaagtgtttgagttcactgaaccgaaacncanccantcaccattctgncnaaacttcagtaggttaacccccttcaaaaaataatacctataggaaggcagata

SEQ ID NO: 3033 - DNA, 338 bp, Mus musculus
  misc_feature (64)..(64): n is a, c, g, or t
gcctgtgtagagtcacacctcccagctaggtccccctgcttcccaaggtgtgggtaagaaaggnccatcagataaaagttgattttgctggtgcagaggttggtattttagcacagccaggtccggagctcctgatccttatttatttttgtaactgaccagtgtggagtatagcacaagaattccctctgcctccctcgtgcctcccgagcgcgtgcttgtggttctgagtgcctcctatttattccatttaccagctgacgtctgtgtgcggtgtttcttggtgtcctggagttgggcatgggcgggaggggggtattcctcctgcccaaggcgtt

SEQ ID NO: 3034 - DNA, 408 bp, Mus musculus
  misc_feature (208)..(208): n is a, c, g, or t
  misc_feature (238)..(238): n is a, c, g, or t
  misc_feature (281)..(281): n is a, c, g, or t
  misc_feature (283)..(283): n is a, c, g, or t
  misc_feature (328)..(328): n is a, c, g, or t
  misc_feature (344)..(344): n is a, c, g, or t
gggctggcttggctgatattcatcaggcccttggacgagtgggcgcgcaggggttggagaagctcagaggtgggattgagcatgcctagcagcggcaggcatggagtgccacactatccacccccagggggcacgaacctggaccagatttctttccaccccaggatttctttgcatcttgcttgcctaatgcagtaggacaccatgnccgagatctgtttccgagtggcatgaaaanccctggctttggccctctgccctcagctccgaaactcatccgntntcttccagccccagtagtgatgagagcggctgggtcatgaagctntaccacaggactactntcgagtttcccacttgactccttttcccaagaaattgttgtaactctggctttagtatatacat

SEQ ID NO: 3035 - DNA, 529 bp, Mus musculus
  misc_feature (333)..(333): n is a, c, g, or t
  misc_feature (342)..(342): n is a, c, g, or t
  misc_feature (345)..(345): n is a, c, g, or t
  misc_feature (349)..(349): n is a, c, g, or t
  misc_feature (357)..(357): n is a, c, g, or t
  misc_feature (372)..(372): n is a, c, g, or t
  misc_feature (375)..(375): n is a, c, g, or t
  misc_feature (387)..(387): n is a, c, g, or t
  misc_feature (410)..(410): n is a, c, g, or t
  misc_feature (429)..(429): n is a, c, g, or t
  misc_feature (448)..(448): n is a, c, g, or t
  misc_feature (489)..(489): n is a, c, g, or t
  misc_feature (502)..(502): n is a, c, g, or t
  misc_feature (504)..(504): n is a, c, g, or t
actaaagtgaatgtttccattagacatctttctcatttccatgaaggtaacatggttttaacagttgtttaatggggtcctggaagagtgtctcagcagttaagagagagcattggctgttcttggagagaattctgattttgttccctgcacccacgtggtggctcacagtcatctgtaactccggtttcaggggatctaacactctcttctggcctctgtgagcaccaggcatgcatatggtgcacttacacacacacacaggcacttatacgcgaaaataaaaatctttattttcaaaagtctaatggaatactcaggaaattttgctgntttttcccnaancctnaacatttntgaacattcctattncantcactagaaggnacagaaaggacacatttgtaagnatagcatcctagaatcccnacctgtgtttacacagacntcttccttctggagaggcaccctgcttcgtagaagctcaancctgtgtgttatnantagactaagctcaatattttactat

SEQ ID NO: 3036 - DNA, 430 bp, Mus musculus
  misc_feature (242)..(243): n is a, c, g, or t
  misc_feature (245)..(245): n is a, c, g, or t
gagatgggctgatcttttctcagtatggagagaatgacagaactccttgccctcatgcaaggtcagtcaactctccaactatattctggtttcagtgtctctctttggcctgttttttgtttttctgatttcagtccttcacaaagtttggctcccttttgtaacttactcaggttcattccttcatagttgtacattatgtatgaaatgcaacttcgttatttggaaaaagttcttgcttnncngtatagaaatgaaagataatctttgggggtttgtcaggtaaatccaaactattaggatagtcaagtcccctggaatgatttgtatctatttttgaatatattttacttagtaaatttttacatattttctccctttgtcagccttgtagccaaaactggctggccatgtattaggcacaccaata

SEQ ID NO: 3037 - DNA, 396 bp, Mus musculus
  misc_feature (43)..(43): n is a, c, g, or t
  misc_feature (242)..(242): n is a, c, g, or t
  misc_feature (363)..(363): n is a, c, g, or t
gttgggactcttgaccaggtgaagatacctctgccattcaatntggcctttgcattgtagcaaccttgtccaaatgcatcaccctgaagctcattcgggtcactccagctcctgtaccccactgattttagcaccccagtgtctacatatttctctaatgtatgtgtgctcagtgctgaagggcttcttttacaggggcacctcatattctcttgtggagccccagttcttaggctgtgttntacaggaggaagcaccccaacgtgaacaagtatttcctttcctcgtgccaactagagaaaagggcacagtgatgggacaatggggacaaacgaggttgatgggcaccaagccctgactctnttctgcctcttcgcttggttctttattggcatg

SEQ ID NO: 3038 - DNA, 489 bp, Mus musculus
ctaccaacacagctatctcttgatgacaaaaatcagaacttgggttggaaagtgggtatgggacacctgtgatggaaacatatcaagacagcttcactcatggacctcaattattccatccataaaatggagaaggacagcaactgaaatcaggcaccaatctcaaagtcttctggccacatctccctctctagagaacttgtcaagcatctgggaatctcgttgttccttcctttctgcttggtatcagactgtaaattctactcttcacacttcatggtccagctctgagtgccactgagcagaggtcatgttggtgatcgccaagctcacaccaggcatcctctgccagcatgaacatgcccccctgaagcagtcttcctgaaaccctcacttcccaaggtatagttggttttccccaagttggtttctcccacgaccttctaaactcagaacagcaggccatagcctcctctgtagccttaagaa

SEQ ID NO: 3039 - DNA, 516 bp, Mus musculus
  misc_feature (34)..(34): n is a, c, g, or t
  misc_feature (205)..(205): n is a, c, g, or t
  misc_feature (302)..(302): n is a, c, g, or t
  misc_feature (323)..(323): n is a, c, g, or t
  misc_feature (376)..(376): n is a, c, g, or t
  misc_feature (419)..(419): n is a, c, g, or t
agtgactttgaagctatcctaggatatatgagancctatactgaaaaaagtcataacaaatttggcctacaatgttcttaattgtatataatgtatacatacatgtagtatgtatacattaagtttgaactattaaaaaatggagttttcatactttattctgtaactaaaaataatctgatcaaaatcaattgttcacttgacnatttatatgaaaactgtatattctattcattgttatatatttccacctcatatcttatttgttttcaataatgtatttatccccaagaaaacatccnaaaatatggaagtaatttggnacaatatccagtaattgtttaaataactggtttgttataaaacaatgttatgnccagattctattctagaaaagattaaacatacttagaacaganccataaaactattttcaataattaaaatcatgtttggctcatgggtgtgactattagtgttcttgatggtaggtctgcctggatgtactttcttagt

SEQ ID NO: 3040 - DNA, 440 bp, Mus musculus
  misc_feature (39)..(39): n is a, c, g, or t
  misc_feature (219)..(219): n is a, c, g, or t
  misc_feature (276)..(276): n is a, c, g, or t
  misc_feature (307)..(307): n is a, c, g, or t
  misc_feature (366)..(366): n is a, c, g, or t
aatgcacttcaacataccgagccttgcagccaagaaccntaacattcattctatccttcactagctccagagataactgcacgtctcagatcacctttgaaataacccgtattcatactgtgttgttctaaatggacagctctcaggcaatgaaattagatgtgtggacatcaggtgagaacaaaagctgaggtagcatttggcattggaaaaaattgngtaatatattaattgatgtaagtttccttaatcttacacagtttgtgaagcatattnatgtacatatgttggccaggatcatgaaatncctcctggtttgcatcttttggtgtggcttcaataaagaaataagtttgaataattccntcctagctacacaggaagccacagtggtgtggaagttgagaacagtagagactggtgctaatcttttataatca

SEQ ID NO: 3041 - DNA, 565 bp, Mus musculus
  misc_feature (334)..(334): n is a, c, g, or t
gcagatcttctctggttgatgtccagtagggaacgctccaacagcatgtctacggctaccgcacagaggaagcctgaacgacacaggtataggatctgtgccctttgacttggtggctgagaacagatatgtaccgcaagtttcaacctcagagattacaggtggggtcagagtcagctgaacgacagagtcttagccatctctcctgcatcagcattgggtaaagccatgccatcacaaggctccacttccttggtcattaagtagacagacagatgctgtgcacaggcctggctttcggggaaggtcttggagggctttagagaagtgcagnagtaaggagagtggcgtgggagttcactgggtatgggaaactacctcattctcccaaaggttcgtagaagcacagttaagtatggaaagtggcttccttgcaccacagacgtctcacgtgaagccctgctagtgttaaggacccacagtggtggtgttctgcgggcaatcgacacattcctcactgttggcaggttctgcagattatgtccacctttctgttgccaataaa

SEQ ID NO: 3042 - DNA, 88 bp, Mus musculus
gagatgggccccaaattaactgccagagcaggcagaaagggatgctgcgttcagccattccacacttacttccagagctcttgtgttg

SEQ ID NO: 3043 - DNA, 414 bp, Mus musculus
  misc_feature (175)..(175): n is a, c, g, or t
  misc_feature (183)..(183): n is a, c, g, or t
  misc_feature (187)..(188): n is a, c, g, or t
  misc_feature (191)..(192): n is a, c, g, or t
  misc_feature (213)..(213): n is a, c, g, or t
  misc_feature (232)..(232): n is a, c, g, or t
  misc_feature (240)..(240): n is a, c, g, or t
  misc_feature (253)..(253): n is a, c, g, or t
  misc_feature (260)..(260): n is a, c, g, or t
  misc_feature (284)..(284): n is a, c, g, or t
  misc_feature (315)..(315): n is a, c, g, or t
  misc_feature (362)..(362): n is a, c, g, or t
gctaacagtattattgtgcctggatttaccatggccctttgtgttgtgtctccacgaggaaacccatggagagaaacatttgccatttgggaaaataccaatgattgcacgactcctgacccactgcatttcaacagttttagcaatcacatttctttcttgaacttgacccatnttgcattnaccnnctnnttcaccatgtcatactagacnagacaggactctgtaccanccagttantcagaattttctnacatagnaaatctgagaccaagtgatctgancaagtattctacagccaggaactgaacaacncaacagtttttaccatggaaatgttaaatcctacaacccaccatggnccggaagatggagcaatggtggctttcttttccttggctgttcttaaagtat

SEQ ID NO: 3044 - DNA, 590 bp, Mus musculus
  misc_feature (75)..(75): n is a, c, g, or t
  misc_feature (306)..(306): n is a, c, g, or t
  misc_feature (340)..(340): n is a, c, g, or t
  misc_feature (357)..(357): n is a, c, g, or t
  misc_feature (393)..(393): n is a, c, g, or t
  misc_feature (421)..(421): n is a, c, g, or t
  misc_feature (514)..(514): n is a, c, g, or t
acatacattgcaagagtcctccatcttttttttttttgttgttgttgtttgtttgtttgttttgttttttttttncgagacagggtttctctgtgtagccttggctgtcctggaactcactttgtagaccaggctggcctcaaactcagaaatctgcctgcctctgcctctgcctcccgagtgctgggattaaaggtgtgtgccaccacgcccggctgagtcctccatcttgattaggagaaacatttcctagattttctttatcttgtattttcatctagcctcctcctgcccccactttttggntcttctacactctttgtctcctttcaatgtgaancaatcaactatacaatnatattcattttcataagttattcagacaggtgagtncaaatcttacattctggatttccatatnagctattttttattaaaatctgataaactgatttccaaatttattacatatgtatctaaatttatattgaattatatatcttatataaagatnatctaaatattgtctttcaatagtatttactctaattgtttagcataattgatgaatcattaaaacatttcctgct

SEQ ID NO: 3045 - DNA, 442 bp, Mus musculus
  misc_feature (284)..(284): n is a, c, g, or t
  misc_feature (302)..(302): n is a, c, g, or t
  misc_feature (304)..(305): n is a, c, g, or t
  misc_feature (307)..(307): n is a, c, g, or t
  misc_feature (309)..(309): n is a, c, g, or t
  misc_feature (324)..(324): n is a, c, g, or t
  misc_feature (329)..(330): n is a, c, g, or t
  misc_feature (337)..(337): n is a, c, g, or t
  misc_feature (339)..(339): n is a, c, g, or t
  misc_feature (342)..(342): n is a, c, g, or t
  misc_feature (344)..(344): n is a, c, g, or t
  misc_feature (346)..(346): n is a, c, g, or t
  misc_feature (356)..(356): n is a, c, g, or t
  misc_feature (363)..(363): n is a, c, g, or t
  misc_feature (372)..(372): n is a, c, g, or t
  misc_feature (380)..(380): n is a, c, g, or t
  misc_feature (383)..(383): n is a, c, g, or t
  misc_feature (417)..(417): n is a, c, g, or t
tctttctcattttcctcagctatgaaaacaattagagagacagatgattgtctctgcattcagaaaacaaactgccctgctaatcaaggctgcatattgtatccaaaatgatgattggattttattacaactgtgtcatcagtctcgaactggcaaacaaaaagtactttccataaagcttgccacatcgctttgcattgtcaacccactgagccaaagagtcactgcagctatgggcatttgcctcatgcagagttcagtataagcatggatgttagttattntgaatgttaatatacccncnncntnctgaagtcccttagnatttnnttctttnanacnanancttagaattntgagacnaaatttccnactcattnaantgggatgattatgacaacacatagaagggtgacngactacatattcacattccccattt

SEQ ID NO: 3046 - DNA, 314 bp, Mus musculus
  misc_feature (26)..(27): n is a, c, g, or t
  misc_feature (36)..(36): n is a, c, g, or t
  misc_feature (38)..(38): n is a, c, g, or t
  misc_feature (64)..(64): n is a, c, g, or t
  misc_feature (66)..(66): n is a, c, g, or t
  misc_feature (68)..(68): n is a, c, g, or t
  misc_feature (73)..(73): n is a, c, g, or t
  misc_feature (88)..(88): n is a, c, g, or t
  misc_feature (91)..(91): n is a, c, g, or t
  misc_feature (95)..(96): n is a, c, g, or t
  misc_feature (117)..(117): n is a, c, g, or t
  misc_feature (149)..(149): n is a, c, g, or t
  misc_feature (170)..(170): n is a, c, g, or t
  misc_feature (180)..(180): n is a, c, g, or t
  misc_feature (213)..(213): n is a, c, g, or t
  misc_feature (226)..(226): n is a, c, g, or t
  misc_feature (238)..(238): n is a, c, g, or t
gcagaccatggccaggcctctggagnncacctctcncngctcagctttcccaggtccacagttntncnagcanctgtggtgataaatnatntatnnattgagtaggcttgcactaancctgcttcccgagtgtgctttttgcagatttntctagctctgaagaggtggtncctgccaggncccggggatctgctcttgctaataaccatgctntttcctgctttgnccttggtgtagntcctggcctcgagaaacagtggtcacgtggttggtgggctaggcagataatctttgaatttcatctgtagctgagt

SEQ ID NO: 3047 - DNA, 255 bp, Mus musculus
  misc_feature (148)..(148): n is a, c, g, or t
ttctctgatcctggaaaagtttcttcctgagcgtgccttaaaagcgatcagtcgtatacagaacattcaatttgaagcaattgtgggccacaaaaccaagatgaagtagtgcatgcagagacgtgtggacaccaatgatgtgaagccnaagtttagaggggacacacagctttctttcacatgttttaagtgttccacatgtttaaaatgtaggcttgaccctagcagccatcgagtgcataagcgtggtcaact

SEQ ID NO: 3048 - DNA, 428 bp, Mus musculus
  misc_feature (253)..(253): n is a, c, g, or t
  misc_feature (277)..(278): n is a, c, g, or t
  misc_feature (282)..(282): n is a, c, g, or t
  misc_feature (286)..(286): n is a, c, g, or t
  misc_feature (301)..(301): n is a, c, g, or t
  misc_feature (316)..(316): n is a, c, g, or t
  misc_feature (322)..(322): n is a, c, g, or t
  misc_feature (371)..(371): n is a, c, g, or t
ttgggctcaccctcaaagaaaaccatgagataaattgacagccaatcccccatttctgccgagctttggttttctctggactctcttccaggaactcctcctgttttatttaccattgctcacattttacctttctttgttgtcaacgtggccttatcatcaaaccctctgcctttattaaccacaccaggattctagggttgacattatctcatgcatctttctgccccagtgtgaagggactacttcttanccttccacacattcatgaggactnncctncctncccccttgcagcctntatgttgtcctcctnctgctnatgatagtctgggtgcaagagacttgaagtgtgttgatggacattcctncaagaaccaacccagcatggatcaagcacctggcaccgttgtatctggcataaatct

SEQ ID NO: 3049 - DNA, 471 bp, Mus musculus
  misc_feature (221)..(221): n is a, c, g, or t
  misc_feature (356)..(356): n is a, c, g, or t
  misc_feature (385)..(385): n is a, c, g, or t
  misc_feature (399)..(399): n is a, c, g, or t
  misc_feature (419)..(419): n is a, c, g, or t
tcaaggttccatgggcctgtgaaacttatagccacaaagccagctagtgtcttcaaggccaggtctgctgtattcaaactgaaaactggaaactgccagacagagtccattattagtcatggtcagggtgagtgtgttcagcccatgctgactttatagttgatgtgggtataactcagaatggtagttttcaagaagcttttgactgtgtctttccagangtaacatgggtgtgtttgtgttcccctctggctgacagtgacagtcagatccctgcatcttttgactggtagcagctcctctctgccagacttcccctgacatctcagagttgctcaagctcttgattcagaatntcattgaccacttctggattttagatttnatatgatctgggtntagaccattgttccatattntagtgcagagggtatcacattaaggtgtccatttgaggcttatccataacta

SEQ ID NO: 3050 - DNA, 216 bp, Mus musculus
  misc_feature (34)..(34): n is a, c, g, or t
  misc_feature (44)..(44): n is a, c, g, or t
  misc_feature (46)..(46): n is a, c, g, or t
  misc_feature (48)..(48): n is a, c, g, or t
  misc_feature (51)..(51): n is a, c, g, or t
  misc_feature (53)..(53): n is a, c, g, or t
  misc_feature (56)..(56): n is a, c, g, or t
  misc_feature (59)..(59): n is a, c, g, or t
  misc_feature (63)..(64): n is a, c, g, or t
  misc_feature (69)..(70): n is a, c, g, or t
  misc_feature (74)..(74): n is a, c, g, or t
  misc_feature (82)..(82): n is a, c, g, or t
  misc_feature (92)..(92): n is a, c, g, or t
  misc_feature (102)..(102): n is a, c, g, or t
  misc_feature (107)..(107): n is a, c, g, or t
  misc_feature (147)..(147): n is a, c, g, or t
ccacacttgggaacacacagatgtgcacaggganccgagagctncnanctntnccnctntctnntcccnntctnccttgganggttttcctnccctctggtngatgntctagtagaatctgttactactttggaatgtttgggcttngtttgttcgtgtgtgtgtgttaagttgttggttggttttattcatggatatgcagctttactctttaac

SEQ ID NO: 3051 - DNA, 441 bp, Mus musculus
  misc_feature (271)..(271): n is a, c, g, or t
  misc_feature (335)..(336): n is a, c, g, or t
attgaatttctgctatcttcttgaaatatggtactatacgactaagtcagatttgggtgtgttgtaacagtgctaagtgtgctcagtagaattttatttacagtactgtgtgatagtccattactgcctagggtagttgaaaaccagtgatctgagctagtgctaggtaaacctatagctgacatgatttcagtcacactcaaaaataggagacatgtacccagcaaagttctccagaatgcaggaacacacttcataaccagggaactanccaaatcctatgggctaatagctcagctgcagggaataaagattgtgaattggtggcaagtatnncacaataactccctaataattgcttcctaagcacttgtggcatacttttgagtgacataacagcattttcttggctgtacatgaccggtttccatgatgtattga

SEQ ID NO: 3052 - DNA, 309 bp, Mus musculus
  misc_feature (220)..(220): n is a, c, g, or t
  misc_feature (222)..(222): n is a, c, g, or t
  misc_feature (236)..(236): n is a, c, g, or t
  misc_feature (243)..(243): n is a, c, g, or t
  misc_feature (248)..(248): n is a, c, g, or t
  misc_feature (269)..(269): n is a, c, g, or t
ggaaggcacccacaaagccgtgtgttcagcgcaatgcctgacagcatcgaacggtcaccccttcgagaaaggaccattgtattggaacagctttcaaggcccagcacaacacacacattccggtcagacacacctcgaaaaggctccctgacacccgtggagtttgtggctcacacttggacgggtcaaagtattttgacaggttcacagtatctgcccnanatcttatcagaggncaacccngactncaagaaagaggttccaagtgncctcgtaatgttactgcttcagaattatggacttgctaga

SEQ ID NO: 3053 - DNA, 52 bp, Mus musculus
agcattcccagtcctaagctgtccactggagacatttctgtcagagaaattg

SEQ ID NO: 3054 - DNA, 493 bp, Mus musculus
gagttccctttgcaaaggccctgaggctagaagtagtagacaagggtgctcttggaggcccctgaggagtctggactggggagtgaggactctaggaggctgttggaattttgagtgcctcagggattttgcgtagtactgacaggagagcttctccggactcaggcctttagtcagtctctcgggtttacaggcagagaggcttgaagcagccttcggttcatgctttctgctgtttctgatttctggctgtgtattctgagctgggataaacagattctcctctccaaacacttatttgctactagaaacgaaattggcacattaagcctccttttattacagttcaagaatttgaactccagattgatcgatttaccctccctgatttttgacagtccctaaactgcctcgtgttgtcacatttcttcaaattcttgggttcgagtttctaaagcacaagaagccaggaggccctactgctgctttttat

SEQ ID NO: 3055 - DNA, 493 bp, Mus musculus
  misc_feature (37)..(37): n is a, c, g, or t
  misc_feature (39)..(40): n is a, c, g, or t
  misc_feature (44)..(45): n is a, c, g, or t
  misc_feature (48)..(48): n is a, c, g, or t
  misc_feature (384)..(384): n is a, c, g, or t
attttacttctgtggcggtgtacaaaagtggagtttntnntttnnttngaagtttttgtttctgatttctgggttttcttagttactagccgataatacagaaaaaggtctgacaggggctttattttcccccaaatttattaatacctaaactagattaatgtaaaagtacaagtcctaaatcttggtactcctgaaggcttgtagttcttctgaagatatatatagatagatagattaacttctgaacatattaccactcaccatctctaccttggagaagcgttagaaccctgctccaggggtctggtgaggagcgggtggctgggggttctctacacagaatttggtttcgtctggctgcttggttgggttttctctctntcctctgctccccaggtttgctctctggtgcttaggagcagccatggcagcctccacatgcagacctcaaccccttgtgtgtgtggcatttgcaaccagtgaccaacca

SEQ ID NO: 3056 - DNA, 379 bp, Mus musculus
  misc_feature (144)..(144): n is a, c, g, or t
gagtgctgcttgatgtatctgctgcttctaaccccatcttgctcttggaggactgactgggctctctctggtttgggatctggccaatgcattacctctttatttcagccctctgcacctgttccccgccttccccctcccttntaggaagggataaaccttcgccatagctcacatttacaaagagctttcgggctcaggcatacactcggaagtgacagctgctattacgtccattttccggggaggaaaactgaggccaaaatgacagtcacttgccagtaatcagatattttaggaagtggctagtaagggacttgaattcagatcaccgtttcaaggcccacacttcatttcctctctaggttctgctgtagaa

SEQ ID NO: 3057 - DNA, 527 bp, Mus musculus
  misc_feature (114)..(114): n is a, c, g, or t
  misc_feature (118)..(121): n is a, c, g, or t
  misc_feature (125)..(125): n is a, c, g, or t
  misc_feature (128)..(128): n is a, c, g, or t
  misc_feature (130)..(130): n is a, c, g, or t
  misc_feature (142)..(142): n is a, c, g, or t
  misc_feature (154)..(155): n is a, c, g, or t
  misc_feature (161)..(161): n is a, c, g, or t
  misc_feature (164)..(164): n is a, c, g, or t
  misc_feature (169)..(169): n is a, c, g, or t
  misc_feature (172)..(172): n is a, c, g, or t
  misc_feature (175)..(175): n is a, c, g, or t
  misc_feature (178)..(178): n is a, c, g, or t
  misc_feature (185)..(185): n is a, c, g, or t
  misc_feature (224)..(224): n is a, c, g, or t
  misc_feature (233)..(234): n is a, c, g, or t
  misc_feature (244)..(244): n is a, c, g, or t
  misc_feature (253)..(253): n is a, c, g, or t
  misc_feature (258)..(258): n is a, c, g, or t
  misc_feature (260)..(260): n is a, c, g, or t
  misc_feature (266)..(266): n is a, c, g, or t
  misc_feature (275)..(275): n is a, c, g, or t
  misc_feature (279)..(279): n is a, c, g, or t
  misc_feature (282)..(282): n is a, c, g, or t
  misc_feature (284)..(284): n is a, c, g, or t
  misc_feature (286)..(286): n is a, c, g, or t
  misc_feature (293)..(293): n is a, c, g, or t
  misc_feature (300)..(300): n is a, c, g, or t
  misc_feature (379)..(379): n is a, c, g, or t
  misc_feature (385)..(385): n is a, c, g, or t
  misc_feature (404)..(404): n is a, c, g, or t
  misc_feature (407)..(407): n is a, c, g, or t
  misc_feature (413)..(413): n is a, c, g, or t
  misc_feature (451)..(451): n is a, c, g, or t
aggtgggccagtgtgatcttctgccaccatggcgccctggtgagttgcagtccctgcaggactccagcgaccgaccggccttcatctaacttgtgtgtttctttgtggacaccngggnnnngggnttntnagtctgacaggnctcaggagagannggacancanggatngantanggnagggggnaatcccttagcaagggtgagaggagggtggaaggccctntgtgttccnncccacccctngcctggggnccgcngntgaggntcgggaganttgnctntncnggctgcncccagcnctgatggaggaaagggcaggaggtttatgttctttttcttttttgattttaatttttttaatttttttggtttaaaganaaaaancaaacgattgcagctttanccngtgggnagtcctctttttactctctgtatctcccctattttttntcttctccccatgtcattgtgcgcatcaaaccccctttacatccctcagagcttcgagaaggttggtgtggctttt

SEQ ID NO: 3058 - DNA, 499 bp, Mus musculus
  misc_feature (240)..(241): n is a, c, g, or t
  misc_feature (243)..(243): n is a, c, g, or t
  misc_feature (245)..(247): n is a, c, g, or t
acaagtggctggtcttctgggactcttcttctcaccagagggagaaatgccggcagcaactgcaagaagcccagtccttcggtgcccacagcccagagcacacactgctgtgctggcccagaagctgggcagaaaggtcaccatgttcttccttacctcagtttacctgcagcccttgctgcagtgcagatgcccaccctgtaccaggtcaggccggcagatgcttcatccatgcctcanngntnnncgccaacatgcttctcacgtctcttcccctccccaccccccttcccaagcactaggcttgttgtttaatggagcccaaccaataatcatgtgtcttcagggttggctcagtgcagttgctaagcaaatcagtcttcaggagaaacggggtggtgtggataaggctggaagaaatggcaggtagtggagagtgttggggtgttcgatggaagacaaaaacatgggccgttctcttcagtctagtacccagtga

SEQ ID NO: 3059 - DNA, 429 bp, Mus musculus
  misc_feature (178)..(178): n is a, c, g, or t
  misc_feature (185)..(185): n is a, c, g, or t
  misc_feature (302)..(302): n is a, c, g, or t
  misc_feature (330)..(330): n is a, c, g, or t
  misc_feature (374)..(374): n is a, c, g, or t
aatgtcttatgtccctggtgtattatcatctttatggaaaaattcattttggtttctgtagagcatttagaaaaatgagttatattggaaaaatgaattatgttggtgatttgaagaagtatctttttgtgttgtctctttgttcagcagtgaaattttattctcagtgttcctattntgcattngtttacattcttaaggtttttattttaatcatccataagtgtgagacatgtacatattatttttagcatctcagtttgaagagacatacagttaaacttgactttgataaatacttntaggtcattgtctgtgcgaacagcaganttgtaagcatacgcttcctagtgatgtagctttctgtcattgtntccttggtatttattgaacatccacatactggtggcacacagatttgttccaata

SEQ ID NO: 3060 - DNA, 413 bp, Mus musculus
ggaacacctgtgacctcagtcccgactcctgacgccaccgctgctcttcttgcgtttttgtaatcttttcatttttgaagcttccaatttgcttgctgctgctgctgcctgggggccaggacagaggtagtggcggcccccatgccgccctccttgagctggtgaggagaagtcgccattgagcacacaacctccaccagactgccatggccccgaacctgcaattccatcctagcgcagaagcatgtgcctgccacctgctgcccctgcagagtcatgtgtgtttgtggtgggcattttaaataattatttaaaagacaggaagtaagcggtaccgagcaatgaaactgaaggtacagcactgggcgtctggggaccccacgctctcccaacgcccagactatgtggagctg

SEQ ID NO: 3061 - DNA, 315 bp, Mus musculus
  misc_feature (26)..(26): n is a, c, g, or t
  misc_feature (30)..(30): n is a, c, g, or t
  misc_feature (46)..(46): n is a, c, g, or t
  misc_feature (81)..(81): n is a, c, g, or t
  misc_feature (135)..(135): n is a, c, g, or t
tgtgttaggtggacttaaatcccaangggntcacttgataattatncccatagaaatgcagaatgcaggtaactgcttttnccctttaccgtcctcaggtgagtctcctagatcaacagcctttttttttttttnccttaaactggctcctgtcaaagattaagttaatatggaaaagacctcttatgtgtattgatggggcatgaggagcccaggcaaggagaggctcgtggagaggctgagggaatgttactaagtttccctccgtttgtctccagtctggtgccaggcagtagagtggaaaaggaggctatt

SEQ ID NO: 3062 - DNA, 493 bp, Mus musculus
  misc_feature (280)..(280): n is a, c, g, or t
  misc_feature (290)..(291): n is a, c, g, or t
  misc_feature (301)..(301): n is a, c, g, or t
  misc_feature (306)..(306): n is a, c, g, or t
  misc_feature (313)..(313): n is a, c, g, or t
  misc_feature (315)..(315): n is a, c, g, or t
  misc_feature (323)..(323): n is a, c, g, or t
  misc_feature (325)..(325): n is a, c, g, or t
  misc_feature (328)..(328): n is a, c, g, or t
  misc_feature (344)..(344): n is a, c, g, or t
  misc_feature (359)..(359): n is a, c, g, or t
  misc_feature (367)..(367): n is a, c, g, or t
  misc_feature (416)..(416): n is a, c, g, or t
  misc_feature (419)..(419): n is a, c, g, or t
  misc_feature (433)..(433): n is a, c, g, or t
taaactatcaccatgcccacaggttcacccatgtctaatttggaaatatttttgggaagagcctaagagacctcacggcacacttcctacatggccatcatgaggagaactgaaattttccttctaaaccacaggtcaaccccaggctgggtaactgtggggcagacacaagggaagtcagagacagggcatcaccggtcctgtgacaggcagagaggcagcagctgtagccagcagaggtaggagatagagaggcccactttagcccacctgaggaccnaggtccaccnnagggacaggnagggnaagaganancagggatngnaanaagcaggctaacaggncctgagcagatagtnatccaganttcactaagagtcatatgatcttggctggcaaggtggttcagggggttnagncccttgctaccacncctgacaacctgacttagtttcccctgtgatagaagattagtgacttccacgggttgtcc

SEQ ID NO: 3063 - DNA, 370 bp, Mus musculus
  misc_feature (60)..(62): n is a, c, g, or t
  misc_feature (64)..(67): n is a, c, g, or t
  misc_feature (69)..(72): n is a, c, g, or t
  misc_feature (75)..(82): n is a, c, g, or t
  misc_feature (84)..(85): n is a, c, g, or t
  misc_feature (87)..(89): n is a, c, g, or t
  misc_feature (91)..(94): n is a, c, g, or t
  misc_feature (100)..(100): n is a, c, g, or t
  misc_feature (106)..(107): n is a, c, g, or t
  misc_feature (109)..(109): n is a, c, g, or t
  misc_feature (111)..(112): n is a, c, g, or t
  misc_feature (124)..(124): n is a, c, g, or t
  misc_feature (130)..(130): n is a, c, g, or t
  misc_feature (146)..(146): n is a, c, g, or t
  misc_feature (153)..(155): n is a, c, g, or t
  misc_feature (164)..(164): n is a, c, g, or t
  misc_feature (171)..(171): n is a, c, g, or t
  misc_feature (187)..(187): n is a, c, g, or t
  misc_feature (193)..(193): n is a, c, g, or t
  misc_feature (197)..(197): n is a, c, g, or t
  misc_feature (208)..(208): n is a, c, g, or t
  misc_feature (222)..(222): n is a, c, g, or t
  misc_feature (231)..(231): n is a, c, g, or t
  misc_feature (242)..(243): n is a, c, g, or t
  misc_feature (246)..(246): n is a, c, g, or t
  misc_feature (266)..(266): n is a, c, g, or t
  misc_feature (272)..(272): n is a, c, g, or t
  misc_feature (284)..(284): n is a, c, g, or t
  misc_feature (305)..(305): n is a, c, g, or t
aggtagaggttattcagaccttcaagctgcaagatgaaagctaagctagcgtttctgccnnncnnnntnnnnacnnnnnnnncnncnnncnnnncatctncgcagnngnannaaatcctccctnattctntcttttgtttaaatantcctacnnntgttgtgancattctntcactggatccctgantccttngatnaccttcctganacctgtgtgctgtnatagaccanatgtgaacccnngtngttgggatgttccatttttntcttcntctgaaatattngtctgtttcaagtgtgagtgnacaaggacttcacattttcttaccttctgtgttcctactttttaaattccctgtgatgtgtgttt

SEQ ID NO: 3064 - DNA, 464 bp, Mus musculus
  misc_feature (226)..(226): n is a, c, g, or t
  misc_feature (246)..(246): n is a, c, g, or t
  misc_feature (251)..(251): n is a, c, g, or t
  misc_feature (273)..(273): n is a, c, g, or t
  misc_feature (281)..(281): n is a, c, g, or t
  misc_feature (297)..(297): n is a, c, g, or t
  misc_feature (301)..(301): n is a, c, g, or t
  misc_feature (325)..(325): n is a, c, g, or t
  misc_feature (333)..(333): n is a, c, g, or t
  misc_feature (354)..(354): n is a, c, g, or t
gtgatcatcatgcttgtgggtaacaagacggatctggctgataagaggcagataaccatcgaggaaggagaacagcgggccaaagaactgagcgtcatgttcatcgagaccagcgcgaagactggctacaacgtgaagcagctcttccgacgtgtggcgtcagctctgcccggcatggagaatgtccaggagaagagcaaagaagggatgattgacatcaagctgnacaagcctcaggagcccccngccangcgagggcggctgctcctgttnatgcaccncccactcggcttcctnagcnccactcacttgttttgcctcctanagcttccnaacggggtgggaactgagttnatcaagactggaggatctttcttttctctctctctctctctctaggagtagggtgggacatggggagggaggctgggcatcagggaccacgtcactcttaacagctgtta

SEQ ID NO: 3065 - DNA, 543 bp, Mus musculus
  misc_feature (40)..(40): n is a, c, g, or t
  misc_feature (114)..(114): n is a, c, g, or t
agctatgtggcatcccaacacgaagaccttgtgtagttcnttttgcaatgacatatttattgaatctatttatatttatttaatttttactctgaagtatatccggttacaatntgcacttgcttaaagcacatcagatctattttggacaatacccctgaccattctaaaactggaaaaggaaaagttacactgtatcctgccaccttatggtagccttgtctttaaagggtgaataatttggtctgggtaaaatgttaatttttagatgattttttaaaaaaatcttgtgccatgtgtcttctctgtggacagttaattgtttaattgatatgtgctgattgtgtgattcactcctctttgtggaaactaaaatattctttttagctttatattttataaactgccagattgtacaacttttatgtgtatttttaaagctcatgatatgaggatcattatctaaacggcctatttttttacctcttttacagttttataattctgctcattgatgaaggcgacttatgctgagccaaccac

SEQ ID NO: 3066 - DNA, 480 bp, Mus musculus
  misc_feature (218)..(218): n is a, c, g, or t
  misc_feature (230)..(230): n is a, c, g, or t
  misc_feature (247)..(247): n is a, c, g, or t
  misc_feature (255)..(255): n is a, c, g, or t
  misc_feature (276)..(276): n is a, c, g, or t
  misc_feature (292)..(292): n is a, c, g, or t
  misc_feature (318)..(318): n is a, c, g, or t
  misc_feature (321)..(321): n is a, c, g, or t
  misc_feature (348)..(348): n is a, c, g, or t
  misc_feature (350)..(350): n is a, c, g, or t
  misc_feature (384)..(384): n is a, c, g, or t
  misc_feature (435)..(435): n is a, c, g, or t
agaggccctctactctcgtgttttttagcactgtctgctctcttttcagcatcttctggttttatgaatatgaaggatgactccaccccctgctaacccagcctcagaggggacccaagtgtcacaccactccgaagtcagggttccctagaggatttcttttgtgtttttctgcagtgctgaggaatgtaggcagggcctcctgcgtgagaggcaantactccacaganccactcccagatcctcncagcagantctctcggctcacagggaggngtaggagattgggctnttaagaaggtaaagttttaggaaccncantcaggaaccccctgggttgggctaccnantcccgaactctgggggtactctatcaggaaagcncacttcaggagttgctcagtggatagggtgttcccatagcattattcccancactcgggagatgaaagcagtcagatcacaagttaaggtcagcct

SEQ ID NO: 3067 - DNA, 521 bp, Mus musculus
  misc_feature (106)..(106): n is a, c, g, or t
  misc_feature (183)..(183): n is a, c, g, or t
  misc_feature (193)..(193): n is a, c, g, or t
  misc_feature (232)..(232): n is a, c, g, or t
  misc_feature (293)..(293): n is a, c, g, or t
  misc_feature (316)..(316): n is a, c, g, or t
  misc_feature (324)..(324): n is a, c, g, or t
  misc_feature (336)..(337): n is a, c, g, or t
  misc_feature (340)..(341): n is a, c, g, or t
  misc_feature (348)..(348): n is a, c, g, or t
  misc_feature (382)..(382): n is a, c, g, or t
  misc_feature (393)..(393): n is a, c, g, or t
  misc_feature (423)..(423): n is a, c, g, or t
  misc_feature (425)..(425): n is a, c, g, or t
gtaagtcttcaactacaatatacagttgtgaaatgatggtgtcggttatacacacattagactgaatgggaagggacacagtgaatttagaaaactattttttttnctatataaaacacttctctctagtaaatttactctctttgaactcatgttattcagaccaatattttacctggaaantttctttttntaagtattattagaaaatggctttgaaatatagaaccanctgaggtcccccagagcccttaccacaatatattttatattttttacattataataatganctaaagcttttcagacaagcccnacttacantctatagtatanngannttagttnactgaagcattcatggcatttaaccagtgcctanaaatgtatttntgcatcatcctctaaaaatgaaacctccantnttcagtattgaaggatttaagagggattgaattttatccagtggtaatattcataaacgttaccctccatgaaaactacatagatatccacaggat

SEQ ID NO: 3068 - DNA, 488 bp, Mus musculus
  misc_feature (57)..(57): n is a, c, g, or t
  misc_feature (88)..(88): n is a, c, g, or t
  misc_feature (97)..(97): n is a, c, g, or t
  misc_feature (116)..(116): n is a, c, g, or t
  misc_feature (121)..(121): n is a, c, g, or t
  misc_feature (152)..(152): n is a, c, g, or t
  misc_feature (157)..(157): n is a, c, g, or t
  misc_feature (177)..(177): n is a, c, g, or t
  misc_feature (183)..(183): n is a, c, g, or t
  misc_feature (186)..(186): n is a, c, g, or t
ggataaccttgatgtccagtactatacccccagaccccacaaaatttgccacatttnatatgaagctggaagagatcgagaacaaagnaactattcnaggacatttggtagctagntttcntctttgcaagactgcaaggagcgcgcagaantggantgggagtcagtgataaggantgtganttntttgttcaactggatcctctctcttgctcttcgacataaatggtctccgtctgcagacatttcagtactgcccagaagaaatcttgagactctgtgtggaccctgttcatgtcattgtcacctgtaacaatggctctttggatgtgtacgtgtgggaggagagaagcccactgcttaggaggtgttatcgactacgaaaaaggggatatctgccactgtctggcttcattatcaaaacattatgtgatgaatcaagcataattttagtgatgactagtagtcccattccctgctttctgatg

SEQ ID NO: 3069 - DNA, 509 bp, Mus musculus
  misc_feature (38)..(38): n is a, c, g, or t
  misc_feature (207)..(207): n is a, c, g, or t
  misc_feature (216)..(216): n is a, c, g, or t
  misc_feature (218)..(219): n is a, c, g, or t
  misc_feature (221)..(221): n is a, c, g, or t
  misc_feature (227)..(227): n is a, c, g, or t
  misc_feature (237)..(238): n is a, c, g, or t
  misc_feature (258)..(258): n is a, c, g, or t
  misc_feature (263)..(263): n is a, c, g, or t
  misc_feature (272)..(272): n is a, c, g, or t
  misc_feature (291)..(291): n is a, c, g, or t
  misc_feature (293)..(293): n is a, c, g, or t
  misc_feature (296)..(297): n is a, c, g, or t
  misc_feature (302)..(302): n is a, c, g, or t
  misc_feature (307)..(307): n is a, c, g, or t
  misc_feature (315)..(315): n is a, c, g, or t
  misc_feature (361)..(361): n is a, c, g, or t
gagtaacttgaaaacagtatctggggcattttagatgnaagtggcaccaatgtgtaacagatgattttttttaaaaaggcagatataaagatgtaaagatgcatttattatctgtgtatattcattttccccttatgtttatggaaatttttgtaactattatttgaattattttttcatatcatgaaagtggctagagattttcanaggattttntnntntttttntgaacactgnnaatgatcatgtaaaactttnccatnactgtattnatgtagtactttacatgancnctnnatatnttatnctattccnacatatttaggtcacatttacaatataatagtatatacacttttcnatatgtttgatggtttgaattgtatttgttagtatagaacttcattttgtattattgtttgatgtttttcacacaatatattttaattactgtctcaccacttttccaactgttaccagattttcgtgtctccctaccaataaaattt

SEQ ID NO: 3070 - DNA, 221 bp, Mus musculus
  misc_feature (33)..(34): n is a, c, g, or t
  misc_feature (39)..(39): n is a, c, g, or t
  misc_feature (41)..(41): n is a, c, g, or t
  misc_feature (48)..(49): n is a, c, g, or t
  misc_feature (51)..(51): n is a, c, g, or t
  misc_feature (55)..(55): n is a, c, g, or t
  misc_feature (63)..(63): n is a, c, g, or t
  misc_feature (67)..(67): n is a, c, g, or t
  misc_feature (70)..(70): n is a, c, g, or t
  misc_feature (89)..(89): n is a, c, g, or t
  misc_feature (95)..(95): n is a, c, g, or t
  misc_feature (114)..(115): n is a, c, g, or t
  misc_feature (118)..(118): n is a, c, g, or t
  misc_feature (121)..(121): n is a, c, g, or t
  misc_feature (124)..(124): n is a, c, g, or t
  misc_feature (145)..(145): n is a, c, g, or t
  misc_feature (161)..(161): n is a, c, g, or t
  misc_feature (168)..(168): n is a, c, g, or t
  misc_feature (174)..(174): n is a, c, g, or t
  misc_feature (189)..(189): n is a, c, g, or t
gcaggcatctgtccagctaccagagagaacatnntaggnanccagatnntnccancacgtgtntttnatntggaggatgaggtgcgtancctgcncaagatcaacagggacctnnttnganttntccacgcgcatcatcacacgnccctccaagtgagacntgctggnccactnccacacaaacacttnccacggggctgtgatctagtgttttaacaaag

SEQ ID NO: 3071 - DNA, 290 bp, Mus musculus
gaaggcacgagtcagggtcaaatatgttgagcagaaagctgtagtgggtctttgatcatggtgagattcacagcgatatcaaacagttggttctcatgtaacagctaaatgtttcagattttgttttttattaaatttgacatttcacactgagatctgtattcctagcgagtagaacacagctcctgtgttcagagggattccgttccacaattgacaaatagatatttcaggacatgggccaccaagtgtactccgttcccagtgtcctcccgttctgaactgtgcag

SEQ ID NO: 3072 - DNA, 388 bp, Mus musculus
  misc_feature (298)..(298): n is a, c, g, or t
  misc_feature (310)..(310): n is a, c, g, or t
gtgtcacgtttgctaaggctgatgcctctcctacaggtaacagtggggatgaccgttggaaggcacagccaaagagcagacagaagttaaggtggccacagcacaggtcagggatccaaggagctggggaggactgctcaaaactagtctggaagcttgccttctctgctcctgctgaccatcaggtcctgtcattaccactctcaggtccgtcttatgagatgaggaatggggccctcctcaggggagagtttcagaaatgagggaaaggcaattatagatagaaagaagtatcctnccatttaaattnctgaaagagctagaatccctgggctcggtagtttgtatcttaatgtttgtgcgctagcacaggcccattggagaggaa

SEQ ID NO: 3073 - DNA, 426 bp, Mus musculus
  misc_feature (49)..(49): n is a, c, g, or t
  misc_feature (56)..(56): n is a, c, g, or t
  misc_feature (102)..(102): n is a, c, g, or t
  misc_feature (183)..(183): n is a, c, g, or t
  misc_feature (199)..(199): n is a, c, g, or t
  misc_feature (279)..(288): n is a, c, g, or t
  misc_feature (321)..(321): n is a, c, g, or t
  misc_feature (326)..(326): n is a, c, g, or t
  misc_feature (329)..(329): n is a, c, g, or t
  misc_feature (344)..(344): n is a, c, g, or t
  misc_feature (357)..(357): n is a, c, g, or t
  misc_feature (399)..(399): n is a, c, g, or t
  misc_feature (401)..(401): n is a, c, g, or t
gagcgcacacggaggttctgtgacctctggatgcctggtgggggtcagngcctcancagtctcacggaggttcctccatggtggcacacacatggcctagcngcctctgcaagaagtgaaatgtaagaacggagctcctcctgccacataggacacatcattggctgctctgaattttacttntaggacttgcaatctntccatacctattgccttaatgttgtggggaaaatccccaagccccagctgtctgcccaaaacttcgcacacagagagaannnnnnnnnntgcaggattttttttcttgttgcttgagagctnttctnatnattggagcacaaccnaaactcaagacanccttaattcagtaagatttgcacaaaaggaagcatacctatncnaactttggatcttaggcatttgatc

SEQ ID NO: 3074 - DNA, 357 bp, Mus musculus
gtattcttggacaaacgttcagcataattcaggcagggttctgggagctgaggcccagctctgaggaaccacaagagggcaaatggaaggcgcactatgactgcttgtggtataacagaaaaggatagggctggagactgcttttaaggagaggacaggaggtgcgcttacacagagaggcctggagggggagttgccaagcagatgatgcaggtgtagtctcctggcctttggacaaaatcgcctctatctggatcagctgtgcctgtttacagttctgctcattgactattgatagcccctcccagggggagtctgagatttcagctgctgcctcagccatttgtatgcagttct

SEQ ID NO: 3075 - DNA, 96 bp, Mus musculus
  misc_feature (68)..(68): n is a, c, g, or t
acaaggctgctggattttcaaggctttaaacagcatggccccctattccattatatttttttccttcntccctaatcctttgtacaggatggagca

SEQ ID NO: 3076 - DNA, 330 bp, Mus musculus
  misc_feature (80)..(80): n is a, c, g, or t
  misc_feature (84)..(84): n is a, c, g, or t
  misc_feature (198)..(199): n is a, c, g, or t
  misc_feature (202)..(202): n is a, c, g, or t
  misc_feature (238)..(238): n is a, c, g, or t
  misc_feature (276)..(276): n is a, c, g, or t
  misc_feature (282)..(282): n is a, c, g, or t
  misc_feature (288)..(288): n is a, c, g, or t
  misc_feature (304)..(304): n is a, c, g, or t
ttctaattgttttaggctggaaagcatttttgcaagtgtgaatgacatctggtttcacagcacatgctgacgtttttttntttnttttacaaaatgcttttaatgccaaagttaatctggttgctgagcagacatgacggccttgatggccctcgtaggacactttctcctgtatcatagcatagtggggtgggggtnntcnagtgtaatgaagataatttgatatgaaaatattttntacgtatatttttactttgttttctcaagtgctgttgncagttncagttnccctaggtgagatgtntcagtgctgactgtatgaatggatga

SEQ ID NO: 3077 - DNA, 492 bp, Mus musculus
  misc_feature (274)..(274): n is a, c, g, or t
  misc_feature (302)..(302): n is a, c, g, or t
  misc_feature (308)..(308): n is a, c, g, or t
  misc_feature (314)..(314): n is a, c, g, or t
  misc_feature (323)..(323): n is a, c, g, or t
  misc_feature (333)..(333): n is a, c, g, or t
  misc_feature (372)..(372): n is a, c, g, or t
  misc_feature (391)..(391): n is a, c, g, or t
  misc_feature (408)..(408): n is a, c, g, or t
  misc_feature (421)..(421): n is a, c, g, or t
  misc_feature (445)..(445): n is a, c, g, or t
  misc_feature (454)..(454): n is a, c, g, or t
  misc_feature (463)..(463): n is a, c, g, or t
  misc_feature (466)..(466): n is a, c, g, or t
ggcagagccccagaattatgaattgtgtactaaggacctaaatgtacctgcgcacctgggaggcagtgatagtcccacaggagaagcagccaatcagctcagagtgggaagtcattttcgccaaggcacccagctaagtggtcaaacaaacagaacccttttccagcagcaggtgatgaactgtttgtaacatcttcaaataagtcatagaactaaataattcatgtctttaaaaatagctaccaacttctgagttatatgaactattaatganaaaggatacttttttgatcaagttcatntactgnatatcnaacccagancctgagcatnatagacaagcactcaccactgacctacattcccaccctnagattttcaattagcttantcagaagctcaggctgnccttgaacttgcnataactttcaatattccctcaaantcataattntcctgcctntantcccagagtgctatgactacaggcat

SEQ ID NO: 3078 - DNA, 582 bp, Mus musculus
  misc_feature (88)..(89): n is a, c, g, or t
aacctagggaggatgccctggacgccccagctagggtctgacatcaggccccatgcggctcacccgctgctgggctgccctggcagcnnccatcatcctcaacctcctagtcttcttctatgtgtcatggctacaacaccagcccagaaactcccgggcccggggtccccgccggacttctgccattggcccccgagtcaccgtcctgattcgggaatttgaggcttttgacaacgcggtgccagagctagtggattcctttttgcagcaggacccagcccagcccgtggtagtggcggccgacacactcccttacccacccctggccttgcctcgcatccccaacgttcgcctggctctgctccagccagccctggaccggccagcggcggcctcgcgcccggagacctacgtagccaccgagtttgtggctctagtgcctgatggagcgcgggccgagtcaccaggccacctggagcgaatggtggaggcgctccgagggagcagcgcgcgcctagtggccgccccggtcgccaccgccaacccagcgcggtgcctagctctgaacgtcagcctgcggga

SEQ ID NO: 3079 - DNA, 568 bp, Mus musculus
gctaccatttacttatctgatctatgagtattagttgaatttagttttgttacaagattcggtgaatgtgattatacataaaatttccagcatttctcttggtacttcttcagactaaaatattcaaaagatgatctgtaggtctgaagcagttcacattttaagtattgataagtactgtttacccttccataaacatttgcttatatggtccccagtgagtgtgctttgggcagcaaatcttatatatggaacacacattctctggagtgcatctcatgagcgctctagagtgtagtttgaaaatcacctaatttgtgtttttaagaattactctgactcttttgaagtgtgcccccaagtggtaatgattcaacccagggtcttatactgctaagcaggcgctctaccactaaacccagcacagattcaccctgattttaaaggaaagcttatgttgtttaagttgtttttatttgagaaggaagccgggtgtggttatacacaactataatgaaggtggagacagcagacttatgaattcaaggccattctgggcttcaacagt

SEQ ID NO: 3080 - DNA, 129 bp, Mus musculus
  misc_feature (33)..(33): n is a, c, g, or t
  misc_feature (39)..(39): n is a, c, g, or t
  misc_feature (59)..(59): n is a, c, g, or t
  misc_feature (64)..(64): n is a, c, g, or t
cgatgcttccttctttactggacattctgatgncccagncaatgggcgcagtagagctntggtnctgtttgggggtggggtggggtggggtggggtgggggtgagtttctgtgaacttactgatgtaat

SEQ ID NO: 3081 - DNA, 119 bp, Mus musculus
  misc_feature (32)..(32): n is a, c, g, or t
  misc_feature (45)..(45): n is a, c, g, or t
  misc_feature (56)..(56): n is a, c, g, or t
  misc_feature (58)..(58): n is a, c, g, or t
caattagggttgagtcctagcccagcttcttnccttagtctgtgntcctgagtgcntntcctggggacctggccagagctgggactttggcaggaaatcacttccctgcttggcttcat

SEQ ID NO: 3082 - DNA, 526 bp, Mus musculus
  misc_feature (102)..(102): n is a, c, g, or t
  misc_feature (300)..(300): n is a, c, g, or t
  misc_feature (309)..(309): n is a, c, g, or t
  misc_feature (370)..(370): n is a, c, g, or t
  misc_feature (372)..(372): n is a, c, g, or t
  misc_feature (487)..(487): n is a, c, g, or t
tgtgtgaggacctacaaggccctgcagccagatgaactcaccttggagaagacagacatcctggcagtgaagaccaggaccagcgatggctggctggagggngtgcgcctggccgatggtgagaagggatgggtgcctcaggcccatgtggtggagatcagcagcctcagcgctcgactgcgcaacctcagagagtacaagagggtctccaacgccagcagcaagctgggggacccacctgcctgatgctctgctggggcccagctggggccactcgggtgcgggtggcctctgtgtgtntgagggccnccttcacagtcactggggggtgtcagtcctgtaaatatgctctggctgcctctgctcacantntgagctggggcctttgcaccggctgccccatcaggagggcggggctggctgttcctgctgtcactggtctccaggtgtcccgtgggcagaggggctgcctcaacctgctactttntcctccaagtagcaaagtgtcagatccaagcaggcttga

SEQ ID NO: 3083 - DNA, 417 bp, Mus musculus
  misc_feature (27)..(27): n is a, c, g, or t
  misc_feature (174)..(174): n is a, c, g, or t
  misc_feature (333)..(333): n is a, c, g, or t
  misc_feature (354)..(354): n is a, c, g, or t
ggagagacaccgttgaaagtagccaanttcgccaacgatggtgaacctcctgttaggcaaaggcacatacacttccagtgaggagagctctactgagagctcggaagaagaggacgccccgtcattcgcaccttccagctccgtcgatggcaataacacagactctgagtttgnagaaaggcctcaagcttaaggctaagaacccagagccccagaagactgtgacccccgtcaaggatgagtacgagtttgatgaggacgacgagcaggacagggtccccccggtggacgacaagcacctgctgaagaaagactacaggaaggaggctaagnccaacagcttcatttccatancccaagatggaagtgaagagctactcaaaaaacaacacgcttgcaccaaagaaggcggcccat

SEQ ID NO: 3084 - DNA, 538 bp, Mus musculus
  misc_feature (90)..(90): n is a, c, g, or t
  misc_feature (93)..(93): n is a, c, g, or t
  misc_feature (141)..(141): n is a, c, g, or t
  misc_feature (164)..(164): n is a, c, g, or t
  misc_feature (175)..(175): n is a, c, g, or t
  misc_feature (215)..(215): n is a, c, g, or t
  misc_feature (226)..(226): n is a, c, g, or t
  misc_feature (237)..(237): n is a, c, g, or t
  misc_feature (323)..(323): n is a, c, g, or t
  misc_feature (344)..(344): n is a, c, g, or t
  misc_feature (352)..(352): n is a, c, g, or t
  misc_feature (354)..(354): n is a, c, g, or t
  misc_feature (360)..(361): n is a, c, g, or t
  misc_feature (375)..(375): n is a, c, g, or t
  misc_feature (380)..(380): n is a, c, g, or t
  misc_feature (396)..(396): n is a, c, g, or t
  misc_feature (413)..(413): n is a, c, g, or t
  misc_feature (417)..(417): n is a, c, g, or t
  misc_feature (422)..(422): n is a, c, g, or t
  misc_feature (425)..(425): n is a, c, g, or t
  misc_feature (458)..(458): n is a, c, g, or t
  misc_feature (467)..(467): n is a, c, g, or t
  misc_feature (487)..(487): n is a, c, g, or t
  misc_feature (495)..(495): n is a, c, g, or t
  misc_feature (509)..(509): n is a, c, g, or t
  misc_feature (511)..(511): n is a, c, g, or t
gatggagctaaaacgggccttgagaacaagttgaaagaagacaaaaggagttctccccccaaactgggcagcatggatatactccagctntgnccatcctggagttcacaggactgccccagatcactcagccactccttnttggaactagaatggcttgcacngtgccgatccnacacttggagtcaaagcaggacatggatgcctggaatcangaccagagtanacacaacaagnccatgaagaatatgccactagatatgaaattcagcactgaaatttctagacagacattaaaattaagctacagtttaagaacattnaacaaacaacaggtgcatctncaactcantncctctnngatacaaatgacgntgagngaattgcagagatggntcagctgttaagagtantttntgatnttntagaggggttgagtttggttcccagcactggtntcagacagntcacatactataactccaantccagggntccaacatttctgntntctgtgggcacccacacttacctgctg

SEQ ID NO: 3085 - DNA, 69 bp, Mus musculus
tcgagatcaccattaattccccagaaagaactgaagaggtcctttcccctgatggctcaccttcaaatt

SEQ ID NO: 3086 - DNA, 360 bp, Mus musculus
  misc_feature (27)..(27): n is a, c, g, or t
  misc_feature (66)..(66): n is a, c, g, or t
  misc_feature (315)..(315): n is a, c, g, or t
  misc_feature (321)..(321): n is a, c, g, or t
gccttggactcctgtcaatcattgggnagggtccaccaaaagcttcattacagagtgacactgggnaaaggaggctctcctgctgttttgtcacgatatcctccaagtttatgagcagcaacacaaaggatctaccacaggtgtatggccttaacacccctcagcatactcagagaacgacaggagatcgaccaccttttacctgaaaactttggccaatgatatgacttcccttgaggctgggagcctaataccctgccgggtttcctgtggtcttcagcgtttgtgtgaaaaaacaaactggtgtctaagatncccagntctttctgatcttccacgaatccaccttttgttacttct

SEQ ID NO: 3087 - DNA, 582 bp, Mus musculus
  misc_feature (390)..(390): n is a, c, g, or t
  misc_feature (395)..(395): n is a, c, g, or t
  misc_feature (477)..(477): n is a, c, g, or t
  misc_feature (487)..(487): n is a, c, g, or t
  misc_feature (505)..(505): n is a, c, g, or t
  misc_feature (513)..(513): n is a, c, g, or t
gctgtatgtataggccctgcgtgtcctatctggaccacttgctgactgtcagtgctcactcactgtgcagggcaccaccacaggagaggtctgcatgtttggtgcatcatctggagccttcactgggatgccaggagctgcttctggccttggccttatccagagcaggaattgttatgtctgtcctgtgtgtccagcccttggcccaggggtggggtctatgtggacaaaattgagagctaaggactgtgacatgagccagagtagtggtaatgggaacagggaacgggtgtggaaggagggcaggtgggcctgccagagatggaatgtggagagaaggtgggtcccgtgggaacagggaaggtgctggggtgcagggtggtcaggagnccctnccagctcagggacacagaatcaggctcctcagactgcagaaagaccgtcctctcacttcttagactgcacacttcttgcccntgggatgtantccaggctagactcactnccatcccncttcagcctcccaaatgctgggattatgggcatgcaccatcatgttctgcttgtgcactgggtcttaat

SEQ ID NO: 3088 - DNA, 389 bp, Mus musculus
  misc_feature (89)..(89): n is a, c, g, or t
  misc_feature (92)..(92): n is a, c, g, or t
  misc_feature (97)..(97): n is a, c, g, or t
  misc_feature (108)..(108): n is a, c, g, or t
  misc_feature (113)..(113): n is a, c, g, or t
  misc_feature (120)..(120): n is a, c, g, or t
  misc_feature (123)..(123): n is a, c, g, or t
  misc_feature (129)..(129): n is a, c, g, or t
  misc_feature (133)..(133): n is a, c, g, or t
  misc_feature (142)..(142): n is a, c, g, or t
  misc_feature (144)..(144): n is a, c, g, or t
  misc_feature (160)..(160): n is a, c, g, or t
  misc_feature (186)..(186): n is a, c, g, or t
  misc_feature (194)..(194): n is a, c, g, or t
  misc_feature (196)..(196): n is a, c, g, or t
  misc_feature (206)..(206): n is a, c, g, or t
  misc_feature (221)..(221): n is a, c, g, or t
  misc_feature (227)..(227): n is a, c, g, or t
  misc_feature (250)..(250): n is a, c, g, or t
  misc_feature (255)..(255): n is a, c, g, or t
  misc_feature (271)..(271): n is a, c, g, or t
  misc_feature (275)..(275): n is a, c, g, or t
  misc_feature (283)..(283): n is a, c, g, or t
  misc_feature (306)..(306): n is a, c, g, or t
  misc_feature (320)..(320): n is a, c, g, or t
  misc_feature (325)..(325): n is a, c, g, or t
tcaagctgagactctttctccatgaacaatgtgcagagtgattgaggaaaactttcagcatcaactttggaagtctatatgcacacacntgnacatncacatctgcanacatntgcaacnacnacaacnacanacacacacncncacatcttttaaaatnccctttgggaaggctgaggacatggnccaatgancncacacataanacccagacgtggcancatgtncctgtaactccagtactggggancaagntccaggaactccctgnccanccagatanccaaattggcaaggtttttgttnagggagagaccctntctcnaaaaaggaaagtgaagaataactaaggaagatacctgagggacaacctttgacctaaacacaca

SEQ ID NO: 3089 - DNA, 67 bp, Mus musculus
gttttacctggttgaatctaacattcatggaattcctcagaattctttggctggttcttaagtatga

SEQ ID NO: 3090 - DNA, 63 bp, Mus musculus
tctgagggcaattacatgctgacgtgctctgccacagggggcctcatctacaagctgggcagt

SEQ ID NO: 3091 - DNA, 531 bp, Mus musculus
  misc_feature (137)..(137): n is a, c, g, or t
  misc_feature (375)..(375): n is a, c, g, or t
  misc_feature (390)..(390): n is a, c, g, or t
catttggactagaagcaactgctgttagttatttggaaatggaatcagcattcaagtagatgttgtgctgttgattggatagggctccttgggaagttcctgtgagacctttgcaggggcttttcatcagccttgcntgtttgttcagtaggaaactagctatgctttactccaagagaatgtttggaccccaataagcataggatgctagagagtttcacttgaacatttgctataaatcgaatgactgtaaaatattatttcatgaacttgtaaatgtgtgatgggtgcctttgttattttgagatgagttctcagtttttttactctgttctttcaaggtcacgtcaacagggatgagatggaggggagtgnctatgtttcacattntcctttgtctctatatgttatttagtaaagtctgtattgtacagagctcctccccccagactggctctacccctccagattatcttgtattgttaatttaaaaatgaagaaattaagttttaccttagaatcttctcaaca

SEQ ID NO: 3092 - DNA, 299 bp, Mus musculus
atgtggcaccaagctactaccctagttggcaatgggactccgccttgcaggaaagccatgagcatttaccacagatctatctgcacaggtgcaggactggagtctgcacagcacctctgaaagccactggttgaggtacctacctgtagggagagggtgtcatttcttgctagtctgatgtgctaaacaagtacaaatgtggaacccttgtctaaatttccaagagtgagaagctaggggcacagacaggaagagcgagtgagaatcctgaggtacatctgctgcatctgctttaggag

SEQ ID NO: 3093 - DNA, 547 bp, Mus musculus
  misc_feature (27)..(27): n is a, c, g, or t
  misc_feature (30)..(30): n is a, c, g, or t
  misc_feature (423)..(423): n is a, c, g, or t
gtcttactgagactccgacttctaatnagntgttgaaggacacattcctggtgccccgcttagcctgtaggttacatacagggaatgagtgggttttatttctttggagcaaagtctatcaactggctcagctctctctcgttctcctgaagccatctcaaacattttaaaatttaaggaggggctttaaactttttcaagtgctttcaactttgctgttaattggcatgggtttgctgaggggccaggaggtccctttgacaaagtaagatgccatacacagtgtttgcttaataactgaaggtctcaatacagctgttactgaacctttatagacaattccttttcttattataagtagaatgagtgactgtatattaatatattctcataattatatcttgaaaaacaaaattttgtctnacctataagctactgtattatgttatgcacgacatttcctcttaaagggttatcttttttctattatttattcatatttttctctatttaatctatgatgacactgactgttactttagctgtt

SEQ ID NO: 3094 - DNA, 510 bp, Mus musculus
  misc_feature (275)..(275): n is a, c, g, or t
  misc_feature (281)..(281): n is a, c, g, or t
  misc_feature (345)..(345): n is a, c, g, or t
  misc_feature (350)..(350): n is a, c, g, or t
  misc_feature (357)..(357): n is a, c, g, or t
  misc_feature (366)..(366): n is a, c, g, or t
  misc_feature (390)..(390): n is a, c, g, or t
  misc_feature (393)..(393): n is a, c, g, or t
  misc_feature (420)..(420): n is a, c, g, or t
  misc_feature (425)..(425): n is a, c, g, or t
  misc_feature (433)..(433): n is a, c, g, or t
gtgcaatgctggactgtgtcacacacagtgtcaggattcccagccagctgttgagagtgcttgtggtgcttcacctcagccacccttccttcctgggtatgattcaggcttcttgactgaagctgagaaaccaggcttatccagccccagcttgtgtcttctcatctagagaaaaagagaagagcattaaggagctcatgaggaaccctaagtggttcctaaggtctccttgggtgttcggtattttgtttgtgatttgaatgtgtgcaagaatngcctgnctttaactgtgtattttataggagtgggaggtggctggggcactggaagtgaagggagactganttatnttttgtnttgttgttntttttgttgttttcgtttctgttnctntcttaatgggtaactttctcccgtttnccctntcagctgntctgacggatttaagaattttcattcttaaaagacattggatttcaaagtttgaattctagattaggaccttttcta

SEQ ID NO: 3095 - DNA, 298 bp, Mus musculus
  misc_feature (240)..(240): n is a, c, g, or t
  misc_feature (243)..(243): n is a, c, g, or t
acggtgctcccggaccttgcagggtttcgtggaccctgcagaagttggatctgtcatccaaccggaagctgaagatggctagtcctgggtcctccagggtctccaggtggagattctggaactgacaagaacaccactggatgctgtgtggctgaagggcctgggacttcagaaactcgatgtcttgtatgaacagactgccagggccgagcctgggtgctgaggctgttgcccactttnganctgcagggcttgattgtgaaagaaagcaagataggatctatatctcaggaggctc

SEQ ID NO: 3096 - DNA, 188 bp, Mus musculus
  misc_feature (29)..(29): n is a, c, g, or t
  misc_feature (32)..(32): n is a, c, g, or t
  misc_feature (37)..(37): n is a, c, g, or t
  misc_feature (47)..(47): n is a, c, g, or t
  misc_feature (63)..(63): n is a, c, g, or t
  misc_feature (96)..(96): n is a, c, g, or t
  misc_feature (121)..(121): n is a, c, g, or t
  misc_feature (147)..(147): n is a, c, g, or t
acatatctcttgtatatttacactttatnctntcctnctctatttanatgctagggacgtagntccttggaatggaggaacataatatatataatntctggacttttcagggtagtttttnttctttgagtaataatatgtttatgntccaaagaatcacaacttggcatccattccctttttataat

SEQ ID NO: 3097 - DNA, 51 bp, Mus musculus
gtgaacccttcctggtatgaggcaaagttttgatcgatctccatccttgcc

SEQ ID NO: 3098 - DNA, 398 bp, Mus musculus
  misc_feature (256)..(256): n is a, c, g, or t
  misc_feature (265)..(266): n is a, c, g, or t
  misc_feature (270)..(270): n is a, c, g, or t
  misc_feature (278)..(278): n is a, c, g, or t
  misc_feature (280)..(280): n is a, c, g, or t
  misc_feature (285)..(285): n is a, c, g, or t
  misc_feature (291)..(291): n is a, c, g, or t
  misc_feature (300)..(300): n is a, c, g, or t
  misc_feature (303)..(303): n is a, c, g, or t
  misc_feature (305)..(305): n is a, c, g, or t
  misc_feature (318)..(319): n is a, c, g, or t
  misc_feature (321)..(321): n is a, c, g, or t
  misc_feature (325)..(325): n is a, c, g, or t
  misc_feature (331)..(331): n is a, c, g, or t
gagcttttgagattactttactctcagtgtactcatcttcgagaaaagttgaatggccatctttatgatgtaccctggcactgtatgagaacagataaaaggaaaaagactgataggacttgagacttgtggttattctcctctagtagatattaacttctatctgacttctcatctgtacaatgttaaacaagtaaagtattcaaataggactcatagaaggtaagtcctaacaaacaaatgcgctcttgtcacnttgttcagnnagtntacagctntnttctntatttnacattcctnttntnttcttttcttggnnanaacnatagtntcttattttgtcttttgtacaggttgtgttaggcttgtatatggtagtccgtccatgcttggtattt

SEQ ID NO: 3099 - DNA, 492 bp, Mus musculus
  misc_feature (209)..(209): n is a, c, g, or t
  misc_feature (211)..(211): n is a, c, g, or t
  misc_feature (237)..(237): n is a, c, g, or t
  misc_feature (243)..(243): n is a, c, g, or t
  misc_feature (250)..(250): n is a, c, g, or t
  misc_feature (255)..(255): n is a, c, g, or t
  misc_feature (302)..(303): n is a, c, g, or t
  misc_feature (307)..(307): n is a, c, g, or t
  misc_feature (311)..(312): n is a, c, g, or t
  misc_feature (322)..(322): n is a, c, g, or t
  misc_feature (325)..(326): n is a, c, g, or t
  misc_feature (344)..(344): n is a, c, g, or t
  misc_feature (353)..(353): n is a, c, g, or t
  misc_feature (389)..(390): n is a, c, g, or t
  misc_feature (421)..(421): n is a, c, g, or t
  misc_feature (429)..(429): n is a, c, g, or t
  misc_feature (452)..(452): n is a, c, g, or t
cacagttgtgtttcatggcatgacagagtccatccaatctcccttcccatcagagttttgctaataggcttaactcttatttgtggactaatagtaggatcttgccctcagcaaacgctttctgcttttaaattaagagagtcccaattgtcttttttttttctgcctcccccccactttatcttgacgggatggattttatatatatnanagaaatatttatttaactattctatnagaatnatcgagntgccntgctaagacctttaagcatccctccttccttattgcgtggtatagannagcngggnngagtgagagncgnntcactcgggaagctgcanccacacggncctgttggaatgagtgacctccttaaaggtatcagnntcctcatcccttgactggtgaggaaaaagtnccttcctnccggccacggactgacatggagntcttcggatgagcccggatgcccatgttcttactgtattt

SEQ ID NO: 3100 - DNA, 356 bp, Mus musculus
  misc_feature (48)..(48): n is a, c, g, or t
  misc_feature (109)..(109): n is a, c, g, or t
  misc_feature (136)..(136): n is a, c, g, or t
  misc_feature (151)..(151): n is a, c, g, or t
  misc_feature (174)..(174): n is a, c, g, or t
  misc_feature (178)..(178): n is a, c, g, or t
  misc_feature (184)..(184): n is a, c, g, or t
  misc_feature (216)..(216): n is a, c, g, or t
  misc_feature (223)..(223): n is a, c, g, or t
  misc_feature (244)..(244): n is a, c, g, or t
  misc_feature (246)..(246): n is a, c, g, or t
  misc_feature (275)..(275): n is a, c, g, or t
  misc_feature (306)..(306): n is a, c, g, or t
  misc_feature (316)..(316): n is a, c, g, or t
gctggtctctgagccggtgactgtctcattgagcccagccaccggggntcccacagttccggctcccacagttgcctatcccatgaagccgaacgactacatgtcggtntcaggaggatccgccatagccctcatngtagcggccaccatnggaggattagtcctgatcggatntgtntgcttntatatactgctggcacttaagaaataaggaangtgcagntaagccatgagctcatgaatntntacccgaagccgatcccaggacaggagtntcaggacaggaagacatggcccttgtcaagntccacctccntcccatttgtgcccaagatgtccccagctaaataaagcct

SEQ ID NO: 3101 - DNA, 481 bp, Mus musculus
  misc_feature (75)..(75): n is a, c, g, or t
  misc_feature (82)..(82): n is a, c, g, or t
  misc_feature (93)..(93): n is a, c, g, or t
  misc_feature (100)..(100): n is a, c, g, or t
  misc_feature (117)..(117): n is a, c, g, or t
  misc_feature (143)..(143): n is a, c, g, or t
  misc_feature (152)..(152): n is a, c, g, or t
  misc_feature (163)..(163): n is a, c, g, or t
  misc_feature (165)..(165): n is a, c, g, or t
  misc_feature (263)..(263): n is a, c, g, or t
  misc_feature (286)..(287): n is a, c, g, or t
  misc_feature (297)..(297): n is a, c, g, or t
  misc_feature (333)..(333): n is a, c, g, or t
  misc_feature (346)..(346): n is a, c, g, or t
  misc_feature (370)..(370): n is a, c, g, or t
  misc_feature (378)..(378): n is a, c, g, or t
  misc_feature (404)..(404): n is a, c, g, or t
  misc_feature (407)..(407): n is a, c, g, or t
  misc_feature (413)..(413): n is a, c, g, or t
ttctctgcagatcatggggcccttggttgtgcttgtgggactgtgtttctttgtggtggcccatgttaagaaganaacaacntgagttcaagnccgaganacctctgaggtcgaagngtggacacgcccacagcacggagccngtccacatncactgtaggtnantcagtgataatcttcccgccccctccaccaccttactttcctgagtcttcagcagcggctccatcccctggggctaacagcctgcaccagattgaaancccaccttcctattccagccttnntaactacggncaggaccccaactcctgagaaccagggagcagcctntgagagagaacangagctcatatacaccatttctggncagggttnatcctcggagagatcatacactgganatnttcctntggacctgccccctagatatgaagaaaaagaaactgccccagccacacccttgggtgccccttctgat

SEQ ID NO: 3102 - DNA, 510 bp, Mus musculus
tatttctggatctcctgttgtgtcttgcatttcataagttattggtactgccaccatcatattcttgctaggggtatctgaccttgtctgcttgtttattcttgtattggtacgacaggtgacccaaccttggaccttgcctgagtgataaaggtactctgtaactgagctacagcccagaatagttacgcatttggttttccgagacagggtttctcggtgtggccctcattgtcctggaacttggtagatagaccaggctggcgtcagactcccagagatccaagtgctgggattaaagatgtgagcccacacacccagcattttaatcctattagccaggcatggtaaagcacacacacctttagtgggaacactcagtaagtaggcagaggcagaggtggtctacagagcaagttccatgatagctagagttacacaacagagggtcctgttcccaccccgttctattagcaaatgcatctgttagggcaaggtacctgccattca

SEQ ID NO: 3103 - DNA, 468 bp, Mus musculus
  misc_feature (87)..(87): n is a, c, g, or t
  misc_feature (99)..(99): n is a, c, g, or t
  misc_feature (115)..(115): n is a, c, g, or t
  misc_feature (146)..(146): n is a, c, g, or t
gatctcctcaacaatcacagctatgcattcttacagccatttctgaaacccaatttaagctccttttctcactgaacttcatgcttntgaaacatattntactcctcctcactgnaattctggctgatagcaatgaccagtagccnatggcacagacggactgttatggccttcaaaattcctctgccaaagagtctagtccctgccttttgaattcagccccaggcaaattatcagggcaggcaaatgtggcaaggttatttgccagcatgtcagatgaacggcctttagcccagtccccagaagagtccagttaatttatggaatagtttgtatttgaggagttttgaagaattggtgcaagtttctcagaaaaggtgatgtcagagccaggcttgatcatgtgaactggctctaacagaattccctggactgacataaattaatgtctcatagttccggttccaa

SEQ ID NO: 3104 - DNA, 472 bp, Mus musculus
  misc_feature (243)..(243): n is a, c, g, or t
tgtggtgtttcctgtcttgagtaaatactgacttttgctagtaggaaacctggactggggcatccagtctagccttttctttgagcttgatcctccaaggattattttcaagatgacaggtgacttagtgcctgggacatagtgagggtgtgtgtgtgtgggaaactgatgactgtctcattcatagaatttagtcatttttgcttccacgtgtgcttgataatttcccttttagacttcacngggggggggtgaggatgtatccatgtcttttatctatggaactaggttggacaaagacagagctttctcctttggcagaaacagaaaggcttggacagatctagctaagcattgcctacttcgatagagaacactatgaattgacttcccagaacttgctaagactgttctctttggttgtttgaggaagctgagtttgttggagacctttgcctcaattatgacatga

SEQ ID NO: 3105 - DNA, 518 bp, Mus musculus
  misc_feature (226)..(226): n is a, c, g, or t
  misc_feature (250)..(250): n is a, c, g, or t
  misc_feature (328)..(328): n is a, c, g, or t
  misc_feature (363)..(363): n is a, c, g, or t
  misc_feature (444)..(444): n is a, c, g, or t
  misc_feature (484)..(484): n is a, c, g, or t
ggtatttggccaaaggaggcttatttttagtttttggctttaacctttctgtgatctaggaagtatgtttttagtttccaagtggaactttggaaaaatgtgtattcctagtctatgattatttcatttgttgttataaaatccacgtagtttagtaagtggttctgcttgtctttctttgaatggagattccgagaaatcctgccacattaagtcctgagaggcncactacaggagggcaacaagcttntggctaaaccagaggaaccccccccccccaagtctaacgaaacgttcctgtcgaagattggaaagacttgctttgctnttctggatgcatagaaagttttacttcaaatattnattctaggttaagtactttaaggattttttttctttaaaacaatgtattatatcaaacaatgaaacaactcaacatgtatntccctaatggtgagaaatatttggaaagattaatttctcnaaacacctgatcagcacacagctaatgtatattt

SEQ ID NO: 3106 - DNA, 479 bp, Mus musculus
  misc_feature (183)..(183): n is a, c, g, or t
  misc_feature (192)..(192): n is a, c, g, or t
  misc_feature (202)..(202): n is a, c, g, or t
  misc_feature (228)..(228): n is a, c, g, or t
  misc_feature (232)..(232): n is a, c, g, or t
  misc_feature (272)..(272): n is a, c, g, or t
  misc_feature (277)..(277): n is a, c, g, or t
  misc_feature (281)..(282): n is a, c, g, or t
  misc_feature (307)..(307): n is a, c, g, or t
  misc_feature (330)..(330): n is a, c, g, or t
  misc_feature (350)..(350): n is a, c, g, or t
  misc_feature (352)..(353): n is a, c, g, or t
  misc_feature (356)..(356): n is a, c, g, or t
  misc_feature (444)..(444): n is a, c, g, or t
  misc_feature (454)..(454): n is a, c, g, or t
gagctcaaggacagaagcagccacatgctttggtcacccttctgtaacttcaattagtacaaaggaaccttttccatgaactacctgctgttttctgatgacctctgggatcttttcatttacccctaaacaaagaaacgaatatgacaaaacaaaaacaaaaaaacaacccacaactaaganttcattcantcacagagtnatcttctgaggccaaaagtccatctnaatncaatgaagatttgctttcattaaagacagaggtgaggacnaaatntgcnngtggaagttatgacactctagaaancaacaaatgtggatcactgaccnaaacaattatgtacttgatncnnatncagattgcgtattgttatatatatagtacattgcgtttttgttttccccatctttttggtggtgagttcatgttgttagaagtacatntcttgtatgntcttaatctctgttgtgtactattt

SEQ ID NO: 3107 - DNA, 260 bp, Mus musculus
  misc_feature (86)..(86): n is a, c, g, or t
  misc_feature (91)..(92): n is a, c, g, or t
  misc_feature (99)..(99): n is a, c, g, or t
  misc_feature (103)..(106): n is a, c, g, or t
  misc_feature (114)..(114): n is a, c, g, or t
  misc_feature (118)..(120): n is a, c, g, or t
  misc_feature (124)..(125): n is a, c, g, or t
  misc_feature (127)..(128): n is a, c, g, or t
  misc_feature (136)..(136): n is a, c, g, or t
  misc_feature (148)..(148): n is a, c, g, or t
  misc_feature (150)..(150): n is a, c, g, or t
  misc_feature (153)..(154): n is a, c, g, or t
  misc_feature (156)..(156): n is a, c, g, or t
  misc_feature (159)..(159): n is a, c, g, or t
  misc_feature (165)..(165): n is a, c, g, or t
  misc_feature (172)..(172): n is a, c, g, or t
  misc_feature (183)..(183): n is a, c, g, or t
  misc_feature (186)..(186): n is a, c, g, or t
  misc_feature (192)..(192): n is a, c, g, or t
  misc_feature (196)..(196): n is a, c, g, or t
  misc_feature (224)..(224): n is a, c, g, or t
tacttgttcctaaatgaaaaccaggacagatgaactatctttacttggtagattcttcctcaggttgcccgagcctggattcattngtctnntaatttncccnnnnttctcatnttannnccanntnnagaaggcnagagggataganantanntnatntctttntaacatnagctaaataanacnaaatcnaacnatataattattatgaactacccagaccnaggtatttaatgaatggcatcaatgaagtatggaaa

SEQ ID NO: 3108 - DNA, 494 bp, Mus musculus
  misc_feature (271)..(271): n is a, c, g, or t
gtgatattcctgcagtttttatctaataacattgtgggaaaggtttgggagggttacaagagcataaataaatgtagcaaaattactttctaacctgcctagaccctaggcccttcttagaaggttctgtcccctttgagacttcattttgtcatctaccacatctgtcaccagaagccaggtctgagggtcttcttcagcgccattgagagtttcccatatagacattttatatatgtgagcaagtattttcatttctggaaaaaaaagntgttaaatttttttttaaaagaaacttatgtttctatttgaaatccaactaggatctaatgtttggtacaaaactccagaaatggtattttcataaagtcacaagttttcattcccagaggtcaaaatatcatttgtgggttctgagtgggtcttaaagtactttaaccctagttttataaatggggagaagtttttaaacattctttcttggctacaaccta

SEQ ID NO: 3109 - DNA, 416 bp, Mus musculus
  misc_feature (30)..(30): n is a, c, g, or t
  misc_feature (95)..(95): n is a, c, g, or t
  misc_feature (125)..(125): n is a, c, g, or t
  misc_feature (140)..(140): n is a, c, g, or t
  misc_feature (176)..(176): n is a, c, g, or t
  misc_feature (186)..(186): n is a, c, g, or t
  misc_feature (188)..(188): n is a, c, g, or t
  misc_feature (194)..(194): n is a, c, g, or t
  misc_feature (196)..(196): n is a, c, g, or t
  misc_feature (202)..(202): n is a, c, g, or t
  misc_feature (209)..(209): n is a, c, g, or t
  misc_feature (223)..(223): n is a, c, g, or t
  misc_feature (225)..(225): n is a, c, g, or t
  misc_feature (253)..(253): n is a, c, g, or t
  misc_feature (261)..(261): n is a, c, g, or t
  misc_feature (269)..(269): n is a, c, g, or t
  misc_feature (288)..(288): n is a, c, g, or t
  misc_feature (300)..(300): n is a, c, g, or t
  misc_feature (326)..(326): n is a, c, g, or t
  misc_feature (332)..(332): n is a, c, g, or t
  misc_feature (347)..(348): n is a, c, g, or t
  misc_feature (359)..(360): n is a, c, g, or t
  misc_feature (368)..(368): n is a, c, g, or t
agtgcacacatctcactagtctatctcttnatggacagcctccctcagtctcactctctgtcaggcatcattcatttctccagccaggaaacagnagattcctactatgctatccctggcttganctacagctgtatatnacctccaatctgaaactaactcagaaggaggttatnggactcacantnttcccnanggggtngtataancaagaaccagttcntnagggagagatgactccctggtagcactncctgcaancagtatancaaacttcagggattcagntccttcaaggcntcacccatgttgggttgctttgttantgactnagctagctgactatnncaaccataatnngaaaagcncaataataatttctctcccattcactgggcttgaaatcacttcagaga

SEQ ID NO: 3110 - DNA, 529 bp, Mus musculus
  misc_feature (285)..(285): n is a, c, g, or t
  misc_feature (290)..(290): n is a, c, g, or t
  misc_feature (294)..(294): n is a, c, g, or t
  misc_feature (296)..(296): n is a, c, g, or t
  misc_feature (303)..(303): n is a, c, g, or t
  misc_feature (316)..(316): n is a, c, g, or t
  misc_feature (332)..(332): n is a, c, g, or t
  misc_feature (336)..(336): n is a, c, g, or t
  misc_feature (360)..(360): n is a, c, g, or t
  misc_feature (416)..(416): n is a, c, g, or t
  misc_feature (447)..(447): n is a, c, g, or t
  misc_feature (464)..(464): n is a, c, g, or t
  misc_feature (474)..(474): n is a, c, g, or t
  misc_feature (492)..(492): n is a, c, g, or t
gaatgcgagttgctcaaggtcataaggcttgcacctagggtctcttgttcttcccatttaccaggattgtattatgtgtttggcaaatcacttcataatcccctttaggaaataagtccacagaatcagcatgtaacatctgatagctttgttacatgtcattcagagtgttgaaattctgaagttaaaggggcatttaaggattgtttcatctaatcttaaaacagcctgtcatggtccttgatttcccaaggtcagagagatccagggcccctagttagagtntagantttntnattcacntagatggaactgncctcacccttagaagntcanatctgggccagaagacatgagttnttccaggtagaagagttctgtgatgttgcagtctcacatgattcataaccatcttncctcctgggaagaggatgcaagcaaattgcngctttagaaaagacctntcagttccantcaccgtggtggtacacntcctaaatcccagctcttgggaggctctgtgatttca

SEQ ID NO: 3111 - DNA, 525 bp, Mus musculus
  misc_feature (99)..(99): n is a, c, g, or t
  misc_feature (127)..(127): n is a, c, g, or t
  misc_feature (133)..(133): n is a, c, g, or t
  misc_feature (153)..(153): n is a, c, g, or t
  misc_feature (160)..(160): n is a, c, g, or t
  misc_feature (171)..(171): n is a, c, g, or t
  misc_feature (211)..(211): n is a, c, g, or t
  misc_feature (218)..(218): n is a, c, g, or t
  misc_feature (287)..(287): n is a, c, g, or t
  misc_feature (297)..(297): n is a, c, g, or t
  misc_feature (333)..(333): n is a, c, g, or t
  misc_feature (373)..(373): n is a, c, g, or t
  misc_feature (386)..(386): n is a, c, g, or t
  misc_feature (395)..(395): n is a, c, g, or t
  misc_feature (402)..(402): n is a, c, g, or t
  misc_feature (408)..(408): n is a, c, g, or t
  misc_feature (417)..(417): n is a, c, g, or t
  misc_feature (451)..(451): n is a, c, g, or t
  misc_feature (480)..(480): n is a, c, g, or t
  misc_feature (492)..(492): n is a, c, g, or t
tggccccgggagtgggatcaatgcaaaagcaagaggaatttattgttccagtgccctggggttgtcccagatcaacagtgctggcagcgacccccagcnccttttcagtgagtttttatacggtttntagggncagaatagagcatcagcaanctaggcncaatatgattnatggaacagtgcaccctttaaactgattggtctttaaggnatgaggngacaaggacttccgttgtctgatggtggaggtcctgtggagtgtgtccccacacacaggtcagttcctntcctttagtntgagaaatgttaattagcctctcccttccagagggngacgtattccatgaccttcccaaagttcttgagctgaccnattcagttaaatnaaacagacnttatttntaattntccacatantcacagatcccagaaaacagaggtgaaattggtntcttaaactgacagtgcaccgaatcattncaaaccttcaanttctttgtaagtttgcttagagcatgatgtcat

SEQ ID NO: 3112 - DNA, 54 bp, Mus musculus
ggatccgaatctttcttaacataaggctcttatactcctccgaccctgagagtg

SEQ ID NO: 3113 - DNA, 477 bp, Mus musculus
  misc_feature (129)..(129): n is a, c, g, or t
  misc_feature (218)..(218): n is a, c, g, or t
  misc_feature (220)..(220): n is a, c, g, or t
  misc_feature (222)..(222): n is a, c, g, or t
  misc_feature (225)..(225): n is a, c, g, or t
  misc_feature (229)..(229): n is a, c, g, or t
  misc_feature (233)..(233): n is a, c, g, or t
  misc_feature (238)..(238): n is a, c, g, or t
  misc_feature (254)..(254): n is a, c, g, or t
  misc_feature (260)..(260): n is a, c, g, or t
  misc_feature (274)..(274): n is a, c, g, or t
  misc_feature (295)..(296): n is a, c, g, or t
  misc_feature (357)..(357): n is a, c, g, or t
  misc_feature (385)..(385): n is a, c, g, or t
  misc_feature (387)..(387): n is a, c, g, or t
  misc_feature (436)..(436): n is a, c, g, or t
  misc_feature (439)..(439): n is a, c, g, or t
tgaagttctctgataaagttctgaattaatgaacctggacaaaagaaaacttggcagaatagtttcttgtcttgagttatgataacactaaatcggtgaccatcctccatcctcccgttcctaagaaancaaagaatgaaaactcagctgtgagaagcagagtaagtgtattgcaaataggaatggagacatctgaagacagaatgagagcagagggnancnctncctnaccnccatntccgaatcaagggganctgttntcaaaagctgaatntcgcaatagactgtagaaacnntcatgggtgcatgctcatagttgaggttcctgtatccattttgggaattcagtgtttatanaataggtggaagacacctataaccccancnaactgaaggctgaggcaggaggataaggatcactgagggttcaagactnttnctgggcaacatagtgagatcttatctgtttcaccacca

SEQ ID NO: 3114 - DNA, 527 bp, Mus musculus
tttcttctttaagcaaccactccggttacttctctcctgtcttcccttcaatcccgccctctttccagcccagtccggtgaggtcagctcatgaataccgctgcacttcctggggaagagtctggcactgcttggcaccccgggtattgcctgctgcatttgcagcccagccagccaagcaccgccggctaggagtcaactcccagagctctaagtctttgtggttgtcgcctttgttcggagaaacagagtgggtgtggatcccgtgcaagcaagcgcgcccagaagaaattcgcctataacactacggaagctgggaagttgaactttctctgaaaggtagaaaaataaagtcggaggtctccggcttcctggaagcaaaagccactgcagagaagtgagatcttctggatttctaaagacacgaagagaaacgggcttacacaggaaggttggtgacagaaaggagagaagaggatgatctagagatggacgcttccaagtggcatccagtaggttctttctag

SEQ ID NO: 3115 - DNA, 424 bp, Mus musculus
gaagccaaggtactcatctcctaatgttctgtggcgtgtccagcagggctgccgttccgccgtgctctggggcgggctgctcggcctggactgcttggctggtctccatcgttaagcactcagttaagcactcagttaagcactcagtgcttccttagcctctaagcacagccacttgattttgaaaattaggaagaaaccacaacatctgggcctttattacttttagatcttactcagtcttcctgttgtaatgcggagatatttaagtcaaaaaaaaaaggggctgtagagatggtgcagtggttggggcactggctgctctatcagagtcaattcccagcatccacacactttaccacatcctgtaactccattgccaggggatctgacacccttgtctccatgaggacacacacatttc

SEQ ID NO: 3116 - DNA, 469 bp, Mus musculus
  misc_feature (26)..(26): n is a, c, g, or t
  misc_feature (99)..(99): n is a, c, g, or t
  misc_feature (263)..(263): n is a, c, g, or t
  misc_feature (314)..(314): n is a, c, g, or t
  misc_feature (378)..(378): n is a, c, g, or t
tttcttcatcgaccctgctgggaaantttgtgtaagaattcccgtggtgacttcattaggctgtgttcagagggaggagaaaataactagctaaaatanggtttccactacaaattaggaatttcttttctatttaaaagttgaactcaaaacaaatttccccggatcttccgattctgccccggatgccagaagagatctctgcctggctggtacacaccgcccagatgacactcctatccctgatttttgtttttccaatntcttgtttcttccaccttcggaaggagaaatgtgaaactcgtcatggccgncccacacgggcttgtggccccagccggctggcccgaaatcccgtgacctggtggttgagtaatntctttcggggaccaaattttctagagggaactagagcacttttgttgtgtttgtacgtgtgtgagggcgtcccttgtcaattcccaaataa

SEQ ID NO: 3117 - DNA, 376 bp, Mus musculus
  misc_feature (115)..(115): n is a, c, g, or t
  misc_feature (119)..(119): n is a, c, g, or t
  misc_feature (164)..(164): n is a, c, g, or t
  misc_feature (351)..(351): n is a, c, g, or t
gtatctattctgtccataaagtctaactcatttttacacatttttacaaagacactgtcatattggtgtttcatataggctacctcaaatctatctgaaataagaggtaagagtnattnatttacaacttactcattatcttaaaaatgttaccaaaggttggnaaactcatgttatttcttctgctttccattctttctggttctttcattcttctccatttttgattgtttggtcatttcttattacaatcttttaatttatgtattacaaatacattttttccttaacaaaattttatgaggaaagtttcattttgtgtttataaaccatatatacatatatacgtancaagtttttctaatctcaatgagaa

SEQ ID NO: 3118 - DNA, 474 bp, Mus musculus
  misc_feature (52)..(52): n is a, c, g, or t
  misc_feature (75)..(75): n is a, c, g, or t
  misc_feature (117)..(117): n is a, c, g, or t
  misc_feature (159)..(159): n is a, c, g, or t
gaactttaccagaccagtgtggacttccaccttgatggcatcagttctgagnaatgtccattcttcatcttcccngctaacctattaccatactatctcaccatcaagtcctctagntaccctgctccaacatgagactcctccacactttgaattagnttgtgttcctctcagcaatgcaagaaggcactggggaaatctgccaaaggaggacatcctacctgccctctgagatcatgttacatcaccgatttgcagctctaatgactcgaggttccaaaggtgagtatcaagtcaagatggagaattttgacaagactgttcctgaacatccaacacctgtggtctctaagagtccacacaggactgacctagatattcatatcaatggacaaagcattgacaatttccagattgctgaaacagggctgacagaataagactcatctacaccgtcctacttcttaatgtatt

SEQ ID NO: 3119 - DNA, 559 bp, Mus musculus
  misc_feature (53)..(53): n is a, c, g, or t
  misc_feature (145)..(145): n is a, c, g, or t
  misc_feature (152)..(152): n is a, c, g, or t
  misc_feature (166)..(166): n is a, c, g, or t
  misc_feature (171)..(171): n is a, c, g, or t
  misc_feature (174)..(174): n is a, c, g, or t
  misc_feature (177)..(177): n is a, c, g, or t
  misc_feature (181)..(181): n is a, c, g, or t
  misc_feature (183)..(183): n is a, c, g, or t
  misc_feature (186)..(186): n is a, c, g, or t
  misc_feature (192)..(192): n is a, c, g, or t
  misc_feature (195)..(195): n is a, c, g, or t
  misc_feature (200)..(200): n is a, c, g, or t
  misc_feature (207)..(207): n is a, c, g, or t
  misc_feature (209)..(209): n is a, c, g, or t
  misc_feature (280)..(280): n is a, c, g, or t
  misc_feature (287)..(287): n is a, c, g, or t
  misc_feature (295)..(295): n is a, c, g, or t
  misc_feature (305)..(305): n is a, c, g, or t
  misc_feature (309)..(309): n is a, c, g, or t
  misc_feature (319)..(319): n is a, c, g, or t
  misc_feature (348)..(348): n is a, c, g, or t
  misc_feature (380)..(380): n is a, c, g, or t
  misc_feature (390)..(390): n is a, c, g, or t
  misc_feature (477)..(477): n is a, c, g, or t
  misc_feature (492)..(492): n is a, c, g, or t
tggatgtcctgtctccttggtgctcggtttccaccaggatgctgcgtgcaggnttgcttgcagcatctggagtcacataatcatccaggcgagccactgtgggcattctctggcgtggcaagaggtctgctaaatcagttgtttntgccctnatcctcacgccttncctanttnctnttcntnttnttctangtntaacntttgtanantgcctcacggggagcacggtcagagcacatttaaaggtttttgcataggagggaaactgcacaaatcagtnctccccntggtcaanacctctgccnagtnagaacctganctcatagaatcaggacacagttgtttatncctttttgtgaccaaggtgattgggaatggantcattgcagnccagacttaggacttgctaattgcagaaataatagttgaataccatgggactctggaccttgaggtcaattcttgaggtcaggactncagacgtcattgctnccaatgggttttaaaggacaccatctagctaccacttcctccccggtcccagacaacaagattgaat

SEQ ID NO: 3120 - DNA, 480 bp, Mus musculus
  misc_feature (257)..(257): n is a, c, g, or t
  misc_feature (440)..(440): n is a, c, g, or t
  misc_feature (455)..(455): n is a, c, g, or t
gagaaattgtgctttgccctctaaagccacttccatgcaaagatacaaatgattttcatttttgagataggtcttgtcatatagctcaggctggtcttcaactcatgattctgctgcctaagcctcctgagtacagagataacagtgtatatcaccaaccctggcattaacataacttgtaattaatatattctcagacagtttaatttatgtacacaacatacactgactgccctcattcccgcccatttctgatntgcctgccactcctgctcaacccccttacccccaaaagtctaacgtaacttttttaattacagggaagtaaaattaaacattttaaatgtttattttgtgtatgtgacatgctgcactttgggagtctgctctcagcacaaaggtctagggaatcaaactccaggctatccttggtggaaggnccttttgccattganccatcttgctggtcccaaaagaaag

SEQ ID NO: 3121 - DNA, 393 bp, Mus musculus
aagtcagcaggtcttcagcaatccggtttgtcctcaggctatcttgtgctgttcacagatatgcgttcacagcattgtatgtgatgccgtacacatgctggccttgggaaaagaatattctagggcagtcatgtgtgtatttcttaggccacagaagttaggaagcaggtgtaacgttaccctgagtgtgagagcctgtcctccgtctcatcgctcagtgacctttcctctgtaactccacactaaacctcaaacctcctcacaagtcagccagcacagcaagtcagtgatggtaagttacagaagagagtctggcttgctttccctcctcagtgttgcccttcacaatgatcactggtgaccatattgttggcattgcttattcctatagat

SEQ ID NO: 3122 - DNA, 466 bp, Mus musculus
  misc_feature (92)..(92): n is a, c, g, or t
  misc_feature (95)..(95): n is a, c, g, or t
  misc_feature (107)..(107): n is a, c, g, or t
acaccagtgactatgttaactacggctttaatccagaatttatccctgaaattaatgctgctagcagctctctgcccaaaagtgaccaaaanttntaatggagtagnagcttgtccaggctccatggttcttgctgataaggggccacgagggtcttccctctggttgtttccaaggcctggggaaagttgttccagaaaaaaattgctggcattcttgtcctgaggcagccagcactggccactttgttgtcataggtccccgaggccatgatcagattacctcctctgtaaagagaatatcttgagtattgtatgggatgtatcacatgtcaattaaaaaggccatggcctatggcttaggcaggaaatagggtgtggaacatccaggagaagaaaggattctgggataaaggacacttgggaacgtgtggcagtggtacctgagcacaggtaattagccatgt

SEQ ID NO: 3123 - DNA, 302 bp, Mus musculus
  misc_feature (27)..(27): n is a, c, g, or t
  misc_feature (36)..(37): n is a, c, g, or t
  misc_feature (49)..(49): n is a, c, g, or t
  misc_feature (64)..(64): n is a, c, g, or t
  misc_feature (67)..(67): n is a, c, g, or t
  misc_feature (69)..(70): n is a, c, g, or t
  misc_feature (82)..(82): n is a, c, g, or t
  misc_feature (98)..(98): n is a, c, g, or t
  misc_feature (103)..(103): n is a, c, g, or t
  misc_feature (120)..(120): n is a, c, g, or t
  misc_feature (123)..(123): n is a, c, g, or t
  misc_feature (137)..(138): n is a, c, g, or t
  misc_feature (174)..(174): n is a, c, g, or t
  misc_feature (178)..(178): n is a, c, g, or t
  misc_feature (184)..(184): n is a, c, g, or t
  misc_feature (214)..(214): n is a, c, g, or t
  misc_feature (269)..(269): n is a, c, g, or t
atgacagttacctttctttgtacattnacttacttnntgtgactgattncagtaggaatagctnatncnnacaacctagttnttatttttttttgagncatgntctcagctttaccttgnctntcctagaactcacnntgtagaccatgctgacctcaactcacaagagatctncctncctctncctcctcagtgctgggattaaacatatgtnccactatatctgactaggatctagattgaaatccaaataaaagattaatgtttanccctttttgactaatcatcctcagaataaacat

SEQ ID NO: 3124 - DNA, 536 bp, Mus musculus
  misc_feature (46)..(46): n is a, c, g, or t
  misc_feature (147)..(147): n is a, c, g, or t
  misc_feature (255)..(255): n is a, c, g, or t
  misc_feature (258)..(260): n is a, c, g, or t
  misc_feature (275)..(275): n is a, c, g, or t
  misc_feature (287)..(287): n is a, c, g, or t
  misc_feature (312)..(312): n is a, c, g, or t
  misc_feature (324)..(324): n is a, c, g, or t
  misc_feature (328)..(328): n is a, c, g, or t
  misc_feature (380)..(380): n is a, c, g, or t
  misc_feature (423)..(423): n is a, c, g, or t
  misc_feature (483)..(483): n is a, c, g, or t
cagtggtcctgaagtgtcccagataccttgcagacctcagccacanagtccattaggcagtcaagagaaaaagagactggagctagcatgtcaagataggtcaaccctgggcgactcagtgaaacgtgagctgaggtcagaactggntggcatagagcaaagtcacacatccgcttacaaagactcgagtcagtgcaatgggaatccaaactgtgggagcattgctgctctgaaatctgtgatttcaaatccaantgnnnacttgataaactctnacccagttcatnattcagactcagcaaatacagagcnagcctatttatnaganagagagagagaaacagggagagaaaacacagatactgaaccaagtatgagtngtataaatgggaaagctttcctgtgtgttcctgaagggacaancagtaccctcaaccctactcaaagtgacagaagactcacatttcatggagcagctcaaanccagttacctgacgactgtgctacagaggacagtaaatgtgctacagtcacct

SEQ ID NO: 3125 - DNA, 542 bp, Mus musculus
  misc_feature (272)..(272): n is a, c, g, or t
  misc_feature (277)..(278): n is a, c, g, or t
  misc_feature (285)..(285): n is a, c, g, or t
  misc_feature (297)..(297): n is a, c, g, or t
  misc_feature (302)..(302): n is a, c, g, or t
  misc_feature (312)..(312): n is a, c, g, or t
  misc_feature (316)..(316): n is a, c, g, or t
  misc_feature (329)..(329): n is a, c, g, or t
  misc_feature (334)..(334): n is a, c, g, or t
  misc_feature (344)..(344): n is a, c, g, or t
  misc_feature (350)..(350): n is a, c, g, or t
  misc_feature (371)..(371): n is a, c, g, or t
  misc_feature (379)..(379): n is a, c, g, or t
  misc_feature (395)..(395): n is a, c, g, or t
  misc_feature (516)..(516): n is a, c, g, or t
ttagatgaacccatgcacacggtctgtttacacacgcagaacgaggaccagacagaaaacaaacaggttcagacaagtacatggtcacctccagtttttttctggactgtatttaattgttttgtttgtttgtttgtttgtttaaacttgtctaaagaaagctgcatttaaaaggatgtttctatactaaacaaacagacacagcctctttgatcagattaagtgaacaggtggtcctgtgactaaaccattagatgagatagaactggctntcaanntcagttntcttcatagtgnttaanaaaaccctgnggcntcctctctacctncaagnaaatcagttnggcagnatagtgttcagttgaaagagnccaagtgntcagatgcattgatgnacagggatagtgtaggtttctaagtatgtgtcagcgttcagtggtccatggttggtatgaaatccaggcacttgaacactaggggaaaacatttttccatgctcccatcacgttgtttcantctgtgctgatttgtgaagtgccctt

SEQ ID NO: 3126 - DNA, 298 bp, Mus musculus
  misc_feature (31)..(31): n is a, c, g, or t
  misc_feature (35)..(37): n is a, c, g, or t
  misc_feature (39)..(39): n is a, c, g, or t
  misc_feature (41)..(42): n is a, c, g, or t
  misc_feature (45)..(45): n is a, c, g, or t
  misc_feature (47)..(47): n is a, c, g, or t
  misc_feature (53)..(53): n is a, c, g, or t
  misc_feature (55)..(55): n is a, c, g, or t
  misc_feature (58)..(58): n is a, c, g, or t
  misc_feature (60)..(60): n is a, c, g, or t
  misc_feature (63)..(63): n is a, c, g, or t
  misc_feature (65)..(68): n is a, c, g, or t
  misc_feature (71)..(71): n is a, c, g, or t
  misc_feature (75)..(79): n is a, c, g, or t
  misc_feature (81)..(81): n is a, c, g, or t
  misc_feature (88)..(91): n is a, c, g, or t
  misc_feature (99)..(99): n is a, c, g, or t
  misc_feature (102)..(102): n is a, c, g, or t
  misc_feature (106)..(106): n is a, c, g, or t
  misc_feature (119)..(123): n is a, c, g, or t
  misc_feature (125)..(125): n is a, c, g, or t
  misc_feature (128)..(128): n is a, c, g, or t
  misc_feature (133)..(134): n is a, c, g, or t
  misc_feature (137)..(137): n is a, c, g, or t
  misc_feature (144)..(144): n is a, c, g, or t
  misc_feature (147)..(147): n is a, c, g, or t
  misc_feature (149)..(149): n is a, c, g, or t
  misc_feature (151)..(151): n is a, c, g, or t
  misc_feature (154)..(154): n is a, c, g, or t
  misc_feature (160)..(161): n is a, c, g, or t
  misc_feature (167)..(167): n is a, c, g, or t
  misc_feature (171)..(171): n is a, c, g, or t
  misc_feature (178)..(178): n is a, c, g, or t
  misc_feature (199)..(199): n is a, c, g, or t
  misc_feature (212)..(212): n is a, c, g, or t
  misc_feature (215)..(215): n is a, c, g, or t
  misc_feature (243)..(243): n is a, c, g, or t
  misc_feature (247)..(247): n is a, c, g, or t
gttcgcgtccacacacatacagcttcctccncctnnncncnnccncnagcctntnttntnacngnnnnccnccannnnntngacctcnnnnccctcaangangcanctccctccagacnnnnntnctnctagnnatntactctnccngnanctnccactnnccactntcantgggtgncggaggatcatcctcacgttnacctgatttcagncancccctacagagaagggggcatgtttacntctntcctgatccacctggcagggtttcctgggatcactggcttagtaaaaagta

SEQ ID NO: 3127 - DNA, 452 bp, Mus musculus
tggtagctggatgtttccctttcaatgtcctcatgcctctcactttgtaggtaaaactgtgtgctgaaaatataatggtactttgattattttgaggatttttattttcttatataagaagaaaatcattattgtctcttggtattgcatatttaactctcagtggtatttgggactgtggaaatgtcttctttgtcccaagaggaacgagagtggagtgattcccacaatattgtatggtgtccacaacactactgggagtccaagtggtactggggagggccagtcatgtgaaacaattagggtgctctcaaaattgctctggtagaaggtatttctgaaaccgagtctttattttgatctcataaacaacatgggacgggcatctaccatgaaaatcagtacctatccatagtactgtgcttgagggactcgcctacatcagattagaa

SEQ ID NO: 3128 - DNA, 536 bp, Mus musculus
  misc_feature (254)..(254): n is a, c, g, or t
  misc_feature (281)..(281): n is a, c, g, or t
  misc_feature (290)..(291): n is a, c, g, or t
  misc_feature (293)..(293): n is a, c, g, or t
  misc_feature (302)..(302): n is a, c, g, or t
  misc_feature (325)..(325): n is a, c, g, or t
  misc_feature (406)..(406): n is a, c, g, or t
  misc_feature (412)..(412): n is a, c, g, or t
  misc_feature (418)..(418): n is a, c, g, or t
  misc_feature (426)..(426): n is a, c, g, or t
  misc_feature (468)..(468): n is a, c, g, or t
aatatatttgatgaccacgctgacttggaagcagaggcactgagtagaacctgagcgggttaggacttggggtagtgtctttgatcacttaatcctttcctttattatcaacaaacagttgccttgccaggggttcagccgcttaagctgccttttctgttatcatctgaatagactaatggggccactttaataccatatattaatgtgaatcattagaattgggaaaaaactagcttttagtctggctcctngactagaaaactgaagaaactgaaacnaactgattnntntatattctntcttaaagtagtttataaatttnatgggaaagcttaccaggaaagtggaagttgtcactgaaaatatttttttaattgttgtgatttttaactggttctttttntatgcngggtanccattttnttcactgaaaccgtcattatgccatcattcttgagtttaagntcttttaatcatttacaaagatttcattaggaatgtctatttagaagacatttttcctagcagctttt

SEQ ID NO: 3129 - DNA, 421 bp, Mus musculus
gggagacggatctcttcaagttcaaggctagcctggtttatattcaggagtgctcactctagataggtaggtaggaggtagggaagtaggtaggtaggtaggtatctctgattcaaatgtagtcaaatataggcaatctgaattctaacttatccacgactactcagacctgagaactgttacctgatcttatgctaaataagaagggagtctgtctgagagttgctgagagggctgctggtttgtctgtcttaagtctcctcaaagcccagcaggagcccttccagaactagatggtcagtggctgtgctggaggaggcccctttcaggctacaggcagagaatgacaatgtcacacatatcagggaacattattcctcctgatgttaagaaaataactctccaacagaagtcacatctt

SEQ ID NO: 3130 - DNA, 535 bp, Mus musculus
  misc_feature (54)..(54): n is a, c, g, or t
  misc_feature (340)..(340): n is a, c, g, or t
  misc_feature (397)..(397): n is a, c, g, or t
  misc_feature (451)..(451): n is a, c, g, or t
  misc_feature (486)..(486): n is a, c, g, or t
  misc_feature (493)..(493): n is a, c, g, or t
tgagaaggctttcagggaccagtcagccctagcacagcatcagagaactcacantggggaaaagccttacacgtgtaacatatgtgagaaagccttcagtgaccattcggcccttacccaacataagagaattcacacgagagaaaaaccgtacaaatgtaaaacctgtgggaaagcttttatccgaagcacacacctcattcaacaccagaggattcacacgggagagaaaccttacaaatgtaacacatgcgggaaagccttcaaccagactgcaaacctcgctcagcaccagaggcatcacactggaggaaagtgatagaaaggcagttaataggtnctgaggggatgatgtcattaattattgaatagaagagagtacataatcacactgaantcttttatcatcatggttggatttactcggagccaggttgcctaatgctaaggntcttgagaatcttatgaatggtgaacacaccttantcttcantctgccacagttggatagtagtgcctttttattggcctgaat

SEQ ID NO: 3131 - DNA, 488 bp, Mus musculus
  misc_feature (260)..(260): n is a, c, g, or t
  misc_feature (264)..(264): n is a, c, g, or t
  misc_feature (266)..(266): n is a, c, g, or t
  misc_feature (274)..(274): n is a, c, g, or t
  misc_feature (284)..(284): n is a, c, g, or t
  misc_feature (307)..(307): n is a, c, g, or t
  misc_feature (323)..(324): n is a, c, g, or t
  misc_feature (327)..(327): n is a, c, g, or t
  misc_feature (335)..(335): n is a, c, g, or t
  misc_feature (342)..(342): n is a, c, g, or t
  misc_feature (344)..(344): n is a, c, g, or t
  misc_feature (349)..(349): n is a, c, g, or t
  misc_feature (367)..(367): n is a, c, g, or t
  misc_feature (370)..(370): n is a, c, g, or t
  misc_feature (372)..(372): n is a, c, g, or t
  misc_feature (382)..(382): n is a, c, g, or t
  misc_feature (387)..(387): n is a, c, g, or t
  misc_feature (391)..(391): n is a, c, g, or t
  misc_feature (461)..(461): n is a, c, g, or t
cttggcaaagcctctgagtgttagagacttcattaccaaccttcagccgctccctgctttcataagaaggaatttttagaaatgggtgagagttgttaccaatccactggtagaaacagcaggtatcccctaagctcatggacccaacaaaacttctgctggcttccaacattcagtacaggaaacatctgttaagcaggataaagatctaaaaaatatttgtaggtagcctagttgagctgaacactggtaattcattngacntngaccctgnatctttaaancccccttccggtcaaagtttganactttggactgtcctnnacngggggctntgggctncnggctntacacaatggagtccatnatntntggggctctncaatnagcnacctaagcattccgacacactacccctggggatcctcccttctgctggcaagggaactcaaggtattttntgagatgccagggcattgattcaatga

SEQ ID NO: 3132 - DNA, 163 bp, Mus musculus
  misc_feature (44)..(44): n is a, c, g, or t
  misc_feature (46)..(46): n is a, c, g, or t
  misc_feature (50)..(50): n is a, c, g, or t
  misc_feature (52)..(52): n is a, c, g, or t
  misc_feature (59)..(59): n is a, c, g, or t
  misc_feature (68)..(68): n is a, c, g, or t
  misc_feature (83)..(83): n is a, c, g, or t
  misc_feature (89)..(89): n is a, c, g, or t
  misc_feature (134)..(134): n is a, c, g, or t
gacttcttaaccttggggagagactcgagttctttggaaatcancntccntntgaaatntccagcttnccagaggaggaatgntcagantcactgcttcagaccttgctaaccagaccccttcctcacaatgantctttcagcccttacgtaagagcaagctc

SEQ ID NO: 3133 - DNA, 234 bp, Mus musculus
  misc_feature (27)..(27): n is a, c, g, or t
  misc_feature (30)..(30): n is a, c, g, or t
  misc_feature (46)..(46): n is a, c, g, or t
  misc_feature (48)..(48): n is a, c, g, or t
  misc_feature (62)..(62): n is a, c, g, or t
  misc_feature (64)..(64): n is a, c, g, or t
  misc_feature (66)..(67): n is a, c, g, or t
  misc_feature (70)..(70): n is a, c, g, or t
  misc_feature (73)..(73): n is a, c, g, or t
  misc_feature (90)..(90): n is a, c, g, or t
  misc_feature (171)..(171): n is a, c, g, or t
  misc_feature (176)..(176): n is a, c, g, or t
caagcacacaggagggtctccccgacntcnatgccagtaccgagcntntgcagggttcaganangnngtnatngcctgtgagaatggttngcctgtccacttcgatgagtcgtttttcagtctatagtcagcaggcccctggcacagacctagctatgttttctttttatntcccntcatagcccagaacactggttccatcgttcattgtcaggggccagaaaaacgaactat

SEQ ID NO: 3134 - DNA, 216 bp, Mus musculus
  misc_feature (27)..(27): n is a, c, g, or t
  misc_feature (30)..(30): n is a, c, g, or t
  misc_feature (46)..(46): n is a, c, g, or t
  misc_feature (48)..(48): n is a, c, g, or t
  misc_feature (62)..(62): n is a, c, g, or t
  misc_feature (64)..(64): n is a, c, g, or t
  misc_feature (66)..(67): n is a, c, g, or t
  misc_feature (70)..(70): n is a, c, g, or t
  misc_feature (73)..(73): n is a, c, g, or t
  misc_feature (90)..(90): n is a, c, g, or t
  misc_feature (171)..(171): n is a, c, g, or t
  misc_feature (176)..(176): n is a, c, g, or t
caagcacacaggagggtctccccgacntcnatgccagtaccgagcntntgcagggttcaganangnngtnatngcctgtgagaatggttngcctgtccacttcgatgagtcgtttttcagtctatagtcagcaggcccctggcacagacctagctatgttttctttttatntcccntcatagcccagaacactggttccatcgttcattgtcaggg

SEQ ID NO: 3135 - DNA, 268 bp, Mus musculus
  misc_feature (144)..(144): n is a, c, g, or t
acaggtgacccgagccgaggtgacaccggtccggtccaggcgactaagccaaagtcggagggctggggagggcgccgggatcccctcagcccacgcccggcattccccgggctccacagggttcgcgattctctctgtccattntagatgggcaggtctgagcccctccggggtctgtcctgcctttgccttgctctgcccttcccgagctggcactgctaggtgtccggggtgtactcagccgggacccagaatgtccgtgctccgg

SEQ ID NO: 3136 - DNA, 491 bp, Mus musculus
  misc_feature (32)..(32): n is a, c, g, or t
  misc_feature (105)..(105): n is a, c, g, or t
  misc_feature (192)..(192): n is a, c, g, or t
  misc_feature (419)..(419): n is a, c, g, or t
  misc_feature (423)..(423): n is a, c, g, or t
  misc_feature (437)..(437): n is a, c, g, or t
atgtgtgttacatctccaacatattttagccnactgaaaatgccccacatttcaggtgctagggtcggcattcagggccttgctcctgtgtcgtgagctctaccnctaactccaccccagccctcaggtggttcttaatggaagggcagtaaagagacttcaaacaagtacgtccttacatttttttttttnaagaaaagaaattaaatcattgttgggatgtttttttaaagccaataaatatcattttatattagctaactcctaacagaaatgtaaagataagctttataaaatatttttgtcatgaagtactatataccaatgatgaatcttttgtgaagtaaatgacttgaatttgtcactgtgtagatagtgagatgattgaattctgtataggggtctgagcagttactctngggnaacagcatttcctntcttaatttgatacagaatcagaaattagtagaaaatgctggacatggtggtgc

SEQ ID NO: 3137 - DNA, 425 bp, Mus musculus
  misc_feature (385)..(385): n is a, c, g, or t
atttggtgactattactctaactttagactctttggcatatactaagtagctagtctgggctttaaaaatatgcatggacatttcagtttgttttagctgaatgaggacattttgaattctcttaaaagtcacctgattattaaataacaatgtttatttttaaaactaacaatgtgttgtgtcttattacacattacacagtcctaaaggtgcggctctgatgtctgtgagctgtgggccaagtattctgttttcagttctatagcacagaacagtgattagaaatgtaaagagatacccacatcaactttctgtttttgtttttccaactgattcaggtgtccattgaatgacgtatctcttaaatgttgggggagtggtgtntcagaaccagttacctggcttctgttttgtccatagctta

SEQ ID NO: 3138 - DNA, 464 bp, Mus musculus
  misc_feature (290)..(290): n is a, c, g, or t
  misc_feature (317)..(317): n is a, c, g, or t
  misc_feature (336)..(336): n is a, c, g, or t
  misc_feature (340)..(340): n is a, c, g, or t
  misc_feature (350)..(350): n is a, c, g, or t
  misc_feature (379)..(379): n is a, c, g, or t
  misc_feature (382)..(382): n is a, c, g, or t
  misc_feature (406)..(406): n is a, c, g, or t
gagtcaaacatagctgtcagccctcagctccctttccctgttctaaaacaggccagactgtgtaaagactcagcaaagtttatgaaaaaggtgcatgctgcccataccccacagaccagtgcccgggaggctcatcttcctgcacgctaaccctgcctgcctgcagccatctgcttcagactgacgatgtggcatgtgactctggtcctggtgagggatgggcactggggggcccctccaggcgtcagaggccttcattttcagggggccggccgaggaagtgtgaaggnaaagctgaaggggatccctgtgggggntgggaggaagaaaagatgntctncccggatggntctcagaggtaacaggaaaagagacctcnccntcagcacctgcggtgtgatacccntctcacctctgtagatgtgtctgttccgtgttcgtgtgtctcgttgtggtagcattaa

SEQ ID NO: 3139 - DNA, 560 bp, Mus musculus
  misc_feature (205)..(208): n is a, c, g, or t
  misc_feature (212)..(212): n is a, c, g, or t
  misc_feature (214)..(215): n is a, c, g, or t
  misc_feature (244)..(244): n is a, c, g, or t
  misc_feature (467)..(467): n is a, c, g, or t
tattctcgctggcttgtggtcacgtgggccctgagctgtggggcctgatggctctatgcagcactgtatagtgcaacactcgcctggctggagcctggctgtgctcactgccacccctggggtaccaccccaccctgtccccccagtgccttcgtgcatcgatgtggacgcacagcccgcattggccacggtggcagtgccctgnnnntccngnngcccatggaggaggcctacatcaacttcntggccatcaaccagaaatgccccctgcaggagatgagcctccagagaaacaccatagaccttctgccgaagctccgggccatggctctggctgacagagctgtgttcgagaagggcatgaaagcctttgtgtcctttgtgcaggcttatgcgaagcacgagtgcagcctcatcttccggctgaaggatcttgactttgccgggcttgctcgaggctttgcccntgctcaggatgcccaggatgccagagctaagggggaagcagtttcctgactttgtaccagtggacatcgataccgacaccattccatttaaag

SEQ ID NO: 3140 - DNA, 406 bp, Mus musculus
  misc_feature (197)..(197): n is a, c, g, or t
  misc_feature (245)..(245): n is a, c, g, or t
  misc_feature (269)..(269): n is a, c, g, or t
  misc_feature (308)..(308): n is a, c, g, or t
  misc_feature (310)..(310): n is a, c, g, or t
  misc_feature (313)..(313): n is a, c, g, or t
  misc_feature (316)..(316): n is a, c, g, or t
tcgtgttccctttcttaggcggcgagtcccttcatttggttttccggggccttcgaagagttgagacagagatgatgatggctttgcctatgtgttgcctcccggtcgcggtgtcgtgtctgcagcagtctcgggaaaagctatcctagggggttacaatcctccatgattgggtaatagaggcttaaggaacagtntcaaagccaggcttgccaggggttggctgtgatggagttcgtgggggnttgtattacgaatagcccttactntcagtattttcaatccactgtggtttttattgaggctantngtnccnagactcttagctgaggaccgaggagataaaactaattaagtatgcagaatagtccctgcccaccaggagcctgtagaggttctatcccca

SEQ ID NO: 3141 - DNA, 461 bp, Mus musculus
  misc_feature (45)..(45): n is a, c, g, or t
  misc_feature (227)..(227): n is a, c, g, or t
  misc_feature (230)..(230): n is a, c, g, or t
  misc_feature (271)..(271): n is a, c, g, or t
  misc_feature (273)..(273): n is a, c, g, or t
  misc_feature (280)..(280): n is a, c, g, or t
  misc_feature (286)..(286): n is a, c, g, or t
  misc_feature (317)..(318): n is a, c, g, or t
  misc_feature (322)..(322): n is a, c, g, or t
  misc_feature (325)..(325): n is a, c, g, or t
  misc_feature (336)..(336): n is a, c, g, or t
  misc_feature (338)..(338): n is a, c, g, or t
  misc_feature (374)..(374): n is a, c, g, or t
  misc_feature (376)..(376): n is a, c, g, or t
  misc_feature (398)..(398): n is a, c, g, or t
  misc_feature (409)..(409): n is a, c, g, or t
agggctgtggatattctgttctcattgagcacccccccccccccnggagcttctctagctcgggtgaagcatgtgatgcccactgtttagttgtgtgtgtggagaaacatgtgatgtaccactgtctaggctgtgtgtggctcaggttgccttcacttgtgtttactttgcagtcctggggatgatcagggtgtgtgcccacgtacccatgtgtgtgtgtgcccacntanccatgtgtatacccatgtgccaatgtcactatttcccaagnanggctggngtatgnatgaaatacctcctcccaacttctccctgcnnacantcngacccaggcantntctgctgcctctattgctgctatctctgtggaagtntntgaagagcaagagggtagaganccttccttgtntctaccatgttgaacttgattccagaatttcagacctgactggcatagttgt

SEQ ID NO: 3142 - DNA, 422 bp, Mus musculus
  misc_feature (270)..(270): n is a, c, g, or t
  misc_feature (272)..(272): n is a, c, g, or t
  misc_feature (281)..(281): n is a, c, g, or t
  misc_feature (304)..(304): n is a, c, g, or t
  misc_feature (319)..(319): n is a, c, g, or t
  misc_feature (341)..(341): n is a, c, g, or t
  misc_feature (369)..(369): n is a, c, g, or t
  misc_feature (373)..(373): n is a, c, g, or t
aagacagcctggaccgtctgctttttgtctttatctttcaaaaggattttgcttttgttcttcaattcttttttctcttactgtcttaaaagtcaaagaatgactcccccttccacctgactctccttcagtctgacagcagcgcttttttctctacttctttttttcttggatgctcgtctctggatttttggatcttctgtccttcagccgtggaaacaggttctctgtactcttggtggtatgtggtattgctggtttttcatactntngactccgtngtgcgtttcttttgtaattcttnttttgtatttttctnggggttttgtgacaccacactnctaatcccacagtggattttgatgggtntctnaggggatctatccagaggtcctcgagcagtgattggttggctcttcctg

SEQ ID NO: 3143 - DNA, 432 bp, Mus musculus
  misc_feature (162)..(162): n is a, c, g, or t
  misc_feature (180)..(180): n is a, c, g, or t
  misc_feature (192)..(192): n is a, c, g, or t
  misc_feature (290)..(290): n is a, c, g, or t
  misc_feature (297)..(297): n is a, c, g, or t
  misc_feature (322)..(322): n is a, c, g, or t
  misc_feature (360)..(360): n is a, c, g, or t
  misc_feature (403)..(403): n is a, c, g, or t
ggtaaccatgagagcttgccagagggtaggagagccaaccttggggtccagacttgctggggcttccccacctcttgctgtgtcagtattaccacctgacagatcccaggactcactgccctccagagaacagaggtgatgaacatgaggaggactggagtnttcttcccctcaggggtntcagaggttttntacaaaccatcttttattttccctgggtcccagtaaactgggaggagtaggttcttggtacttaggacttaatcctatgtttggccatgctgctgccnaactcantcccctcctgggggctgacccctgncccacattcccgacaagtgggtcctgcacttgctgagntccccatcatgggggtaaggaagggagaactgacaaaaccctntgatgtattgagggtactggcttagccat

SEQ ID NO: 3144 - DNA, 295 bp, Mus musculus
  misc_feature (49)..(49): n is a, c, g, or t
tgcttgttacatctctctagtggaagtccacaaatcaacttctcctagncaacaaactcactgaatacattgctgtacccaggatcacagccacatatgaagagtatgtgaaggtccatcacttccccttggaaactgtcacaaggctctgccatgagatgtgttcagcttgctgagttctttctactcaagatcagttgcctctgcaacatactgtctagttttgcctaaaccaaagaagatgtagcattccaagtcaaaattacaatttgtccttgagatatgctactgatag

SEQ ID NO: 3145 - DNA, 539 bp, Mus musculus
  misc_feature (63)..(63): n is a, c, g, or t
  misc_feature (72)..(72): n is a, c, g, or t
  misc_feature (84)..(84): n is a, c, g, or t
  misc_feature (86)..(86): n is a, c, g, or t
  misc_feature (95)..(95): n is a, c, g, or t
  misc_feature (101)..(101): n is a, c, g, or t
  misc_feature (111)..(111): n is a, c, g, or t
  misc_feature (114)..(114): n is a, c, g, or t
  misc_feature (123)..(123): n is a, c, g, or t
  misc_feature (307)..(307): n is a, c, g, or t
  misc_feature (309)..(309): n is a, c, g, or t
  misc_feature (312)..(312): n is a, c, g, or t
  misc_feature (322)..(322): n is a, c, g, or t
  misc_feature (325)..(325): n is a, c, g, or t
  misc_feature (336)..(336): n is a, c, g, or t
  misc_feature (342)..(342): n is a, c, g, or t
  misc_feature (386)..(386): n is a, c, g, or t
  misc_feature (404)..(404): n is a, c, g, or t
  misc_feature (449)..(449): n is a, c, g, or t
  misc_feature (471)..(471): n is a, c, g, or t
  misc_feature (476)..(476): n is a, c, g, or t
gacctattcctcattgggttccaatatagataaaactacagcaatcgagcgctagggggcgtnatactcaanccgtgccatatnanatgctctgntacctntctgagctgncanatagctccntggaatccattgggctccattggcgacaagggtctacagcaagtggagttccgggctgcaggctggcgctgctgtcctgtccctccctcccctgtaacatcagcagtagaagcaaaaagctattctgcattctttcagatgccccagcaagctagtcattgctgaccctggaaatataaattancngcnggcagcgttnccnttcttgaaatnagaggnccaaaaagaatagaggaaagaaacctaggcacgccggggaattntccttaatttgatgacancagcgataagtgcacctatgaaatgctctttggaagagggatttncaagttaattattaaagacaanccttnggggggtttccttggaacttacaagtaacggctgcctccatgctggaggctcgactctttgag

SEQ ID NO: 3146 - DNA, 229 bp, Mus musculus
  misc_feature (40)..(40): n is a, c, g, or t
  misc_feature (115)..(115): n is a, c, g, or t
  misc_feature (160)..(160): n is a, c, g, or t
atgggtatcttgctatgtatctgatttgtgatttaaaagnacagaagactgctaagaaccaccaagttctctctgacctggggtgttttcactcgtgtgactgcttaattgagtnaaacccagatacttaccttgttatcaaaaacttaaaatatctgancccatcctctccctttagaaaaaatctggattaaggcccagtttgaccatggctagcatacatctgtta

SEQ ID NO: 3147 - DNA, 513 bp, Mus musculus
  misc_feature (288)..(288): n is a, c, g, or t
  misc_feature (296)..(296): n is a, c, g, or t
  misc_feature (374)..(374): n is a, c, g, or t
  misc_feature (378)..(378): n is a, c, g, or t
  misc_feature (388)..(388): n is a, c, g, or t
  misc_feature (396)..(396): n is a, c, g, or t
  misc_feature (424)..(424): n is a, c, g, or t
  misc_feature (434)..(434): n is a, c, g, or t
  misc_feature (436)..(436): n is a, c, g, or t
gggtgccattcacagcaaaggccagggctgtcttgcgcaaatttgacccgtcctctttctttcttttaaatgaatggcctttttgttaatgaggggcgacaaaacatctgagcttctgttgtgtgtgcctcttcaggcaggagtgcaggtggtgggtcagagggtacctctacaaagaggtctggaggcctctggcaaccacagatctagaaggtcaacaaagggttaaattcagcctcagtggggctgctgctggggtgatgacctcaaacctggatgcgccatgtnttttacangaagattttagaggctcttaaaagactcaggaggcctggagttaattagttgtatggcttgggggaaagtaccctttntgancctcagtttntctacccntaagatgagacaagagttggacacctancccttgacantntgttctgtgattctttgcttcagaaccgttgggtataataacagagacactttgaaaggcttttgacctccttatgc

SEQ ID NO: 3148 - DNA, 450 bp, Mus musculus
  misc_feature (213)..(213): n is a, c, g, or t
ctgcgttccaactgactcaaagggatgtggagagagtgcggcaggcgacagatgtccacctctacttgaggccggacgtccagcaacacatggggcgccccggaatccagaagccgcttgtagtcggtcacagaaatccgctcctcggggcacagcagcttcagggcgcggcacttgtcggtggccgaggagccgcagaaggcctcgtagtcntgcaggcgggtcacggtgggctgctgcccgcacacgacgcagtcaggccggcggcgccgcagccggatccggcggaagtggcccccgaggccgtcgaagagcagcatgctgccgctgtaggaggagccgaggccggcggcgatcttgagcacctcgagggcctgcgcgcagcctagcacgccgggcaccgctccgagcacgccgccgtctgcacagttggtcactgtctccggcggg

SEQ ID NO: 3149 - DNA, 579 bp, Mus musculus
  misc_feature (55)..(55): n is a, c, g, or t
  misc_feature (262)..(262): n is a, c, g, or t
  misc_feature (290)..(290): n is a, c, g, or t
  misc_feature (343)..(343): n is a, c, g, or t
  misc_feature (352)..(352): n is a, c, g, or t
gatgaactcgatacccctgatgaagcagactcttttgaatatactaaccatgaanatcccacggccaacaaaagctctggtcaagagtcagagtctattccagaatatacggctgaagaggagcgagaagacaaccggctgtggaggacggtggtcatcggggagcaggagcaacggattgacatgaaggtcattgaaccctacaggagagtcatttctcacggaggtactcaatctgttcgagtccaggaaatgggagganccaactctagttttcactgggaaacaantgcgggtccagttgagttctcagtgcttagaacccagagtcattaaaagaccnggagtggcngcctatcctctaccgaggctctgactcatcttgttagattcagcctagtagttacttcccctacgctgtttgtttacctgtgagccacattaaatttggaacagacaaaagctaacccccgtcaaaacctccattttggcaagagacccagcagagggcaaagtgtgtcttgtatttccagtgttttacctgggggctccgggcacccatgtggctttgatcaattg

SEQ ID NO: 3150 - DNA, 516 bp, Mus musculus
  misc_feature (293)..(293): n is a, c, g, or t
  misc_feature (312)..(312): n is a, c, g, or t
  misc_feature (340)..(340): n is a, c, g, or t
  misc_feature (357)..(357): n is a, c, g, or t
  misc_feature (389)..(389): n is a, c, g, or t
  misc_feature (399)..(399): n is a, c, g, or t
  misc_feature (402)..(402): n is a, c, g, or t
  misc_feature (413)..(413): n is a, c, g, or t
  misc_feature (464)..(464): n is a, c, g, or t
  misc_feature (478)..(478): n is a, c, g, or t
  misc_feature (490)..(490): n is a, c, g, or t
tgaacagcctgtctgaccttcttttcctgttgctgtgataaaataccctaacaaaaagaaacttatgggagaaagggtttatttgggtcgcagacaaggtatagtccgacaaggtgacaggagcttgaagcagctggtcacagggcagccacatcagaagacagagtggcataggaatgtgtgaaactcactttctcttcctactcaccccagaaacccaagcccagggaatggttctaccaacttttagtctgtgtcttcccacctcagttagccaaattaagataatcccngacaggaatggccagaggntcatctcccagtgttcccagatccctcncagttcgtaattaattntgcagctcagcttgcccacaggagcaggaatnggtgggaagnccnccagcacaggntcttttattcttccaatttgttgttcctgctggaagtgtatagctggaatntggtagtttatatntcaagaccagcnttctacacagacccttgctccaaaaa

SEQ ID NO: 3151 - DNA, 572 bp, Mus musculus
  misc_feature (238)..(238): n is a, c, g, or t
  misc_feature (250)..(250): n is a, c, g, or t
  misc_feature (255)..(255): n is a, c, g, or t
  misc_feature (276)..(276): n is a, c, g, or t
  misc_feature (280)..(283): n is a, c, g, or t
  misc_feature (286)..(288): n is a, c, g, or t
  misc_feature (292)..(292): n is a, c, g, or t
  misc_feature (294)..(294): n is a, c, g, or t
  misc_feature (324)..(324): n is a, c, g, or t
  misc_feature (329)..(329): n is a, c, g, or t
  misc_feature (336)..(336): n is a, c, g, or t
  misc_feature (345)..(345): n is a, c, g, or t
  misc_feature (354)..(354): n is a, c, g, or t
  misc_feature (369)..(370): n is a, c, g, or t
  misc_feature (373)..(373): n is a, c, g, or t
  misc_feature (434)..(434): n is a, c, g, or t
  misc_feature (456)..(456): n is a, c, g, or t
gagactgtatttcctactcctactggctgtctcaggttagctgtactgcgagtgtccaaggcttctgcttctcctccgccatctccctgtactgggattccaggtgctcactactctgtttcatttctggggatccaaactccggtcctcagtgaaagtctctgcccattgacctctgctctccagccctgggaaaatgtcctttgtaggatattttttttttaaattaaaagtatgntacttcattttnaaatnttcatcaccatgtaattttgnaatnnnntcnnncttngntttatcctttctggtgcaaagcagttttcnatccnatgaganatatgtttnccttcatgnattaggatcagatcnntcntgtttagggagtcatttttactttacattttcctattccagtttcaaagcacttattaccnactctctcattttccagacaancaaattagagctctgagagattataggcttgcccatgattacatagctccttagtctgatagctgcagacctggaattaaaactcaggttttttcccctaacctagttctgatgat

SEQ ID NO: 3152 - DNA, 432 bp, Mus musculus
aaaggttcctgatgtcgtttgtcaagattagtgcctgtaacatgaaccacagagtgtgcaaaacatgtctctcttttgtttaatccgttctgcctagctttttaaatctttcaagcctcagcccaagcccatccatcccagtaaatatattttccgtggtttaatttacccttaataagactcagggtatattacaggtttgtttctgtgtgtaaacatttcctgccggctttctctcggcattgccagcataggccacgcacactgctgcagggacatcattgccacgcatgcgctgcagggacagcaccactgccctccctgctgagctcacgtctcagcatctatcacgtgctccgttttggcttctctggaggtagaaattccgtgacagcttgttccaagggggatgcatgctgcttattggcaaac

SEQ ID NO: 3153 - DNA, 487 bp, Mus musculus
  misc_feature (354)..(354): n is a, c, g, or t
  misc_feature (374)..(374): n is a, c, g, or t
agggtccaactcaggcctaatctttctattgctctttctacaccttgggttggccagctcatgtgaccctgacacttgagaagggaggcccaggacatctggggccacactgggtgagggaggaatctcactgcctgtcctgggcctcagttctcagaagcagccctcatgtcccatgccactttggaggtatggagttcaagggtctatcccacagcaacagcccctcccactgcattgctcctggcactagggaccccactggccgcctgcccaccctgcttgctacccgcctgtccttgctctgccattccatctgacttcatctcgttgggtttttctttctcttgtcanggctccttcgttcatttgtntgttctttctctccttctctccctctctccccttgccccccccccctttttttcttttctctctttttgtcttctgttctgtgtacccaggcaccccattgagtaacttcttt

SEQ ID NO: 3154 - DNA, 511 bp, Mus musculus
  misc_feature (485)..(485): n is a, c, g, or t
agaaagcttctgtttgcatctgccttgtcttgcatccttattttcttctcaatttctgtgctctctgtccttttgtttttaaacctcattgacaccaggaatgctaattttccaaacattataagcaaacattcagggggtagggagcaccacattaaaacttccacgccaaaggcttaagtttccatcttaagtttctaagcatgctatcccagtgtctatgtgaagtccccagtgtctcccatgattctcctgctaatcatgatggggacccagcactcagcaaggtcccaccctctctccataatcatacacaagtatgcgcaaacccagctgagcaattatgaataattaaatcaattagagacagtctagcaggagggattatggtcgttcgggtgtgggcctctgtaatattttaacagtaaatgcatgggccccagagaggcctggcagggagacaggaacaaaagcatgtccaaatnccaagccatgttgctgggtgaccctc

SEQ ID NO: 3155 - DNA, 513 bp, Mus musculus
  misc_feature (278)..(278): n is a, c, g, or t
  misc_feature (286)..(287): n is a, c, g, or t
  misc_feature (290)..(292): n is a, c, g, or t
  misc_feature (299)..(299): n is a, c, g, or t
  misc_feature (308)..(309): n is a, c, g, or t
  misc_feature (314)..(316): n is a, c, g, or t
  misc_feature (325)..(325): n is a, c, g, or t
  misc_feature (333)..(333): n is a, c, g, or t
  misc_feature (356)..(356): n is a, c, g, or t
  misc_feature (362)..(362): n is a, c, g, or t
  misc_feature (398)..(398): n is a, c, g, or t
  misc_feature (423)..(423): n is a, c, g, or t
  misc_feature (463)..(463): n is a, c, g, or t
ggccattaaacttcattacagtcatttttaaatgtgcttattctgaaatattcaactttattgtgatgtgttctgtaggaatttctctgtgtttaataatattcaggctatactattcttttcagaaatttattagaaaactagaagaaggcaattgggagcacttgctgttcttggagaagacctgggttcagtttcctgtactcccaacccttccaggcaatccatgctgacttctggtctctgcaaccatcagatgcacatgccatactcacacntaaccagnnttnnnacactcntacacattnnaagtnnnaattagtcnatcttttnacaattcattagcacagtgattntacatnatagtggttttcactctgatgttttcatatatgtgnacatgagatattttgattgcataancccttcaatcagctctcacacctgctgaccacatcctctncctctttcctcttcccagtgactccccctctactctcatggttgttttta

SEQ ID NO: 3156 - DNA, 472 bp, Mus musculus
  misc_feature (89)..(90): n is a, c, g, or t
  misc_feature (178)..(178): n is a, c, g, or t
  misc_feature (266)..(266): n is a, c, g, or t
  misc_feature (271)..(271): n is a, c, g, or t
  misc_feature (296)..(296): n is a, c, g, or t
  misc_feature (298)..(298): n is a, c, g, or t
  misc_feature (303)..(303): n is a, c, g, or t
  misc_feature (307)..(307): n is a, c, g, or t
  misc_feature (326)..(326): n is a, c, g, or t
  misc_feature (335)..(335): n is a, c, g, or t
  misc_feature (340)..(340): n is a, c, g, or t
  misc_feature (350)..(350): n is a, c, g, or t
  misc_feature (358)..(358): n is a, c, g, or t
  misc_feature (362)..(362): n is a, c, g, or t
  misc_feature (432)..(432): n is a, c, g, or t
  misc_feature (443)..(443): n is a, c, g, or t
tggtggttgggaccacactcccgaccctaccagataggctgggttatgctcactttcctagaatattttaggaacatatgtagctcaannaggaaggcgaatgaggatcattctaagggatgggttggcaagcccacttttctgaaatgggaagcaatatacccctaactgggccatntctccctggctttggtcctccctctagatttcttatccaccaaagctctgaacaggcaacagagagggaaccctgcagcaggaaaccncaacntcaacaatagtaactaaccattgtncnaaatntctnatatcaacccatttggttntcatcacanccctncaaagtaatnttgttatntccnttttatacaggaggaagtggagacacagaagggttaagagatttagctatgggcgctaatcccaactctntggggtctgantcaagagaatcttgagttggaggttagcc

SEQ ID NO: 3157 - DNA, 404 bp, Mus musculus
  misc_feature (54)..(54): n is a, c, g, or t
  misc_feature (70)..(70): n is a, c, g, or t
  misc_feature (84)..(84): n is a, c, g, or t
  misc_feature (87)..(87): n is a, c, g, or t
  misc_feature (152)..(152): n is a, c, g, or t
  misc_feature (204)..(204): n is a, c, g, or t
tgtagcccttattatctgcagcttccagacttccactctcctcatcctttatanaagggaactgtgttgnaaatgtcctgcaanctnccactgcaagccagccctcccctggggctgtattttgctgttttgtgatcacatttatcaacctnaaatacaaataaagacagaacatagtatttactaaaacaatgaaattttcantttattgaatgacaaatttttgctagatattttagatataagtattttggctacattgattaatttaagtgagtctattaggcattctgatatttaacaagtcttaaaatatttatagaaaataaaagcaaattggtataaatttttaagcaattctatttttctagagaagattagtgacaatctgaatatgtagtatt

SEQ ID NO: 3158 - DNA, 408 bp, Mus musculus
  misc_feature (164)..(164): n is a, c, g, or t
  misc_feature (172)..(172): n is a, c, g, or t
  misc_feature (189)..(190): n is a, c, g, or t
  misc_feature (193)..(193): n is a, c, g, or t
  misc_feature (195)..(195): n is a, c, g, or t
  misc_feature (197)..(197): n is a, c, g, or t
  misc_feature (205)..(205): n is a, c, g, or t
  misc_feature (225)..(225): n is a, c, g, or t
  misc_feature (285)..(285): n is a, c, g, or t
gcctgagggagcacaaataatccttcaaaacttagataactgtaccctgtcattcctgattcttaaaatacaattgaactgaagtcaaatgaataaaaatattttcacttctaagaaataacgcatgtacatgtgcatacatatacactctccacaaattctancttctatnaaatcatgtaatttctnnaantntnttcatcanacaggctacagtttttggtncctgtgtccatatatatggcatgatagaaatcatagtatattgttttcaagtttacaatntctgcttttcggaggaataacttttaaaataactgttctatttttttagcagcagttttgactttcactattttctgtatcttattttcaagaaaatgttgactggcaactttaaataaactt

SEQ ID NO: 3159 - DNA, 57 bp, Mus musculus
cttgccttcaaagtaagatgtggactgtgacctaatactgaggctttagctggtcaa

SEQ ID NO: 3160 - DNA, 464 bp, Mus musculus
  misc_feature (28)..(29): n is a, c, g, or t
  misc_feature (31)..(32): n is a, c, g, or t
  misc_feature (42)..(42): n is a, c, g, or t
  misc_feature (49)..(49): n is a, c, g, or t
  misc_feature (56)..(56): n is a, c, g, or t
  misc_feature (60)..(60): n is a, c, g, or t
  misc_feature (66)..(66): n is a, c, g, or t
  misc_feature (77)..(77): n is a, c, g, or t
  misc_feature (87)..(87): n is a, c, g, or t
  misc_feature (341)..(341): n is a, c, g, or t
  misc_feature (355)..(355): n is a, c, g, or t
  misc_feature (379)..(380): n is a, c, g, or t
  misc_feature (434)..(434): n is a, c, g, or t
cccttctgtagctttctgaggctgagtnncnntcccactgcnatatgcnaactgangctnatctantcaatctgcgnaaggactttngttttttcccaccttttgaccattgtgaaggagaatatataaacattgcacattgctgtacaagtaacttttgtttcccctctttacggctttgggtatctgcccagaagcgaaactgcctaggtacaggtacacccgatgtttcattttttgaggaccccatcccccaaacacacacaccatcacctggcacagacacgcctttttacattgccaccaggatgtgaagggtccaacttcctgcaggccttgcnagtattgattgctntccttacaaataaagaataaaaannttgaggctgaatcttaacaacaggatggggactggtgcgaccataagaacttancaactgttcatttgtgcagtctgatcacta

SEQ ID NO: 3161 - DNA, 210 bp, Mus musculus
  misc_feature (62)..(62): n is a, c, g, or t
  misc_feature (71)..(71): n is a, c, g, or t
  misc_feature (145)..(145): n is a, c, g, or t
  misc_feature (147)..(147): n is a, c, g, or t
tggctctgacatctacttccagtgaccttggacaagttgctccttccttctagagctcagtnttccaagtnagaagacagcaggagataatatccaccattctctggctgccttggaatataatgctgcctttgtggcccccatntntgctctgcctcctgacaccaggccgacttctgacacacaagccttctgtcaatgccagggaga

SEQ ID NO: 3162 - DNA, 502 bp, Mus musculus
  misc_feature (334)..(334): n is a, c, g, or t
  misc_feature (354)..(354): n is a, c, g, or t
  misc_feature (378)..(378): n is a, c, g, or t
  misc_feature (381)..(381): n is a, c, g, or t
  misc_feature (387)..(387): n is a, c, g, or t
  misc_feature (396)..(396): n is a, c, g, or t
  misc_feature (459)..(459): n is a, c, g, or t
  misc_feature (466)..(466): n is a, c, g, or t
agtttacttcattctgtacatgtgaagaaattattcagtaattaacagttaagataaactaagtatgtagtaataccagacctctaccaattttttctatccaaacttaattttagagtctctatctttgttgggggctggggggtggtacatacctttaatcttagcacttgagaggcagagggatccccgagttagagatcagccttgtttatttcaacaaaactttctaatttcttatctgggctgctggtcttgattttaagctgcttaacagtaatatttttcttgagatagggtcttactatgtggcctgggaacttatgatcctccngcctcagcctccctagtacnagttagtgtgcatcctaggccctnatnatcaantctgccttnatttagttatctcccttatattttaagtcaacatggtcattactttcccatttatcatcttanataactntcttaagtagtaatgcacagtagtttcagaccttag

SEQ ID NO: 3163 - DNA, 462 bp, Mus musculus
  misc_feature (179)..(179): n is a, c, g, or t
  misc_feature (219)..(219): n is a, c, g, or t
  misc_feature (246)..(246): n is a, c, g, or t
  misc_feature (274)..(274): n is a, c, g, or t
  misc_feature (304)..(304): n is a, c, g, or t
acagtactctccacatgaaactaccctgacttcagaactaactggcagctaccctactacccttcttcatagtacagttgctaaggaggagattgcagtaccaggatttcaggtgtggcaatccagctaaactgctgacaaggttctcactatgctaaactaccttcccattcctatcntgggaaaatgttttaagacactaaatattgggtaattcgntatacaacactagtcagtagaagatcnggttgtgacttttgtgttgtttactttntagttcctctttctcatgtcttcttccttntacctcctcctccctccctctctgatgctgagaactaaaactagggtcctgctcgttggtatcaggaaccagcttgccagattgcctctgaacccagtgatgtcacccatagggaacagagacatgcacatctgttaccatggcaatcacattcccag

SEQ ID NO: 3164 - DNA, 409 bp, Mus musculus
  misc_feature (317)..(317): n is a, c, g, or t
  misc_feature (367)..(367): n is a, c, g, or t
  misc_feature (375)..(375): n is a, c, g, or t
gatttttgtctgtgaggtaccccttgccctagtggatcagttacaggcctatgtccagcaccagagtccctgttccgatatcatcacagatagcctgttgttttccacagaggagccagatgtaagtcagacacctccagcctaccagtctcctgccatcagctttggctctaatgggctcttggtggcctccttggtgtgtcactggtacaggacagcaagtggctcagaaaggctgcttgctcctgagctcagccacttattcacatggttcagagcagatctttgtactcttcagactcaagtatggtgatctntttgacagtagaggtctggcctacccctcaccctcattctccagcacctntaacaagnaccacactcatgcctctggtgtcagttttcttgt

SEQ ID NO: 3165 - DNA, 534 bp, Mus musculus
  misc_feature (50)..(50): n is a, c, g, or t
gaggtcttcgaaagcccaggccttgtccgtactggtgaaactttatgctnctctgaagaggatgacttctggtggcgactgccaggaccactctagacctgagtcgagttcctcaccgttttatcccgattgttctgcgcggcctgtcccgccaagccctcggccttctcacaggcagagagcaccaaaggacacctttttgcggttcgacgacccggtgtgacggtggatgtgagaatccaggaagaagatccggttgcattgctgggatgccgcgcctgtccggccaccacctccgcatggaggctgcgggttcctggggaccccacctagttcggtgcttctctctccctttactctcttggcgcagcagggacgcccagctggaaatcaaagccgggcgggagggattctgaagacgctaggggacatcagggaccagaatgaggctaggcctggattcatcgcccgggacgcgggagccacggggagctgggcgcaggcactgctctaatcgccgaccgctattaaaaa

SEQ ID NO: 3166 - DNA, 542 bp, Mus musculus
  misc_feature (377)..(377): n is a, c, g, or t
  misc_feature (383)..(383): n is a, c, g, or t
  misc_feature (385)..(385): n is a, c, g, or t
  misc_feature (449)..(449): n is a, c, g, or t
  misc_feature (501)..(501): n is a, c, g, or t
aaaaagttccgagtgccagaccacatagctgacccattgcagggcaggcaagttacatgctggaggggccacgcagtaaatatttcagactttgtaactctgctcagttctgcatttgtaactggagaacaactttgggcagctccccaatgagtggatgtgactgtggatcaatcaaacagaactcttgggggcaggatggctcagaagttaagatcatttgatgtgaaattacgagcagcagatcccagcaccgtctgtgggacaagtggaccatgccagcagacagaagaactagtaaggttgagcaggtttaaaaccccagggaatcttaacattgagaatagcaggcttggaaacagcttcctgccaagctnttcctntnctggaacaggtaagcatgacaccccattgagaggacctcaatcacatagggacaacacctgaantccttccccacacaaatagagcatgcctaacatcccagactgagctagcacnaagcatctaactctggacccctccttatgcctggaatgtat

SEQ ID NO: 3167 - DNA, 461 bp, Mus musculus
actggttaaaacaagcccctctgatgcagtttctggagctttctggctgtgaggcagctaaggactgcataaagaaggaagagacatgtcttggtatgtgacactctctaggtcagactctcctaactccaaaccatagaccccaaccttgtgaggggaccctggttcctacccaggtcaagttccaatagctggatgtattcaaggagtacagttgcacatgccgtgggctctgtgcaaaccagcagcatgaggccactttcaacagtcatttcttttgctctctcctagattggaggtttgggaaagttggggtctaactagggcaaaatacaatttcctgtttgcattggggaattatggctcttttccaactttccttttccctgtggctttccctatgatccatttgtgacagttaacatcttagggaggcaaaatacttcaagcacttctctcct

SEQ ID NO: 3168 - DNA, 100 bp, Mus musculus
  misc_feature (57)..(57): n is a, c, g, or t
  misc_feature (59)..(59): n is a, c, g, or t
tccttgaattttactctgggtaaaggtttgctgtgtgtccacccctccatttcactntnttcttaatgatactccacccttcctggtcaaaagaagccat

SEQ ID NO: 3169 - DNA, 353 bp, Mus musculus
  misc_feature (136)..(136): n is a, c, g, or t
  misc_feature (235)..(235): n is a, c, g, or t
  misc_feature (254)..(254): n is a, c, g, or t
  misc_feature (273)..(273): n is a, c, g, or t
atgtatccaacagactcttccatagcaactgggcgtaactaggacttccgtggttcagcagcagggtgtcccgtccttttctgtctttatgcaattgtgctcttgagtatccttgtctcgctgaaggcactgatancccacacctcaagtgtgcctttaagcctgactgagtatttctctatgaggtatcttggaggcatttttctcctcctaaaataagttccaacacatgaanccaactgactgaatgccanccatgcctaaagcttaacnatagaagctggggacttatgccatggttcacagtattctgaggcatgacaggtacacccctctatctgtacagttgcttg

SEQ ID NO: 3170 - DNA, 517 bp, Mus musculus
  misc_feature (49)..(49): n is a, c, g, or t
  misc_feature (54)..(54): n is a, c, g, or t
  misc_feature (246)..(246): n is a, c, g, or t
  misc_feature (262)..(262): n is a, c, g, or t
  misc_feature (336)..(336): n is a, c, g, or t
  misc_feature (361)..(361): n is a, c, g, or t
  misc_feature (369)..(369): n is a, c, g, or t
  misc_feature (378)..(378): n is a, c, g, or t
  misc_feature (390)..(390): n is a, c, g, or t
  misc_feature (398)..(398): n is a, c, g, or t
  misc_feature (437)..(437): n is a, c, g, or t
  misc_feature (444)..(444): n is a, c, g, or t
  misc_feature (452)..(452): n is a, c, g, or t
  misc_feature (466)..(466): n is a, c, g, or t
  misc_feature (472)..(472): n is a, c, g, or t
ggctttactgagctcttaacataacatcagttatttctcatgtgacaancccanatcagagaaatctaactctttgtccaaggctagggtggcaatatagaacttaggtcacccagcccaagtatctcaaccagttcctcccatcactcagttcaagtacctcatccagctcctcccatcacttagcacaagtactgcatccagctcttcccatcacccagcccaagtacctcatccagctccttncatcaccctgcccaantactgcccccagctcttcccatcacccagcccaagtactgcatccaggatcacccagatccagggtgcctgatncagcaccagagttctcattctcagnatggtctnggctgattnaatgttctattnccatcctntcttaaagttctttactctcagggttggagagaaagctnggctgtncaaacatnccagtgtgtgcttntcatcntctcagcagtagggaggcagagacaggaggctcccgggtctcact

SEQ ID NO: 3171 - DNA, 510 bp, Mus musculus
  misc_feature (316)..(316): n is a, c, g, or t
  misc_feature (325)..(325): n is a, c, g, or t
  misc_feature (330)..(330): n is a, c, g, or t
  misc_feature (335)..(335): n is a, c, g, or t
  misc_feature (365)..(366): n is a, c, g, or t
  misc_feature (368)..(368): n is a, c, g, or t
  misc_feature (381)..(381): n is a, c, g, or t
  misc_feature (383)..(383): n is a, c, g, or t
  misc_feature (386)..(387): n is a, c, g, or t
  misc_feature (399)..(399): n is a, c, g, or t
  misc_feature (422)..(422): n is a, c, g, or t
  misc_feature (464)..(465): n is a, c, g, or t
  misc_feature (470)..(470): n is a, c, g, or t
  misc_feature (480)..(480): n is a, c, g, or t
  misc_feature (485)..(485): n is a, c, g, or t
gaaaacacagccaggtagcgctccgtattgcgtgtattttgcttgaagtaataatgcggttgaaaaataagcccacctattggccatcggagttactgaaagatgctaaacattgatgttaaacttaaaaaaaaaatacaatttgtttctccatttctcatgtcagcaaggagatttggaactgagcctgcagacagggctccccactacctcgttgtccttagataggagcaagacaccttaaaagtgggatttctctccatcctttccctttccccgcgtaaagaacctcttgatgtttgtgattgattgcatngcccaaatnctganatatnaacgaccttcttggactgaggacccaaagnnangaaactgaaaccnantcnntcatcacaattnaagactcccctggctttaattancctgacctggggtatatctcccggttgcttgagttaaagagnnaagancccattatantccantctgagaccgatagctacttaattg

SEQ ID NO: 3172 - DNA, 229 bp, Mus musculus
ttgctgctactaccactcgcagtggcctctgagggcccaaaccgctgtgataccatataccaaggctttgctgaatgtctcatccgcctgggggatggcatgggtcgaggaggcgagctacagactgtctgcagatcctggaatgacttccacgcctgtgcctctcgggtcctgtcaggctgcccagaggaggcggctgcagtgtgggagtcactgcagcaagaagctc

SEQ ID NO: 3173 - DNA, 354 bp, Mus musculus
  misc_feature (289)..(289): n is a, c, g, or t
  misc_feature (292)..(292): n is a, c, g, or t
  misc_feature (299)..(299): n is a, c, g, or t
  misc_feature (309)..(309): n is a, c, g, or t
  misc_feature (314)..(314): n is a, c, g, or t
  misc_feature (327)..(327): n is a, c, g, or t
aaaacctttccccatctgatcttatgacatgctatgttatagtcaacctttgtttgggagacagtgagcaaaaataggccatgctcttgcctcttccagctggtagaaaaggagaattagcgtttttgtttgtttggttggttggtttttttgcctttggcggttctggggatggactgccttctacttgctatgcaaaggctctaccactgagccataccctggctagaagtaagaattgtgtgtggatgcctgtgtgtgtgtgtgtgtgtgtgcccgagcactcatntgntggctgnccagagtttnatatntggtattcacctnatttattcatacatgttcttacactga

SEQ ID NO: 3174 - DNA, 230 bp, Mus musculus
ctcatctgttccacctgtgtaagaggtggaactaagcttgtttaaaatgtgctttatatttagcaccaggattctagatgagctgggcattttgtctcttggctgcaatcccagtcccaggaagctgaggcaggaggattgctaagtgttctaggggagacatttgccttttaaaagtatgtgcaaactgggacttactacctcagattcctgtataaaatagggcatgc

SEQ ID NO: 3175 - DNA, 495 bp, Mus musculus
  misc_feature (116)..(116): n is a, c, g, or t
  misc_feature (136)..(136): n is a, c, g, or t
  misc_feature (153)..(153): n is a, c, g, or t
  misc_feature (324)..(324): n is a, c, g, or t
  misc_feature (328)..(328): n is a, c, g, or t
  misc_feature (373)..(373): n is a, c, g, or t
  misc_feature (380)..(380): n is a, c, g, or t
  misc_feature (392)..(392): n is a, c, g, or t
attgagcttccaatttagtggttcaggttggtgtaagcatcatttattagtcttataacttattaccattgtttaggaaaaaaacctgagcagaaatttttatttttttttttttntgaagagcattgctaggttntgatgtctagggatgcnaatttaagtgataaaactattaaaaaaaaaactacaaggaagtgatgcttctatccttggggtcttggaggtgttagttttaatttaatttatgagctcatacatttgtgtgtttgttacctgggttttatattttacataaaaatatttttaagaagcctgaatgtaatncagnatagaaggtgcttaggttaagttaataattttcaagataatctgntttcctntcacatcctttnatcttttccctgttgattaaaaattttagtcattggtgtctagcttaagggcactccctgggctcttctttgctaacaggtttagacttcttgcatcataaat

SEQ ID NO: 3176 - DNA, 290 bp, Mus musculus
aacagctgcgactgaaggttcccaggatacagcttcccttttctcagatgttgtagatagtgtcctgaatcagagtcataatttatttgaagaccctgcgtcttctgccccctgtgttccagagtgggtccagcaggagcttagtcataccagctcctggagtccagctcttgtcgaaaagtggtttcctttctccaacgccagtggtgctacttcagacttgatggaatcattttggttgttacacgctgcctcacctgataatgatgaatcctccaaaaccgaaagtg

SEQ ID NO: 3177 - DNA, 520 bp, Mus musculus
  misc_feature (67)..(67): n is a, c, g, or t
  misc_feature (69)..(70): n is a, c, g, or t
  misc_feature (77)..(77): n is a, c, g, or t
  misc_feature (98)..(98): n is a, c, g, or t
  misc_feature (100)..(100): n is a, c, g, or t
  misc_feature (123)..(123): n is a, c, g, or t
  misc_feature (331)..(331): n is a, c, g, or t
  misc_feature (383)..(383): n is a, c, g, or t
  misc_feature (401)..(401): n is a, c, g, or t
  misc_feature (476)..(476): n is a, c, g, or t
agatatctgaattttgactccaaagtctccgaaactttctccactatattacatcctctataatctntnntacccgnttgtaactttaagtaaatgtnangctcacatgaacagagaagtcantttgccttttactcttcagagaatcttctggaattactcagaccacagtcatctcaacaccacatccaaatacagggaaggttccatatagcatattgtattaactgaagtgcacacacaaatctacacacaagacatatgatctctgctcgtttaacaagacattcacaggcactgaactaagcagaataaataagcaaccataaancaaaggtctaaaacaatcttgtttctaatgctcatttcaagattcagttaancagaaatgggaaatactntcttgggtttaaaatgtgttgatacaatcaatttcaattttaaataagcccgtgaactttcgtgtatgaagcccnaaatctatatgaataattcacaatttgtgaagccactgagctat

SEQ ID NO: 3178 - DNA, 109 bp, Mus musculus
gggccattgctgtatgctctttgtgtcaggacaggaagagggcaggttggaaaggcacaattggatgcatctagtagtgtatacaagtcccttttaagattctggctct

SEQ ID NO: 3179 - DNA, 214 bp, Mus musculus
  misc_feature (26)..(26): n is a, c, g, or t
  misc_feature (47)..(47): n is a, c, g, or t
  misc_feature (90)..(90): n is a, c, g, or t
ggctgaattccctaaggctgggttancccctggtacatgcaggcccnttgctttcttcgaggaaccagctgccttctctgtctccttgcngttcatattttcctcgggccattgctgtatgctctttgtgtcaggacaggaagagggcaggttggaaaggcacaattggatgcatctagtagtgtatacaagtcccttttaagattctggctct

SEQ ID NO: 3180 - DNA, 152 bp, Mus musculus
caaaacctccgtcttccattttctggtactccctctcatccatgtccctcttcccacctcaaatccccaaactctggcctctttcaagggcccgttctcccccttggacagattgggggggggcgggggaggtcgccagaaaaccgcccatc

SEQ ID NO: 3181 - DNA, 490 bp, Mus musculus
  misc_feature (55)..(55): n is a, c, g, or t
gttttgaaccacctccatcaaggatctgaagcagtttgagggattatattatttnagaccctaacttcccatctggttagctgttgttctctagaagctacatgttgctaacctagaaaagtgcaaagtcttagctttctcctttctcacttcaagaagaagctctggaacaacctatctggtgctcaattcacagtgattcacttacacaggccacatgtcttgagcttcttggtgctataaccaatccaatatgtttgatgctactcctgttgctaattcaagtattttctttttaattcaagtatttttattttaagttctgtcactaaagataatgtgatggggaaaaaatgtatttctccctaccattgccctccaaaataatggtgtgacatccatggctaacgcattgtctcccccatgtttctgcactgctgctttaccacctgattcccacactccttatgtatccagtgagtacctcagt

SEQ ID NO: 3182 - DNA, 528 bp, Mus musculus
  misc_feature (164)..(164): n is a, c, g, or t
  misc_feature (318)..(318): n is a, c, g, or t
  misc_feature (325)..(326): n is a, c, g, or t
  misc_feature (406)..(406): n is a, c, g, or t
  misc_feature (471)..(471): n is a, c, g, or t
tcatacttggaacaaacccctttggtaatgtcaaaggcagtacctaaaccaggaattggaatagtctcaacattctttatgtttaggtagtagtttgtaagatttctgtaagaggtccttgtgtgaggagtcttacaaacttatttgctcatacatacttcttntgatatgtaattcctagatattcttagccttcatagttagcattcagaaactatgagaaagcatttgaaattctgagaaccaacacactgcctatagttggagtttattttgaaatgttgatctaaacaatgctgcacctgttttagttatttnatatttnnaaaaatacttttcttattattaaatcactttgtttctagaaaaatcagaagttataagtaagcaaggaaaagatactatnaggtaatttgatccctagtacacactgtacatatcttggtatatctttccaagtggttttatgtntcttgtttgtatatatgtatattttattttcacaaaatctgatcatactgtgcatta

SEQ ID NO: 3183 - DNA, 387 bp, Mus musculus
  misc_feature (38)..(38): n is a, c, g, or t
  misc_feature (52)..(52): n is a, c, g, or t
  misc_feature (89)..(89): n is a, c, g, or t
  misc_feature (94)..(94): n is a, c, g, or t
  misc_feature (113)..(113): n is a, c, g, or t
  misc_feature (359)..(359): n is a, c, g, or t
acctttttccattgagtctctcactggcctagaacttnccaaataggctctnctggctgaccagtgaactccagagatctgtctgtctnatccnttctaattctggaattgtnaactcgaatccttcactcattgattagtccttgtctggatcacttaaagcctcaggcctgcagttcccccaaccacgtggccttcatgtggagaagtggtctctttctcctccaagagactgggatagcctggtgcacagctaagcaaatgcctctttaaggacccttgcgaatgaaaagagagcttggagagcctgctgggtaatattgccacttggaggctgaagcaggattgtgagtttgganccagcctgggctatttactaagactgtg

SEQ ID NO: 3184 - DNA, 469 bp, Mus musculus
  misc_feature (156)..(156): n is a, c, g, or t
  misc_feature (279)..(279): n is a, c, g, or t
  misc_feature (304)..(304): n is a, c, g, or t
  misc_feature (320)..(320): n is a, c, g, or t
  misc_feature (332)..(333): n is a, c, g, or t
  misc_feature (335)..(335): n is a, c, g, or t
  misc_feature (401)..(401): n is a, c, g, or t
  misc_feature (406)..(406): n is a, c, g, or t
  misc_feature (412)..(412): n is a, c, g, or t
  misc_feature (418)..(418): n is a, c, g, or t
  misc_feature (440)..(440): n is a, c, g, or t
gaggcctaagccttggcatttaagtgaaatatttgcaggaagaaaaaggaaatgctaagcccaggaagacagaagttacagctaatgcctcacacagatacagaattcagacgaatgcaagaagacattggtagacaagagtgcttactctccagnaggtgcgacgaactggtctcatgcctattaaactcaacactggtgcagtgagggaagccgtggaaagtgtacttctctaggcaccccagtattgcctcttcaagaccctgcagtgtggccagntctgtgggcgacatggacagaaatnttaaagaaattgactnttcttgctctanncngaggcctccacatcatgagcctccttgagaagaatttcccggccccaaaccaagcaaaggtcagancccancacagntcagancccagcacaggtcagagcccancacaggtcagagcccttgacttggagaat

SEQ ID NO: 3185 - DNA, 296 bp, Mus musculus
  misc_feature (93)..(93): n is a, c, g, or t
  misc_feature (103)..(103): n is a, c, g, or t
  misc_feature (232)..(232): n is a, c, g, or t
gctctccacggaggacgtcgtcggtggcctgcaacagcatgccctcccgcatctgcgagttctccagcatgatgaacagcttgtcccactccngagtgctccntggcggcagtcgcatggcgtggctagaacgcaggacacacacaagtgttatcagcttgtcctgggtggccatgggttgcactcttggtgactccaagtttcagcctgtccccagcaaccgctctccttntaaggatagctctgaaaacagcgtgcgtgtaaactcaaagatgacacaggactattctttatag

SEQ ID NO: 3186 - DNA, 548 bp, Mus musculus
  misc_feature (33)..(33): n is a, c, g, or t
  misc_feature (42)..(42): n is a, c, g, or t
cattgttcagaagcctctactgaggctccagcncccccttanctgtaaactctgtaaaataatataaaggaagttataaactttcaatatgtatgagtccagcttggctgcacagtgagtgagaccaacaacaaccaaccttttaacttccaagggcacaggttaaaataggaaagaatgagtgcatcaaaagaaaaaatcagaccaaagctgacaggagtctgctgggaaataccaaatcctgaaatgtggcattccaaacctggagctcttggcccagcatctgggcctcaacagtctacctgctgcacatgcagcctctctcatggggtagttctgctcacccatgcctttcttgggaaaacataccatggtcctggtgttttcaaaattctgaggtcctgggctgacaagatggctcagtgagtgaaggcatttgctgccaagtcggaggaggtgaattagatccccaaggcttacgtggtggaaggagaggactgactcccacaggttcttatctgacctccacacttgtgctttggcaggca

SEQ ID NO: 3187 - DNA, 516 bp, Mus musculus
  misc_feature (281)..(284): n is a, c, g, or t
  misc_feature (286)..(286): n is a, c, g, or t
  misc_feature (288)..(292): n is a, c, g, or t
  misc_feature (294)..(294): n is a, c, g, or t
  misc_feature (296)..(297): n is a, c, g, or t
  misc_feature (299)..(300): n is a, c, g, or t
  misc_feature (306)..(306): n is a, c, g, or t
  misc_feature (311)..(311): n is a, c, g, or t
  misc_feature (318)..(318): n is a, c, g, or t
  misc_feature (323)..(323): n is a, c, g, or t
  misc_feature (326)..(327): n is a, c, g, or t
  misc_feature (335)..(335): n is a, c, g, or t
  misc_feature (339)..(341): n is a, c, g, or t
  misc_feature (356)..(356): n is a, c, g, or t
  misc_feature (373)..(373): n is a, c, g, or t
  misc_feature (386)..(386): n is a, c, g, or t
  misc_feature (401)..(401): n is a, c, g, or t
  misc_feature (407)..(407): n is a, c, g, or t
  misc_feature (409)..(409): n is a, c, g, or t
  misc_feature (417)..(417): n is a, c, g, or t
  misc_feature (431)..(431): n is a, c, g, or t
  misc_feature (435)..(435): n is a, c, g, or t
  misc_feature (439)..(439): n is a, c, g, or t
  misc_feature (451)..(451): n is a, c, g, or t
gggagtcctttgacgagaccaacacctcggtcaccagccaactggtccagtcctcttacttctcctaccaacacgtctcagaatacgttatctccaagtgcatttgattacgatacagagaacatgaattctgaagacatttatagctcccttagaggcgtcactgaggcaatccagaatttcagcttcagaagccaagaagatatgagtgagccagtgaggagggaccctaaaaaggaggatggtgacacaatatgtagtggtcctgggatgtcagatcnnnnangnnnnngngnnanngctgcngacgncagccanccagnctnnggataatnaagnnntcgttgctccactcnatgccactccactcctntccacgctcccgngactataacccatanaactantnagatagcntcagtcctttcaancaantctnccctcaaggaanccatgtttgatgatgaccccgaccaatttcctgatgatctttccttagaccattctgacctagtt

SEQ ID NO: 3188 - DNA, 525 bp, Mus musculus
  misc_feature (159)..(159): n is a, c, g, or t
  misc_feature (164)..(164): n is a, c, g, or t
  misc_feature (247)..(247): n is a, c, g, or t
  misc_feature (303)..(303): n is a, c, g, or t
  misc_feature (311)..(311): n is a, c, g, or t
  misc_feature (350)..(350): n is a, c, g, or t
  misc_feature (354)..(354): n is a, c, g, or t
  misc_feature (380)..(380): n is a, c, g, or t
  misc_feature (390)..(390): n is a, c, g, or t
  misc_feature (393)..(393): n is a, c, g, or t
  misc_feature (409)..(409): n is a, c, g, or t
  misc_feature (438)..(438): n is a, c, g, or t
  misc_feature (442)..(442): n is a, c, g, or t
  misc_feature (500)..(500): n is a, c, g, or t
atgaatattggctgtgggtccccaggatgcttgtctctgcattaccctgtccatctcatgggtcaagcattaaacatcagttgatagataaagatatcctaagagatgaagctccaggtattaagtctgtaactttataagaagattcaaacccagctngatanccctgtcaaaaagcatagccagcagtatgtggattacaggagagtttagtggactttttggttgaatatttatggtctggttntcgtgttaaaccttgtgtaaggtgaagtgtgtggttttaatcgtttcaagggaacnatgttagntagcgccagattctcattgatatgtacccatcaccaccntctntctgcagagaaccatctatgttgaanctgtacccantcnatacagctcttcctantccttggtagctactattggtactttctntctntgaattatgacgtttttaggcaccccatcaaggtaaaccatacatatttgtccatttntgcctggcatacttagtgtatttca

SEQ ID NO: 3189 - DNA, 511 bp, Mus musculus
  misc_feature (34)..(38): n is a, c, g, or t
  misc_feature (291)..(291): n is a, c, g, or t
  misc_feature (364)..(364): n is a, c, g, or t
  misc_feature (437)..(437): n is a, c, g, or t
  misc_feature (440)..(440): n is a, c, g, or t
gccttctttgtctggaaattccattttatatctnnnnntgcagagcacagaatgtcatttcgtgtgtttattcctataatgcattcttgcacttatgcgatgcttcacttaaaaagactttagctctttctcttcttttgccctaaatcaataactttaatgcctactccaaataagctaaaatagtttggataattttcaggcaaatggcaaacttttgctttttagcagttaaaaactttctgaaatatttaaaaatctcttttgacagtatattaaagtgagcagaanccgttatctaaaggtaccattcaacttttcatgtgcttaaaatattacagacaaattgaggaggcaacttatnatagaaacaagagacttaaatgaagagatctcctgaaagaaaggaaacatttgtgacaaaatgtaaatgccanatntgtggtgctccttctgtggtgtgagtcaaaggtcacgctgaaacttcagagcaattacaaacttcccaacc

SEQ ID NO: 3190 - DNA, 513 bp, Mus musculus
  misc_feature (44)..(44): n is a, c, g, or t
  misc_feature (198)..(198): n is a, c, g, or t
  misc_feature (281)..(281): n is a, c, g, or t
  misc_feature (289)..(289): n is a, c, g, or t
  misc_feature (293)..(293): n is a, c, g, or t
  misc_feature (305)..(305): n is a, c, g, or t
  misc_feature (357)..(357): n is a, c, g, or t
  misc_feature (399)..(399): n is a, c, g, or t
gtagtggtgaatactgccctcaaaatctaaagtctttaccattntgcttctttcagaaaagccttcttggcacctgtgctagatgcctgagcatttttaattatctcttttagggctagttggccatgctgcttaaacagtgaaatcggctcacactcacacacgtgtccaaagcactgactcactgctaagtgtcangcacatttggttggtgcaggcctcttagcaggaggattcaagtgcttttagagtacgtgcagatggggaggcgggtggctcancaagcccntgancacagttaactnaaaagtgttatttaaactgtaaaatttgcattttgttctgtttaatttttanttgtatagtttcagaattcccaggataaatagctatgtgcanttgaaatatcttctgttcctagctgtttacatttcttggcttttttttttcaaacataatattttattgattatttgggaatttctcacactgtactctgatcacactggctac

SEQ ID NO: 3191 - DNA, 495 bp, Mus musculus
  misc_feature (130)..(130): n is a, c, g, or t
  misc_feature (264)..(264): n is a, c, g, or t
  misc_feature (277)..(277): n is a, c, g, or t
  misc_feature (281)..(281): n is a, c, g, or t
  misc_feature (286)..(286): n is a, c, g, or t
  misc_feature (307)..(307): n is a, c, g, or t
  misc_feature (340)..(340): n is a, c, g, or t
  misc_feature (356)..(356): n is a, c, g, or t
  misc_feature (365)..(365): n is a, c, g, or t
  misc_feature (388)..(388): n is a, c, g, or t
  misc_feature (394)..(394): n is a, c, g, or t
  misc_feature (410)..(410): n is a, c, g, or t
  misc_feature (417)..(417): n is a, c, g, or t
  misc_feature (426)..(426): n is a, c, g, or t
  misc_feature (440)..(440): n is a, c, g, or t
  misc_feature (444)..(444): n is a, c, g, or t
  misc_feature (467)..(467): n is a, c, g, or t
tctgggattcactgccatcaagtcagtcctggaagcctcaacctactctgaaacacctgcctgccagaaccttaactctggctccagccagagcgccatagtttcaaggtataatctctaatgaagcgcnctaaggttccttaggactggctggttctggatctataaccatgtgaggcctcgatccttccctcagtgagactttccccacgcaccagagcccatagaaaggatagcaaggacgggctgcagagacgatcctgntccaagtgtaggncatngtttnggaagtacagaggcagttttnttgtgcatgtgtggtcaccgagagagaaccaangctgaggtgaaaacancagcaacanctgggatctccaggcttccacancctccnaaaacccttggagttncctggtnccactcagntctcaggactgtgncctncaaagggctatgatgggaaggcncggctcctggaggtggttcatgtggaca

SEQ ID NO: 3192 - DNA, 512 bp, Mus musculus
  misc_feature (162)..(162): n is a, c, g, or t
  misc_feature (397)..(397): n is a, c, g, or t
  misc_feature (419)..(419): n is a, c, g, or t
  misc_feature (459)..(459): n is a, c, g, or t
  misc_feature (487)..(487): n is a, c, g, or t
atggtgagcttctggttcattgagagacagtgtctcaaggcagtaaggtgggtggggacagagaaaggcatggggcatcctgtctccatgtacacgtgcacaaatgggcaaaccggcacacgcatgcttgcatcatgcacagaatccacatacagacacagnaactatggacttgaaaattaagatgattcacctgtttgcccgtgtattgacttggttacagagtatttgtagaaatgaaacaacgcaagtaaactgcccaaatagaggcgtttacccaatctcccattataacctggggccagcagcatttcccaagctttgtccctcccaggttacgttcccaggaatgcaatcacactgtacagaaatcatgttcccatgtgctctaccccancctgctaatctttgagggaacnatacaaactcctcaaacctaggctttagaaattatgttcntgggtgtgttttaacatctcacaacatnccgttcctttagctatcagtttggg

SEQ ID NO: 3193 - DNA, 133 bp, Mus musculus
gaaaagactgtcctaacatttagaagacctccatgttgtactttcccgtgcatctgccaccctgcattccctccaatccgtaattaagattgagagacttagttggatttgtggctcatttcctctggcctac

SEQ ID NO: 3194 - DNA, 412 bp, Mus musculus
  misc_feature (78)..(78): n is a, c, g, or t
  misc_feature (96)..(97): n is a, c, g, or t
  misc_feature (232)..(232): n is a, c, g, or t
  misc_feature (259)..(259): n is a, c, g, or t
  misc_feature (298)..(298): n is a, c, g, or t
  misc_feature (308)..(309): n is a, c, g, or t
  misc_feature (314)..(314): n is a, c, g, or t
  misc_feature (317)..(318): n is a, c, g, or t
  misc_feature (373)..(373): n is a, c, g, or t
gtgagaggcaccttccgtgcaatagctgcgtgctcatgtggggagttcttacatccctgacagccaacggaaacaacntagaggagcctcagtgtnnggactccgccggtccttgagactggatcttcagacacagttgttctttaatggcctgtggctctggctaacgctcagagcttacagttttctttatgactataggaaaacaaaacccagagaattcctattaacnattgagtgggcctgtgttacacagacnaagccagttgtctcaagggtatcactgtgtgccaatcanatcttcccannccagnacnngcggttctcagtaagcacgcatccacatcccgaccctcgttctctctcagcttgnaaagcagagtctgggatgtgtgcccataggaacttgaca

SEQ ID NO: 3195 - DNA, 543 bp, Mus musculus
  misc_feature (331)..(331): n is a, c, g, or t
  misc_feature (398)..(398): n is a, c, g, or t
  misc_feature (405)..(405): n is a, c, g, or t
  misc_feature (427)..(427): n is a, c, g, or t
  misc_feature (437)..(437): n is a, c, g, or t
gtccttattggagggtgtcgcaacaaagatgatgagtttagagtaaaccaactgagaagtctatctgagaatttgggagttcaagaaaatgtggaatttaaaataaacatttcattcgatgaattgaagaattacttgtctgaagcgaccatcggtctgcatactatgtggaatgagcattttgggattggagttgtcgagtgtatggcagctggcacagttatccttgcacacaactcaggaggcccgaagctggacattgtcattcctcatgaaggacagataactggctttctggctgagagtgaagaaggctatgctgactctatgnctcacattctttctctgtctgcagaagagagactccaaatcaggaagaatgctagagcgtctataancagattntccgaccaggagtttgaagtancattcctgtnttccatggagaagttacttacttagtgtccagtctgcacagtctgggtattttatacagcatggagctggagctataggtcatgggagaacccgtgcttcgtgtgt

SEQ ID NO: 3196 - DNA, 507 bp, Mus musculus
  misc_feature (240)..(240): n is a, c, g, or t
  misc_feature (242)..(242): n is a, c, g, or t
  misc_feature (247)..(247): n is a, c, g, or t
  misc_feature (255)..(256): n is a, c, g, or t
  misc_feature (265)..(266): n is a, c, g, or t
  misc_feature (270)..(270): n is a, c, g, or t
  misc_feature (272)..(272): n is a, c, g, or t
  misc_feature (278)..(278): n is a, c, g, or t
  misc_feature (295)..(295): n is a, c, g, or t
  misc_feature (299)..(301): n is a, c, g, or t
  misc_feature (303)..(305): n is a, c, g, or t
  misc_feature (315)..(315): n is a, c, g, or t
  misc_feature (327)..(327): n is a, c, g, or t
  misc_feature (335)..(335): n is a, c, g, or t
  misc_feature (343)..(343): n is a, c, g, or t
  misc_feature (363)..(363): n is a, c, g, or t
  misc_feature (394)..(394): n is a, c, g, or t
  misc_feature (413)..(413): n is a, c, g, or t
  misc_feature (467)..(467): n is a, c, g, or t
  misc_feature (481)..(481): n is a, c, g, or t
ctgatattcttttctgatcctgctcccatttttgtttgtttgtttattgaaaacagagtcttacttgtgtaaccaaggttgcctcaaactcaaaattttgtcactgcttccttagtgatggaattacagatgtgtttccccacctgacacctcctcctttttatttttgcttttcttgagacagggtttcatggatcccaggctgactgcaaacatggtatatagcctagattacttcgnanttctnacccttcnncctatcctnngttntnatggantactagggatcaaaccnagannntnnnacatgttagncaaactctaccnatttagcnacatcccnaccctttttcttttttttanagaattgaccacagtcatagacatatgatgnctttagtcaccttgatcanttaaatgtccctccatatcatgtctaagaccatcaaggaaggcagataatgcancctcatcagatcancctcaagaagagagcattcctaggtt

SEQ ID NO: 3197 - DNA, 458 bp, Mus musculus
  misc_feature (33)..(33): n is a, c, g, or t
  misc_feature (46)..(46): n is a, c, g, or t
  misc_feature (53)..(53): n is a, c, g, or t
  misc_feature (57)..(57): n is a, c, g, or t
  misc_feature (72)..(72): n is a, c, g, or t
  misc_feature (74)..(74): n is a, c, g, or t
  misc_feature (110)..(110): n is a, c, g, or t
  misc_feature (117)..(117): n is a, c, g, or t
  misc_feature (164)..(164): n is a, c, g, or t
ttggctggtccctgcgtctctgaatcagggatntgggcagcagggntgaaagntggntcacccttcctgacntntctgctgataggtggtagctggacccatctaactgntcttccnatgggagctataaggagttgcccacttgacatctttgatccagaganttctctgtggggctacaggcgaccacagtaagagctgaggactcacactgattgtctgaaatttttcacattgagtttctttttgctgttgcttctggggttctcataaattgataagcactttttaaaaaatctgtatgatactaacaaaaaatctggaagcagtagaaccatgtaagtgtgacggccctgtgatacagttattttaaattatgtttgtattttcctaatgtcttcctaatgttttagtatgtattatttataattatgtgcacatatgcttcttcttgtata

SEQ ID NO: 3198 - DNA, 543 bp, Mus musculus
  misc_feature (114)..(114): n is a, c, g, or t
  misc_feature (265)..(265): n is a, c, g, or t
  misc_feature (325)..(326): n is a, c, g, or t
  misc_feature (346)..(346): n is a, c, g, or t
  misc_feature (349)..(349): n is a, c, g, or t
  misc_feature (359)..(359): n is a, c, g, or t
  misc_feature (383)..(383): n is a, c, g, or t
  misc_feature (387)..(387): n is a, c, g, or t
  misc_feature (391)..(391): n is a, c, g, or t
  misc_feature (393)..(393): n is a, c, g, or t
  misc_feature (402)..(402): n is a, c, g, or t
  misc_feature (405)..(405): n is a, c, g, or t
  misc_feature (409)..(409): n is a, c, g, or t
  misc_feature (414)..(414): n is a, c, g, or t
  misc_feature (421)..(421): n is a, c, g, or t
  misc_feature (434)..(434): n is a, c, g, or t
  misc_feature (471)..(471): n is a, c, g, or t
tgagctttagcgtacgggtttgtgctttggcttaatttgaatgaagccttattttctgtaaactgagatagcttagggtttttattggggtgatggtggtgcagggcggtgcanattttgctgctgggagtttgttttccatctgttctgcttctagaagtttatctttttgtaaaatggtgttgcaattttgtctttatcacattaacccaataagacagcttgcatctcctgttatacccagaattttgttagtcagatttantaggaatggtatgatctgtgcatcatacatcaaacccttatttgtttatttatttattcnngtgtcccttgtgctcatgtntgntattggtggntcagattcagggcttcagtcactntagncaantnctgaccatnccncttntccancctaagnttttatatctttnataagaattgcagacagctcctaaaatatttcatgtnacatatgtgcttgatttcatattattgaaaaatgacctttattttaaaaggattacttattgtaccacacaa

SEQ ID NO: 3199 - DNA, 502 bp, Mus musculus
  misc_feature (33)..(33): n is a, c, g, or t
  misc_feature (71)..(71): n is a, c, g, or t
  misc_feature (248)..(248): n is a, c, g, or t
  misc_feature (267)..(267): n is a, c, g, or t
  misc_feature (295)..(295): n is a, c, g, or t
  misc_feature (396)..(396): n is a, c, g, or t
  misc_feature (406)..(407): n is a, c, g, or t
  misc_feature (440)..(440): n is a, c, g, or t
  misc_feature (463)..(463): n is a, c, g, or t
aagtcttccatttcagtcagctgttctaaaagnaaaatgcctagtgatctgggaaaataaaggaagtttanatttgtgattgagagtaagaaatgtttctgtggttttgaaaaagaaataccagcatgtcacattaaaattatggcatctacagttctgtacagttaacagaaaaacgtattacatcagggaataggatgtgcttcagagacctcatgtagggccatgagagaaaagcaagtgccatnaccggcttgcgcattaatnatccagtcagcggaagaattttcctgtntcccatgtaacataaaccagatgttccattctattaaaactccttactaatgcggatatttagatcactggtcactaggaaaaaaatgagtaatagcaatntagtactttnnccagtttgtcctgttgtgagataatgttggcantcaggagactagaaggtttcctnccaaatacgactaaatctcatcactctgtttttatctgt

SEQ ID NO: 3200 - DNA, 244 bp, Mus musculus
ctgttttctctttgtcgtgtgctaacatggatgtcttgtgtttgtggtaagtgattaaccatgttctggtggcgggtaccaaactgttcttcatgatagagtagctgcttcctctcagatgaacagaggaggtttaaattttttagtctctttcatatctttgattatgtcttctttgtattgtgttcttcggctgtcaaatctcttgaatatataacgtatgacattgtctgagtcttgactt

SEQ ID NO: 3201 - DNA, 417 bp, Mus musculus
atattcattgctatcctggttacatgtggcacctgggtcatgagttggacacctctgctttagaacaggcacagcgctcttcttggtccatcctagaaacgtgttaagaggcacgtgactcaagttcccttcaagataatgaccaaggattatgtattggttcattgtatttactgctcttgtagattaaacaatgaaacaacatcttaaggcacgctcatctccaacatcccatctagaaagttcttccatggattcaaggtcaataacatggatacattcaggacccaacctcttcagctttgatttctgaaggccagggtcattccaacccatagccgtagggtctattcaggagtatttagctggatagtcagggacctgagaccttggtttcctcgacctacatatttctgt

SEQ ID NO: 3202 - DNA, 427 bp, Mus musculus
  misc_feature (36)..(36): n is a, c, g, or t
  misc_feature (74)..(74): n is a, c, g, or t
  misc_feature (285)..(285): n is a, c, g, or t
  misc_feature (289)..(289): n is a, c, g, or t
  misc_feature (299)..(299): n is a, c, g, or t
  misc_feature (344)..(344): n is a, c, g, or t
  misc_feature (356)..(356): n is a, c, g, or t
  misc_feature (370)..(370): n is a, c, g, or t
gtgagtactggctcaggctgccattcacaaagtatntaagcaagaagggctctggtcagtttccctcagaagcnccatacctagtgagttatgtaggttagatagattccagataaagactcctagaaagaatccaactagcaggaccccaaggacagagagcatagaaaccattgacaaaagccaaaagccacccaaggccattctctgcccaatgcatcttagggtgacctgtatgtagagtacccaaagtcactccccttttccttgtgagtagagaccaanagcngggtagtttnggatgtacatggacagatcactgttaggaaaacagagcaaagggnagctaggtcttntcctctgagttaantcatccccttgtggtttcctgagggatacaactcagaggcaggaaccgtaaaaggct

SEQ ID NO: 3203 - DNA, 500 bp, Mus musculus
  misc_feature (202)..(202): n is a, c, g, or t
  misc_feature (214)..(214): n is a, c, g, or t
  misc_feature (302)..(302): n is a, c, g, or t
  misc_feature (474)..(474): n is a, c, g, or t
gtgactgccactgaaattaactggaaatcaagagccaagatagattacttttcagcctcagaatatcgtgaattataggtttttctaggaaactacctcgaggtagacaaaaacagtctgaaattaactggaaatcaagagccaagatagattacttttcagcctcagaatatcgtgaattataggtttttctaggaaactncctcgaggtagncaaaaacagtctcgattcagaagcatcgccaggagccgagagtgctcccacttatctgccaggacccgagagtgctcccacttatctnccagcagccgagagtgctcccacttagcagagttggctgttgcagctacttgtcaaaagtatcgcagttgactatgcatagtgctacaaggctatcttcattagactgaactgattggttgggtttttttgttgttgtttttaagttattcataagaagaacaggaattatntgacacattgtattactgacttacgt

SEQ ID NO: 3204 - DNA, 424 bp, Mus musculus
  misc_feature (59)..(59): n is a, c, g, or t
  misc_feature (73)..(73): n is a, c, g, or t
  misc_feature (238)..(238): n is a, c, g, or t
  misc_feature (371)..(371): n is a, c, g, or t
  misc_feature (377)..(377): n is a, c, g, or t
tatagcctacgttggtgtggaaaacaaactaacattttgttgattccagcacaaactcngaaagccaaaacanacaaacaaaccactctgggggacaaagggagggtgacttcaagcagtcctttctataggggtggctggctgaggtctgggactgtggagttgagaaaaagctaagtagatcatcctgaactaaaagttaccttgggaaacaagacttgagatccggggttgaggntcatgtggggggtcatccagtattcctttggagcatagcatagctgagaacttagcaggactcagtcacttcagactggagattgggaaatttcttcccctggcgtgcacagcaccaaacctgagttaaggtntccttncctctccctcaggatgctcccgacagaggtactgcacttcccaactg

SEQ ID NO: 3205 - DNA, 503 bp, Mus musculus
  misc_feature (283)..(283): n is a, c, g, or t
  misc_feature (326)..(326): n is a, c, g, or t
  misc_feature (340)..(340): n is a, c, g, or t
  misc_feature (362)..(362): n is a, c, g, or t
  misc_feature (391)..(391): n is a, c, g, or t
  misc_feature (454)..(454): n is a, c, g, or t
aaagctgtcaatgcctgttcagaggctgctggagagacacgccatagggtaaactgtgactgggtggctgtgcttccacttacaggccatgcccaggaaggcttgtaagctgccattacaaagtctgatggaaagacacctaaaatggtttctagtttcggggctttccccaccaatatcatttcctggaccatggtattcagttaaatccttccccttcttatacttgtgtagtttgtataatacatattaaagagtatagagaaatcatagacagtattgnaaaataatacacattttcctgtgtaagtatagatttaaacttngccattgctgtggnaaataactcattccttcacctnccttgtatgtaggatttaaccacatactncacttccatacgaagatggaatcatgtttcttggagaacatttctcaaaatatgctatttacnaaaaaattttagataaaaatttgaaagcatgcattctcatggaataaca

SEQ ID NO: 3206 - DNA, 476 bp, Mus musculus
  misc_feature (66)..(66): n is a, c, g, or t
  misc_feature (70)..(70): n is a, c, g, or t
  misc_feature (84)..(84): n is a, c, g, or t
  misc_feature (96)..(96): n is a, c, g, or t
  misc_feature (107)..(107): n is a, c, g, or t
  misc_feature (129)..(129): n is a, c, g, or t
  misc_feature (153)..(153): n is a, c, g, or t
  misc_feature (167)..(167): n is a, c, g, or t
  misc_feature (169)..(169): n is a, c, g, or t
  misc_feature (192)..(192): n is a, c, g, or t
  misc_feature (194)..(194): n is a, c, g, or t
  misc_feature (198)..(198): n is a, c, g, or t
  misc_feature (239)..(240): n is a, c, g, or t
  misc_feature (242)..(243): n is a, c, g, or t
  misc_feature (245)..(245): n is a, c, g, or t
  misc_feature (248)..(248): n is a, c, g, or t
  misc_feature (260)..(260): n is a, c, g, or t
  misc_feature (264)..(264): n is a, c, g, or t
  misc_feature (267)..(267): n is a, c, g, or t
  misc_feature (274)..(274): n is a, c, g, or t
  misc_feature (277)..(277): n is a, c, g, or t
  misc_feature (281)..(281): n is a, c, g, or t
  misc_feature (284)..(285): n is a, c, g, or t
  misc_feature (288)..(289): n is a, c, g, or t
  misc_feature (292)..(292): n is a, c, g, or t
  misc_feature (298)..(298): n is a, c, g, or t
  misc_feature (303)..(303): n is a, c, g, or t
  misc_feature (307)..(307): n is a, c, g, or t
  misc_feature (309)..(309): n is a, c, g, or t
  misc_feature (311)..(311): n is a, c, g, or t
  misc_feature (324)..(324): n is a, c, g, or t
  misc_feature (330)..(330): n is a, c, g, or t
  misc_feature (334)..(334): n is a, c, g, or t
  misc_feature (336)..(336): n is a, c, g, or t
  misc_feature (353)..(353): n is a, c, g, or t
  misc_feature (357)..(357): n is a, c, g, or t
  misc_feature (360)..(360): n is a, c, g, or t
  misc_feature (365)..(365): n is a, c, g, or t
  misc_feature (413)..(413): n is a, c, g, or t
  misc_feature (433)..(433): n is a, c, g, or t
tgcagcgccccaaccaggagcagaagcagatgctgggggagcatctgttcctgcttatccgaacantgcnattcaaacctggcngggaaaatcacngggatggtgcnggaaattgacaactctgagctnctgcacgtgctggagtccccccantccctctgctccangntagatgaagctgtggcagtcctncnggcnggttcatcatgccaagaaagaagctgcccagaaggtggacnncnntnctnctctacctcttngacnagnataagantcnaaanccnnatnnccnctcatnttatnccancntnaggtctgtagacntactantttntntccggacctccacaccnaganccnaggtncaaattcaataggtcattttgtatcagaaggtcaattatgaagcaccnataattttgaaattataagnatatattctctggcttctgttgtgacccagatgataacttttc

SEQ ID NO: 3207 - DNA, 469 bp, Mus musculus
  misc_feature (146)..(146): n is a, c, g, or t
  misc_feature (163)..(163): n is a, c, g, or t
gaggagatgactgctcacatagtgtaggttgaagagctgcaggccctgtacctgatgtctcctgtcttttgctcagcccagttgcttgtacttgataggtcacatctgtttacccattccttcacttggatgttgataatctgagncaatcctgacaaggtangactttccatgctatcaaggagaactcttaatatgggcttaggtagataataataaaataataggtttttctccagagaatatgctattatagagcagagattcagatctttggaaaaagcttttccatattttacctggaaatagtttatttctaaaaagcttcaatgacaaacaagtggcatgtatgtttccatccagtataaaggcagttctctttgcatgtgtttatacagctgtaaaaattacacttgagaaaataaacagcaaaacctcaaagggctgaccagtgtttgttaggatatac

SEQ ID NO: 3208 - DNA, 402 bp, Mus musculus
  misc_feature (291)..(291): n is a, c, g, or t
  misc_feature (297)..(297): n is a, c, g, or t
  misc_feature (307)..(307): n is a, c, g, or t
  misc_feature (309)..(309): n is a, c, g, or t
  misc_feature (311)..(312): n is a, c, g, or t
  misc_feature (318)..(318): n is a, c, g, or t
  misc_feature (355)..(355): n is a, c, g, or t
  misc_feature (362)..(362): n is a, c, g, or t
gtgtgagaactcagcccactttgctcatttcttatctctctccaagtcatactcagacactagctccctactctctcactctctgtggtgatggagacagtgcaggaagctgcggtgtgacgagaacataacttatgttaagttcagcccagggaagtgtgtctgccaagaaaacgactgacccgtttccatcagaaaagagggaaagagagagaagatgggactggtgtcatcaaagctagtgccaccaatcctatgcctctctcagtgcccccgcaaggatcagactancctcancttctatggntnanntttgcngggcccaatggtgcccaagagaattgccagaccactntcggggncaagcatatgggcacctctcctccagtggtattttagaga

SEQ ID NO: 3209 - DNA, 457 bp, Mus musculus
  misc_feature (347)..(347): n is a, c, g, or t
gagaacagtcatggtcctcctcaatggaaacccagctgataagacaactaaaagcattgctgctgaaagagagatgctttttaaacattaataacttgagggcgtggctcaagagaagagcatctgcctgccaagaacaagtccatggtatccccatacatgcacacacaacgcacccacatactcacacatgtacacatgcgcacacacacaaactaataacgctcaatatagtttctgtgccatttgtttttttttattgcaataatgataacttgttggtcctttgcctgccattttctctccttagatttcttttcaatttcttgaatttaagtgtgaaaaangagcctaaaattcttcaagataaaatatttttgtttggtgaatatattattaaccctaaatgattatatgtacgctcctcatagtatcatttgagttttagctttagtac

SEQ ID NO: 3210 - DNA, 503 bp, Mus musculus
  misc_feature (272)..(272): n is a, c, g, or t
  misc_feature (274)..(275): n is a, c, g, or t
  misc_feature (278)..(278): n is a, c, g, or t
  misc_feature (283)..(284): n is a, c, g, or t
  misc_feature (288)..(288): n is a, c, g, or t
  misc_feature (342)..(342): n is a, c, g, or t
  misc_feature (356)..(356): n is a, c, g, or t
  misc_feature (360)..(360): n is a, c, g, or t
  misc_feature (366)..(367): n is a, c, g, or t
  misc_feature (386)..(386): n is a, c, g, or t
  misc_feature (397)..(397): n is a, c, g, or t
  misc_feature (445)..(445): n is a, c, g, or t
  misc_feature (458)..(458): n is a, c, g, or t
atacctggagtgcatttgtgagctgtgccattgtggcacatgcctactgtgcgtacgttacagctagcgccaagcagccttgttcccagtgtggatgatcttggtagagtggagtctggtacacagagacagctgctcacgggatttaaacagaggagattggtgcacatgtgttgggttttggaattttttttgtgggggttttggtgttttaaaatgtggtgtttaggatgaaactcccgatgcatgctggcaagtacttgacccctgancnntanccatnncccnggagttacactctttgctctttcctcggccttcagttccttgaggtgcagtggnccccaggttggatncctnaccatnntcattagattggaagtctncctctctcctnttatgatctgctcttgacactgcagaagcagcagctcactgtatattnatctagtgttccntggtatgattagcgattaaagcaaaggtggtcacagacagtcatt

SEQ ID NO: 3211 - DNA, 514 bp, Mus musculus
  misc_feature (295)..(295): n is a, c, g, or t
  misc_feature (343)..(343): n is a, c, g, or t
  misc_feature (345)..(345): n is a, c, g, or t
  misc_feature (354)..(354): n is a, c, g, or t
  misc_feature (371)..(371): n is a, c, g, or t
  misc_feature (378)..(378): n is a, c, g, or t
  misc_feature (406)..(406): n is a, c, g, or t
  misc_feature (409)..(409): n is a, c, g, or t
  misc_feature (452)..(452): n is a, c, g, or t
  misc_feature (481)..(481): n is a, c, g, or t
  misc_feature (485)..(485): n is a, c, g, or t
tatgtacaaagttgtcctggccagaggattcatggatcttctctggctagccataaggctggctaaaagcactagaaagaacataagggaaagaggtaacatctatcaacaaaatgacagtatttgtaacctgttaaaactaactccaactttacattctggaaatcttagcatgagtaatttcaccaagcaacatctgccacaatctgaagtgaattctagcttacttaattctactttaaaaaccaacataagcagagatctgattaaaatatgctaactgtatatagtgaanaaatgatgtagctacttttaaaggataaattcaatttttacacataananatctatggnatataatttttaaattnaactagnatatacaggtaagcccacatcatatttntanatgacctatgtgtgtttgatgattttcttataccaattattcnataatttcaatttcttctttctatagatncagnaaattcaccaaagatctagctgttatatt

SEQ ID NO: 3212 - DNA, 548 bp, Mus musculus
  misc_feature (270)..(270): n is a, c, g, or t
  misc_feature (285)..(286): n is a, c, g, or t
  misc_feature (288)..(288): n is a, c, g, or t
  misc_feature (291)..(291): n is a, c, g, or t
  misc_feature (306)..(306): n is a, c, g, or t
  misc_feature (320)..(320): n is a, c, g, or t
  misc_feature (325)..(325): n is a, c, g, or t
  misc_feature (327)..(327): n is a, c, g, or t
  misc_feature (329)..(329): n is a, c, g, or t
  misc_feature (344)..(344): n is a, c, g, or t
  misc_feature (373)..(373): n is a, c, g, or t
  misc_feature (382)..(382): n is a, c, g, or t
  misc_feature (416)..(416): n is a, c, g, or t
  misc_feature (430)..(430): n is a, c, g, or t
  misc_feature (469)..(469): n is a, c, g, or t
  misc_feature (513)..(513): n is a, c, g, or t
gggccattggcccattttaacattcatgcattcattaactatcagaacataaaagaactctgggtgtatttttttttccaaacacccaaccagcatgaagcaactttttccaataagccacaggggtctctctacatatgttctcaactgcaagctattgtcacctattctgaatacctcaaaaggccgagaggagggaaaaaactcaactcaacaaaggccaactgtagcaattgtgaagtcttagtctcaatatgacaaaaatcattnaccttccattttctnngnagnacaaattccagtatnattgtaacagttgnaacantntntcagattcctatganccaaggttaggagaaatataatcaatttnctgataatngattactttggagaaaatatttaaactagaaccnaagtggaattttgnaaattgagctgtttgattaatccgtctctgtgctcagancctcgctctttgaatttgtttaatctgatgacgaagaatgactnttcggtttctagctaccagttttcattatgtcctt

SEQ ID NO: 3213 - DNA, 205 bp, Mus musculus
  misc_feature (105)..(105): n is a, c, g, or t
  misc_feature (131)..(131): n is a, c, g, or t
  misc_feature (145)..(145): n is a, c, g, or t
tctgggaacaggacccaagtccccatgcacactagaaaagtgctccagcgctgacttccccacagagagctttttaaaaaagcatcctgcgaggcttatagggtntcttccttgctggagcaggcttccanctgtgaggaggacnggggaggggtagggcagaaagttccaggtctggaaataaatgtaaggatggtagtggcca

SEQ ID NO: 3214 - DNA, 249 bp, Mus musculus
  misc_feature (124)..(124): n is a, c, g, or t
  misc_feature (181)..(181): n is a, c, g, or t
agactctcaattcccaagctttttacatgtctgcactaggcagagatctactcccatgatcctctgttccaatatgtcacttcctgtacaagccttccctagccatgcattccaaagcagcgtntcccataaccacattaaacctccagctttcttgagtgtcctccattggcagctgcantccttagttggtggcacactagtcaccagcaccttgcccattaaagtctatgctcaacaagggtcgga

SEQ ID NO: 3215 - DNA, 233 bp, Mus musculus
aggctgacacttctgtcagttgccttcacgtagtcattatcataacctgcccagccccagccagtctgtgccctggaggattggcctgagcagcaggctgtccctctcagcgagctaacataccctgcctgccaggaacctcacttgagccattaactgatgctgtttgcttgctttcccatctgaatgctatctccatgagggagagcctctgagacttactacaccttggg

SEQ ID NO: 3216 - DNA, 186 bp, Mus musculus
  misc_feature (28)..(28): n is a, c, g, or t
  misc_feature (41)..(41): n is a, c, g, or t
  misc_feature (43)..(43): n is a, c, g, or t
  misc_feature (49)..(49): n is a, c, g, or t
  misc_feature (52)..(52): n is a, c, g, or t
  misc_feature (56)..(57): n is a, c, g, or t
  misc_feature (64)..(64): n is a, c, g, or t
  misc_feature (71)..(71): n is a, c, g, or t
  misc_feature (85)..(85): n is a, c, g, or t
  misc_feature (99)..(99): n is a, c, g, or t
aacttcctagtttctgacagtgatcaanctttgtacctcancnaggttnctngccnngtggttnctgagancactgatgggagantcagccctcccagnctgtccctgcacagtgctcacccagtgcttcgtgactcccttcagtactcccttaggctcctcccagagtcactgtccctgaacaaa

SEQ ID NO: 3217 - DNA, 203 bp, Mus musculus
  misc_feature (31)..(31): n is a, c, g, or t
  misc_feature (35)..(35): n is a, c, g, or t
  misc_feature (40)..(40): n is a, c, g, or t
  misc_feature (45)..(45): n is a, c, g, or t
  misc_feature (47)..(47): n is a, c, g, or t
  misc_feature (53)..(53): n is a, c, g, or t
  misc_feature (65)..(65): n is a, c, g, or t
  misc_feature (77)..(77): n is a, c, g, or t
  misc_feature (84)..(84): n is a, c, g, or t
  misc_feature (93)..(93): n is a, c, g, or t
  misc_feature (117)..(117): n is a, c, g, or t
  misc_feature (120)..(120): n is a, c, g, or t
  misc_feature (127)..(127): n is a, c, g, or t
  misc_feature (155)..(156): n is a, c, g, or t
  misc_feature (158)..(158): n is a, c, g, or t
  misc_feature (173)..(173): n is a, c, g, or t
agaggatgttgcattttgtgtgaccgtccantctntcctntgcancntccctntgggaacttacncagacatttcancctgcgnaggcaaagnttccgaaacccctgcttcctcggnatnccatccntacaccttggtgctatccttttgaaacnntntacattttcacctcntctgtgattctgtttttggaaagattttat

SEQ ID NO: 3218 - DNA, 154 bp, Mus musculus
  misc_feature (30)..(30): n is a, c, g, or t
  misc_feature (101)..(101): n is a, c, g, or t
  misc_feature (125)..(125): n is a, c, g, or t
gctgtgagcatcagatgtaacaaatcaaantcaggagaactcccttcagcggtgcacctggacatcagacccccttgtaagaactgggaaattgctggcantctagtggagcggtacggtaaatntggaaaacactcccctctgtcactgaagg

SEQ ID NO: 3219 - DNA, 92 bp, Mus musculus
  misc_feature (26)..(26): n is a, c, g, or t
gggaataaggtctaatgattctttgntctcccttagtgttgttatgtccctctttttctttctttctgattttgttaacatgggtactatct

SEQ ID NO: 3220 - DNA, 361 bp, Mus musculus
  misc_feature (58)..(63): n is a, c, g, or t
  misc_feature (74)..(74): n is a, c, g, or t
  misc_feature (190)..(190): n is a, c, g, or t
  misc_feature (210)..(210): n is a, c, g, or t
tgtacctttattctcttatcttttggtttcttaaattaaaagatattaaaactctaannnnnngatggaatttnatatatttaaaaatgtttttgtcttgctctttctaaatttcttcctatgctgcctctcacaagtttattatttcttgttacagttttccctgacagagctatgaaaatgtcttctncctttctacctttatatcanccacattctgaattgtgttgcagaaagggacatttgaattatttcatatgaaacactactgtattttctttcctcttaaaaatgttagtttttcttatctgctgtccataattatgcatgtttaatgttcagtgagaactagagcttcagt

SEQ ID NO: 3221 - DNA, 450 bp, Mus musculus
  misc_feature (317)..(317): n is a, c, g, or t
acatcgcctgcctgtagaatttttacatcttacagctaaatcagaagtcgagacacaaaaataacctttgttgaatgcttgggaccgtaatcgctcagcagccagagttacaaacaatgctacgcagggccgtgttagatgccagtgttcactgcgtgtcctgattgatcgacgacatttagtacgttgcatctatcatggttattgatgtgtatagagaacctcagagattcaccacacagtagacatttgtaagaatatttgtggtgcctcccgttccttcgtagatgtgtcatttttgtggaagaaaaaaaaangcaatcaatgtaccattaagtacactatagcagacttacaaaggggctttgttcctgctgtctttgaatgacaggcctgaaaaggtgctatttaaattgtttatgtcctcaagccctctaaacaagtcacctg

SEQ ID NO: 3222 - DNA, 507 bp, Mus musculus
  misc_feature (149)..(149): n is a, c, g, or t
  misc_feature (249)..(250): n is a, c, g, or t
  misc_feature (252)..(252): n is a, c, g, or t
  misc_feature (259)..(259): n is a, c, g, or t
  misc_feature (265)..(268): n is a, c, g, or t
  misc_feature (321)..(321): n is a, c, g, or t
  misc_feature (428)..(428): n is a, c, g, or t
  misc_feature (437)..(437): n is a, c, g, or t
  misc_feature (440)..(440): n is a, c, g, or t
  misc_feature (447)..(447): n is a, c, g, or t
cagtccttagaaccacgtggtaggaggagagaatcaactcccataggttatcctctgatctccatccatgaattatctcacgcatacagtttaaagtgtattgggaatggtagtgcagcaattaagagctcttgttgcttttctagagnccttagtttaattaccagcacttatgttagataacttactgtatttctaacttcatggatcagtgccccctttaggcctctacaggcactgaattctacnnanacatacncccccnnnnacacacacacacacacaccacacatgcaattaaaaataaaataaatccttganatattaaaagtttgcatgtagcgcttgggacttttcaatcccagcatgcacttattaacttgaacttatttggaagaagaatgaaagtatgcttccaatgacctacnaaatatcanccnagctacnagggttaaatgcaaatctgaatgaaatttatcccaacagctaggctgttttcagatgttt

SEQ ID NO: 3223 - DNA, 443 bp, Mus musculus
  misc_feature (150)..(150): n is a, c, g, or t
aaggtctctcttggtgctaggtgcatatatctaagataatccttggagtgtttgtgagctagaggtgtttaggtagtagtgactgtatccttttgggatcagctgtaccattagaggcctttggagggagaagctataatcactttgagnaagccctaccatggttcttagccctgcttccttttgggtacatgccttgctgtgtttaccacctaaaagtgaggtggactaacgtctcatttgcaatagccaactttatttagtgttggacaatttatactcttggggatttaagaaggtttacattgagtgaactgtacaatctcaaggacaagtcacatgtgccaagaaacacttttttccatacaggcacataaatggataacaataaccagttgtaattaataatctctaaacttgctcctatctgatacacctgggaa

SEQ ID NO: 3224 - DNA, 465 bp, Mus musculus
  misc_feature (29)..(29): n is a, c, g, or t
gggcccttgtatctgggaacttatgcaanagatactgtttcatactcagaacactgacttcactggagggcaaaatagctttgttaccaacatagtcaacccccgacaacctaccacagaaaagaagtctcatgtctgtgcacaagagacaaaccaaggcggtttcctgtaaaattctaaagtccccccatagccactctctttcatctgatcaccaagagtggcaaggaaaacacctggttcaccctgtttagactcacgtggggcaatggtcaccaactgtatgggcaaatagaaaatgggtgcagaacagaaggaaagccaacctactgggaactgtgtgaggatctggcatgggatgttccttgctctaaggggtaaagaaagctgatgctcacggcacactggaccacaacgtggaaaaggggcacacacagacaggacatccttactgtcaatcacgag

SEQ ID NO: 3225 - DNA, 394 bp, Mus musculus
agagcccagagggttccaaactgtaggtatctgcgtgctttcctctgcagtacagttgtacgcagccattaccacaggaagcttggccgtggacatcacagctcaaagccgtccttcaaatgcagtgtcttctggttcctgagaactggcaaaaggctgatgactgggacggtagacatttctggaaagatactcctgtcatttatatatgtccacctcattctgtgggaggttcagggagttttccctgcaggactacgagagagaagacaccctagttgtttagaatttgagaattttaagaccttaagtttatatgactgatgtaaatattcgaaacgacagctcctgttgtcagatgactttaaagagtcttttgaacgttctggtgcca

SEQ ID NO: 3226 - DNA, 491 bp, Mus musculus
tggcctctttgctgctgtagtgaaggaggctgggtcacgtgggcagtgaatagcagggaagtcaagcacggtagctacgagtccgagtcggtcaggccaggagagggactcgtgtaggactgtccccatttcctgccagattccagcagaccctgtgcttctgcttgagtggctgtggcacgtgtcctcctcggtccccgaggctaggcgatggtgacccataacaacaggaggtgactcataacactgtccccgccactgtcatctctacacagctactttggaaggcgtgcagggctcaaaacatggtggctcctggcagagctccggggctgtgccagggagcagggctgcccatcttgtagggactggagcagttcttgtagagagcggcagatggtgaggaaggaggctcttcccgggtacatcagctcaccagacagagggaccccagtcacgctccctctcgttttctttgcttgccctaactt

SEQ ID NO: 3227 - DNA, 404 bp, Mus musculus
cctgggtttacatcccttcatgaactgcacacagcctggggagaactagagaagtcacccttgggaaagaacattgatcgaggtctagaacagtggctaggagtattttctgtagagctgagggaaggccatgcactgtggtgaggatgtgcaaagcaaaaggatgcaaaagagagacaagttaataaggcaaggagtccatgtgacaggaaccgaactgccgccttctgccttttgtggatcagcaagttgctgcctggttgtgttgtttgcaaagacccacacaggtgatgatgatggtgatggtggtgatgatgatgatgatgatgttctagattattttagacctctacctcctgctattctttccaggcaactgaatcaccttctctttaaactttgct

SEQ ID NO: 3228 - DNA, 302 bp, Mus musculus
  misc_feature (132)..(132): n is a, c, g, or t
  misc_feature (140)..(140): n is a, c, g, or t
  misc_feature (147)..(147): n is a, c, g, or t
  misc_feature (162)..(162): n is a, c, g, or t
taaggtggctccaggataaatggacaacctgagctggccatgacctccagctttggatgatgttgcaatctctgctattttaatgggactgatgtttgaggttttgtttttatgagacagggtctagctatntagcctanactaganttgaactcaaccctncctaatctcctgactactgagattacaggcataaaccaccaaaccaagtttacattaactttttgtttgtttgatctgtatagcctgaaggtattcctgcctggggaactgtggatgcggagagacatgccctgattgcc

SEQ ID NO: 3229 - DNA, 427 bp, Mus musculus
  misc_feature (384)..(384): n is a, c, g, or t
  misc_feature (386)..(386): n is a, c, g, or t
catgcgtcttcctgtgcacagaaatattaagtgaatagaagtaggtgagagaaaaataaatctctgctttaagttccttttcttgacaattgttttggctgtagagtcaaattatcctaccagtctttattgattacattgtatgtaatttatgccactgtatatcccgagtcacacatggtgtaattgtgtatgtctaatatattgaaaggcaaggatatgagaggggaacaaaactaaagtggagagctttcttgtaataactatgccagatcctgttgctgaatgaactaatttagctctcttgaaatccatcggttcttccaaaccgctataaaaaccatttaactattggaatgaagtgaatttcaacacgattatctntnttgaagttgcaggctcatgtgtgcatgaaaactgccttttt

SEQ ID NO: 3230 - DNA, 429 bp, Mus musculus
  misc_feature (287)..(288): n is a, c, g, or t
  misc_feature (293)..(293): n is a, c, g, or t
  misc_feature (296)..(299): n is a, c, g, or t
  misc_feature (302)..(302): n is a, c, g, or t
  misc_feature (358)..(358): n is a, c, g, or t
gggagctagctctcttgggtactcttgcgcttatgaaaaccatctctttgcaatgcagagaaagaagttataactaactcgagttttctttctttgaatgacaactcctcaaaaaaaaatgtaatttcttctagtttcctctctgctttcccatgctctgatctaatgactggctgccacattctcaatgccaagacaagacaatgggcagtaaagttgcaaggctcaggacagttgtggtttctggggcccctccctacaaagtgatttttataagaaacaccaanncaganatnnnntgnctaagagcaccctattggttgcccgaatcctgctctcgcattaggagttcattaanccctctttcttgccaaattacaggcttcagttttgttttgcttccagctagagtttgtcttcctggatttc

SEQ ID NO: 3231 - DNA, 417 bp, Mus musculus
gttcttagttaagggtgactctctagaatgttgctatcacctcttacttgtcattgccactgccaaggctaaaaagcaaaatataaatacaacctgttcagccttctctatgagtacaaaataccacaagctggtatatagactaatcactgtatggctacactcatgaaatttcaacaacgtgaacagctgaacaagctcaacacaatgacaataccagttgccatgcctgactggattggggaaatcttacaaggctcatcaccagatgaagaactacaggcaattaatggctgctaagagaggcagaactagtcttcttcagggacagagccctgatgggttattcaatcccaaatactaaacacaaatacatacgaccaatactaaatggacagcagagtgtatttctttaaa

SEQ ID NO: 3232 - DNA, 442 bp, Mus musculus
ggtcagtacttgatgatcacccttgtccccctcccctgaagagtcaacagcacttgctttgtctgcagttttattagtccctggctttggccacactgaaaggctccgttgttttcttcttgaaagggctaactgctcctactcggtcccctctggctttgggaccgccctctacttgctttcttcaaaatctctggccctttctcctgttctgtcagcctcaactactaaacttggtgtctgcttgactgaatccttagtcttctcaagcttggctgtctcccactcagtgcccccaaacaacctcttattccatacccatgcacttgctttctaagcatccttaagcccttgctgattctagtctgtgccagggcctagtgttctagcatgttccttccttttctaaaggcactggcttccgtctgtagtaaggccttta

SEQ ID NO: 3233 - DNA, 472 bp, Mus musculus
  misc_feature (361)..(361): n is a, c, g, or t
  misc_feature (371)..(371): n is a, c, g, or t
  misc_feature (410)..(410): n is a, c, g, or t
tgccttaatttgctgtgggactgtccaggattccagggactcacggatcctagcctgataaagtcactgaagactctgcctcaaacggtcctgggttgttcttccaagtcacctccttagacccagcgatgcaaggcttgtcccccacaagtgagctccagctcctgagatcttcagggctcctgcacggggagtataggagtctgtcctcgtcgcctccgtgatgtagcatgcggagggctacaggggactgcaactggccacggggactgcaaggccagagctgcgttcctggctccaacagctgataagcctgtcaccggtaccacatccacagtgagacctgtgttggcttctcgancccttcaggnacaccctcccaaagatgtcccggaggccctgtgtgtatnatctaaactctgtcctctgaccacattctttgcagcctcacacttgggctgataacacttgt

SEQ ID NO: 3234 - DNA, 408 bp, Mus musculus
  misc_feature (99)..(99): n is a, c, g, or t
gggagttgtttgttgttctgccatctggcctgtcagagaatgttcttgtgcagtttagccctggttgtccactgggtttgatagccttctgagctggtnccctctaggtccagtagaccaggttacccagtgccgagtccttctgtctctttttcccatcgtggctctgctattcatagtatctgtgtcatcagcccagtctgaggagccttcccatctccagcaccctggcggtcatttaggttctttggattaaatgaagcagctatcaagagttgttttttctctgccacaaaggctttcactaaagatttggtgctgcgtttggtaaggcttggtgttatgttggttgagtttctgtagaggaaagtactcattaaaatgttagatttccctcatcatagagca

SEQ ID NO: 3235 - DNA, 397 bp, Mus musculus
  misc_feature (70)..(70): n is a, c, g, or t
  misc_feature (78)..(78): n is a, c, g, or t
  misc_feature (104)..(104): n is a, c, g, or t
cccatccggagcagttgtgtcagatgatttatactgagtcggtttcacaatgaagcgctggctggcctgnaactcctntatcgaccacatgcctctctctctcntgagtgttgagatgagaggcgccaccacacctggctacatctgttttttcagggtttcagcctttccctagccagtctgctaactgtcacttctcagtggtcagagagaggcctccaacacatacctggtttggtgcctgtttactgtgggcacggacagaaccacacccattttcacacgtgtctaaaatgggagaaaataggttcagacagaggccccaaaggccctgctgtaagcaaatcatgtatgcttacattctcagggatggtttcttccacaagctatctctatt

SEQ ID NO: 3236 - DNA, 502 bp, Mus musculus
  misc_feature (94)..(94): n is a, c, g, or t
  misc_feature (96)..(96): n is a, c, g, or t
  misc_feature (98)..(98): n is a, c, g, or t
  misc_feature (324)..(324): n is a, c, g, or t
  misc_feature (365)..(365): n is a, c, g, or t
  misc_feature (457)..(457): n is a, c, g, or t
  misc_feature (477)..(477): n is a, c, g, or t
cagcggcatgtacagtgactagcaagcagggtgctcagttgctcgacattgaaaagaaaggagcgagttaaaaataaagagggaatcccagtcntntncttattttaccttattttggcatccaagaatcatgtcttggaaacacacgctccatctagctgccttcctttatagatgatgcgagctaggttttgcagcataaatatgctgagcaggtctctctgctagcagagatagaagctgaacaatgccccgctgattatctttctaagaattctgaaccctgctgagttcatggggcaacattcttgtgcatggcttgcngcttaagtgggcttctgaatccagcatccttcagccagtgngatgagagagcagacaaggagtcaagggaagtgtgtagtgaggatttgtttacagccacccaagctgagcttttgctgaagatgtttgccantcagcacaaccctgcccacnccaatgctgctccatggtagaaatt

SEQ ID NO: 3237 - DNA, 478 bp, Mus musculus
  misc_feature (218)..(218): n is a, c, g, or t
  misc_feature (243)..(243): n is a, c, g, or t
  misc_feature (361)..(361): n is a, c, g, or t
ggctaccagccatgaatgcacctaaatgctgctaagcttgcaaccagggttggcatcctttggtacttgatgtgacctgggtgaagcctaccacatcacatacctccagcagctacagagtatgtttcaccaagaccaaatcttcaaatgatcttatctcctaccaatctttttaattagtcttgtaaatcactaatagacagggataacagaatttnctgggaagatatggagaactagttnctgtcctttagagcccattacattttcatgtgtctgggacagttctaatggcctgcacagatcatacaatgaaagtctgattgtctttcctctctccatttccccttagccacattanaaattgcagagatttttttttctccctcagaatattagtgttggaaggttgtacccagctatactctttagcatttctgatggtacccatttattcggacctcactggttatttaga

SEQ ID NO: 3238 - DNA, 352 bp, Mus musculus
  misc_feature (321)..(321): n is a, c, g, or t
atgagcgatgccagtttgaaaccttcagacgacaaaagaatcgaaattgaaagaagaaaacacatggaccaggttgtggtactgtgcccgaagcgccaggatatcttgctgcgtcttggccagcctgacctgggaggcccggaaatccaccttctgctgcttctcggcctcctgcttcgtgcggaggaggctgttctccgaaaacttgaacacctggtgcagatggttcttcagctcctggatcacaaagttctccttctccacctaggccaggacgaatgaggacagggccctatttaatagccacgcagtcctcccacncccagtcacaggacagctggcctttggttgt

SEQ ID NO: 3239 - DNA, 551 bp, Mus musculus
  misc_feature (362)..(362): n is a, c, g, or t
  misc_feature (423)..(423): n is a, c, g, or t
  misc_feature (463)..(463): n is a, c, g, or t
gatcatctggtatgtgaccacctgcctcaggaggcaaggtcaccgcaatgaggacagggataggggaacccgcaaacacaaacaaaaaccaatggcctccagggccacaattgccatgggcagctgcctagggagtggaagccactggttttagaacacagatcctcagcctggggaaggaggtcccctgctgctttaggatttttgttaacttcttgctctaactcttaaaagtcacttataaaaatagtaccacgtgttcacctgtaagagatcaaggtagcgcataaaggcttagagtcaaaggtaagtcagcaggctccatctcacatgctcagtctccagaaacccaccccagcatncatccatgtccagatgccctccccccatcctcccctccaggaccatgagcgtggtgtagcngttgtaacacagactggtgtctggccatgggtgctccagncctgactccccttcctcaaagcatgcactgcaagtgaggtgctgtgccttggtttcccccttgtgagtcctccccagatgttagttgt

SEQ ID NO: 3240 - DNA, 507 bp, Mus musculus
gttataacctgtagtgaccttgcaatgaccttactctttgaagttcaatagatctacctctggcttcctgccagccctggacagtgccccttccttcatgtataaacagttttacattctcaatctgcctttggtccctcacattcactgagtacaaagagaacttaactggctcttccaacaaaagtgcggtttgcctgtcaattgcctttgtctttactccatcacatcacagtaaggctcgctcttcagaggagggaagcaaaggaaatatcaaattgttgggagcagaaatacgaaccattccttgcaatctgttgacactgacatcaaaacaaaagtttcctaagagttatacagcactcagcagtcctgatctaagccagatgtcctctccctggtctgagaccagtgcgtgccctctgagtggaaaaacaagtattgaaaataatatttatttcaatagtacgtttaggcaaatacggaaagctctttatctgcctgaga

SEQ ID NO: 3241 - DNA, 212 bp, Mus musculus
  misc_feature (102)..(102): n is a, c, g, or t
  misc_feature (110)..(110): n is a, c, g, or t
  misc_feature (112)..(112): n is a, c, g, or t
  misc_feature (119)..(119): n is a, c, g, or t
  misc_feature (128)..(128): n is a, c, g, or t
  misc_feature (143)..(143): n is a, c, g, or t
  misc_feature (159)..(159): n is a, c, g, or t
  misc_feature (176)..(176): n is a, c, g, or t
  misc_feature (185)..(185): n is a, c, g, or t
caatcttgtcattaaatcccacctcaaaatactgaaacctttggtctgactctccataagttttgggtaaagccttattttgcataaggcatcttgagcccntcagtgtnantaggcanaggcccctnacacctaatgaggtnttcgttcggtcctttntcatctccctcctgcantgacatcangctgacccctaaggctcggctttccag

SEQ ID NO: 3242 - DNA, 476 bp, Mus musculus
  misc_feature (196)..(196): n is a, c, g, or t
  misc_feature (222)..(222): n is a, c, g, or t
  misc_feature (225)..(225): n is a, c, g, or t
  misc_feature (238)..(238): n is a, c, g, or t
  misc_feature (240)..(240): n is a, c, g, or t
  misc_feature (242)..(245): n is a, c, g, or t
  misc_feature (247)..(247): n is a, c, g, or t
  misc_feature (250)..(251): n is a, c, g, or t
  misc_feature (253)..(256): n is a, c, g, or t
  misc_feature (260)..(260): n is a, c, g, or t
  misc_feature (262)..(262): n is a, c, g, or t
  misc_feature (264)..(264): n is a, c, g, or t
  misc_feature (272)..(272): n is a, c, g, or t
  misc_feature (274)..(274): n is a, c, g, or t
  misc_feature (281)..(281): n is a, c, g, or t
  misc_feature (308)..(309): n is a, c, g, or t
  misc_feature (312)..(327): n is a, c, g, or t
  misc_feature (329)..(329): n is a, c, g, or t
  misc_feature (331)..(345): n is a, c, g, or t
  misc_feature (356)..(356): n is a, c, g, or t
  misc_feature (358)..(358): n is a, c, g, or t
  misc_feature (411)..(411): n is a, c, g, or t
  misc_feature (415)..(415): n is a, c, g, or t
aattatgacagtttgcttgagacacatgtatacatacatacatacatacatacatgtcacaagtatgtgtgtgtgtatcaccatgcccagctccccccacttaacaacccattgaatgtgattaatactaccctcatacatagaggcccaggcccatccactggagcatgggtagcctcctacagcctgaggcagngagacgccttcctatcagcagttgtnatntgctcctcagcangngnnnncnccnnannnncccntntntaggagtnantttgatntacacaataaagggtgaggccggtgannaannnnnnnnnnnnnnnncnannnnnnnnnnnnnnnactatgttgtntngtggaagaagttcagtgcccccaaaaccctccacatcctcctgtctgtcagtntttnttttccgatgattagaaacttgattgcgtccatagttttgcctttcccaaaatggtatgtt

SEQ ID NO: 3243 - DNA, 451 bp, Mus musculus
ttcacagtgtatctcgttcttcatcgccagacctaagctccagcagtaaactgacagcgagcaggaaaagcaccggacagctgaacgtcaatcccgggactcctggcagcggcggaggcggcggcggcagcggcaacaccacgactgcagagcgaagccggcaccagagaagcttctctgtgcccaagaagttcggtgtcgttgaccgatcctcagacccgcctcggagcgccaccctggacagaattcaagcttgtacccaacaaggcctttcctcaaaaaccagaagcaattcctccctgaaggagagcctcacggacccgtcccacgtaagccaccccaccaacctgctggccaccattttctgggtcacggtggccctgatggagtctgattttgagtttgaatacctgatggccttacggctcttgaaccgactgctggcacatat

SEQ ID NO: 3244 - DNA, 356 bp, Mus musculus
  misc_feature (127)..(128): n is a, c, g, or t
  misc_feature (145)..(146): n is a, c, g, or t
  misc_feature (172)..(172): n is a, c, g, or t
  misc_feature (186)..(186): n is a, c, g, or t
  misc_feature (193)..(193): n is a, c, g, or t
  misc_feature (240)..(240): n is a, c, g, or t
  misc_feature (246)..(246): n is a, c, g, or t
  misc_feature (251)..(251): n is a, c, g, or t
  misc_feature (258)..(258): n is a, c, g, or t
  misc_feature (265)..(265): n is a, c, g, or t
gaggtgttgcctccactccacaggactgtctagaacttctagagttttgtgaatcaccccccttttgtgcaggcctcccgtggtgttcctagatcaaggccccttgtttcctgagtagtagaaatgnnttccattattcatcacnntgacaaccggacatttgacacccttntgaatcgtgatcanttgcagntgactaagagtgactggcttctctgaaggtgtatccccaccaggagnaggganccatnctggctntcagagntccttcttaagaagaattattttgtacaaaatcatcatattactatttgagttatttttattgtgtgcccagagtttgcatgagatttttc

SEQ ID NO: 3245 - DNA, 530 bp, Mus musculus
  misc_feature (76)..(76): n is a, c, g, or t
  misc_feature (353)..(353): n is a, c, g, or t
  misc_feature (464)..(464): n is a, c, g, or t
atatgggtgatatatttccctcctcctataaaggagagtttcaaacctatttcattttgttctgtttattttgggnaggtacatgggggtgttctttcaaatgattcatttagttttttcaaacccataccactctcaatgttcatttgatgtgttcaaagccaaaaaaaatatgaaataacattttaagcagagctgaacactaactcggacatgaagctgaaggagtgagcaagccacaggagagggtctaagcgaagcatggccttggcttcataccacactttttgtgccttgtattatcagtgtaaattctgaatgttgtacagtaaatacttggatggactccttancaaggatgcaccggcttcttttttcagcacatgtacatatctataaatatatatacatatatatttggtaatgccaaacagctatgttatattgtactgaacaaaatggcncgtttggatgttttatgtagagtttgcaaaaaaaccaaaatggatggttattgacttttcgagata

SEQ ID NO: 3246 - DNA, 511 bp, Mus musculus
  misc_feature (284)..(284): n is a, c, g, or t
  misc_feature (295)..(295): n is a, c, g, or t
  misc_feature (313)..(313): n is a, c, g, or t
  misc_feature (316)..(316): n is a, c, g, or t
  misc_feature (331)..(331): n is a, c, g, or t
  misc_feature (337)..(338): n is a, c, g, or t
  misc_feature (340)..(340): n is a, c, g, or t
  misc_feature (347)..(347): n is a, c, g, or t
  misc_feature (350)..(350): n is a, c, g, or t
  misc_feature (371)..(371): n is a, c, g, or t
  misc_feature (374)..(374): n is a, c, g, or t
  misc_feature (379)..(379): n is a, c, g, or t
  misc_feature (391)..(392): n is a, c, g, or t
  misc_feature (407)..(407): n is a, c, g, or t
  misc_feature (416)..(416): n is a, c, g, or t
  misc_feature (430)..(430): n is a, c, g, or t
  misc_feature (481)..(481): n is a, c, g, or t
attggctattgttggtataaccgcaaactttctggcttaaagtgacagaaatatattactctatggatctgcagtccatttcgtgtagtgatgctgttgtagaggaaagtcttttccttatcttttctagtttctagaagccatttgcattacttgtatcatggtctctaccttcttctttagaagttatcagttcagcatcttccaatttgaccctctacaatttttcaccattcctttctgattacattttcttggaaaacttaattctatccccttatttntcagaaatttnagcatattacaaattttnttngtcaatttatggtanacattnncnatttctnagnattaggggttcctgggggttnttntcctncctaccacacanntaatcttaatgacanaattgcttntaatttttttacanttctaaggcttatgatgttataattgtaaacacaagataggcgaatccaantcctaaagactcaaagctgctttcctataa

SEQ ID NO: 3247 - DNA, 226 bp, Mus musculus
gaaggcacattctgaggtcccagtagaactgctgggagctgctggctcaggggtctgggcttgcacagaggctgagattggcaggttcttactcttgggcactgcagacgcctctgaatgccgcagaagagctgagaacagattgtgggcctgcatgcgggctctggccctgggccaaagggaaaggggcaggagggatgctctggctggttaccacaaggacata

SEQ ID NO: 3248 - DNA, 358 bp, Mus musculus
  misc_feature (188)..(194): n is a, c, g, or t
  misc_feature (196)..(199): n is a, c, g, or t
  misc_feature (201)..(201): n is a, c, g, or t
  misc_feature (203)..(204): n is a, c, g, or t
  misc_feature (209)..(209): n is a, c, g, or t
  misc_feature (211)..(211): n is a, c, g, or t
  misc_feature (286)..(286): n is a, c, g, or t
tgtcctctcacttaactcagacttccattctttatttcccagaagagaggtggaagagtaaaacctccttcacaacacttgctgaatggcaagccctggaagacctctttagactgagggttgggaaccagtgccccttgggccatttctctccttgaaacctttcttttaattcctttctgggtccnnnnnnntnnnntnanntgaantngacacattcatcaaacatgattgaatattggcagtttcatctggtatgacctaatagttatgtggttacaatttnctctcaacttgttcccacattgttaacatggaaataataatggtgttttcctcacaattttgatggctatta

SEQ ID NO: 3249 - DNA, 521 bp, Mus musculus
  misc_feature (135)..(135): n is a, c, g, or t
  misc_feature (144)..(144): n is a, c, g, or t
  misc_feature (153)..(153): n is a, c, g, or t
  misc_feature (157)..(157): n is a, c, g, or t
ggagcctacatgtctgccaaggattgctggagtctcctgggctctgaagccaatcggctcagcagttgagttccatgcagtgggatgcttaccaacctgggccaggactgtggtgacaaccctgttctctagggnaaatgtggnccccgatgnaagncttggctaactcggtctgtgctctcaggcccagacctacaaatctgcaacctcttcagaattcccaagagtgagcttccttcccagcaacccctcatctctgcccccttccctggccggcctcagcacctcccccttcttcagcaagttaaccgaactctcccttcatggacagttcactggaaatttagtctgaaacgacagtgtatcgtatttcatgaatttaatagggttttcatgattttacaaagtgcctccaccagacactcgcagctggaggcggctcagcgggaggctgaagcccagcatctgggtttttcaactcttgccaaaatccattgaatttgatccggaatgactacgaa

SEQ ID NO: 3250 - DNA, 511 bp, Mus musculus
  misc_feature (264)..(264): n is a, c, g, or t
  misc_feature (301)..(301): n is a, c, g, or t
  misc_feature (303)..(303): n is a, c, g, or t
  misc_feature (405)..(405): n is a, c, g, or t
  misc_feature (429)..(429): n is a, c, g, or t
  misc_feature (441)..(441): n is a, c, g, or t
  misc_feature (448)..(448): n is a, c, g, or t
  misc_feature (453)..(453): n is a, c, g, or t
  misc_feature (478)..(478): n is a, c, g, or t
  misc_feature (486)..(486): n is a, c, g, or t
gctctgtacatctgctcttgatagattctttcacaccattaaattgtttattgatggctcttcttgcagacgttgtcaccctgttactccatcttgccgtgttggacactgaattctttttaatgatttaactatgaaatctgggagtaggtgggcacatgaaacagatgtagtttcagtcattctcatgacgaactttaaaataagagttgtgtttgagcgtgctctgtcctgtttaaacttgaggattctagcttttgtganacaactttgaagatggtgttttctgtaggaggtgggntnttctgcacgttagcactcattcagaggatgcatagcttccagagtaattgaagctcttgttcatgaatatgaggacctcaattctttcagctttgcaggagncagagttaactgcaccaaaatcanccacgaaggatntcatgtntactnagttatttactaaacagcacatttntaccccgnggctacacaggttatctcactttga

SEQ ID NO: 3251 - DNA, 520 bp, Mus musculus
  misc_feature (66)..(67): n is a, c, g, or t
  misc_feature (79)..(80): n is a, c, g, or t
  misc_feature (83)..(83): n is a, c, g, or t
  misc_feature (86)..(86): n is a, c, g, or t
  misc_feature (89)..(89): n is a, c, g, or t
  misc_feature (166)..(166): n is a, c, g, or t
  misc_feature (174)..(175): n is a, c, g, or t
  misc_feature (183)..(183): n is a, c, g, or t
  misc_feature (202)..(203): n is a, c, g, or t
  misc_feature (210)..(210): n is a, c, g, or t
  misc_feature (212)..(212): n is a, c, g, or t
  misc_feature (218)..(218): n is a, c, g, or t
  misc_feature (220)..(220): n is a, c, g, or t
  misc_feature (237)..(237): n is a, c, g, or t
  misc_feature (252)..(252): n is a, c, g, or t
  misc_feature (254)..(254): n is a, c, g, or t
tattgctgcctgttaaatgattcatttatttacataatttacacggtaaatatatttttttcttcnntaaacatccatnngtntanttngcttacatgtagaagaggagaacatgggatggcaaacgtgcggaggcaggagtgtaattcattccagagagttctcngtttccanntgtgtggncccctgagaccaaaatcanngccttangnttggangncaagcacttcagccacngaagcccctccttgncntatcccctatcttttcccaattttgttaccttttttttgagaagcttaatttgccaaagctcaggaagaactccctagatgttgcccagctctctggacattgactttaaccttccccgagtggaccagaccactgctcgctggcctctgtactttacccaatcctaaggcagctttaaaccctgcctatttccatgctccagcattctcagttcctgtctgtgataaacacattaagtaatgttgtcaccataaatagttctcag

SEQ ID NO: 3252 - DNA, 351 bp, Mus musculus
  misc_feature (176)..(176): n is a, c, g, or t
  misc_feature (256)..(256): n is a, c, g, or t
  misc_feature (260)..(261): n is a, c, g, or t
  misc_feature (267)..(267): n is a, c, g, or t
  misc_feature (286)..(286): n is a, c, g, or t
  misc_feature (289)..(289): n is a, c, g, or t
  misc_feature (316)..(316): n is a, c, g, or t
agggctgagctctggtctctggtcttggtctcagctcagtcctgtgtcttgtacttgatctttcacctttcccctggttttactgctctctgccctggattcctggagtcaccttctaaatgaacttcctgcaccacagcctgggagggcctagtgtgcacagctttcattcagtntcatcctcttagcaacaagcatcagtcctgagaccttcaggctgctgcagctttgtcctgtttctccagctctgtctctntctnntctccnccttctttcctcttggttncantcttcaccctttccgtatcttgaattnacctaattcctttccaccctgatcttgtgataggt

SEQ ID NO: 3253 - DNA, 407 bp, Mus musculus
  misc_feature (76)..(76): n is a, c, g, or t
  misc_feature (132)..(132): n is a, c, g, or t
ataggcagtactctgaacagctgagttctctctccagctccctctttcccttccttcactagctttgtggaccagnactggctgtgaacttgcagcaatcctgagtcagtgccttctctccttaagtgctangacaacatatacgcacccttggaatctatatgatttcattgtgacatttcaaatgtgtatgttgtgctttgctgagagtcactcctactattactacctcttgtccccttttctcctctctgatggcttcccttctcccctcaaatagccccacttctgctttcatgtcttgtgtatattgttaaatatctcatttgaattcttcttaccaaagaaaacatacttgtctgagtctgccttattttggttaatatgatgttctccagtttcaccca

SEQ ID NO: 3254 - DNA, 509 bp, Mus musculus
  misc_feature (165)..(165): n is a, c, g, or t
  misc_feature (177)..(177): n is a, c, g, or t
  misc_feature (181)..(181): n is a, c, g, or t
  misc_feature (185)..(185): n is a, c, g, or t
  misc_feature (190)..(190): n is a, c, g, or t
  misc_feature (197)..(197): n is a, c, g, or t
  misc_feature (199)..(199): n is a, c, g, or t
  misc_feature (204)..(204): n is a, c, g, or t
  misc_feature (230)..(230): n is a, c, g, or t
  misc_feature (245)..(245): n is a, c, g, or t
  misc_feature (266)..(266): n is a, c, g, or t
  misc_feature (269)..(269): n is a, c, g, or t
  misc_feature (295)..(296): n is a, c, g, or t
  misc_feature (354)..(354): n is a, c, g, or t
  misc_feature (363)..(363): n is a, c, g, or t
  misc_feature (398)..(398): n is a, c, g, or t
  misc_feature (427)..(427): n is a, c, g, or t
  misc_feature (441)..(441): n is a, c, g, or t
gatggtatatattctgatcctaagggaagttattaaacattactaattacacatagttattcataacaaagacatagagaagcttacttttattggctttgaaatatatgtacctttttttttggtagtggtgggttttttggtttggtttggttttgttttgtnttgttttgtttngttnttantgctntttgttntngtttntggagaaagtctttctgcataatccnggctatcctgaaacntaccttatagatcaggatggnttngaacccacagaaatttgcgtgcctcnncctcctgaatgctggattaaaggtgtacatcacaacatccatctacagtcatgctttnatttaactntaatttatttgactctaatctttgcatttcaaagncaattagaaattttccttttgttttaatncctttgtgattgtntactacctcagagaaactgaggcttgttgaagaagaaatgtatatgggtcaaaatgaacagagctcaa

SEQ ID NO: 3255 - DNA, 566 bp, Mus musculus
  misc_feature (73)..(73): n is a, c, g, or t
  misc_feature (76)..(76): n is a, c, g, or t
  misc_feature (94)..(94): n is a, c, g, or t
  misc_feature (207)..(207): n is a, c, g, or t
  misc_feature (274)..(274): n is a, c, g, or t
  misc_feature (281)..(281): n is a, c, g, or t
  misc_feature (379)..(379): n is a, c, g, or t
  misc_feature (456)..(456): n is a, c, g, or t
atctttcagtgccttcttcttgtaaaggtcaagactaaactatccattcagtgacaatggtgtttatctggcntantgttttttctttcttttnctttcctttttcatgctggggttggaactcagggcctcttatgcctttggtaaaggctctaccagggagccatccagtagcctgaatttgaaagcaagaactcttcatgaccnccttctagagataagcagagtggccccctttctttctaattacagctaggatgagatagatggtctnaagtgancctcacagtggatgggcagacattcctattgctgctacaatgtatggagttcagactgcagcaaacacccgcaatgagggatgtctcagcaacgcccncaatgaaaataagaacagggaccaagtagagtccacctgttgaggctggccatcacaaaggagataggttggagganccttgctgtcacatatcctcatagtgcccccttagggactggtaaaacaacatctttcagctcctttgggtgatctgacctcatcctgccctttgttatctgtccaacaa

SEQ ID NO: 3256 - DNA, 336 bp, Mus musculus
aattcaaatgttaccctctctgcacagtaagttttcctttcccatcccatcttagtagaactgcacatctgttcctcactctgtgatagcacaaaccgaggcatgttactgtacatgctactgtagagctgcagtgccagctgcttacgagattttcaggatgctattcctctaccaggttttggtaagaaaattaaaaacccatcctgacattttccctttcacaaatgcatatccaagtcccaaagctagatacttcgaatgcagaaaccagttgacttttctaggggggagggtagaaggaagtaaatctaacctctgtggagacatggacat

SEQ ID NO: 3257 - DNA, 425 bp, Mus musculus
  misc_feature (334)..(334): n is a, c, g, or t
  misc_feature (381)..(381): n is a, c, g, or t
  misc_feature (386)..(386): n is a, c, g, or t
  misc_feature (390)..(390): n is a, c, g, or t
gggaggacaggctctacagctgcctgctgtgaaggactgagtgagctctcttctgccaccttagtgagtgtgtcccagatgacctggtggaagtaagcattgagcgtcctcagaagtttaatctctgagattgctcccagtttgggctctaatacaatgtttgatgtacagtggtgtccgttggttttatgagacactatataatagaaagtattgctatttttaaaacgaatcaaataaattaacatcttaaaaagaatttctttacctgtgtgtacaaggcccaagtggaggtcagaagaaacttggagttacttctcccccagtaggtgantcctagagatccaactccagtcagtcaccaggatcaaggcaaaccanccaanccanccaagccatcttccccaccccaagtgtgagtgtgt

SEQ ID NO: 3258 - DNA, 466 bp, Mus musculus
  misc_feature (219)..(219): n is a, c, g, or t
caggaaccggaagtcatcgcggactcccacaaaggccggaagcggtggagccctgttgctcccagagccactctagggagccacggagttccactcagtggtttgtccttactctggcaaaagaagttgggattttctgtctaatcatagtgagcatgccggtccttatccggtttcgcgtttgtgtttcagtatcactgagattagtgatgtctcaangagacattcttctggtcaatgggaaaaaatgtattaaaaggataatttagtaagttaacaggatattatgaacactaaaatcagccttcataagtacgagtgtgaatgaaaagaccacagctacaaaagcaacagcaaaaatactcagagctcaagagatgtgccacatttacttggggctaactttaaaacactttaaaagccaaatatgaacataaataggaggcaataagctttcttgggtaga

SEQ ID NO: 3259 - DNA, 461 bp, Mus musculus
  misc_feature (325)..(325): n is a, c, g, or t
  misc_feature (352)..(352): n is a, c, g, or t
  misc_feature (399)..(399): n is a, c, g, or t
  misc_feature (403)..(403): n is a, c, g, or t
  misc_feature (416)..(416): n is a, c, g, or t
  misc_feature (426)..(426): n is a, c, g, or t
tcccctgaatttaaccaagcttgaggcttagtgtggggctgtgcctatgtgacctgtccatttatccactctctttcgtcctgtcatctgatcacctattttctcgccaagattttttctatcccatggccgcatttgtcttaggttaaacatatattcttggaaacatgaaatcacaactctcaaaaaccgtgaaccaccagaccctccccaggacacggaggcagctaccttcaaagaaaactaccatgaacgctaaagggtaaatagaggtccagctgtggctgctgccctgagaacccagaaagatgggaagaaacagaantcttttacacaccatgttttttttttnctggactccttaggatcacaactcctgtccagccatgttgcacccangacnggctgctctgctnagctggtaantcagatctaggacaggtccgaagctgaggagtcat

SEQ ID NO: 3260 - DNA, 485 bp, Mus musculus
tgagtttacggctgctgggccacatgggacatctcttagtaagcagagtagccagagagaaattgtcctcttgtgaggcttatggttcctgcgtggaaagtctcccgcagaatgcagtccagacaagagctgcaacacccatcttcagcatctcgcaccggaggcctgtaagcagagcacatccatcgaggctgtctgagtgtctgttcctgtggcatcgcgctcatgctgtcctcactcccatgtacctcacgaatgttcaaagctcaatggttgctttaatccctgctgtctggctctgctgagcccgacttccaggctttttttctggcagcatctgtggggccaggaacgggcttcagatgactcagtgctgtgcttcatgcctgactgccttctctagagggaaggctggagcctcctgcctgttcagctcctggcaagccagcagcactgaccaaaacttcacgtctttgttgcttgat

SEQ ID NO: 3261 - DNA, 350 bp, Mus musculus
  misc_feature (292)..(292): n is a, c, g, or t
  misc_feature (308)..(308): n is a, c, g, or t
  misc_feature (313)..(313): n is a, c, g, or t
  misc_feature (325)..(325): n is a, c, g, or t
ttgaggacatgtatagactatcttactacatagctaaccctggctggccctgaactcagagattcacctacttatgtctcttaagtgctaggaaaaaaatatgtgtgttgttgccatacctggtttgtataattttttttttttttttttgagtttattatgtagctttagctgtcctggaactctctgtgtagaccatgttgccctaagagatctaccttcctctgcctacagattgctggggttagaggcatgtgcccatgcctggcttgtttaacatctcattcccatnaatttttttattggtnttttnatttagaggctnttcgtgaagtgttgagtaccatgac

SEQ ID NO: 3262 - DNA, 545 bp, Mus musculus
  misc_feature (29)..(29): n is a, c, g, or t
  misc_feature (31)..(31): n is a, c, g, or t
  misc_feature (178)..(178): n is a, c, g, or t
  misc_feature (218)..(218): n is a, c, g, or t
  misc_feature (240)..(240): n is a, c, g, or t
  misc_feature (253)..(253): n is a, c, g, or t
  misc_feature (258)..(258): n is a, c, g, or t
  misc_feature (287)..(287): n is a, c, g, or t
  misc_feature (340)..(340): n is a, c, g, or t
  misc_feature (362)..(362): n is a, c, g, or t
  misc_feature (425)..(425): n is a, c, g, or t
  misc_feature (445)..(445): n is a, c, g, or t
  misc_feature (479)..(479): n is a, c, g, or t
ttggtttccggctgagacttttaagcgcncncgctcccctgactgggcatctggatagcagatcctttcgccctctccatagtatagaagggacccttgttttaaagacgattgcagtgggccataagctgggaattgccttattgaagggaacagtgattgcctaatgagaaaatgnattgtttgctacagagctgaattgaatttaagttggctgnttccgaagatagcactttcccnataagcaaatcanatttnttcttttttacataatggccaaattggtntattttaccgtgcagtccaagagagagctttgtcctgttaatttttcctcacnaactttagagtttgtcagaaantttccacatggaaaagagaagcctccagcatgttgccaagagccaaagaatcaaaaagcttantttgttaacgtgtggctgtntctacccccaggcaggaataccacctaagctaancaaaaatttcttcaaatgacatttttattgatacccatgtctgcatactcttgctatcacttacat

SEQ ID NO: 3263 - DNA, 407 bp, Mus musculus
  misc_feature (126)..(126): n is a, c, g, or t
  misc_feature (147)..(147): n is a, c, g, or t
  misc_feature (170)..(170): n is a, c, g, or t
  misc_feature (180)..(180): n is a, c, g, or t
  misc_feature (202)..(202): n is a, c, g, or t
  misc_feature (251)..(251): n is a, c, g, or t
  misc_feature (258)..(258): n is a, c, g, or t
  misc_feature (264)..(264): n is a, c, g, or t
  misc_feature (354)..(354): n is a, c, g, or t
ggtgacttgagttgaatagccagcagagaagaactgaggaattttctggcagggaaggtcttagacccagcatcagggtgccttatcaactggagagcctggctctatctagactggcaccttgtncttggttctccccaagcaacngggaagggttgaagttcagaagnttatggtgancccagagagaagatagggcttntaagccaaggttctgaaacttttgacctggaaacccacagttccttttntcctcantttacnatcattgaggaggatatgagggttaaaaggggaaagagaacaatcacagctaagggacatttgcaagctgctgtcagacttggaagggtnaactacttaaaggaagattagaagtatcataaatcctgaaccgaactcaagtg

SEQ ID NO: 3264 - DNA, 303 bp, Mus musculus
  misc_feature (111)..(111): n is a, c, g, or t
gttgctgggcatttctgagggctacccctttcccccctaactgactgtagcatagggctgtaccacttgctttgtctcctggttcactgcaaggccctagacccatgatcntagtaaggatgggggaggtttggagaccagattgcagaggggacagagctcacagcttgggttccctgaaccttggggatttagttattgtgaagggaaggaagggcaaaacagaacaaaacaagaaggggtgggggatgacgacagagcttaggcagcggagcagcgggaatggcagccttgtctcccagc

SEQ ID NO: 3265 - DNA, 329 bp, Mus musculus
gctaggtgacaggtttaggacatttgaaagcatttccttgggattatagaggcagtctggtcctttctcatgaggcgagctgaggtgcttgttttaccacacactccagctgtggtggtctcactcaccacaggccccaaagcaatggctaattgatcatggactgaacctttgagccagaatgaaccttgtctctttataaattcattatctcaaacatgtgttacagttacagaaatccgaaaaatacatatggatctggaagaactattatgggctgctccaagaactagcacagttaagtaggcgtcattaaagcttgtctccca

SEQ ID NO: 3266 - DNA, 201 bp, Mus musculus
  misc_feature (71)..(71): n is a, c, g, or t
  misc_feature (96)..(96): n is a, c, g, or t
  misc_feature (137)..(137): n is a, c, g, or t
  misc_feature (141)..(141): n is a, c, g, or t
gtaaagtgcttaatatgtttgtgattgagtttagattcccatcacccacataaaaagtaaaaagctgggtncagtggtgcacacctgtaatcctancactgggaaagcagagacaagagtggattactggtgcttanccantctaggcagttggtgaggtctaggtttagttagagattcggtctccaaaaatgaggtgga

SEQ ID NO: 3267 - DNA, 125 bp, Mus musculus
ttgcagtttcttctccagcccttgcagctgctgctgttagtacctcttggatgaatcccttcagtgtaacccagccccccaaacacgtttacacccgttctcttttgccctttggatactttcct

SEQ ID NO: 3268 - DNA, 147 bp, Mus musculus
  misc_feature (28)..(28): n is a, c, g, or t
  misc_feature (30)..(30): n is a, c, g, or t
  misc_feature (32)..(32): n is a, c, g, or t
  misc_feature (36)..(36): n is a, c, g, or t
  misc_feature (48)..(48): n is a, c, g, or t
  misc_feature (50)..(50): n is a, c, g, or t
  misc_feature (63)..(63): n is a, c, g, or t
  misc_feature (73)..(73): n is a, c, g, or t
cttgaagggcccttgggacactggcccncntntttnccttttggctgntntcaagtgaagaantcatcccctnatattttccccttcatgatgccctgccttaccacaggcacaaggacagtgactgggtttggtcactgctagcct

SEQ ID NO: 3269 - DNA, 473 bp, Mus musculus
agtgtctaccactggatctcattacctgagctgtaagaaccaatggcccctctttttatctgagcctggaaggccccccttacaataatgacaagcaccccaatcccatcagctcagactctctgtcccctccccccaggaccccagagtgtaaggcccgggttcttctgccagcaaagccattcggattgctccatctttcaaggaggccaagccaaccatattagccatactccaccagggtcttcaccactcttctttgggttgtgttcatgggtcctgttcaaccttcatcagtagaaggctctagcccttcctgtccatgtgacagtgcacatcagcgtgcatgtcttatacgtgcacatgagtgcacacacaaggaaaccaacaaaactccagtgtcgtcttctgcatgtggtgagagggacttgtgacccctatgtgacctccagctgctgtcctgtcttgtataa

SEQ ID NO: 3270 - DNA, 423 bp, Mus musculus
gcactgacgcaggagctcgaggcttggcaggacgacatgcaggtagtgattggacagcagctgcgctcccagcgccagaaagagctcagtgaggctgcagccgccccaagacgtgcgaagacccgcttttcactgcgcctgggatccgggcagagtggaggctttctgagcaacctcttccgaaggacctgagggttgggggccagggctaccttttctcactctggagctcaatttcctaacagccaatggagccgtggggtctaaaatgacttccaagggaagtcttccatgccccaagaggtggacagaggcactttgggtgcaggggccagctttggggcaggtgccccaggtgggtggcgggggcagagctgtttattttttgaatctaaatagatctatcttttctaagcgccaggt

SEQ ID NO: 3271 - DNA, 497 bp, Mus musculus
  misc_feature (62)..(62): n is a, c, g, or t
  misc_feature (191)..(191): n is a, c, g, or t
  misc_feature (406)..(406): n is a, c, g, or t
tcggcttcagcaccaggatttcggacagctcccagcgggtcacgaagagactaggcttcagnacccggcccctggcagtgccaagctctcaacacccagcttcagggatcgccttggggtctgttctggcggagagtgtacagggaaggaacctcttaatggttcttggcatttgtcctttacggagggantttttttttcttttttgaaacagggtttttttgtgtgtacctctagctgttctgaaactcactatgtagactaggctggcttcaaactcacagagtacaggcgaagcatttggtcaacgagatgttatgagtgcctctgggtgtactaatttccaaagtgaagtggtgaggggaaagccagcctcaatccaactttaaatctcaagttctttttntttttaaaaagagtttttctctcaattatatatataattattattattttaaaacactgtagaccaagctttgaactccttgtgtagccaa

SEQ ID NO: 3272 - DNA, 524 bp, Mus musculus
  misc_feature (50)..(50): n is a, c, g, or t
  misc_feature (111)..(111): n is a, c, g, or t
  misc_feature (200)..(200): n is a, c, g, or t
  misc_feature (210)..(210): n is a, c, g, or t
  misc_feature (226)..(226): n is a, c, g, or t
gtgaccaggcagtaccttggcctggggaggaagtcagggcaggaccccantccctcagcatccagaagcctgagggcacagccttgagagaggccagacagttcttgcctnctggagaggtgggagcccgagctggctggagagggagggcaggtatgtgggcaccagcagggctgactgccagcatagccctgcccttntgaattgctntgacagggccagggantcaagggcctcagaataaagaggcttgctgccatggctccctggacacacacttccacttggtccctctgtccctttgccctctcctaaagggtgtcctgtgccgggatcagcaaggtgggtacagccttcatgacggacctgccagcaggttactcctagttctgcctttgcatctcgtcccttgcctggtgtctgtgctgatagctcacgatgtgccatttaatgtcccctgtgcctccatttcccagccagcactatcttctccaggaggagagggtagagcaacactgtcacct

SEQ ID NO: 3273 - DNA, 496 bp, Mus musculus
gtgaacttcagtgccatcttgtcagaatgtgctaatagcagcatctaaaatctttacctgtgtccttctgccatgtggtcagggaagtgcactataccttctgtcttagaatatgaggcctgagtggcgacaggtggttactgtgccctcatgccaccagcctttgtgggacccacttttcatatggaacttgtacacagatttgcagccttaccacactcacacctcagtgatgggcataagttctagttctctcctgaatgcgctgggaaaatgatcttccttgtaatcaacacttgaaccagtttgtaccaaatgacctcaagttcttttgggaaccattgttaattgtctgtctctatagtctcaggatggagagaagcgagatgaatgttcctagaggacacagttaacaggtctcatcagggatgccttcccagagggttgggagaaggaggttgggttgggctgacagacctgcttttggcttcaggaa

SEQ ID NO: 3274 - DNA, 496 bp, Mus musculus
  misc_feature (321)..(321): n is a, c, g, or t
  misc_feature (332)..(332): n is a, c, g, or t
  misc_feature (357)..(357): n is a, c, g, or t
  misc_feature (401)..(401): n is a, c, g, or t
  misc_feature (414)..(414): n is a, c, g, or t
acaatgggccattccggttgatgctaacactctactggctgtatctggcatgaatactgacaacacagactcccagaagctgaacaagatcatatctgaaatacaggctttgcaagaggtggtggctcggttcagacagctccgattagacgccactgaatttgcctgtctgaaatgtattgtcactttcaaagctgttcctacacacagtggttctgaactgagaagtttccggaatgctgccgccattgccgctctccaagatgaggctcagctaactctcaacagctacattcataccagataccccacccaaccctnccgattcgggnaactcctgttgcttttaccagcttnacggtcaattagcccatctaccatagaagaagtgtttttcaaanaaaaccatcggcnatgtgccgattacaagactactttcagatatgtacaaatccagtgacatctaagggctccagtacccacttttccaagatgg

SEQ ID NO: 3275 - DNA, 486 bp, Mus musculus
  misc_feature (281)..(281): n is a, c, g, or t
ggaatgacaactatcccacttctagtcctgctgggcttggagaataatgtgaaggatgatggacagcatgtgtggcgactcaagcactttaacaagcctgcctactgcaatctctgcctgaacatgctgattggcgtggggaagcagggcctctgctgctccttctgcaagtacacggtccatgagcgctgtgtggccagagccccgccctcctgcatcaagacatatgtgaagtccaagaaaaacacagacgtcatgcaccactattgggtcgaaggcanttgcccaaccaagtgcgataagtgccacaaaacagtgaaatgttaccagggcctgacgggcctgcattgtgtttggtgccagaccacactgcacaataaatgtgcttctcatctgaagcccgagtgtgactgtggacccttgaaggaccatattttgccacctaccacaatctgtccagttgtattgactatgcccagtgctgga

SEQ ID NO: 3276 - DNA, 520 bp, Mus musculus
  misc_feature (141)..(141): n is a, c, g, or t
  misc_feature (155)..(155): n is a, c, g, or t
  misc_feature (160)..(160): n is a, c, g, or t
  misc_feature (168)..(168): n is a, c, g, or t
  misc_feature (175)..(175): n is a, c, g, or t
  misc_feature (205)..(205): n is a, c, g, or t
  misc_feature (290)..(290): n is a, c, g, or t
  misc_feature (328)..(328): n is a, c, g, or t
  misc_feature (336)..(336): n is a, c, g, or t
  misc_feature (350)..(350): n is a, c, g, or t
  misc_feature (364)..(364): n is a, c, g, or t
  misc_feature (369)..(369): n is a, c, g, or t
  misc_feature (374)..(374): n is a, c, g, or t
gccattcgcgtggtgtaatccgagaggcgccactttccaactaaaggttttcatataaggtctacaacactgaaattttgtagtattagcccttgcattgggacgttcagctatcatttcgtagtatatgtgtgaagctangagcgaagaatctnagccnttgtgtancgagagnacataattacttggttgttagatgactatngacagtctactaactgcaggtcaaagctagttaacttctagctctaacttcttggagcacaactagaatgagcactctccattgnaagatattagaggcttctgactggccatcatctaagancataggtncaattctatgtganttaaacttttttgncaatncattnccttaagaaaacctttttatgtatttatattaaattcacaaactgttaaactttaaagttttgttttttaaactttcatggttgtagaaatgttaatttgtaaaacattaattttaaaactatgctctttgttgcattttatctca

SEQ ID NO: 3277 - DNA, 419 bp, Mus musculus
  misc_feature (321)..(321): n is a, c, g, or t
gtagttctgtattgctgagttctttgatgggatttctaggttataaaagtgttatgccacaacttcaggcagtgtttcagtctagcagttggaagttgctacatgatttttttaattcactctcatttgctgagattattagtaaaggcagctgtactagagttatactatgcattacaaagagctgtcttccattcatggacatatgtaccccatgctccaccctgtcacctccgcagtcatgtctgtactgctgacactggccaggcccagtgaaggaacccataagagcccagcacgataaggctttgtacatgacanttaggaatgatctgtgggtcttttaagagccacctactcactggggaatgggcctcagataaaataaatccactagagtctagctcttttcatataga

SEQ ID NO: 3278 - DNA, 458 bp, Mus musculus
  misc_feature (298)..(298): n is a, c, g, or t
tgtgatgcccttgaagcctacgctagccactgtcgccaggcaggggtgactcctgtctggaggggtcctacactctgtgtggtgggctgccctgtggaccgtggctttgtgtttgatgagtgtggaccaccttgtccccgtacctgtttcaaccggcacatacccctaggggaactggcagcccactgtgtgagaccctgtgttccaggctgccagtgtcctgcaggcctggtggaacatgaaggccattgcatctcacctgaggtctgcccaccagtcctgcttactggcgactagncagctcacatcctgtccaatcccagtcaggagcagcccctggttccatgctgagttaagaatacccatatcccgaacttacctggccagaggttaccccttggtgagcagtagtggagactgccctgctcaggcaatgggatcttatgccagtcctccag

SEQ ID NO: 3279 - DNA, 506 bp, Mus musculus
  misc_feature (336)..(336): n is a, c, g, or t
tagtctgctgcaaacctttatttttttaatttgctttatatgtataggtgttttgcatatatgtctgtgcaccatgtgcattcctagtgcccaaggtggccagaagagggcattggatttctagaatagatggttctgagccaccatgtgggtgggtactaggaatccaacctgaaaatctccgggaagagcagctagcactcttcaccactgagccaactcttcagccccatgctgcagagacatttagtaagttaagcggagaaaagacctgatttgatcttttggcttttacttctgttttgcagcttttaaagttttatttggggaagaggnacacataccttgtcctgtgtatgcaggtcagatgcacttgtggacggcagaggacttgtggtagtccatttccctctttccattatgctggccctaggatcaaacttgggttgtcagtcttggcagctgtacctttttacactgcactgtctggtcgctttgtctttttt

SEQ ID NO: 3280 - DNA, 316 bp, Mus musculus
  misc_feature (59)..(59): n is a, c, g, or t
  misc_feature (71)..(71): n is a, c, g, or t
  misc_feature (84)..(84): n is a, c, g, or t
  misc_feature (86)..(87): n is a, c, g, or t
  misc_feature (91)..(91): n is a, c, g, or t
  misc_feature (104)..(104): n is a, c, g, or t
  misc_feature (124)..(125): n is a, c, g, or t
  misc_feature (131)..(131): n is a, c, g, or t
  misc_feature (158)..(158): n is a, c, g, or t
  misc_feature (177)..(177): n is a, c, g, or t
  misc_feature (199)..(199): n is a, c, g, or t
tcttcaccatcaattacagagtgtgcttagtctcagatattgaacaatttgtttctcantttgctgagagnctgaaaatatagntnntgcnaagcaggttgagntaacttcagcacagaggggnnttctgnagggcactgactagctcaagctgaccncagttacaatgcaaattanaggtcagcttgggctacatganaacttgtgtgaaagataaaataaaacaaatgtgtgcataggtgttctccaatccagccctcatgaattgaaatggcaatttatttgctttcattaatatggttcattgtgggctggt

SEQ ID NO: 3281 - DNA, 502 bp, Mus musculus
  misc_feature (234)..(234): n is a, c, g, or t
  misc_feature (269)..(269): n is a, c, g, or t
agtccgctcagctatatcttggagggcggggtgtgtgtgtaccaatcctggctgtaggaaccaagaagctagagctaggccttctgggagggatgggggacttggatgtcagtcctttatagcaatctcacatgcacaggtagtttctggaatagcaatctgcttgggccagacttgtctctacagtattaggttatggttattgcttctatgacagaaggggtccggaagccntggtggctttggagtctgagaaacaactggattgntgtgtgtgggggggacatacacctgtaggtatggacaccccaggagtggactgtcccaggatggcacagcccatggaagcatttggaagcattctggggctgtgttctattctatggtgtcaggcacgggaggcatgctaggggcgggaagggaacacaacagggtcatttcccaagggccacggcattacaagaggggctgaagtgggtaccaggcttttcctcatttttgg

SEQ ID NO: 3282 - DNA, 379 bp, Mus musculus
  misc_feature (40)..(40): n is a, c, g, or t
  misc_feature (52)..(52): n is a, c, g, or t
  misc_feature (62)..(62): n is a, c, g, or t
  misc_feature (69)..(69): n is a, c, g, or t
  misc_feature (83)..(83): n is a, c, g, or t
  misc_feature (120)..(120): n is a, c, g, or t
  misc_feature (190)..(190): n is a, c, g, or t
  misc_feature (217)..(217): n is a, c, g, or t
  misc_feature (261)..(261): n is a, c, g, or t
  misc_feature (295)..(295): n is a, c, g, or t
gccttgtatctcaacaccctgagtgctgatttctgctacnatgacaggtaantgggtgaganaaagggncaatggctgcggtncgacgggggtggggtgggggctcctcggtggctctgntactgcttgctgtcaggctgaagcgcgtcttgggggcggggttggggggacaggtatctgcacctgaagntttaggcgacacggaaaccgtaacacnctaaagcaaacagccgggacggacgcaggcgcgctgggcgggcngaacgagtttccgctcctactttgcagcaggttnttgcttgcttcttgctggttggcaggcgcttaagtttctttgcggaaatccaggcaatttggaagactgtttaatgaacccacg

SEQ ID NO: 3283 - DNA, 396 bp, Mus musculus
  misc_feature (369)..(369): n is a, c, g, or t
atagttcttccctcattttgatcagaacaatgagaaaagcaatcacaggtagcaaaaccatctcaacaaacctaataaatgtgtcaacagaagtattacagctgagggtgtcacagctctaccatgagctacaaagtggctcagccaatgaatgacttccgagccttaaggaatttttggagtcttgttgacctccagagctcagggaacttattgcaggtcagcagtgttgccatttgggggctctacccaactcctgcggtttactgatgcctcagacattgaggcaggatatttagtgtgtccttgcccacccgtcagctcgacattgttggcttgaaagcttgtctggtttttaaccttgtcatnatttgagtgtctccttgcttaaagtga

SEQ ID NO: 3284 - DNA, 399 bp, Mus musculus
  misc_feature (219)..(219): n is a, c, g, or t
  misc_feature (267)..(267): n is a, c, g, or t
  misc_feature (272)..(272): n is a, c, g, or t
  misc_feature (293)..(293): n is a, c, g, or t
  misc_feature (368)..(368): n is a, c, g, or t
aaggtaactgttgctacctcatgccctgacccctgatacaaggataaaattcccattgagttgaaccactcacggtgattggttcctgagaagaggcttagtctctatggagaccacactgcagtggctaaacccttcccttgcattgagacctctttacctgtgacatcatccttggcgctcactgggttatttaaagaggcttgcagttccttaagnggaaaactgttggcattctctggcagtgtgtatatctaccagtgtttntaatnttgagattttctatacatgancactcctagtcatttgttataatgaagaatccaggcacctcttaaataagaaatggtacatagtacattttagantcctgtgggatccacagactatgtgttctta

SEQ ID NO: 3285 - DNA, 484 bp, Mus musculus
taagtctcagttcttgggccagatcagggatgtgttcatttgtgcttgcaactcttctaaaaatatcgctatgtcaagaagagggaaacgttgtaatggtggcaggtttcatccgttaccttaccatctcagtatgctttccattttcagggagcgaggggggaagagctcacttccccacatcttccttatgctgctagagaggtacgactctcttagttctgtgctaaatttaaattaagatgtcagtcaggaagcttccctggcttgtcagatcagtgaattctccctgtaaaactggcaagatgctttctcagtggagaaaggactggctcctacgagagcagacagaactaagccaaccgtgtacttgacttgagcgacttccttacgacctatcaattaggctctagggccagcgcctgggggatcctgcttgtttgccactgtcagggttctttgccctggccagttactaatgctg

SEQ ID NO: 3286 - DNA, 507 bp, Mus musculus
  misc_feature (384)..(384): n is a, c, g, or t
ttttaattcattttcgcctcttcctcaggtctctgaggttctttccagcattttctttctttggattttgcatcactggagatggcatcccccagccttgtgcatgccaagacactgcccctcatcctctcatgctcagaattctcgtcgctgaactttgtagttttccctcttaatggttcagttctctgccacttaagagtcacggcactgcctgcctggcctcagttgtccagaacaggccagcatgctcacagggcccagcaagtgtgccggtttatttcttgcacccgtctcctcacgaaccagtccaatcccaattcacttttatatttcttgtatactgaattgttatttccccaaaaaactgcctcgaacagaaancaacaccattgtgacttaattctaaaaatatttttaaagtatattcctttcaggggtggagaggaggaacttctgctggaattctacaggcagcctctggccgttgtctcagaagcccaacaa

SEQ ID NO: 3287 - DNA, 443 bp, Mus musculus
  misc_feature (72)..(72): n is a, c, g, or t
  misc_feature (83)..(83): n is a, c, g, or t
  misc_feature (207)..(207): n is a, c, g, or t
  misc_feature (289)..(289): n is a, c, g, or t
  misc_feature (307)..(307): n is a, c, g, or t
  misc_feature (314)..(314): n is a, c, g, or t
  misc_feature (405)..(405): n is a, c, g, or t
gacaacctcgttgcagaattctgcccagcactgacagcctcagcgcccaccctctgcttctcaggatgaccntgggagcgccngagttttctttgctcagtgaggaaacccctgggtttcagagtaactcctgctggcacactgggaaagacttttaaagctggaattaaaaaaccaaaccaaaccaaaccaaatcaaaccaaaccnaaccaaaccaaaccaaaccaaaccaaaccaaactgaaacaaaaagaaaaacaaaccatctgatccatggcgctgttgcctgnctagggcaagcctgcgtncgggggnggggcggggtggagtgagggggaatcggaggaggtcagaccttcagtttctcaatccaagagtgtggaatgattcttgttttagttttacntagtgtagctcactgtttgcaagtcagggaaccggccc

SEQ ID NO: 3288 - DNA, 515 bp, Mus musculus
gaagagcagcccatgttcttacctactaagctatctctctagccctgcaatgtctcacagagcaccacactcagttctgctgcatctgctgacttgtctgtgagctgacaaccgtttaacaggctggttcatgagggccagtctcctggggactgaacattttcacaaaacctctcttgactattgttacaaagtcagatttgagttatatttgctctgagacaaaattacacacaaaaacactaggtgttttcaggaaaccaagttgatcatatgcaaaatttgtagcttatttttccagaatttcagaaattataaatccttagttgtcaaaatatattaatattacaaatttcatttcaatagccttattgggctcccgggtgtagtttcatggtagagtgcttacttaccatgtcccaaggctctgggttcaattcccaacacagaaaacatcccagagtcttcaaaccccggctgtttaaaagtcatacctgatggtcttccttatgttt

SEQ ID NO: 3289 - DNA, 361 bp, Mus musculus
attcaaggttccgtgagaacccctgcctcaaacactaattagttagcaagcaagagaagctatttcctgtccacctctggcctacacgtgtacacgcacaaatacacacacacacacacacacacacacacacacacacacacacaccctctctctctgatgaggaacagatgtctagcctgcaagaagttactatgttatagagggttggtcacatcagaaaaaataaaacctagaatcacggttcattgttgtcactgtgctgccccctgctgaccatgtgacacttacggacagtgctgtacaaaagaatgcctttaaataactctgagactggttgctgactacttttgctttttgt

SEQ ID NO: 3290 - DNA, 453 bp, Mus musculus
gttttcgtgacttcttcaggctacaagcagagactcaaggggatgcagagccttaacaggggagctgaacatggtgtggatgttaatggccctgtataacttgtgtgctcatgagctgatgcagagggtagtttatgacagctggccacaatacagagccaggagacaggaagtccacagcatagttagtgagtttctaggaggtggctgaaaattgttctcgaaccatatctacacagtagtgagcctgaattaaatggtggatggttggagtggccagcgaggctgagagccagcctacaacctggctgctagtctctgccctgtgtgaccatgtcactcctatgagccagcttggcaggtgactttgcctggaacctccgtagcctgaggacgggtgtattagtggcttgttgcacttaccttctgacctgcctcaaatggctctttcta

SEQ ID NO: 3291 - DNA, 220 bp, Mus musculus
  misc_feature (137)..(137): n is a, c, g, or t
  misc_feature (189)..(189): n is a, c, g, or t
  misc_feature (192)..(192): n is a, c, g, or t
acaaccttagaactccttggacactggcagaatttgacacaaataaaagacagtagagaggctggttaggaaggtgggaggcaccccggggcgagcactacctaccaggctgtgtgattcttgacaaactgtaattntgcacagtggactaaacaaacaataaaggtgcagtgggggaaactattggtntcnccaacttcctcgtgagcccgtgtgtaat

SEQ ID NO: 3292 - DNA, 544 bp, Mus musculus
  misc_feature (205)..(205): n is a, c, g, or t
  misc_feature (211)..(211): n is a, c, g, or t
  misc_feature (259)..(259): n is a, c, g, or t
  misc_feature (264)..(264): n is a, c, g, or t
  misc_feature (271)..(272): n is a, c, g, or t
  misc_feature (276)..(276): n is a, c, g, or t
  misc_feature (293)..(293): n is a, c, g, or t
  misc_feature (308)..(308): n is a, c, g, or t
  misc_feature (317)..(317): n is a, c, g, or t
  misc_feature (325)..(326): n is a, c, g, or t
  misc_feature (420)..(420): n is a, c, g, or t
  misc_feature (448)..(448): n is a, c, g, or t
  misc_feature (511)..(511): n is a, c, g, or t
ctctgtctggatctggaccactgacccactcacagccctcagcaggactttaagcctcatcgtggtttcagatggctacacaagcatcagcgtggcccccctgaggcagcaaagcctgaggacatcaccacatcttcagtcagaggcacagagcttacatccccgtggacctcagacttcatcctggcctggggcagcagcatgnaccacnagacaccagcatggcctctggtgacatcatggaccatggtggtccttnccagnaggtccnnatcnagacattgaacttttcntcatctcaggcctcnatcattgancagagccnngatgatcctgtgacctgactgggtggcaggttcgggacctgagtctgcagctgcacaagctccaggatgctgcacagcaccctgcacaccttantgcgctatgacggcaggttaaccctctntcttccctatcaccacgtctccagttctgcctccctccatagagcacacaccgctgttttctntctttcccatctccccatcacatatgatcatca

SEQ ID NO: 3293 - DNA, 505 bp, Mus musculus
  misc_feature (326)..(326): n is a, c, g, or t
tagtctgttagtgcccagctggtagctctggttggccttggcccaatggagcctccattcagagccatgtcaccgggcatcaatggagcagaagcagacccaggggagcatggtagaagaactgggggggaaactgctgttctctgaagcaggaaaagacaaagttcaagtctaggagaaacaagtatgtggtcccatgctcaaaaagcagaccagagctggggatgtacccggctccggctacgcttccatctcatcagcctaaaacactgtccaatttaccttgacatcaaccagctcatttagaagaaattgttaccagaaanctctctaaaagacacaactttaaaagccacccaaatgatttctttggctctggttaatgtcagcagcagcagggaaagaggcagggccttgtgacatcactaacagtggcctgcagaagtccctgtcttcagacagacctttactgaggcaaacccaggattcctggtttcatcatgga

SEQ ID NO: 3294 - DNA, 412 bp, Mus musculus
  misc_feature (313)..(313): n is a, c, g, or t
gtcctgttggtatttttgtcttctctcctccttagagctgagacttggctcagagagtggcctgcaagtcaaggaagcagtctacggtcttgcctgtgtgcactggccctgtattcagaaagtctgtgctttaaaacatattctgttagcctttattgtcaacacatcagagaggaaaacctaactgaggaaccacagagatgagatcagcctatgtaggatcatcctgattgctaatcagtatatgagggagggcctagcccactgtgggcagcgccattcccctgacagtggttctgtcctatataaaaantctaagcaggagcctgctagctagccagcagggtttcctctggtttctgtttttcaagttcgttcctgcctgagttctgcctcaacttccctgaatgaa

SEQ ID NO: 3295 - DNA, 505 bp, Mus musculus
  misc_feature (87)..(96): n is a, c, g, or t
  misc_feature (98)..(103): n is a, c, g, or t
  misc_feature (105)..(106): n is a, c, g, or t
  misc_feature (111)..(111): n is a, c, g, or t
  misc_feature (174)..(174): n is a, c, g, or t
  misc_feature (236)..(236): n is a, c, g, or t
  misc_feature (326)..(326): n is a, c, g, or t
ataaatccctgtagtggccaagacagctgcctccacacccatgaattttccagaccagaaatgttagcaaggataaggttgagtaannnnnnnnnnannnnnnannaaaangtagaatctccttaccacagcacatcatgagtagcatttgcttccagctggagactaggcaangttgcttgtatgtttgggcagtgtccacgctggcccatcaaaacatttgctccaaaaaccanctggagagacctgccttctagactcagcaaatgtgagacaatatcatcctgctcatcctaaaagacccaagcagggatgcctgctgcctncccgcgactctctggacaacttttcttcctcctgtttttatgacatgcccattcctgggccatttgtcaaacatgccttatctctggtaatagcatcttgtttggtgtggtttttgaattctaggcagaccatgcccagtataatagtcttggacaaacattcttcctgtctggagtat

SEQ ID NO: 3296 - DNA, 438 bp, Mus musculus
  misc_feature (86)..(86): n is a, c, g, or t
  misc_feature (92)..(92): n is a, c, g, or t
  misc_feature (94)..(94): n is a, c, g, or t
  misc_feature (98)..(98): n is a, c, g, or t
  misc_feature (101)..(101): n is a, c, g, or t
  misc_feature (109)..(109): n is a, c, g, or t
  misc_feature (115)..(115): n is a, c, g, or t
  misc_feature (118)..(118): n is a, c, g, or t
  misc_feature (133)..(133): n is a, c, g, or t
  misc_feature (137)..(137): n is a, c, g, or t
  misc_feature (168)..(168): n is a, c, g, or t
  misc_feature (198)..(198): n is a, c, g, or t
  misc_feature (212)..(212): n is a, c, g, or t
  misc_feature (245)..(245): n is a, c, g, or t
  misc_feature (342)..(342): n is a, c, g, or t
  misc_feature (345)..(345): n is a, c, g, or t
  misc_feature (364)..(364): n is a, c, g, or t
tgaaatcccaatcccagcactggtgatgctgaccatgacttaactccacatgtgtagcgcactgcttgcctgttcccaggcacacngcatcntnctanctntattccanaccttngcngctctttaactttgntgantgagctatgtggaaaaggttgtaacacacangagacgaggaacaactggtccatgtgttgnccacatcatccagngtccagtccagcccagcccagccctaccaagtntagccagcactagtcagtaacacaatcctcctttttattaaatcaagatttggatgtggcctccgtcctaccttagtgttccaggtaattatcaccnacntgagtggcaatcctacttnaaacccctttactggctctgatcttgaccttataacaagtaaggttgctttgtgcacccacacggaaagatgtc

SEQ ID NO: 3297 - DNA, 472 bp, Mus musculus
  misc_feature (26)..(26): n is a, c, g, or t
  misc_feature (298)..(298): n is a, c, g, or t
  misc_feature (332)..(332): n is a, c, g, or t
  misc_feature (345)..(345): n is a, c, g, or t
  misc_feature (356)..(356): n is a, c, g, or t
  misc_feature (370)..(370): n is a, c, g, or t
  misc_feature (381)..(381): n is a, c, g, or t
  misc_feature (392)..(392): n is a, c, g, or t
  misc_feature (440)..(440): n is a, c, g, or t
tctgtggttgtcacctgcagagctanattcaggcaaaggaggctactgcaaaggagcagagctgtccagttcagccctcccagctgtgggatgcttactgccaggttacagctccccatcctgccatgagctgtcccaccacggaggtcacttatgcacgtggcattgtgaacttgatactaaaagagttagtgcccaagccccacctggagacgaggactggacgccacgttgtggttgaagttattacttgcaatgtcatcttaccactgatcagcaagctatcagatcctgactngatccaccttattcttgtgagtatcttttccaantacagacatgatncagcacagggnactaaacccccctnctcatccagtntcctagagcanccctcggtgcccacatctctgccattgattgttgaagtagagagtctnccagtaggaaaagcatcttctccagcaacagc

SEQ ID NO: 3298 - DNA, 475 bp, Mus musculus
  misc_feature (263)..(263): n is a, c, g, or t
  misc_feature (270)..(270): n is a, c, g, or t
  misc_feature (329)..(329): n is a, c, g, or t
  misc_feature (343)..(343): n is a, c, g, or t
  misc_feature (388)..(388): n is a, c, g, or t
gaaaggtgttagtcagaggccctaagttaccacattgaatgactagaagaaacattttgctctcacactacactactcacagagaggaataatttcaaattgcctgtgtcagcaaagtgggcggtgcacaggctgaggcttcagtggtctgcagggctgacctccagcccagtctcacaagctcagcgtctgagcaggggacaggcgcacttccccttcttccctgccttggtttttttctgatcttttactggaaggcactnaaatcanccctagagattccttatatgagatactacctggatcaagcccatatgttttcatggtgnccttcactgaaacntaccaaatgggcaaaacttaaagtgagatgctcgggaaagtgacngactaattgcatgcactactccttcagtgaactcaagttcagtccccagaactcatctcgggtggtttaccacctcctgtaagggat

SEQ ID NO: 3299 - DNA, 421 bp, Mus musculus
gttgtgtcactgtttcatatggtatcttatgcacctgagattctctcttccatctcttgtaatctgttggtgatgtttatgtctatgactcctaatctctttcctaggttttctgtctccaagcttgtatccctttgtgatttctttattgtttgtatttccatctttagattctggatggttttgttcaaagtctagcttcctcctgattctgtgatctggggcatttcagagcacctgggagttgggtccctctgggtgttgtaagagtgggtgcagagccagtaccccaggtctgctccaggtgcaggttcagaccagaaggaacccgtgccactgggctgactagggttcctatgtccctggatcctgtgggaccagttactctgggtattgggacagatgttgtggtctcttcacc

SEQ ID NO: 3300 - DNA, 413 bp, Mus musculus
agtgttctgtgcctaccaggtaacatggagcacagaatacttggcttcccagaagtgtattcagagacttggctgccagaaatgtcctggttacctcggacaatgtgatgaagattacagactttggcctggcccaagacgtgcacaacctggattactacaagaagaccacaagtggcctgctacctgtgaagtggatggaatcagaggcccttttttacagagtcttcacccaccagagtgatgtctggttctttggtgtcctccgctaggacatctcaccgtatcctggcatcccagtggaagagcttttcaagctacttacagagggccactgcatggacaagccccacaactgcacacgtggcctgtacatggtcacgtggggatattggcatgcagtgtcttcagag

SEQ ID NO: 3301 - DNA, 451 bp, Mus musculus
  misc_feature (216)..(216): n is a, c, g, or t
  misc_feature (227)..(227): n is a, c, g, or t
  misc_feature (236)..(236): n is a, c, g, or t
  misc_feature (241)..(241): n is a, c, g, or t
  misc_feature (248)..(248): n is a, c, g, or t
  misc_feature (254)..(254): n is a, c, g, or t
  misc_feature (261)..(261): n is a, c, g, or t
  misc_feature (267)..(268): n is a, c, g, or t
  misc_feature (270)..(270): n is a, c, g, or t
  misc_feature (275)..(275): n is a, c, g, or t
tatgatagattaaaaactttcccaacaataaaatttcatatggctacacctgtgttatcagaggtgggttttggtatatggtaaagaaagtcttaattagaaagaattagtttaaatttatgcattgaagatttataaaaaatcaggcactagatgttgaataattgaccatatggggctggagagctagctcagtgattaagagcactatcatanagattaacctnctcttgcanatatnccagtanccttgnatgactncctcanngnatacntccttttagaattgttatattttgatgatttatattaataatgatgttacctgttctgtatgtgattcactgaatacatagtttcagagttgtaatgcttggatgatttttgttggtatttgtgattgattcactggatacagtttctaagagatgcaatgtttggattttaatgt

SEQ ID NO: 3302 - DNA, 481 bp, Mus musculus
  misc_feature (246)..(246): n is a, c, g, or t
  misc_feature (257)..(257): n is a, c, g, or t
  misc_feature (266)..(266): n is a, c, g, or t
  misc_feature (271)..(271): n is a, c, g, or t
  misc_feature (278)..(278): n is a, c, g, or t
  misc_feature (284)..(284): n is a, c, g, or t
  misc_feature (291)..(291): n is a, c, g, or t
  misc_feature (297)..(298): n is a, c, g, or t
  misc_feature (300)..(300): n is a, c, g, or t
  misc_feature (305)..(305): n is a, c, g, or t
tctgctggccggacacaacaataaaacagttatgatagattaaaaactttcccaacaataaaatttcatatggctacacctgtgttatcagaggtgggttttggtatatggtaaagaaagtcttaattagaaagaattagtttaaatttatgcattgaagatttataaaaaatcaggcactagatgttgaataattgaccatatggggctggagagctagctcagtgattaagagcactatcatanagattaacctnctcttgcanatatnccagtanccttgnatgactncctcanngnatacntccttttagaattgttatattttgatgatttatattaataatgatgttacctgttctgtatgtgattcactgaatacatagtttcagagttgtaatgcttggatgatttttgttggtatttgtgattgattcactggatacagtttctaagagatgcaatgtttggattttaatgt

SEQ ID NO: 3303 - DNA, 349 bp, Mus musculus
  misc_feature (39)..(39): n is a, c, g, or t
gccttttcctggatctcagatctagaaactcagaattgncccatccttgtgctcactgccccccacgccccattggatagacgtttggcccactgtgagagccagatgccatgctgggtgctgcttgaggcaccgtgctgagtggcttcagtctccacgcagcctgatgtctgtaaactcacaatcctgtatcctgagtccagatataggagttagcaaaggccagaggtgagggaagatgaggccaggccgcagtaacaacagctacctctcgcatagtttatggtgtgccagatgctattctaagcacctccagtctggtttgttgctagtactgactccattttct

SEQ ID NO: 3304 - DNA, 442 bp, Mus musculus
  misc_feature (225)..(225): n is a, c, g, or t
  misc_feature (234)..(236): n is a, c, g, or t
  misc_feature (242)..(242): n is a, c, g, or t
  misc_feature (244)..(244): n is a, c, g, or t
  misc_feature (253)..(253): n is a, c, g, or t
  misc_feature (271)..(271): n is a, c, g, or t
  misc_feature (286)..(286): n is a, c, g, or t
  misc_feature (291)..(291): n is a, c, g, or t
  misc_feature (324)..(324): n is a, c, g, or t
  misc_feature (410)..(410): n is a, c, g, or t
ggccctgctagggaaacagtgtctccctgtaactttgctaactgagtgttcagtatgtaacccctgtgtatggcccccctggttttgcatcctgtgtgctgggattagagcacccaggcctgctaacttccttaagtctaccactgacctatatataaggcctatctttgggtttgtttgtttttttttttttttaactggtttttgttttcttacatgcgtgantattttgcnnncatggnantggagttanaaattagataagattttntatgattttgatttntgaantttgataaccctatttctaaatttcataagcanccttgagtggcagctattaattttacaggtgatatatattgcttaggaaatgataaaatgaagaaaataaatactttcttgatttntcaacaagttaaaaaccactccaggcactcag

SEQ ID NO: 3305 - DNA, 444 bp, Mus musculus
  misc_feature (26)..(26): n is a, c, g, or t
  misc_feature (355)..(355): n is a, c, g, or t
cccaggtagcactgctgtcctggganctcattctatagaccagactggccttgaaaacttttttgattgttttcaagataggatctcttatgcagctctgtttgtcctagaacttgctatgtagaacaggctggcctctgttaggattaaaggcatgcattaccatgcccgggtcttatctgcctttgcagttagtactgttttttttttttaatttttaaaatatttatttatttacttattatatgtacgtacacttgtagctgccttcagacactccagaagaccgtatcagatttcattatggatggttgtgagccaccatgtggttgttgggatttgaactcaggaccanttggaagagcattcggtgctcttaaccgctgagccatctcatcagcccagtactgtttatttttgatactcttgtatactgtgacagga

SEQ ID NO: 3306 - DNA, 410 bp, Mus musculus
gtctcgtttttgcttgagcgttagcggactgccagaggcaaactctctcagctcctctgactttgacagctcttcagagtccgtgaggtcgtccagagctgcgatagtagaatcttcattgctcgccgactggtggtttcctgagtccttggaagaaaagtctttggagcaatcctctacactcacctgcacaagaggagttgtgctcaggctgaggacagagggctggctggggatggagggggaggaggcagcattgttacccaaggcaccaccattcccttggttcatcatctcttcttcttcatcactttcgactattctgagaggtgggagaggctcaaacaccagagagtcactgtcggatgtggacagtatagagtgtttctctggcccagatgttgagtctg

SEQ ID NO: 3307 - DNA, 110 bp, Mus musculus
  misc_feature (26)..(26): n is a, c, g, or t
  misc_feature (29)..(29): n is a, c, g, or t
  misc_feature (83)..(83): n is a, c, g, or t
ataacagaacccatggttagagacantcnatatgatttcgtgaacaaagatggacaatagaagctgccctgctattgggaagntcccagctactgcagggccagggaact

SEQ ID NO: 3308 - DNA, 545 bp, Mus musculus
  misc_feature (86)..(86): n is a, c, g, or t
  misc_feature (122)..(122): n is a, c, g, or t
  misc_feature (297)..(297): n is a, c, g, or t
  misc_feature (322)..(323): n is a, c, g, or t
  misc_feature (343)..(343): n is a, c, g, or t
  misc_feature (358)..(358): n is a, c, g, or t
  misc_feature (446)..(446): n is a, c, g, or t
  misc_feature (497)..(497): n is a, c, g, or t
caagactcttccttatggtggtggtcactgcaggattagctccagatgtgagacccggggatgaaacagatatgaaccatgttcanaaacttgatgacgtacctacgcatttggagaaacantgggggcatttcttctgtgtttgatccagcggagaccatctgccagcaatcatacactgagagtgaaggcagggataaaaaacagaagatttttatcattgggatagagataaatcctctcttgatggcccctttttggggctcctcacttacacgctcactgttggaagtgaangccagagccaatggacacaaacacnntgtattatttccttctgtgnaacttaataataccnaaggagttccaacaggagacaagcagatttataagatgcttaaatggaagaaacaataaaggaataactttgtgtaacaggtttatgncctaaactctgcaaaacccaggacatttaaaatacagacagcaaacatatntgttagcaggtttcattgtgggtggctggtccttaagtttgcatgaaa

SEQ ID NO: 3309 - DNA, 300 bp, Mus musculus
  misc_feature (171)..(171): n is a, c, g, or t
  misc_feature (173)..(173): n is a, c, g, or t
  misc_feature (195)..(195): n is a, c, g, or t
  misc_feature (213)..(213): n is a, c, g, or t
  misc_feature (255)..(255): n is a, c, g, or t
  misc_feature (265)..(265): n is a, c, g, or t
acacaaaacacggtccagccagttgactgttctgtcagctgaggccgttgaacctagatctctatccacgctctgctcttcgaagtcacgctgttgatgtgcctcgcagaaaggccactcatcttgaggctgcaagcttggagaatgtggctttatcactaatgctttcgntnttctctgtgaaagaaaaacatnctctggagaattagaaanacagaggtctgtaagaaccagtatttctatgtttttttaccnaacacttagnacagtgttaaatttcagattaacctttaaatgcta

SEQ ID NO: 3310 - DNA, 509 bp, Mus musculus
ggaactacagttgccttactgggctttctctgagggttcctgggattaaactcaggtcctcacatttgcctggcaagcgcttactgactgaggtattcctgtagccccttggctgcatttttaacagacttcctcatttccctttgaccctccttcatatcagtttctgcccacagaggggaaaatgtgaagccagggctgcacatctgagtgatttgccttctgtggcttagctgactgggggaggaggggcgtggggaacactaaattggattcctatgctcctgtttaaatcttgtttttcattgtgagttgtaccagcaaagctctgggagataatcatgaaaatgtgtagattggcagctaatttttgaaaaaatgaaaagaatcagagatgaaataggagcgctcagaagtttttatgttctcccaacctgttttgtcaaattgttacacaaacctagaaggtctctgactagatacaaagacgtcgcatattgctgctcttt

SEQ ID NO: 3311 - DNA, 463 bp, Mus musculus
  misc_feature (246)..(250): n is a, c, g, or t
ttttctattacctggccgctgaaagatgcgaggcagcgtcttgtgaggagggagctggtttggagaatgacacctgatttaaagccctggttttactctctgcaatgtcctctacttttcacatctataacgtggacttgagggctaggggtgtgactcagcagaaaagcatctgcctagcatgcatgaggcctcgggctccatcccaactacaggagtagagggggatttgctgcctgtcttgannnnngtagataggccagtctctgctgctggttcttggtgaaatgagctggacagtgtctcctagctatgtgggcctttcttggcctagagtcataaagttatggggtgtaatcttgggatgttaccatgactacagaggtgctagagctctagctcggttggtacagggcttacctggaaggtataaagccctgggtttgaacaccatcgtcacata

SEQ ID NO: 3312 - DNA, 385 bp, Mus musculus
ggaactgctccctgagtagagtgaggtcttgtgggaaggtatgaggagagaagatgcttaacccaagccactgtttgcttatttttgtttgggtttcactatgtagtccaagctagcctcctgcctcagtctccctagtgttggcattacagacatgtcctactatgcttgatggttatggaccaggtattgaaattgaggaaagatggagacaggtggaaggtagaacacctaatgggatcctgaacccctttacctgaaaatgtcctcatcatctttgggaggctaagtattttcctgtggaggtttcggatcttcttgacaagatcagaggaaatggcctctgggctcacaaaagtcttcagctcgtacctgcagacaagtt

SEQ ID NO: 3313 - DNA, 432 bp, Mus musculus
  misc_feature (48)..(48): n is a, c, g, or t
  misc_feature (189)..(189): n is a, c, g, or t
  misc_feature (213)..(213): n is a, c, g, or t
  misc_feature (233)..(233): n is a, c, g, or t
  misc_feature (262)..(262): n is a, c, g, or t
  misc_feature (286)..(286): n is a, c, g, or t
  misc_feature (335)..(335): n is a, c, g, or t
aatgataaagataccatcctggcataattggtaaattctcacttaggnaggggacattcattattctcaatggctgatgtatgggtctgttttattaaagtttgtcacttaggaggaaatgatatcagtgtaaaagatggacagcctccctgaatgggatgctgtgttggctaaacttgaaccaagctntgaagcatcaaagcattgaatttnttcttccttccaaccctccncccactgtgaaagctcacagattccactntttgcagcagcttactcccaactntcctccaccttaccgtttaggtcagtcacactccatcatcaaatccctntccttcaaaatgaaacctgaagtctagagagggggtagaaagaacattgttccaatcttcaaaaggcaggctgacatcattttcgattgttccaatc

SEQ ID NO: 3314 - DNA, 489 bp, Mus musculus
aactgagggcctccgctgaaggacacacaaggttctaactggagagatggctcaggagataagagcacttgcttctctggcacaggacctgggttaccagcacccaatggtctgaaactctagttacagggatctgacacttgcttctggcctctgtggacactgtaccctcatagtgcttatccatgcatgctgacaagacagtaacacacacataaaaataagtataagtaagtgacaacccccactaaggtacttgaggcatcagtagtcagccacaaaaatgtgacgtgtatggagaagggtgtttgggaagatttgggatcaggttcacttctgttcaagtttccttagctggacctctgttatgggctaagtataggggaatctgggaactgtggtctatctctgtgtctaggaagtcacattattatgctgtctaaggtacagatttcatatttcatggaaagctatccgtgtatttttatg

SEQ ID NO: 3315 - DNA, 522 bp, Mus musculus
  misc_feature (96)..(97): n is a, c, g, or t
  misc_feature (103)..(103): n is a, c, g, or t
tgcaaggctagcatgaccacaccatccagcccctagctccagcccctagtcccagcccctagctccagaccctagctcagacatttttgttttaannaaaagnttttggcatcctaggaagttgaggcaaggatgaagcatccgagctgagtgtcagtcctaggtgactgcaggttcttctggcagagactgggtattcatacagggttattgatgaactactaatgttcaagaatatgcaataagggctgaagagatggctccgcagttaagagcactggctgctctttcagagaaccccggttcaattcccagctcacatctgtctgtagctccagttccaggacttgtaatgcccccacagagacatacatgcagtcaaaacaccaatgagtataaaaataagtcatatatttaaaaactttaatgtggtggcctggtggcacatgcctcgagtctcagcactcagggcagacacaggcaaatctctttgagtttgaggtctgccttgtctattaatga

SEQ ID NO: 3316 - DNA, 402 bp, Mus musculus
  misc_feature (192)..(192): n is a, c, g, or t
  misc_feature (194)..(194): n is a, c, g, or t
  misc_feature (206)..(207): n is a, c, g, or t
  misc_feature (224)..(224): n is a, c, g, or t
  misc_feature (235)..(235): n is a, c, g, or t
tgtgtaggtgttctatatcccgccagtgggtgggcagcacgtgacgtggcgttgagaaggttatttccctcttttcctttctcatatgcatgggtgtgtgaagtacggtgccaggctctcagcagttgctaacctgagatttctgtgctgatccccagaggttgggtcttccagatccctctcaggctccancngcttgctttccnnctgttcctttctgtagnatagtctaccngcttagtgattcgagtacacatataatatatgacaccctgcatagtgatgaaagtacatatgtactacaccctccttagtgatgtaagtgcacacacacacacacacacacacagcaccctgcttagtggtaataagtacagacttgatttctgtcaggctctctaa

SEQ ID NO: 3317 - DNA, 513 bp, Mus musculus
  misc_feature (283)..(283): n is a, c, g, or t
  misc_feature (290)..(290): n is a, c, g, or t
  misc_feature (301)..(301): n is a, c, g, or t
  misc_feature (312)..(313): n is a, c, g, or t
  misc_feature (315)..(316): n is a, c, g, or t
  misc_feature (318)..(318): n is a, c, g, or t
  misc_feature (325)..(325): n is a, c, g, or t
  misc_feature (329)..(329): n is a, c, g, or t
  misc_feature (353)..(353): n is a, c, g, or t
  misc_feature (356)..(356): n is a, c, g, or t
  misc_feature (396)..(396): n is a, c, g, or t
tcaggaagtagaaaccctttccagttatatttaatatttaatagtattttatttactaacatttactgttttttcttcaatttctggaatttacatttgactttatttctagataaatttatgagaatgttcatttccctattcttttgttttacattgaaaaattaaatgcagttctatttttgtctctggggttattttgattgccttatttaaactcacaatgcctacaaaagtggctagcactggccctacttgggacattcgagaatttgagaaaatncctgaantttcaacctantgaatgagtgnncnngnatccatntccnctttagaccagaacctgtggcacnaantcttctcattcatgtttagacactgacctctagaaagganccagcaacatcccaagaaacacaggagggaatggacagcaccagtctttcctaactcagctgcagtcctgaaacttgtcagctaagagctgctcctcccaaaagtgttgatggcccc

SEQ ID NO: 3318 - DNA, 527 bp, Mus musculus
agctatgctgtgttgtatgttggttatgtgatcttaaagactagatggctaaaattgtatgtaaaatctttaaactgtcagtatccaggatacttcttggttttttagaaatatgaagcaaaattggctgtattttgaaaagttatttctgtgtctcctttaagggagattagtaatcctacacatgctctttggtggctccttctagggagctgtgactatatctattcctcctacatagagcactgacagagcggagacggtgccactcaagtccctcctggtgaactgatgagtttagcgggtcacctacaggagcatggccaacaggttcattaatgcaggtgcattaccaggaaggcagcatgggtaaccaatcaggaaagctgcaatctttttttttttttttttttttttgaaaattatagtatcacaacagaaaaatctaaattttatacattagcagagaatgtatttcttttagactacagtcaaatattcctggcccagacctcagttaagacaat

SEQ ID NO: 3319 - DNA, 489 bp, Mus musculus
  misc_feature (41)..(41): n is a, c, g, or t
ccctctgtcaaatggccttcaagtaaaaggactttcagttncatttactgcaattacagactgacaagcagagacttggaaatagcggatgaatttgtcatcctcagagggccctcgtggatgcaagcccctaagcaagaagctccaggagggcctcctgacagtttgcaggatttggctgtggcagtggcgggatttaggagccatctcacagtcttttctctagtggactgaattccagacccacagctttaccagggaaaccccttggctagctcactgctttgtttaagaaggccagagaaaatgtttctgacgttaaaagcagaaggtagattaaacaggaagtcagtcctctaagacatgctcaggagctgtttcagaatgaggaagtgaaagtctgtttgctgatccgtttgcaccgagggatacgcctttgggacgtagcttactttatatgaaaatacagtgacaggatctttcgctaag

SEQ ID NO: 3320 - DNA, 496 bp, Mus musculus
  misc_feature (266)..(266): n is a, c, g, or t
  misc_feature (275)..(275): n is a, c, g, or t
  misc_feature (277)..(277): n is a, c, g, or t
  misc_feature (281)..(281): n is a, c, g, or t
  misc_feature (285)..(285): n is a, c, g, or t
  misc_feature (294)..(294): n is a, c, g, or t
  misc_feature (303)..(303): n is a, c, g, or t
  misc_feature (309)..(309): n is a, c, g, or t
  misc_feature (311)..(311): n is a, c, g, or t
  misc_feature (316)..(322): n is a, c, g, or t
  misc_feature (342)..(342): n is a, c, g, or t
  misc_feature (347)..(347): n is a, c, g, or t
  misc_feature (365)..(365): n is a, c, g, or t
  misc_feature (370)..(370): n is a, c, g, or t
  misc_feature (424)..(424): n is a, c, g, or t
  misc_feature (439)..(439): n is a, c, g, or t
  misc_feature (445)..(445): n is a, c, g, or t
  misc_feature (470)..(470): n is a, c, g, or t
gtagcttgggctggccttttggtatggggatatccttggataaccttgattttagtctcactgttgcctaggctggccttgaactcctgagtttgagtgagcctccaggctcagcctcctaagtagctaagaccccaggcgtatgccaccttgcccagctaagaccccaggcgtatgccaccttgcccagctacctagagttggctgtttacttaattttttttcttttcctttttctttttctttttcttttttcttttgagacnaggtgtcangnagtncagnctagacttnatcctcatncctctntntcccnnnnnnnagaattagaggtctataccntcatnctgggatttattttcatntatgnttactgaaatgaattaagatgacgtaggttcaggttccgctcatactggctacnttccttgggtacacntttcantctcaagatagaggtggtggatctntgcggttggcccctggtctgcataga

SEQ ID NO: 3321 - DNA, 531 bp, Mus musculus
  misc_feature (188)..(188): n is a, c, g, or t
  misc_feature (204)..(204): n is a, c, g, or t
  misc_feature (224)..(224): n is a, c, g, or t
  misc_feature (231)..(231): n is a, c, g, or t
  misc_feature (234)..(234): n is a, c, g, or t
  misc_feature (249)..(249): n is a, c, g, or t
  misc_feature (253)..(253): n is a, c, g, or t
  misc_feature (276)..(276): n is a, c, g, or t
ataaggactgtgcactcgactcatttagggggctgattgttcccaagttctctgaaacctaaaatactctctcacaccaggctgggggtgtagttcaatgctagagggaggacttccctaacactaacaatgccctaggataaatccccagcgctataacacccaccctccaccctcacgctcacacncccaccagcaaactcncaagcaaatgaccgaagcgncaacgtnatntgagaacgtttcggntatnccaagagctgagcccctttcttntgcaggagaagcaagacacccaggacacgctgaccctcagcctctgttcgccaggggtcaccgagcctgctgtctgtcctgacctccccagccagagctatttttcagtttcttgtgggctaaggcccggatctgtctgtttactatcttagcctggtgtttttgtactcaaaagtttcgtaacgcctgcgagtatgttcttcttcactggctaaattctgagatatgaaaaatggtctttcacctacaatttag

SEQ ID NO: 3322 - DNA, 525 bp, Mus musculus
  misc_feature (316)..(316): n is a, c, g, or t
  misc_feature (335)..(335): n is a, c, g, or t
  misc_feature (341)..(341): n is a, c, g, or t
  misc_feature (412)..(412): n is a, c, g, or t
  misc_feature (426)..(426): n is a, c, g, or t
  misc_feature (430)..(430): n is a, c, g, or t
  misc_feature (447)..(447): n is a, c, g, or t
  misc_feature (456)..(456): n is a, c, g, or t
  misc_feature (458)..(458): n is a, c, g, or t
  misc_feature (500)..(500): n is a, c, g, or t
ttgataacccgacaaatggccccaaatggacatgttcacatagtaaattaacttgcagtgatggataggaggtggttcaaaggttacttttcatggggcttgaaggctaccctggcaatctccgtatgccatcaggtctccctatcagattagaagcttctctaaggaggctcagactttaccaggtacagaacaagcatccatgactgtctactgaccgacctggataaaagcactgacacttgactggagctggctgggttcacagaccccctgcactgctctctatagaagcgggcaagtcattgaccttttntcgttctactattcatganatgagnatagtagcacttacccttgggctgggcgataaaagattcataaggcaaattagagcacacttagcataatncccaccacatggtntatnccatgtaatggctttanctgcccttntnatcttactagcatttcagttggtgtgaaatggcagggttcantcattcgctgcatggtgatcactaa

SEQ ID NO: 3323 - DNA, 440 bp, Mus musculus
aatctaggcatatccaaccttttgacatcatgacatacatggtcatctacgatgtccacattcaagaaccccggcatggagggcactaaaaaagaaaaccaccagttcgtaaagtgtcacggctatcctgaggtgtctctggtagcggtaagggctgcctggtatggcagaagggtgaggtgactgttaccattcttgcttttctctgacacagacactagtgtgtattggtcttaaggattaaggaagttaacgtgggctttaagtaaagtagtacttggagacagagttgacacgctgcctactatggactagaaaagcaagtgtacaactaactttttaaaaatatgtctggctctaagagtgccacatagaataaacaagcagactttgtccatgcatgcctacatacacattaccctcacagacacttcacagat

SEQ ID NO: 3324 - DNA, 532 bp, Mus musculus
  misc_feature (263)..(264): n is a, c, g, or t
  misc_feature (266)..(266): n is a, c, g, or t
  misc_feature (269)..(269): n is a, c, g, or t
  misc_feature (271)..(271): n is a, c, g, or t
  misc_feature (275)..(275): n is a, c, g, or t
  misc_feature (278)..(284): n is a, c, g, or t
  misc_feature (287)..(292): n is a, c, g, or t
  misc_feature (295)..(295): n is a, c, g, or t
  misc_feature (300)..(300): n is a, c, g, or t
  misc_feature (302)..(302): n is a, c, g, or t
  misc_feature (304)..(306): n is a, c, g, or t
  misc_feature (310)..(310): n is a, c, g, or t
  misc_feature (314)..(314): n is a, c, g, or t
  misc_feature (319)..(320): n is a, c, g, or t
  misc_feature (339)..(339): n is a, c, g, or t
  misc_feature (341)..(341): n is a, c, g, or t
  misc_feature (344)..(344): n is a, c, g, or t
  misc_feature (418)..(418): n is a, c, g, or t
  misc_feature (471)..(471): n is a, c, g, or t
agctgactattgtctgagcactcatttctcaaaaaaatgcaggaacccatgactaaattatacatagataattatactagagtttatactggttgaagagaaagccatattttgtcagaaagtgctatcctgggtcctcaagtcccatcagtggtagccagcaaagttgttcaaccctcggtacctctggttcattctgtcctggacatctctgtatatactggggattataagaaatcatgatgttttaattgctgggctanntncantnattnttnnnnnnnccnnnnnnaangatcnanannngctnaaanactannaagagatatggataatttnanatntgatattctaggttataatgctctatttcataatctcacaactaagtataagttaataagtttatagatactanatctaagtcaactgtatagtattcttctgaataggtctatatggaactgtgantcctcagcttcatatgttgaaatcttactctttagtccctagtgcctccaaatggctggaa

SEQ ID NO: 3325 - DNA, 458 bp, Mus musculus
  misc_feature (344)..(344): n is a, c, g, or t
gatatatggtggtctcatagagcccaggctgtactcatcatgtagccaaggatgaccttaaaccaatccttctgcctctacctgtcagaccaggtgtacattcttatgccggcttcaaagtagcatttttatgtaatgtagtttttatttttttagaaatcttagtgagggattgattttactctgttctcctaaaggaagtatttggttttcttcctgtcttcttgctcttctagggcagtcagtcagacctgatgccatttgttgttccacagacattccctcatttagaggggtgtggtcctgaagggctacagtactgtcacttttctgccttaagtgtnttcataacccttactttgaattttatttgtttaagtgtggctgtatgatggctttatcagatgtcagagctggtttgctgattgtatttggagccacaatcctctgttgagtac

SEQ ID NO: 3326 - DNA, 513 bp, Mus musculus
  misc_feature (163)..(163): n is a, c, g, or t
  misc_feature (225)..(225): n is a, c, g, or t
  misc_feature (235)..(235): n is a, c, g, or t
  misc_feature (237)..(237): n is a, c, g, or t
  misc_feature (239)..(239): n is a, c, g, or t
  misc_feature (243)..(243): n is a, c, g, or t
gggcaacttgcactggaggattaattttcatatatataatctctctattttaaagaatcaaactctggtctcactgccttatcttacacctgtctatatcccaaagatgacttagtttctttggtatatcatggatatggatgtctttggttcagagtaaganactgtgtgtgtgtgtgtgtgtgtgtgtatgtgtgtgtgtgtgtgtgtgtgtgtgtgtgtgtnagagagaganananaganagagagagagagagaatctttataggaacattgtaatgcctcgggacattagtaacccctcacagtatttagtcaccgtatttatgtctttttttttccctacccttggtatgaggggaaatgattgatattcaagcaagttctctagggggagacaacaaccatagccagattctttccagctcagatatctgtgtcagctcagaatgtatctttttcatgctttgctctgtggatttataactgtttagactcttccatacattttag

SEQ ID NO: 3327 - DNA, 480 bp, Mus musculus
acatgatttatctaacccttgaggaaagagctcaatggaaccctatgtctaaaagaaacttagaactgtttttgtgttgtttgtttgaaagcatctcccttagtccaggctagtctttaaccccatatgtatccaagggtgaccttgaactcctgacatctggcctccatcttcagaaacttggagctttaagcagaggacttagattttgttagctacttatagctgtgcccttggacaaatctttgaaataaactggtcaatttctagtatggtgaaagtggggatgtagttcagctgggagcgtgctgcctatcatgtgcaaagtccttgatctccagaactgcataaaactaggcaacctgattccttaagaggcaacgcaggatgatcataaattatggtcattttctgctacacaggaagttcaagatcagcctgaaccttatctgcctgcctctatctctcagttgtcattaa

SEQ ID NO: 3328 - DNA, 504 bp, Mus musculus
gctggagcccatttgaatagttcttaatatcagcactatcagcttagttctttagcttttgttgttggggtcagttttatcattgttacctgctggcatttggctgtagattggcctcagagtccatttgggaggtgtgatattttaaaggcacatgaactgtcgtaagaacacagcacaataaaggagtggctttagaaatgtaatgatatgcctgtggagtgggatatggtagagtaacatgtaatttggacccagtcaggaccttagccaataggaactgtgagtaactatgggtggcttgcttcagctgtaggcttatttcattgtagcatcacgaagaataaataaggaaacctgtaagatcctaagcatgtgctttacacaatgaagggacaagggcatgcacattgctcggagtgggagatctagcaatagagtccatgatgcatcagtctcccaccacgtctggtcctttagtctgcctagtacctacttgtaagt

SEQ ID NO: 3329 - DNA, 495 bp, Mus musculus
  misc_feature (54)..(54): n is a, c, g, or t
  misc_feature (78)..(78): n is a, c, g, or t
  misc_feature (101)..(102): n is a, c, g, or t
agagaccacatcctgtaacctgggactgaagtagttgttagctaccatgtgagngctgggattcaaacccaggtgttntagaagagcaaccattgctcttnncttccgaaccatctctccagcccctacataataatatttttgacatctgtcttccatggtttagaaggagtcaggctgtctctgtaactgagccacaactagcaatgtaaaccttgttccagagcatagacaataaggcctttcagacagctatgccaagacatcctctgtggtggcatcagccaggacttccactcttggtgcctgattcccaccccgctgcctctgcagcagtttatatcccggtgtcttcttagctgcacatatgacacctgtgccctacaatgcccaaaggaaaaataactaaaatttgctcctgtcacccaaaggtttgcttcctagcctttggtgtattttttatcttccttttatctctgctcgtttgcccagaaa

SEQ ID NO: 3330 - DNA, 527 bp, Mus musculus
  misc_feature (33)..(37): n is a, c, g, or t
  misc_feature (41)..(41): n is a, c, g, or t
  misc_feature (46)..(47): n is a, c, g, or t
  misc_feature (53)..(53): n is a, c, g, or t
  misc_feature (61)..(61): n is a, c, g, or t
  misc_feature (75)..(75): n is a, c, g, or t
  misc_feature (89)..(89): n is a, c, g, or t
  misc_feature (95)..(95): n is a, c, g, or t
  misc_feature (114)..(114): n is a, c, g, or t
  misc_feature (123)..(123): n is a, c, g, or t
  misc_feature (150)..(150): n is a, c, g, or t
  misc_feature (153)..(153): n is a, c, g, or t
  misc_feature (162)..(162): n is a, c, g, or t
  misc_feature (192)..(192): n is a, c, g, or t
  misc_feature (195)..(196): n is a, c, g, or t
  misc_feature (212)..(212): n is a, c, g, or t
  misc_feature (214)..(214): n is a, c, g, or t
  misc_feature (220)..(220): n is a, c, g, or t
  misc_feature (224)..(224): n is a, c, g, or t
  misc_feature (226)..(226): n is a, c, g, or t
  misc_feature (249)..(249): n is a, c, g, or t
  misc_feature (256)..(256): n is a, c, g, or t
  misc_feature (281)..(281): n is a, c, g, or t
  misc_feature (285)..(285): n is a, c, g, or t
  misc_feature (297)..(297): n is a, c, g, or t
cataaaggtttgttctccagatggtattgagcnnnnnaatncaaannttttancttttcangtttactattgtancccatagactagcngcactnattcattagcttcaatagnctttagagntttctagtcacataactatgtcatctnaantggaggttnactttaactttttttaaaaaatcttgtctnacnncagtgtctcataatangntacagnagancnggaagcaggttatttttgttaanttctaangaatccttcagcttgttattacagnatgntatgggctgtgnggtggccatagatactctttggacacccctcatccccaagatggcttctttgtgaagtccgagctgtcttggaactcactctgacctcaaactcagagatccacctgcctctgcctccctagtgctggaattaaaggcgtgcgccaccactgcccggccatagatgcgccttttgagggtgaagatctttctctttatttttagctctagttttctgaggttcttccttc

SEQ ID NO: 3331 - DNA, 504 bp, Mus musculus
  misc_feature (464)..(464): n is a, c, g, or t
taggactttccttgaggagcccaaggctgaagatgtgtcacatactctcttgaaattgtccatctcaaaccaggtagtggaagagaacatgataaactgagtcttatatacactgagcctcgcacaaactctcagggttaccccaaaggagctgtttattctttccatgcctcctctgtgagttggggtctttcttgaggaagttagtggagtggaagagctgtaaattacaaagtgtactttacaaaggcattaagtattgataaaaagaacaaaaggcatgagtatctgtcactgaaggtgacaatagaaaagaattcaacatcacccacccctgtctaatctcctccctgacgggcagtgtatattcttctgccaaacattttttttttaaatagaaccaatgtaggaaaatcaggcaaaataaaatgatgatcagtccatgtcatcatggttagagcaangacctacagttggcctctacaaggccaacaggctcattca

SEQ ID NO: 3332 - DNA, 470 bp, Mus musculus
  misc_feature (39)..(39): n is a, c, g, or t
atcagacttctaactcatgtttcagttttcgaattctgnccagctaagcactaaattgctagtacgcactgcctggggagaagctcacgcaagggattcaaatttgtcttggctgctttgaagttttggatagaaaagctgcagtcagaggctagggagatggctcagtcagaaaagggcttgccatggaagcatggggctctaagttagatctccacacacacacaaagctgagcacagcaatgtgtgcctccagctggggtggaggggagagaggaggacctcacaggaatgctggccagtcagtctagctctaggctcaatgaaagtcactgtctcaaaaaataaggtggagagcattgaggaagacacttcatatcaatttctattcttgtgcacatatgcccacatatgaacacacaccatacatgtgaggtctcctcacatttgacaccctttgatccactgaa

SEQ ID NO: 3333 - DNA, 510 bp, Mus musculus
catggtgccatagaggtcagtgccttgacactgagaccatttatcagaatgactgtattatctaatgcttcctgtgcctggttcacccagtcagtattgagtgtctttgtttcgcactgtgtaaaattctggaggcacagtagacaaacgtgtaacttctcaagcaattctttcagttcaagaaagaaaggaagcttgcccctagtctccgcctttgaggaagtagtctagggcagaagtcagttctgggtatgtgctgaggaagttaggaaggtggattgctggaaaggtgggctgctgggaagagattgacattaaacttctctggcctcagttttctgtcaaagggatttggtactgtcagtatagccttagagaagcgggaaggaagggttggtgcctgccttgggctgaattgcctgaatgggctatgctacctgcgtttacatccatgcctggcacacagctgtagatgtagtgaggaagacaactctggtgtagctgagacat

SEQ ID NO: 3334 - DNA, 386 bp, Mus musculus
aatattggcttctagtgctgtcagagccactgactgtgtggctttgtgtacgtctctctgactcctgttgtaaggagcaaacatgatgactgacaggagtgcatcctgtgttaaagtcaatgtggccgtgacttactctcatggttaaaagcatcaacctttataaaagagcactgatcacggacccagaactgtattcctaggcatttcctccttacctgccctcattttaaaaatgtttccagatgattagattgctggtctgtctatgggacagaagattcagactggcgcttgtttccagtgaatcccattgcggactgtgatatcagatcagataagtctgaccagtcgggtggtgagaacctggaaccttggctactcaa

SEQ ID NO: 3335 - DNA, 480 bp, Mus musculus
  misc_feature (305)..(305): n is a, c, g, or t
  misc_feature (308)..(311): n is a, c, g, or t
  misc_feature (313)..(313): n is a, c, g, or t
  misc_feature (315)..(315): n is a, c, g, or t
  misc_feature (317)..(318): n is a, c, g, or t
  misc_feature (322)..(322): n is a, c, g, or t
  misc_feature (341)..(341): n is a, c, g, or t
  misc_feature (348)..(348): n is a, c, g, or t
  misc_feature (360)..(360): n is a, c, g, or t
  misc_feature (376)..(376): n is a, c, g, or t
  misc_feature (434)..(434): n is a, c, g, or t
gtcttcctcaaatgacttcttcatggactaaaagaaatggcatcccctcctttgttagaaaccaaaaaacacatagcaatccaaaatgttctgaatataaaatattatatgaaaaataagggtctgaggtgaaatttaaactacctgttaatatataataaaggtgacaatctacataagacttaggactttgaaaactgtgtttttctaaattaagtcataaatttgaaaatttgatataaccatcatgcaagtgttgctatgaatcactctcttgatagatagatatgacaaatccctgctantcnnnntntntnntttntttaacatgcacagagatntaagtgncccctagtattntttatatgttaataantatagcaaataaatcctttcttcttccaaaagaagaagggaaaatgtactattcctantgaggcataggtttaaagtaacaatttcactgacctttgctttcaa

SEQ ID NO: 3336 - DNA, 416 bp, Mus musculus
  misc_feature (76)..(76): n is a, c, g, or t
gggcaaagcgcaacatttggtcaaatcagttacctgtaacaaaatgtcaaaagtactttggggctgcttgaactcntgcggcctgtgacagtcacttggtacagtgaatggtggttaaaataatcagtgtaacacacccaggttcaggaccattttgtgatggctcccatgccaggtgtatagacaagaattcatagaaattcaccctgacatgggctgttttctggacagaagcagatgcataatttgcaatgaccagtgcaaaaataaaatgcagttctcctttcttaaaaaaaaaattagtaggtctttcatgatgacaaggcaggagattaaagcaactgttttgttgttgtacaaggactcagctatgtaactcagcttgggctggaattcctcttgctttagttttctga

SEQ ID NO: 3337 - DNA, 536 bp, Mus musculus
  misc_feature (144)..(144): n is a, c, g, or t
  misc_feature (161)..(161): n is a, c, g, or t
  misc_feature (182)..(185): n is a, c, g, or t
  misc_feature (187)..(193): n is a, c, g, or t
  misc_feature (195)..(196): n is a, c, g, or t
  misc_feature (207)..(207): n is a, c, g, or t
  misc_feature (222)..(222): n is a, c, g, or t
  misc_feature (255)..(255): n is a, c, g, or t
  misc_feature (270)..(270): n is a, c, g, or t
gtgagtctaccttaagctgtgctaaaaggcttggaggaatgaatagtacttctttaaaataacattataatatacttttccttcccataatcccagtccttagaagctaccatgaggttctgatggttttgtctacctttctangtcctgactcaaaatantgtgacttgctggtcgtggtnnnnannnnnnntnnatctcagccantgggaggcaaaggtnggtggatctcaaagaatttgaggccagcctggnccatttggtgagttncaggtcgtccagagctacatagaccttgtctcaaataaacttttccattttcttcttttctgtgttcctttggaagctggtcagagcctaacaatgcttttgcttgtatcatgggcttccttggtctttctgtaacatccaacccaatgtcatgtggctgcttgtcctaactgaactgtatactggcttaactcaaataacatggcttcctttggcccttctttgttctcctttggacagctgccaaggttcacagcatgtttgct

SEQ ID NO: 3338 - DNA, 357 bp, Mus musculus
aaactggtattccatttacagctaaaatttccagacttgccactttaatttaaaaacatacttttcccagttcagaatttcaaactttgccgaaccgattaatttaaatgcatgaaggtacagcaaatataacccagtattttggtaactctggttacctctaagacagctttgcctggtagagatcttctgtgaaaccacaggtattgggccaggactacagcacagggccaaacatacattccatactggacatgcaggacctgcaaagaaagttcatcattaacatacattattaccatgacactcctggcctgctctagttcacacctggcaggttctgaaaccagtcctttt

SEQ ID NO: 3339 - DNA, 466 bp, Mus musculus
  misc_feature (228)..(228): n is a, c, g, or t
  misc_feature (238)..(238): n is a, c, g, or t
  misc_feature (254)..(254): n is a, c, g, or t
  misc_feature (258)..(258): n is a, c, g, or t
  misc_feature (261)..(261): n is a, c, g, or t
  misc_feature (276)..(276): n is a, c, g, or t
  misc_feature (291)..(291): n is a, c, g, or t
  misc_feature (358)..(358): n is a, c, g, or t
  misc_feature (430)..(430): n is a, c, g, or t
gcatttcctggagttagtcatatatatatcataaaaactcagaaacaactaaaatataatcagatatagtttgtggtgagttgtttgttgctttggtgattggtgtcaaactcagggtctcatgcatactaagcaagaagtttaccattaaggcacaggccagcacccagtcacccataatttttacaccctagacagcaattatgttttggtggggcttttacattnattgacattnatttacatttgtgttnttanatntcctttactctctcnccagctctgaacatnttttaattgaaaagtttatactaattcctgttattttattgttcgttgttgtttattcacggatacnccatggtttattctttactgtgccctcataaatgtatatatttctctttagtacatagtattgcttcatgtntcctctgtaatgttggcgattacaaacaggagctgt

SEQ ID NO: 3340 - DNA, 553 bp, Mus musculus
  misc_feature (250)..(250): n is a, c, g, or t
  misc_feature (262)..(262): n is a, c, g, or t
  misc_feature (275)..(275): n is a, c, g, or t
  misc_feature (282)..(282): n is a, c, g, or t
  misc_feature (295)..(295): n is a, c, g, or t
  misc_feature (300)..(300): n is a, c, g, or t
  misc_feature (312)..(312): n is a, c, g, or t
  misc_feature (328)..(328): n is a, c, g, or t
  misc_feature (339)..(339): n is a, c, g, or t
  misc_feature (341)..(341): n is a, c, g, or t
  misc_feature (344)..(344): n is a, c, g, or t
  misc_feature (350)..(350): n is a, c, g, or t
  misc_feature (355)..(355): n is a, c, g, or t
  misc_feature (388)..(388): n is a, c, g, or t
  misc_feature (432)..(432): n is a, c, g, or t
  misc_feature (450)..(450): n is a, c, g, or t
  misc_feature (489)..(489): n is a, c, g, or t
tctggtgtgtccttgcggctggtcagatgctattctaatttttttttgagaaatctccaaactgatttcacaatgactgtaaaatttacaacccctaccaacagtgcagaaaggttcctatctagccatacaatcttcaacatttgttgtcagatttcttgatgatagctattttgactgaagtaaaatgttctcacaaagcagatttaatctgcatttccctgatgcctaaggattcttagcacttttnaaaacaggtatnggccatttgaggnttttttnaaaactgaaatcngtccnatctatttgctnatttattcagtagcanttttatttccntngtntttaanttctncaactctttgtaaattctgggtatgagttcttnccctgaaatgtgtctgataaagatttctcccattctgtgggctntcctgtttgtttcctttntcttacagaaaacagaataaaactaaacaaaaagccccnaacacaacaaacaaacataatcttgaacactaaaagaactgctagaggtctcatcattcccaat

SEQ ID NO: 3341 - DNA, 540 bp, Mus musculus
  misc_feature (276)..(276): n is a, c, g, or t
  misc_feature (302)..(302): n is a, c, g, or t
  misc_feature (342)..(342): n is a, c, g, or t
  misc_feature (506)..(506): n is a, c, g, or t
ggcgcttctttggaaaagatcctgtgcagagcaaatgaggagagaagggaccctcagcctgaataaggcagtggagtttggaggtggaaccaacttgaaggggattccaaaggcttctcaagactgtctgtctgtctgtctgtctgtctgtctgtctgtctctcagaagactgggtcttgggaagcccagtactggctttctatccaagaagcttatgttttcattccaggtctagattagatggaaagtcccactggaactccaggcttctgaantctcctttctagattcagtaaatgtntattgcttgtctaagatgtggcagacattatgagtttaangggggatcttaatgattatattattgcttccaaacatatgtagttcttgaaaccactagttaaacattggtaatctgcttttcaaatatgtaaaacagactagtactccgactgactttcttacggtgcacattcccagtggtaggacatgatgttatctgaantcaggtggtgacaccaatagactcaacagcttcc

SEQ ID NO: 3342 - DNA, 544 bp, Mus musculus
  misc_feature (28)..(29): n is a, c, g, or t
  misc_feature (33)..(33): n is a, c, g, or t
  misc_feature (35)..(39): n is a, c, g, or t
  misc_feature (42)..(43): n is a, c, g, or t
  misc_feature (45)..(46): n is a, c, g, or t
  misc_feature (50)..(59): n is a, c, g, or t
  misc_feature (61)..(62): n is a, c, g, or t
  misc_feature (64)..(64): n is a, c, g, or t
  misc_feature (68)..(68): n is a, c, g, or t
  misc_feature (70)..(70): n is a, c, g, or t
  misc_feature (74)..(74): n is a, c, g, or t
  misc_feature (81)..(82): n is a, c, g, or t
  misc_feature (84)..(84): n is a, c, g, or t
  misc_feature (86)..(86): n is a, c, g, or t
  misc_feature (91)..(91): n is a, c, g, or t
  misc_feature (97)..(98): n is a, c, g, or t
  misc_feature (104)..(104): n is a, c, g, or t
  misc_feature (106)..(107): n is a, c, g, or t
  misc_feature (112)..(112): n is a, c, g, or t
  misc_feature (121)..(122): n is a, c, g, or t
  misc_feature (127)..(127): n is a, c, g, or t
  misc_feature (134)..(134): n is a, c, g, or t
  misc_feature (143)..(143): n is a, c, g, or t
  misc_feature (145)..(145): n is a, c, g, or t
  misc_feature (149)..(149): n is a, c, g, or t
  misc_feature (151)..(151): n is a, c, g, or t
  misc_feature (153)..(153): n is a, c, g, or t
  misc_feature (175)..(175): n is a, c, g, or t
  misc_feature (181)..(181): n is a, c, g, or t
  misc_feature (192)..(192): n is a, c, g, or t
  misc_feature (219)..(219): n is a, c, g, or t
  misc_feature (367)..(367): n is a, c, g, or t
tagtccgggtggagatccgcctttttcnncccntnnnnnttnnanngcannnnnnnnnnanncnaaangnggtnaatgatnngngngattnaatgcnnctttananncctgntttaatatnnctgtnaaaatcnaagatcacngnaggnancnccatgtggagtgatagaatcantgtacnggaaaatcacnctggtttcctgggactcctcctgcccnctggcaattacagtgtattgctctccttcatcagcagctaatgtatgtatgaaaaagtgaagaaagggctgcatttagcacaggaaacagcaggccgtggttctcagagttgcagttgtatggtttatgcttattactgtctagcccnttttttaaaaaatgactggaaatctaatctactagagagaaaaagtcactaactcattattttttgtgtccatttttctgctcatcaatatattactgtgcacagtttgatagaacagatgtacatagtgactgaactgtcaacatcacaaagaatccacaaagtacatctcctgaa

SEQ ID NO: 3343 - DNA, 511 bp, Mus musculus
  misc_feature (151)..(151): n is a, c, g, or t
  misc_feature (194)..(194): n is a, c, g, or t
  misc_feature (444)..(445): n is a, c, g, or t
gtatacagacacatctatgcatgcaaaatcaactgatgaaaaaagaggctatgagtttaaaaaagtgtgtggggaggggtaactaggaaggtttagaaggaggaaaggccaaggagaaacattgtaacgagaatacaagctcaaaactaanccccaacaaaaagagtaaaaagcatgcttgcttacaaccccanaagccaccagtcatcgctccaggcctctggctccctggctccttggctccctgcaggtggcacagtgcccctagacacccacctggcccaaggctagctcctatcagagttatagtcagcgagcacctcttagtgacttccactgtcaccatctcctaaccacattcctcttttgctccactcaatgctactagccagggtgagtgtagtttgttggtttgtattgcctatattcttcaagaaaaaaaanncgttcctgagggcaggaactctcgtgttacttcactgctataatccttgggtctggaaaagcactc

SEQ ID NO: 3344 - DNA, 284 bp, Mus musculus
gacagtgacagtgtctcaccatatacgtaaataaatcttttctaaaaaatatcgtgtgttttatacattaaaaaaacaaacaggacagtctttcaaacaggttgcttcaataaattacccagggatctctcttcaaaaggtttccttagggtttaaggtttatcttggaacttgttaaaatttggaaagagtcatctggctttcagagggtagacgggtgggtctgctgcatccagacatggcctgtgatgcttccattggattctgcttcagagaatgctcag

SEQ ID NO: 3345 - DNA, 436 bp, Mus musculus
ataagtcaatttcctcctggtgagacaccagattttataaatttatttttagttttcatttgctctgttacaacaacctgactttattaggaggtagaacctggttggttgaagtaggacactgaggatgtatctggacccatgtccctgcccctcctattttctgattactgtccgtcacaagtgggtgccttaccttatcacatagtcttacagccctgaagttttgactcaccacaggctcttcctctaactgagctgaaaactcacaccagtaccctggagatggacttggggttactggaacctctgtctggtcctcctcccagtgcacattgatgaactcacccattttttgattttcaccattgcctctctctttaatcagtgtactggggatgagtggccaagcagaacctgagatttttgccctaaa

SEQ ID NO: 3346 - DNA, 475 bp, Mus musculus
  misc_feature (145)..(145): n is a, c, g, or t
  misc_feature (281)..(281): n is a, c, g, or t
  misc_feature (286)..(286): n is a, c, g, or t
  misc_feature (288)..(289): n is a, c, g, or t
  misc_feature (294)..(294): n is a, c, g, or t
  misc_feature (299)..(299): n is a, c, g, or t
  misc_feature (305)..(305): n is a, c, g, or t
  misc_feature (311)..(312): n is a, c, g, or t
  misc_feature (318)..(318): n is a, c, g, or t
  misc_feature (321)..(321): n is a, c, g, or t
  misc_feature (325)..(325): n is a, c, g, or t
  misc_feature (329)..(329): n is a, c, g, or t
  misc_feature (341)..(341): n is a, c, g, or t
  misc_feature (347)..(347): n is a, c, g, or t
  misc_feature (350)..(350): n is a, c, g, or t
  misc_feature (361)..(361): n is a, c, g, or t
  misc_feature (375)..(375): n is a, c, g, or t
  misc_feature (405)..(405): n is a, c, g, or t
caagtcagtcagttacctgtgtttagtgatgaggccaggatagctccctcagcatggaaaggctacagtgagttttctttggtccatgttaattacaaaggcgtagttaaatcgggttcccaataaagacactcttcagacctcncgacctctcacagttcggatggatatgtttgccgcttcctagaaccccccaggaagcagtctgaaaaaaagactagtaaggagagagaggagcaatgtccttatagggtttaatgtgtggccagcacagtacaggncccangnnctttntcctntgtttngttttnntttttnttntttntttntttttttttttnagcttnttngctggggaccnagggaattggtttnggagttggggggagggggggttccctcagncctttggcaaattctttagtattcccaatttcttatttttctacagaaatttccactcaaaactgcaagc

SEQ ID NO: 3347 - DNA, 527 bp, Mus musculus
  misc_feature (116)..(116): n is a, c, g, or t
  misc_feature (119)..(128): n is a, c, g, or t
  misc_feature (131)..(131): n is a, c, g, or t
  misc_feature (133)..(139): n is a, c, g, or t
  misc_feature (141)..(141): n is a, c, g, or t
  misc_feature (143)..(143): n is a, c, g, or t
  misc_feature (145)..(145): n is a, c, g, or t
  misc_feature (147)..(148): n is a, c, g, or t
  misc_feature (150)..(151): n is a, c, g, or t
  misc_feature (154)..(156): n is a, c, g, or t
  misc_feature (158)..(161): n is a, c, g, or t
atccccatgggaactctgagttacctacgtccccgtcttagcccctgtcctaagatccagctctcatgctcctgcattctgagagcacacgggatgcgcttgtcaacattcatggnggnnnnnnnnnncantnnnnnnngngngncnntnnttnnncnnnngtattgtcaacgttcacccatgttgtcgctgctgtcagacgctcctcctttttgagggtggaacctgattccattgtgtgcacatgccatattgtgctggcccatttctctgtcactggatctccagctgccgtgaatcatgcggtaatgggaaggagtgtgcggatatcctactttcaaatctttgtgttgacgttttgagacagtgcctcgctcgctcaataatagcccagcctggcctcaatcctcctgcctcttcctcccagaactgagggattacaggtgtgtaccgccgtggctgactctactttcgaatgttttgggtatacatgtcccaaagtggaattcctgtatcacacaatccat

SEQ ID NO: 3348 - DNA, 468 bp, Mus musculus
acatgcttgtgctgcagttctggtaggcttgctcacatgggccaggcaaccctggtactgaagctgagcagaagaaaggacagtgtcctcaagtactccggccacagttgtgcatgctccttaggcctttgtgcctgcactagtctcaggcctccaaactgggaatgcattcactggctacaatagagacagcttccaaggctgtatcagccacacagcactgactctgctcaagcatgcagtcagtcagttggggctgttgtagcagaatattgagatcaggggcttttaaagaatgcaaatgtattcctcacagcctggaagcccagagttaccagtcaagttctagtattgtgaagccctcctgctgaatcttcactggacaaatgttactttggtgcaccacctttgtattctaagcacttaaaactccctcctggttctgctacttggaaccctgcatcttag

SEQ ID NO: 3349 - DNA, 331 bp, Mus musculus
  misc_feature (36)..(37): n is a, c, g, or t
  misc_feature (129)..(129): n is a, c, g, or t
  misc_feature (133)..(133): n is a, c, g, or t
  misc_feature (135)..(135): n is a, c, g, or t
  misc_feature (148)..(148): n is a, c, g, or t
  misc_feature (166)..(166): n is a, c, g, or t
  misc_feature (168)..(168): n is a, c, g, or t
  misc_feature (181)..(181): n is a, c, g, or t
  misc_feature (195)..(195): n is a, c, g, or t
  misc_feature (198)..(198): n is a, c, g, or t
tctctctagggaatctcatttgttacaggtgagaannacagagggttttatggtgcctgagttagtcctgtgcctaaccagtggagtttccgtctctgtgcttgctaatagtttcacaagtggcttgantttntnagaagtattatgnggtattttactgtgtatnanttctgtggtaaanatgtgaagtccttnggncttagtcatacttcataacttttgaacgttgggttttttgttggaagaaacttggatgaatctgtcatgtcattaacagaactgaaatattctattgtaagacgtgcatttgcggttagaatggtcttgttgc

SEQ ID NO: 3350 - DNA, 486 bp, Mus musculus
  misc_feature (164)..(164): n is a, c, g, or t
  misc_feature (167)..(167): n is a, c, g, or t
  misc_feature (176)..(176): n is a, c, g, or t
  misc_feature (256)..(256): n is a, c, g, or t
  misc_feature (264)..(264): n is a, c, g, or t
  misc_feature (268)..(269): n is a, c, g, or t
tgagtggtaggaccccacacctggttgtgtactcagtttttttcttctgtcaaatggggggtagggactggggatgtagctcaaaggtagagttctgccttagcatacccaaagccctggggtttgtctctagcaatatttcatagagaggatgaagccaggtntgntggctaacncaaacctttaatttcagtacctgggaactctgtgagtttcaggctagtcaggactatatagtgagaccctgtccaaaacnaacaaacnaacnnaagcactattcctaacataggtgagttttagatacctacagatatgtctctgtttcctgtcctttgggatattacacaggattgaaccaggtaagctgctataggaggttaggcaaaatgcaggaccaataggcaggaaactaagtgtgccaccaatatctctatctggcccaagctgctactctttctggactccagtttcttcacctctaaaata

SEQ ID NO: 3351 - DNA, 416 bp, Mus musculus
  misc_feature (130)..(130): n is a, c, g, or t
  misc_feature (138)..(138): n is a, c, g, or t
  misc_feature (141)..(141): n is a, c, g, or t
  misc_feature (151)..(151): n is a, c, g, or t
  misc_feature (162)..(162): n is a, c, g, or t
  misc_feature (167)..(167): n is a, c, g, or t
  misc_feature (175)..(175): n is a, c, g, or t
  misc_feature (184)..(184): n is a, c, g, or t
  misc_feature (208)..(209): n is a, c, g, or t
  misc_feature (212)..(212): n is a, c, g, or t
  misc_feature (227)..(227): n is a, c, g, or t
  misc_feature (244)..(244): n is a, c, g, or t
  misc_feature (252)..(252): n is a, c, g, or t
  misc_feature (259)..(259): n is a, c, g, or t
  misc_feature (261)..(261): n is a, c, g, or t
  misc_feature (270)..(270): n is a, c, g, or t
  misc_feature (296)..(296): n is a, c, g, or t
  misc_feature (324)..(324): n is a, c, g, or t
  misc_feature (338)..(338): n is a, c, g, or t
  misc_feature (384)..(384): n is a, c, g, or t
gaagttaagagtcttgccttctcttacagaggacctaggttcaatttctagcacccgtctgtaactgttgttccagggcatctgatgccctcttctggctgccacaggcaccaggtacacttgtggtgcntgaacacncancagaagactnatagcagttgntcgtnctccagtnatctatatnaccttccaggagagcttactttcnnatnctggaactacttttnagtggctccacagagtntgggtgancctccancnaacgtctcnagctaagcagttatgatgcttgctgntcttccagtggacctgagttctgctccnaacaccagggttgnccatctcacaactccctgtagttcctgttccaggggtctgatgctntctgctggcttccatgggcatctgcctgcaca

SEQ ID NO: 3352 - DNA, 370 bp, Mus musculus
  misc_feature (139)..(139): n is a, c, g, or t
  misc_feature (223)..(223): n is a, c, g, or t
  misc_feature (227)..(227): n is a, c, g, or t
tcccttctgtaatttgcttggcaccattttccctgttcgtgggtggaagcatcggccaacattgcaggacccacctgcctgataatttaagagttcatcttcctgtttgcctttgatgtaccctgggaacatggctccntagtttccctgggaacacataccctcacctggattccagcctcacaccatggagacgtggctccatggcagaccaaggaattcntccnatgatctgagtgggattgcaggctgcctgttggatagatgtctccagagcatccttacatttccgtcacttgctttgcagacatgaggtcctgagtttgcccctaggagccatggaaaaagctgggtctgataacgggtttat

SEQ ID NO: 3353 - DNA, 299 bp, Mus musculus
gagatcctccagatctgggccccagtcttcccattttacagtgggtggctttgcccagcatgacggaggccctccctggacgtaatcctcaatgttctcactaccccacacacttgcacagaatggatgatttatttcataggttacattataacctcaaactctgcctaggcaggaaaagcaaagaggtatggcagtctgctctcctcgggtgacttctgagcttaagaccaccatactctgcatatcttgaatttttgacttttatgtccaagccctaagatgttcccatatgctgg

SEQ ID NO: 3354 - DNA, 429 bp, Mus musculus
  misc_feature (39)..(39): n is a, c, g, or t
  misc_feature (83)..(83): n is a, c, g, or t
ctctctcttttctataagccttcatttcttgatcctgtncagtaagcactcagaactgttaatggtgtggccaaaagggatancaaggagcagcagcaaggcattcccagtgtgcatgccttgttttgcagtcagagggagaattttcttttgcccacattcagaatgttgcctgttttttttttgttccgcgtgtgtatttactatgtttttatatcatctgattccagtttggatatatagcagattaatgttatatcaatccaaatatgaatctttttgtgcactaacttttatgagactcagtggcctcattgtgcctgtcatgtgtgggtcctaagttccatcccaacactaccagagaaaaagagactttaacaaaacttgtaactttaaaacagttttgaatgtaagtgtgctctcctaggg

SEQ ID NO: 3355 - DNA, 380 bp, Mus musculus
  misc_feature (135)..(135): n is a, c, g, or t
gtaagggttgccagccaggagaaccctataacaggtagggactgagggatgctgggagaatatggaggccagggtctactttgataagttaacaggcacctcagccagttgtcctgggtttgagacctaatgctnctccaagctcaaatgtcagttttctgaaaggtaagatttagggtagcagtgacaggaggttccagatcactatagaggcgacaggtggctatcactatggtgtctttctcagaagcctgagcaggggcccaggatgagcctgcagagccctggtatagacagggcttggcttctggcctcagatgctccttgctggagggaaggggtcctgatgaaccccacgatttacacgctgctctgagaat

SEQ ID NO: 3356 - DNA, 67 bp, Mus musculus
ggtcagcctctatgtaatcattcctgcatagagggtacgtacgccttagtcactttaatgccttttt

SEQ ID NO: 3357 - DNA, 376 bp, Mus musculus
  misc_feature (28)..(32): n is a, c, g, or t
  misc_feature (49)..(49): n is a, c, g, or t
ggagaacattgatgtcacctccaatgannnnngggaacaatcaagagcncacaagggcagggcattgcttgctgctggccaaggctccagggggcccatgctggactctggccactccttagccaggctgcagggaggcctcgagtcacggccccacagggcttggagcctggggccatcactgtcagagggacaagagaatgggctggctgaggcctgggactgctcagccttctggtggagagcctgctgcttgggtggaccgcccatcactgcagccccccagctgctctccatgtctctgtctttgttctgagacatttctgttttaatttattttccaggtcctgctgtagttcttagtgacatcctctca

SEQ ID NO: 3358 - DNA, 281 bp, Mus musculus
  misc_feature (72)..(72): n is a, c, g, or t
  misc_feature (95)..(95): n is a, c, g, or t
gggcctggacatgtcacaacagctctgctgaccctagcacacacatctagaagctctgtgcacatcactggntaagtcaaaacaggagccattcntacctcccagacccacctgtgttgtagagcatcaaacatcagcctttctataggttttcccttcttgatatggcagggttgtaaatctgtatctcactgagtgaatggaagccaactaaatgattctgaactaggcagagctaatttcaagtctgaccacatctgggacactgacataggcttttt

SEQ ID NO: 3359 - DNA, 355 bp, Mus musculus
  misc_feature (46)..(46): n is a, c, g, or t
gacacttttgtctcattcttgctaggaatggcccccatgtcagtcntatagcccgtctcccagatgctgatgaatatgtgtccattcttgctttttatcctgatgcagtatcatgaggacatggcagctatggctggtcttacctccaggcagaagtctggagtcaggtgtgcagtttaaacagggcaaaaccaataggatgtgtttgtgaagagaaagtgggctcagctctatccagccaactttaatcttgtttgataatagactgagccaagggatcttgcaccccatgcaaccttctcggtgtttgtctagctatctggcttccattgaatcgtggtttctcaaatctgga

SEQ ID NO: 3360 - DNA, 276 bp, Mus musculus
  misc_feature (178)..(178): n is a, c, g, or t
  misc_feature (197)..(197): n is a, c, g, or t
agcaactccttgtcaggccctcttagttgttgacctccctacactgcatgccagagagccaggctctgccccagattctttacagtttctctctccactttgtttttctgattctcatcttcataccagagacttaatatctgcctgccaatgaactatatctaaggtcttaagatgntcgtcagcacctacaattnccccaccttagatgagatactctttctttcctgtccttcactctttcctagctgcaccagccttgtgtcattccttgaa

SEQ ID NO: 3361 - DNA, 305 bp, Mus musculus
  misc_feature (167)..(167): n is a, c, g, or t
  misc_feature (178)..(178): n is a, c, g, or t
ggccaggcgcaccaagaacttataaaatcctggctggctctgtctgtacctttatctggatacaatgctctagcctgcaccagttccccacaacttctattccgtccttgcaagcatggttaaggacaagttagccagtctccctgtgacctccatctgctctactntacccacagtncaactgtcttgctctctgaaaacaaaactctcttcttggcccagctccaatctctgatagattttgcttgctccagtgcaggtagcagaaccaactgagtcagatgcagtgctattttccagcctag

SEQ ID NO: 3362 - DNA, 343 bp, Mus musculus
gaagccgatggagagtctctttccctcgtgatggaagcagacaacaggagggactggaagaagaaaagaacacatggccccagaccagcttgcacagccctgagccggaagcacacaattctctcgaagtcctcccaagcctggaaaaccatgccaaatcgccagtgacagcccaaagaaagcaatttggggaagatggagcggtcatttatccttcatctctgactgacccttaggatgtgacccgcatgcggtggccacgctgttcatcctccggcaaggaccctaggaagcgaggggtctggttccccagctgctgatgtgccagggtgtcctgatgcac

SEQ ID NO: 3363 - DNA, 323 bp, Mus musculus
ttttaccccatatttagcctatactttcaaagtggatttacatgtctatatcatttgtagaaatgagattgtaaaataaaatgcatatttttataataattttaaccaagtccaagcctgctggcattatcctgtcttaatcaagaaagaattaagacaatccctcttaaaatgttgttatactgatgcctttatacaatgtataaatgaatactgagataattgaagatattagtttacacagattttattttaatttgaaatgctaaaatgtcagtgacagtgtgaaggttgctgtgggttggtataacttcatcagtaat

SEQ ID NO: 3364 - DNA, 182 bp, Mus musculus
  misc_feature (28)..(35): n is a, c, g, or t
  misc_feature (38)..(39): n is a, c, g, or t
  misc_feature (41)..(42): n is a, c, g, or t
  misc_feature (44)..(44): n is a, c, g, or t
  misc_feature (49)..(49): n is a, c, g, or t
  misc_feature (51)..(51): n is a, c, g, or t
  misc_feature (54)..(54): n is a, c, g, or t
  misc_feature (57)..(59): n is a, c, g, or t
  misc_feature (62)..(63): n is a, c, g, or t
  misc_feature (73)..(73): n is a, c, g, or t
  misc_feature (117)..(117): n is a, c, g, or t
ttcgcaataccttcatcttctccttttnnnnnnnnccnncnnanttctntncanccnnnttnntggaccctgncacctacaatgaattctcaccctaccccacaccctgtaagattnttttttgggccttcatagggtccatttcctccagggcctactttccttccattttgcaaagcctg

SEQ ID NO: 3365 - DNA, 211 bp, Mus musculus
  misc_feature (49)..(49): n is a, c, g, or t
  misc_feature (143)..(143): n is a, c, g, or t
gaaaataaacccatggtcctatattattatttattacaactttgtgagncagtttggatacctactagagcatctttttgaatcctgatttcttttgagacagacattaaagataagttttaaaatggaacataattcgattntgcttattaaaaaaatatttttattgactctttgaatttcatgttaagcatcacaatcctactccact

SEQ ID NO: 3366 - DNA, 235 bp, Mus musculus
  misc_feature (35)..(35): n is a, c, g, or t
  misc_feature (42)..(42): n is a, c, g, or t
  misc_feature (46)..(46): n is a, c, g, or t
  misc_feature (55)..(57): n is a, c, g, or t
  misc_feature (59)..(64): n is a, c, g, or t
  misc_feature (66)..(66): n is a, c, g, or t
  misc_feature (68)..(68): n is a, c, g, or t
  misc_feature (70)..(75): n is a, c, g, or t
  misc_feature (77)..(79): n is a, c, g, or t
  misc_feature (81)..(88): n is a, c, g, or t
  misc_feature (90)..(94): n is a, c, g, or t
  misc_feature (96)..(101): n is a, c, g, or t
  misc_feature (130)..(130): n is a, c, g, or t
  misc_feature (162)..(162): n is a, c, g, or t
ttttctgctctttttcgaaatccattccagagganatccagncttntgatgtttnnnannnnnngncngnnnnnncnnngnnnnnnnntnnnnntnnnnnntcctccaccataataacagtgattgccanttgcttgaaatcggtcaaggtgggcgattcanacgtgaaaaatagcacactcgggccccagcgaaccatggcccgagacctacgtcccttttgcggcccaggctt

SEQ ID NO: 3367 - DNA, 48 bp, Mus musculus
tcagcacgtgttcctcactagaagaaaatgctgttacctttaagcttt

SEQ ID NO: 3368 - DNA, 71 bp, Mus musculus
acatggtgggaaattgccaggaacctcacctgctcatgaggttgaagtgggaggatcattagttcaagccc

SEQ ID NO: 3369 - DNA, 42 bp, Mus musculus
actctagggcccaatgtgctgccagtgttaagttctagactg

SEQ ID NO: 3370 - DNA, 88 bp, Mus musculus
tctaatctggaaacagtaggttcagacatacaaccaggacccaagtagagagtgagtgagtccccttggtgatttatttttcctggag

SEQ ID NO: 3371 - DNA, 161 bp, Mus musculus
  misc_feature (75)..(75): n is a, c, g, or t
  misc_feature (99)..(99): n is a, c, g, or t
tctaagtggtcctttcctaaggaggataagcagctgcagaacttagagaaacaggacccagctctcaggtgtgcntacggtgagggggttgttttgttntcttagttttctttttgagacagggtttcactgtataaccctggttgccctagaacttgcta

SEQ ID NO: 3372 - DNA, 151 bp, Mus musculus
  misc_feature (50)..(50): n is a, c, g, or t
  misc_feature (64)..(64): n is a, c, g, or t
  misc_feature (82)..(82): n is a, c, g, or t
ggaagaggtaagtcactggtgcccagctttgaggttttaaaagactggtnccattcctaatgtncctctctccctctttttnttctaggtcaatatgtgagctcagagatttccctgcttttgttctgtcattatggattctaaacttctg

SEQ ID NO: 3373 - DNA, 149 bp, Mus musculus
  misc_feature (35)..(35): n is a, c, g, or t
  misc_feature (38)..(38): n is a, c, g, or t
  misc_feature (60)..(60): n is a, c, g, or t
  misc_feature (121)..(121): n is a, c, g, or t
agaccaggctttcctggaattctgtgtagaccagnctntccttgaattccaagagggatntacctgcttttactgcctcagtgctgggattaaaggtggggaggcccattcctgcccttgncctcaaatgtttagcattccttcctgtt

SEQ ID NO: 3374 - DNA, 95 bp, Mus musculus
  misc_feature (57)..(57): n is a, c, g, or t
gggaaatatgtagctttgtgggttatgacttgtctattcagcaccatactatgggantcccaggcatggaccactggacagtgttcatcatcctg

SEQ ID NO: 3375 - DNA, 41 bp, Mus musculus
ggcagcctggactgttccaccgttttctgcatatgttgctt

SEQ ID NO: 3376 - DNA, 162 bp, Mus musculus
  misc_feature (26)..(26): n is a, c, g, or t
  misc_feature (39)..(39): n is a, c, g, or t
  misc_feature (70)..(70): n is a, c, g, or t
  misc_feature (77)..(77): n is a, c, g, or t
  misc_feature (107)..(107): n is a, c, g, or t
acaggaagcccacccagaagactttnaaacacgttttgnaccagacttcctttattgctatattccgacngactgtntctattcttaccaaatgtgagtgatttgcntcacttaggaatgatagaaaattcgtgaactgaaagataattcccaaaaagtcaa

SEQ ID NO: 3377 - DNA, 55 bp, Mus musculus
aataatttttattctcattgagacaggcttctatttctaccaccggtctcctgga

SEQ ID NO: 3378 - DNA, 100 bp, Mus musculus
  misc_feature (56)..(56): n is a, c, g, or t
tttaggcgaccccacattcctctcccttagacaaccaaagatctgaccattcatgntctcaatagcatgggcacctttctgcttctatcccattatttcc

SEQ ID NO: 3379 - DNA, 112 bp, Mus musculus
tgcttatcctttgttaatttctaagtttttggagttatttctcactgggaggacgcattaatacgataacattataactggtttccctcaagatgcactgattctgtaatgt

SEQ ID NO: 3380 - DNA, 114 bp, Mus musculus
  misc_feature (53)..(53): n is a, c, g, or t
  misc_feature (86)..(86): n is a, c, g, or t
aactacatttcaagctgtggttgaactgattgttagtacaaaattgtgacttntcctgaagcattatccatgctgtcacctggtgntcatacaggtacacccttcttgaagaga

SEQ ID NO: 3381 - DNA, 110 bp, Mus musculus
  misc_feature (53)..(53): n is a, c, g, or t
  misc_feature (56)..(56): n is a, c, g, or t
gggagaagcttcactcagtgctcagacacagcaggccaaagttccctcctctnttntacctcgtgaggtggagggcattcccacccagagggagatccttgttttccttc

SEQ ID NO: 3382 - DNA, 42 bp, Mus musculus
agctccattcacctatatgccagggtgttccctttcaatttc

SEQ ID NO: 3383 - DNA, 561 bp, Mus musculus
  misc_feature (434)..(435): n is a, c, g, or t
  misc_feature (437)..(439): n is a, c, g, or t
gtgacctttcctctgagtatatctgtatcccataaatgtttatatatgatgtgattgtcataaataactcatcccttcaaactggagtttatcttttactgaggagagagttgaaattatacttttagacttcctgatcgtttgtctttgttgctgttgtttttaactttgttacagactctgctttatcgcctgttgtcaaggagggtatggcttgtacaacttgtgcatttcggagttcattaacattttgttgagacctaataaatttttagttttaataagatacccaggaagttgtagaaggtatattctttgaaagcaacaatatttgatctatgtatattaatttgactttactaaatatactattatggactttaaattttattttcttaattcattaaagactaagaaaggcgtgttcccatgannannntctgtcagcccttctcctatgtgtctaacgccttcttctgtatctgttgccatagaaaatgacccttttatatgtaagggaaaattgttttcctaaagacctgtgtccgttgggtttacctg

SEQ ID NO: 3384 - DNA, 394 bp, Mus musculus
  misc_feature (39)..(39): n is a, c, g, or t
  misc_feature (47)..(47): n is a, c, g, or t
  misc_feature (49)..(49): n is a, c, g, or t
  misc_feature (52)..(54): n is a, c, g, or t
  misc_feature (110)..(110): n is a, c, g, or t
  misc_feature (198)..(198): n is a, c, g, or t
  misc_feature (214)..(214): n is a, c, g, or t
  misc_feature (236)..(236): n is a, c, g, or t
acacacccctaagctcgtgtagaaaggtgtggaggattngtgtttantnatnnnccttcctctcccatttatatgtagcactttatgacataggaaacagagagaatgtncagtgttacctgggtcattgtgcaataaagctgctagtgtcacccgtgtgtgggttagtgtgatactcaatactcatgtgagcacatntcctgtagacgttttnaaatataaagctttaacaggantcagagaaggaagctgttcaaacactgtatcactctatagaaattgcttagtggaatttcaatttttaataaaaaataaataaataaagggaagccaagtgtagttattcaagtctgcactacagggattttttactctgctttgtggaaaaccgaaa

SEQ ID NO: 3385 - DNA, 539 bp, Mus musculus
gagaacttattcctgcaaactggtctctggtgacttccacatgtgcacagtggcacatattctaataagtaaataaatgcaattaactttttaattaaaataagataaagataaaagtcattaccgtttgtagatactgtcgctggtcatccgaaacacgtatgctgtatgttgatgccttcagtctgatggactggatttcttccatgttttgtgtttacaaacctttccttaacagtttgaagttaaccggtacaaatgtatcagtatttgtattatctggaaaagacaacccatttttttaatgcatagccttcctaaaatataactgcgttttattttaatgaacttcttgttacatttaccttttgtacatgtgaataaactttatattaagtaatatttattgttggttttataatgactcacatatgatattatgcaggttaagccttgaacaactaatttcatgtcttcaaaataatgtttatagcatatgtatctttcctttggctgggccagcatcctacttaaacaac

SEQ ID NO: 3386 - DNA, 272 bp, Mus musculus
  misc_feature (143)..(143): n is a, c, g, or t
  misc_feature (151)..(151): n is a, c, g, or t
  misc_feature (167)..(167): n is a, c, g, or t
atcctgtattagaatctagcaatcatgaagtcatatttcatgaaaagaatcctacttgtggtttgaagagatttggctcccatagactcatgtgtttgaatctgtttggcccagagagtggcactattagatgtgtggccttnttggcggntgtgtcactgtggggnttaggctttgagaccctcctcctagctgccctgaagacagtcttctcctggttgtctttggtacaagatgtaggactctcagcagtgccagtgctgccatgctcc

SEQ ID NO: 3387 - DNA, 541 bp, Mus musculus
  misc_feature (54)..(54): n is a, c, g, or t
  misc_feature (57)..(57): n is a, c, g, or t
  misc_feature (86)..(86): n is a, c, g, or t
  misc_feature (89)..(89): n is a, c, g, or t
  misc_feature (129)..(129): n is a, c, g, or t
  misc_feature (132)..(132): n is a, c, g, or t
  misc_feature (157)..(157): n is a, c, g, or t
  misc_feature (211)..(211): n is a, c, g, or t
  misc_feature (219)..(219): n is a, c, g, or t
  misc_feature (221)..(221): n is a, c, g, or t
  misc_feature (223)..(223): n is a, c, g, or t
  misc_feature (311)..(311): n is a, c, g, or t
  misc_feature (341)..(341): n is a, c, g, or t
  misc_feature (344)..(344): n is a, c, g, or t
  misc_feature (348)..(348): n is a, c, g, or t
  misc_feature (365)..(365): n is a, c, g, or t
  misc_feature (372)..(372): n is a, c, g, or t
  misc_feature (396)..(396): n is a, c, g, or t
  misc_feature (415)..(415): n is a, c, g, or t
  misc_feature (474)..(474): n is a, c, g, or t
  misc_feature (489)..(489): n is a, c, g, or t
  misc_feature (492)..(492): n is a, c, g, or t
gaagtcaagtaatactgtactccatgttttccacctgatatatgggttactaanctntctacctcatagcattcctgtgaggattnttntaaataataaagttgaaaagttgaagaacatttaaagatntcnaaaaatgcagagtacattattgttnatagataccaatatagatgatacagaaaatgcatttagattatgaagattgagncattttgntntncaatgttgtggttttattgctttgtacatttggcaaacataaaaatggttaacaacacacaagaaaatgatcttgcctcctctgtatngacactatagtaattttagtactcttttantcnaaanccggatataggcttaanagaaccnaaaaatcaattagatgtatagaanatgtaataatccctacaanacagaatctcttgaaaccttgggttctgactaaaggttatttatttatttattttttgntggagaaagactaanccnaaacttttggtagtaataaaccatgactctgacatctttataattcacc

SEQ ID NO: 3388 - DNA, 551 bp, Mus musculus
  misc_feature (108)..(110): n is a, c, g, or t
  misc_feature (388)..(388): n is a, c, g, or t
  misc_feature (512)..(512): n is a, c, g, or t
  misc_feature (515)..(515): n is a, c, g, or t
atgcagagggactcctggctttaagagggagggtcttgctttaggaaagtggggctgctgctgtattttgtgacctggaagtgtcctcagcacactctgaagcttagnnngcctcctggcctcagagcaaaccatgaagaagccatttgcttgtccttacgtggcttccaatttctgatctgcaaactgtgacaatttcctattttctttcctatccatgggcagagccatggcccccgtgggcctatggaaacaccattagtttcattaggagggaaaataatctccggagaagcgaagatgttttcgctgattccctgacctccacgctaaaagcagaagtagaatctgcctcttacaaaccactgagtgacagttttccccagcntcagtcctcagcacaaaacagtttctcccaacactagcctgctgaaacagctgctccataccaaaaaaaaaaaatgtcctccctccaaatgtaaaatgacgtgacatggttgtacgcatttccnttntggagagaaccacagcagacttttttccagcatttc

SEQ ID NO: 3389 - DNA, 465 bp, Mus musculus
atcacccaggatcacctcattatttttttgctgagcttccctgggtcagggagggtgaattagtaatggcaggttagttaggccatggcaagtcgaatctgaaagtgattcctgcccctgctgatgcacaggctcaccagccagttctctggagtgtagacgtaaccctgcatgcaccaacactcttctctgactatgtcacactgtgtggagatggtggagggattgatgcagattaattatagtctctaattaattaaactgtctctgagttaagtaagagatggggacaggaacactggtgcatgcctgtggtctaagctaaatgtggcaggttgaggcagcagaatgacttgggtctaggactcaaggtcagcctggataacaaagcactgcctggccttaactctcagtggggtctgctatgtagctcaggcaggcgtgcaaattgttaggtagccccat

SEQ ID NO: 3390 - DNA, 434 bp, Mus musculus
  misc_feature (35)..(36): n is a, c, g, or t
  misc_feature (143)..(143): n is a, c, g, or t
  misc_feature (233)..(233): n is a, c, g, or t
  misc_feature (238)..(238): n is a, c, g, or t
  misc_feature (323)..(323): n is a, c, g, or t
  misc_feature (332)..(332): n is a, c, g, or t
  misc_feature (371)..(371): n is a, c, g, or t
ggcccttggctctgtcagcgactgccctctattgnngtggaacccactgaagcgggtgctgtggaaagcggggagctgcgttggccacctgagggtacacagagaggtacccctcagatccaggctgctgctgctccttcccnaagtccaccagggaaggaagcagatgatgatgtcatccagggtgccagctccgggcaccaggcattccctgctccagtaacagatgcggntgtgncaggctctactctctgaccaccaagaggacctccatcccaggatgacaggctgattcacagaaaaggctgggcccacacaggagncccagctcnccaagcttcctgtctggctgggtgtggccaggaccccancccctgcctttgcgctccatggtctagatctggaacatacccctctttgttcagtggcttgaa

SEQ ID NO: 3391 - DNA, 362 bp, Mus musculus
  misc_feature (150)..(150): n is a, c, g, or t
aggcatttgtatttccaaggcttaataatagtgtgttgagcttagtggttccccagctgttcttagattgagttttatcattgcatagattgtattggaatttctcagccttggcattgccgctgttaggagctcggtaaggcttctagntacgctgtaggtatttagctgtatcccttgctagagtctgcccactagttgacaataccactttccctaatgtgacaaccaaaaatgtctccagacaaagccagcaaccttgggcagtgcagtcttccacagttgagggtcattggcagtggtttgcagtgcttgggtccaattaagatagagtattggatccctcaaatttgacttgtctt

SEQ ID NO: 3392 - DNA, 525 bp, Mus musculus
  misc_feature (84)..(84): n is a, c, g, or t
  misc_feature (91)..(91): n is a, c, g, or t
  misc_feature (100)..(100): n is a, c, g, or t
  misc_feature (102)..(103): n is a, c, g, or t
  misc_feature (107)..(113): n is a, c, g, or t
  misc_feature (115)..(119): n is a, c, g, or t
  misc_feature (121)..(121): n is a, c, g, or t
  misc_feature (125)..(126): n is a, c, g, or t
  misc_feature (138)..(138): n is a, c, g, or t
  misc_feature (147)..(147): n is a, c, g, or t
  misc_feature (158)..(158): n is a, c, g, or t
  misc_feature (162)..(163): n is a, c, g, or t
  misc_feature (166)..(166): n is a, c, g, or t
  misc_feature (169)..(169): n is a, c, g, or t
  misc_feature (175)..(175): n is a, c, g, or t
  misc_feature (190)..(190): n is a, c, g, or t
  misc_feature (228)..(229): n is a, c, g, or t
  misc_feature (244)..(244): n is a, c, g, or t
cttctgcaagacttttctctttctgagaattatcacaatttacagttatagaaagcagtcctttggcatgtccagatatgccancatgacnatttgtatncnntgannnnnnnannnnntnaaanncatgttactaanacaccacanccataaatgtnatanntgntgnccactntaaaggaaaaaaganccaaatgaaggcaaaattgtcacacctctacagtccanncctctacaaacgagntgtttggggcctggttccctagtgacccaagattccttacacaaacatctggagcgtaacccctaataatttacacactttacacaaaaggccagtctttaaaacatgacttgtgttatatgttaaaactttctctttagcaaggtaccaagaaattcacctgttccttcagatatgggccaacccagaagtcccacaatgaaaggaccaagtaatttctcctttgcctgcaatagaataacttccacctgcttttgtgactggcatgatttactctgtat

SEQ ID NO: 3393 - DNA, 407 bp, Mus musculus
ggctgacctacaaacaacgttcctttggttccattctaattgtcctaatttcagattatccactttactgatagataactttcctttcccccctctcatctattagaagttccttgtcctttgctcaaaactcacaaatcaccaaatactttacaaatgcttttgagttgtataacactattcttctgtccagactctttcttgccttagttaacaccctcaacaaccctggtctaagattacatgtttagcaaggtttctcactgtcactaagtaacaatctagaaggagaatcttgaaaatccatttaaattttaaaaaatttagatttatatgtatgaatgcattttgcacatatgtatatatgtatgtatcatatggctacctggtacctgaggaggccaaaa

SEQ ID NO: 3394 - DNA, 435 bp, Mus musculus
  misc_feature (83)..(83): n is a, c, g, or t
  misc_feature (275)..(275): n is a, c, g, or t
  misc_feature (279)..(279): n is a, c, g, or t
  misc_feature (288)..(288): n is a, c, g, or t
  misc_feature (297)..(297): n is a, c, g, or t
  misc_feature (301)..(302): n is a, c, g, or t
  misc_feature (304)..(305): n is a, c, g, or t
  misc_feature (308)..(308): n is a, c, g, or t
  misc_feature (318)..(319): n is a, c, g, or t
  misc_feature (326)..(326): n is a, c, g, or t
  misc_feature (334)..(335): n is a, c, g, or t
  misc_feature (337)..(337): n is a, c, g, or t
acctggttgatgtgtcaagggcccacattaggcacaacgagtaaagggattaaatcagatgaaataagaaaggctctaacggncccataatagcagggggtgagcgaacgacagttatctgttaccatgttacatgccaaactaggccttgtaggacccagagagagacaagaggtcacaggcaccacttaggtattcagatctttattttctagttgcagaagtctgcttctagcctgcctttaaaggctgtctcgccctgttttctgaaggcngggnagtacgagntctcacttncccnntnnganttttatcccnncattagncttttccnntncattcagtgccatcacccacataggaatatagacccactgtttcatcaggtacctgtgctgttactacttgtagctggacatttactgggtttctgct

SEQ ID NO: 3395 - DNA, 520 bp, Mus musculus
  misc_feature (111)..(111): n is a, c, g, or t
  misc_feature (164)..(164): n is a, c, g, or t
  misc_feature (171)..(171): n is a, c, g, or t
  misc_feature (183)..(183): n is a, c, g, or t
  misc_feature (201)..(201): n is a, c, g, or t
  misc_feature (219)..(219): n is a, c, g, or t
  misc_feature (224)..(224): n is a, c, g, or t
acagatttctggtattctgggtttccacatttatgtgaaataatgttctcagcattgacacttaataaaattaaaaatgaaatcaactgtgaaaaatgttgaagatgctcntataccctctataatatcaaatgcttagccatcttcaatttttttacataaantaaacangaatatacatcntcattagtatgcaaattnactttagtccagtatcanttatnttttattttatatgcattgatattttgcctgcatatatgtctgtgtgaggttgttggatctcctgaaatgagagctgccatgtgggtgctgctcctgaacccaggtcctttggcagagcagccagtgctcttaaccacggacatttctccagagttactttagtctttaataaaagctagaaccctttgtatactaaatttattttaaaataaatttctttatgatttgtcagtaaatctttggtttgcatacctattttctctacacctatatgcccaagtttgcaaatgtgttt

SEQ ID NO: 3396 - DNA, 519 bp, Mus musculus
atggaggctcatcctgtcgtgatcatggcatttgagaggttcaagcctgggagtcagcatgagtctgggccagcctagactgaaaccttctctagaagacaaacaaacagaaccaaccaaccaaaacctccaagaacaaacaagagaccctttcactaacaaaaaaagttttctcccaaagtgctgagaaacatcataattctagctatacttcagccttacagtgaggaggactgctcagactagacactgttctgtccccctggactctttatactttacatagagtaataatactgagtgattgcatttgttgtgctgtttccatagtgcacataatactgtgataatcagtcttctaatgccttgcctacccttgccctccatacccctgactgtcctgctccatttgcttgtttctcgctcctaatttgcatatgtaagagaaacgtgcagtgcttgtcttcctgcatgagtttagcttatttgacttagcaaggtgatctccagttctgttta

SEQ ID NO: 3397 - DNA, 321 bp, Mus musculus
  misc_feature (32)..(32): n is a, c, g, or t
  misc_feature (79)..(80): n is a, c, g, or t
  misc_feature (92)..(92): n is a, c, g, or t
  misc_feature (95)..(95): n is a, c, g, or t
  misc_feature (97)..(98): n is a, c, g, or t
ttctgaggtatattctgggtggttagatgacnattgaaggggaaataactttggctaatagcttggaaaactcagtacnnaagccagtcatnagngnntgcacatctttaatcagtcctcgggaaacaggcagggcaataaacaaaagtttgaagcctgactggccttcagtgcaggatcttgcttcataaacaaagaaaacactcatttctgggctggagagatggctcagtggttaagaatattgactgttcttcctgagttcaaatcccagcaaacacatggtggctcacaaccatcctgattagatctgatgtcctc

SEQ ID NO: 3398 - DNA, 375 bp, Mus musculus
  misc_feature (282)..(282): n is a, c, g, or t
  misc_feature (284)..(284): n is a, c, g, or t
  misc_feature (314)..(314): n is a, c, g, or t
  misc_feature (326)..(326): n is a, c, g, or t
  misc_feature (343)..(344): n is a, c, g, or t
taagcatgcactctacagctgagcctgcccagaccagatctaaggaggtttaacccagttgattgtttctgcactgaaggactgtttgcctcccacctttaccacaaatgcactcagtgaggactttgctgcctgccaagaacttggcaagatgtttgcagctcctgccaacattgaaagcaagctggctccgccttcagcagagatggaagtgacctcagagacgtggtctgtttttcccctccagggtgcagtaccatgtcagtcctctggagttaactncnatcccaaacctgggccccatcacattgatntgaattctgaancctgaaaaggaacagannaagtgtaaactagccacatgcttgccttaaa

SEQ ID NO: 3399 - DNA, 410 bp, Mus musculus
  misc_feature (71)..(71): n is a, c, g, or t
aatcagagttgcgacctttcctaaactcgtgactggccatggcctctgtgaccaaccatgcaggctaaggnctggcccagagaagcttcagaaacagagagcagagaagtgggggatgggtgttttgttgtctcagggctcgaacccagggccttgtgcatgccaggccagtgctttgcccctgagctacaattttagctccatctccctgcccccaggatgtttcgagtacactattgtaagctggcaaggccctaacggttacccatgttcggtttgctcatgcagcgactgtcagaacaaggctggcccagcacatcgctgtgtccggtaccatgggtcccgatgtctcctcagactgacagttcttaccaggacacaggctacttcctactgccatggtcttaagt

SEQ ID NO: 3400 - DNA, 490 bp, Mus musculus
  misc_feature (157)..(161): n is a, c, g, or t
  misc_feature (163)..(164): n is a, c, g, or t
  misc_feature (195)..(196): n is a, c, g, or t
agtcagggcttttcggctctgcagagcagccactccgtagcctgcagcctgggccacctctcaccttacagccttgggcaactggagtgggggatggggagccctagagccctgatgtgttgccatggggacataggcttgtgaataggctttctgnnnnnannttctgatgtggcttggggaaaaaaaaaaaanncagttctgtctcttgagttcccacctttctagaatccttctggccaatttccctagtgacctcatgtgttgaactgttcatggttctgtcttctcctctctgccctggggccactctcctctgtccatattgatgtgtatataggtaatgtcacccacagatcaaaaacctctaagtttacatttctaccgcagcttttcttttgaactccaggtatcttctttataagctttaggggcgatctagaatggccaattggacctcaacttgtaccacctgctaatatcactgaag

SEQ ID NO: 3401 - DNA, 453 bp, Mus musculus
  misc_feature (38)..(39): n is a, c, g, or t
  misc_feature (156)..(156): n is a, c, g, or t
tgtgtcacacccgtatggcatgcaggctcatggcggannagcctaattgacaccattgagaagttctagttgcgagactgcatatacagcctcgaaaggccttcctgttcgtgacatggttttgagttggcctcttgaagagatggccctagaggnaaagctagatgtcagagaaaccctttctgcagatggcacagtacacagcttctttgttccgtgttacgacggaggatggtgatgagagacccttccttgttgggtcagttggatcaggagcatgaagctggacattttaaaaaatgaatgtgcttaaactttcaaatgtgttactgactggaactggaaagatggttcagccgttaacagcactggctactcttccaaaggacgacctaaatccaattcccagcacccactcagcagctcacaattgtcagaaattccagtcctagg

SEQ ID NO: 3402 - DNA, 523 bp, Mus musculus
gtttgatctcttaactcccaaccaaaactaaccacattaagcaataatgactttttttggtgttttggtttgtttttgagacagggttgctctatgtagccttggcttgcctggaacttattttgtagatcaggctggcctcacactcacagagacccacctgtctgcctcccaagtgctggaactaaaggcgtgcaccaccacacctagctgctgcaatgacaattaagttgccagaacgagagatacttaccaagtaagctaaacagtcatatgtatggttttgaggcgctaaggaacctaactttgtacgtatttaaaaccaaccagttagagatttattgctgccttgttgggcttcctgtaaaaattttcataaatcctagttactatccctcatgtttttgcttctgttaaatatttgtgatgtttaatctaacttttaaaaaacagtcattattatttcaaaaaccagaacctggtatttatgtataagtatgttgctgaaactattatgacttaa

SEQ ID NO: 3403 - DNA, 514 bp, Mus musculus
  misc_feature (122)..(122): n is a, c, g, or t
  misc_feature (227)..(227): n is a, c, g, or t
  misc_feature (326)..(326): n is a, c, g, or t
  misc_feature (464)..(464): n is a, c, g, or t
acctctttgtgcatccactctggaaccgctcgtgtgtggcctgtggcaatgacatcgccctcatcaagctctcacgcagcgcccagctgggagacgccgtccagctcgcctcactccctccngctggtgacatccttcccaacgagacaccctgctacatcaccggctggggccgtctctataccaacgggccactcccagacaagctgcaggaggccctgctgccngtggtggactatgaacactgctccaggtggaactggtggggttcctccgtgaagaagaccatggtgtgtgctggaggggacatccgctccggctgcaanggtgactctggaggacccctcaactgccccacagaggatggtggctggcaggtccatggcgtgaccagctttgtttctgcctttggctgcaacacccgcaggaagcccacggtgttcactcgagtctccgccttcatngactggattgaggagaccatagcaagccactagaaccaaggcccagctgg

SEQ ID NO: 3404 - DNA, 516 bp, Mus musculus
gatcttgtagaagcattttctccattagggtcccctcctctcagatgactgtagagtgtatcagattaatatataactagtcagcacagcttcagatctcagaaaactagagttacaaacagttgtgaacctccatgtgggtcaagggaagtgagccaatggcttctgcaagaacaagtgcccttaactatgagcgtctccagcctctgcttcctaaattcttagattttagtgcctgtcttcatctctgcagggtttttcttttttttgctaattacaagattgtagaattattttatgatttgttacttgcaaatcagaacaattggaaaataagcattaaccaacctgtgctttctataagcagtttcaatgcattatgaacattttaatgaatcagattgttcaattctaaaactttgtaaaacttttcggaatctactagaagataacctgacttgtcatatataagtatgcatagaaatattgttatgtttatgtggtattgtctcagat

SEQ ID NO: 3405 - DNA, 540 bp, Mus musculus
  misc_feature (119)..(119): n is a, c, g, or t
  misc_feature (310)..(310): n is a, c, g, or t
  misc_feature (329)..(329): n is a, c, g, or t
  misc_feature (341)..(342): n is a, c, g, or t
  misc_feature (344)..(345): n is a, c, g, or t
  misc_feature (347)..(347): n is a, c, g, or t
  misc_feature (349)..(349): n is a, c, g, or t
  misc_feature (394)..(394): n is a, c, g, or t
  misc_feature (404)..(404): n is a, c, g, or t
  misc_feature (409)..(409): n is a, c, g, or t
  misc_feature (475)..(475): n is a, c, g, or t
tcctgtcggtttggtcagttgcagtaccggtagctttctgcttgtgacggttacctaagtgtgtcaatgtacatctgtagtatgtacatgtgaaagtgccttcctaccttagcgtttancctagctcttggactgtggcccactaggtcccgcccacttccttcatttccagccacgccccacagtgttctgaaaccccctccgctccttcccagcctctccccacccccatcatcctcccgtgcctctgtcacgtgcatctcgcatccacgtggattaccgcactgtcttgttgccctcctagacgtgnctgtgcctttctcaccccnctgtgactcccnncnntntnatccaaccttcccacccacagtgccactgccatcctgtcccttgntctgtaccgnttctntctgaggtgaggagaaaagtgatgcttttacagtcctggaagaaatgatgatgttttgttaatttntcgtgacgatgcacttttctgtatagtacagtacatttttggcatgtaccattacaggcttcagt

SEQ ID NO: 3406 - DNA, 448 bp, Mus musculus
ggatttagcagagagccttctatctcccctgtagcttttgtcatggctatttttgggggggggggggttccgtcttgtccgcactcttatctataacaactaacccacgataaatgtttgttgagtaaacggattaattaaggaggccggcaagctggagagggattcgttggatagtctataagccaagaagaagcaaggacttctggtgagctctcgagatgtccatgtattgaaaaggttgttatcaatacaggttttacagtctgcaatccctgcttgctatactcatctccttgtgtcctcgattagaaacaaaacgcttgcaactcattgtcaggtgaggttttgtcattctattttgttggttggtgctgggaattggactcaaagcttcatgcacgctgggcgcatgctctctgaaggagttatatcgtgccagtcccaa

SEQ ID NO: 3407 - DNA, 554 bp, Mus musculus
  misc_feature (27)..(27): n is a, c, g, or t
  misc_feature (32)..(32): n is a, c, g, or t
  misc_feature (41)..(41): n is a, c, g, or t
  misc_feature (62)..(62): n is a, c, g, or t
  misc_feature (82)..(82): n is a, c, g, or t
  misc_feature (109)..(109): n is a, c, g, or t
  misc_feature (111)..(111): n is a, c, g, or t
  misc_feature (125)..(125): n is a, c, g, or t
  misc_feature (151)..(151): n is a, c, g, or t
  misc_feature (176)..(176): n is a, c, g, or t
  misc_feature (194)..(194): n is a, c, g, or t
tcatttgactccactgagcaggtcccnagggntcaggtcanatggtgtccagcaggatgccntagaatgctggagagaaggncatgagtatcataactagctagtaccntnatagccacaatctnaaccctggggaactattccaggaagnccaccagagttgaatcagaaggtcntaagctgagaagtgccanccatatctactcacctagtttgcctttgattgtccctgtaactctgagctagttctgggctgtttgtggcttctgcagtttcatctttaaaggaaggacatcggatacatcttcaggccctccctgggattctgccctagcctctcctcctgcagtggatttctaactactccaatcttagcttgctcttctccataagatcattcttatgtaaagaagaagagggctggagagatggctcagcagttaagagcactgactgctcttcctcagagatcctgagttcaattctcagcaaccacatggtggcttacatccatctgtaatgggatccgatgtcctattctggtgtgtttgata

SEQ ID NO: 3408 - DNA, 432 bp, Mus musculus
  misc_feature (75)..(75): n is a, c, g, or t
ttgtaaaccacccttgcgaagttctgctttacccagaccacatatggcaaagaagagaaattcccagcttgcctnccagagaatcagcacttagcaacatgtggttccccggtaagctagctggagcccagtggcgtgattaccctcacacacaccgagcctggagctggggacagaggcctacaccttctcattgatttttctaaagctatacatttatgtcatccgataacgaaggagactgacagaaactggttcactgtgcagccaagactgtcctcgagctgatcctgtctcctacacatctcaagtagggagtctgcaggagggaagccccaaatgagtgggatgcaagggatcaaatccacatagccaccaagacttccatgaaaaagataaagagagcaacttaacccaagttccactgacaat

SEQ ID NO: 3409 - DNA, 515 bp, Mus musculus
tgatctccatactatgccacagcatgcatatgtgcacacatatgaaaattataacattgttattaaataaaaataaagcaagaattaaaaaaaatgaagaggggtgtgtctaagatgtattaaggatttttacaatgtgatgataagacaagaaaaccaacaaatatgatcaatacatttgaggagaaatttcacagaagatgtataaatggttacagttacataaaagatggtcagcctttagtatcagtttataaatacaattaaaatgataaggacatgccatgatacagtaaatctaaaaacaaaaaacaaaaacaaaaaaactgacaacaccaagtgctggcaaagacatggagtgactggaaccctcataggttgctgatgggaaggtaaaattgtgacgtggccagtaaggtcatctttactcagttaaactacacttatcctacagcacagccattctattccaggaacttacccaagagaaacagagcatctgtccacacgagtgt

SEQ ID NO: 3410 - DNA, 380 bp, Mus musculus
  misc_feature (78)..(78): n is a, c, g, or t
ggtggactccttggcttatgatttctgaaaggtctaaacatgtacaacgaaaacacttaacaagtcattgtcatgtgnaaaaaaaaatggaactgacctaaaagcattagttcctgcccataatgcactgcaactgtcaccctgcttcctcaccctgcttcctcgggtaaatacgtacccacgtgtccccaatgcctcctctcacccactccaaggtctcattgaactttttctgttggggaagggcgggaaagcctaggaagtagagaaaggggagagaggtgagagagaaattcctaaggaatttctagtttgtcttcaggaaagaaggggccacttagactgtatgacttgagcatctcctgacaagcctcaaaaat

SEQ ID NO: 3411 - DNA, 523 bp, Mus musculus
  misc_feature (81)..(81): n is a, c, g, or t
  misc_feature (91)..(91): n is a, c, g, or t
  misc_feature (136)..(136): n is a, c, g, or t
  misc_feature (140)..(141): n is a, c, g, or t
  misc_feature (147)..(147): n is a, c, g, or t
gacaggcttcttctgcagttattatttcagggatgcacaactcatcaaagtcctcagaataagccaccattaagtgcttanccccaaatangatctctatactagcacctccaaagctcagaggacatcatggaanaaannattggnaggacagggaggggtgtgtgaaacgcatcttccgacataacatgatcactatagtcacggacctactgctgctatggtctcctgcacaagaccaagccggcaagttcagtgagctttccagcagccagcactaactggaataatgggtaattaaataaataaaggtgaggatatgaaggtgggaaggaggtcttggggggggttgtcctgggggagtgggagttaggagtttgtgtggatacattgtacacatggaagaaattgtcaaagaattaataaaagggaaaaatggccccttttacaagtagatctgtggtatcctcagagtggtactgtagtgacatgtggccttgcctgccagagacttactgtgctt

SEQ ID NO: 3412 - DNA, 504 bp, Mus musculus
tatatatgacttcactccctctttctactggtgacatgtgtcacagggcagggcagttaagcacccttaacccgtccccaccacaggagactaccctacttttggggtttgtgtgctgcgttgctcttggggttactgcagactacatccccagcaagcaggcttggtgataggctgtacaaattctggagagttaggctggaccagaacttcggctccaggagctctcatacctgtgtggttggatggagctttggggctttggttccgcatgggggtgccatgtcttatgactgctgagcccagctttgaggcctatgtttgaacaggcattgtagactgtgggtgtgtctcaggcagggtgcctagtctgaactcacagagaggggctgtaggtttaattaagtggtagagctagcatataacacatacaggccattaccacagtcgatctctagtactaaaaacagacatctgcctgtctgcctgactgttgaggccaga

SEQ ID NO: 3413 - DNA, 493 bp, Mus musculus
  misc_feature (307)..(307): n is a, c, g, or t
ttaaactagccagatcgtggtctctgttttttggggggtgagggaggcgcagtggtggccggtatgcagctttagcaaactaaagagggaagcacttggaacctgcgtccagaagggggcgctggtgcatcgagcaaggagctccgtgcagctcaactgcaattttctgcttttctccctatttctctaagccctgccaggagcatcagagaggtcatgagtgggagagattttggtcaccatgaggtttttgtacagaatggcgcgtcaatttcactgcacacttatctgtgtgcacggcagtatntgaattgcatcaggctcctatcctcactgcaaactttgcaaaccgacctcattggttaaattcagcccttcttccatgaaaagaatgcatcctaagtgttgtagggtcgctacctacatagtttcaggagtttagacatttttgcagatgttcggtgattattatgacaaggcctttgtttccctc

SEQ ID NO: 3414 - DNA, 353 bp, Mus musculus
tatgggatatgcctaaagccttgttgatttattttttttgaaaacttttttatagcctagctgtggtagtgcacacttttaatccagctctcagcacttgggagactggcaggcggatctctgtgaattccaggctagtctgtcttatagagtgagttccagagcagctgaggctacatagagaaaccctgtctcaaaaaacagaaaacctcccaactcaaaccaagccgaaccaaaagcaaacaaaacccaaaacaacaaaacactttttcataatgtatgttttcatcatatcgttcttcttccccaaatcctctcagattctccccacctctctacacacgtggattata

SEQ ID NO: 3415 - DNA, 419 bp, Mus musculus
gcatccaaaattccatatctccatcaattcattagcctaaggatagggagaaactcccgctgtcagctaagaaactcaaatgaatgatattttaaacgtcaccttttggactgtagaaatggcttagcagttaagagcacttactgcttctctagctgtgctaagttcagtaccccagccttggtgttgggcagctcacagcaacctgtaaccacagttccaggctggtctaatgcctttgcctcccgtggacaccagcactcccttgcatgtacccatacacatgattaaatgtaataaaataaatatatattttttaaaagtaacctttttccagatatggtcacatgcaactctagccctggccactcagtaggttaagtgggagaattatgtgagcctatatgagtttgaaacca

SEQ ID NO: 3416 - DNA, 367 bp, Mus musculus
  misc_feature (206)..(206): n is a, c, g, or t
actctgtcattcagtgccagtcttagccccctgagtgctgggattgaagcctgtgcctcagcctgactgttattttttaccttttctttatttttgaaaattgtataatgggctggtgagactaggcagctcattgagaatccttgacccccaagcctgctgacctggatttgttcccagactcagggtagaagcagagaaccaantcctaaaatttgtccccagctctttctgcagtgtggatttcagtgcagaatacagaggtaatgctaacatatccagttttttggcccccaacaacaattccctaatgtcagcagaaagtaattatgcacgattgagtcactccccttattcctttgaagag

SEQ ID NO: 3417 - DNA, 364 bp, Mus musculus
  misc_feature (119)..(119): n is a, c, g, or t
  misc_feature (130)..(130): n is a, c, g, or t
  misc_feature (144)..(144): n is a, c, g, or t
  misc_feature (163)..(163): n is a, c, g, or t
  misc_feature (169)..(169): n is a, c, g, or t
  misc_feature (195)..(195): n is a, c, g, or t
  misc_feature (204)..(204): n is a, c, g, or t
  misc_feature (252)..(252): n is a, c, g, or t
  misc_feature (311)..(311): n is a, c, g, or t
gaccatcatcaacaaggcagtgaagctaaaagctggtcggtcttccagagctaagggaggaccagagagtcaggccttctggaagcagtgtgtcctctcccacaacctttgttcagggntcaatggagcntgctgcagggctgnccgatctccaagcagaggnctcgcngttctgtctgtaaggaatacctcaanaacccaggnaccatggagtgtggccataaagtctgtctgtcctgcaccagtgtgttntgggaggatctaaagggtagtgtcccctgcccctcttgtcatttgaactgtccaggaanggaactttttgagtaatcagccaccaggtgagttcaccgaagttgccatcttg

SEQ ID NO: 3418 - DNA, 565 bp, Mus musculus
  misc_feature (84)..(84): n is a, c, g, or t
  misc_feature (295)..(295): n is a, c, g, or t
  misc_feature (302)..(302): n is a, c, g, or t
  misc_feature (316)..(316): n is a, c, g, or t
  misc_feature (318)..(318): n is a, c, g, or t
  misc_feature (412)..(412): n is a, c, g, or t
  misc_feature (521)..(521): n is a, c, g, or t
  misc_feature (536)..(536): n is a, c, g, or t
accttagattgtgtttcatgagaccacactattatcctatgtacacaacagagtctaatgcagaatagttagactggatttaancttatctttgcataatgacttgacataatctaagctccaccacatgaactaatcaaaattgtataatatctctttaatttttgaccattggatgactttacagtatgatagtaattaaactgcaggatcagagtttagatataggtcattaagaaagtcttacagccactgttaaacacaagtggacagagggcacttggggcagaaatgnggagatngttgtgattgtctngnatccaggatgaaagctttgtacaaagagtgttcaacatcataggctatagatcttccatttgttcagtgtaggactgttctgatagaactagtnaggtaaatgtttccatgtactaagctcactgttgatagactatcaattcaaatacgtatatgagtgactttcaaaaatacgtcagaatttaaaatggattgccaaaatnttctctttcggattnttcaatgttaaagcgcatattcctgatga

SEQ ID NO: 3419 - DNA, 450 bp, Mus musculus
  misc_feature (103)..(103): n is a, c, g, or t
  misc_feature (105)..(105): n is a, c, g, or t
  misc_feature (152)..(152): n is a, c, g, or t
  misc_feature (165)..(165): n is a, c, g, or t
aagtcctcttgtaaagctctttagcatttgcctgtcaccttgcagggaggatgtgtcccatctccatggcaaggctgtatcgatctacccatcctctaggtgnanttaggcagagtttggggcttaagtagctccggtgacagaagcacatnacctaagcctctnatctgagccaaaagaaaggttgggctgggaaggaccacctatggacatcaccttggctcctgagctaatgagctgatatactgtctgcttgcagatagtctgggctggaagctcttctatgtcacaggctgcctatttgtggctgtacagaacttggaagactgggaggtaagatggaacagtaggacccttcccgttcagaagcacctgccccagctcagaggcattcagttacctggactcagcccttcccttgattttgcttgtaaacatctctggactttt

SEQ ID NO: 3420 - DNA, 317 bp, Mus musculus
gggacaccaccctgaaaaggagattcacgggcaggaagatatttgagccaaacagagcatcacctaagaacaagtaaaagaagcaagactcagagaggtgggaaccacagcaccattgtcatgggaaccacaatgtgacaactccagaacaaagtattctttcctccagcatcaaagcataagtcttaggtaagtatttattggtgcagagtgcctgacctttaatctaactaccaagaccaggtcaagagtaattgtgactagccacaaattagatgaccccacctaccaataaaaacagttattggagccagcag

SEQ ID NO: 3421 - DNA, 468 bp, Mus musculus
  misc_feature (32)..(32): n is a, c, g, or t
  misc_feature (57)..(57): n is a, c, g, or t
  misc_feature (73)..(73): n is a, c, g, or t
  misc_feature (82)..(82): n is a, c, g, or t
  misc_feature (86)..(86): n is a, c, g, or t
  misc_feature (95)..(95): n is a, c, g, or t
  misc_feature (103)..(103): n is a, c, g, or t
  misc_feature (107)..(107): n is a, c, g, or t
  misc_feature (115)..(115): n is a, c, g, or t
  misc_feature (123)..(123): n is a, c, g, or t
  misc_feature (130)..(131): n is a, c, g, or t
  misc_feature (138)..(138): n is a, c, g, or t
  misc_feature (146)..(146): n is a, c, g, or t
  misc_feature (166)..(166): n is a, c, g, or t
gtgtgagctcagctgttgcctgtcacttaggngacaactggcctttttctgactaancctttgctgtcgccanttatcctcnagtnaaagtatcnagtgttcngganggccttcntattaccnaagagtnngggaccngggccccnttgggaggtgtcagccgtgnttgaccatccctaacaatatgtctgtttttagaatagaaagggggggaggaccaaaaaaaaccctgacagcaagatagatacacttttagattaagaccaacctaatctaaaaattctgttttaatcaagacagctccgtaaggatgacgcaatgtttgtcaagcctttctccctagaacaatatttactcccaccaggggatttaaaacttaaacaacagccatttatcttgctgtctggtagagctgggttcattttgcctccaatgtggtcctagcctaggtggctggaacaagaatct

SEQ ID NO: 3422 - DNA, 341 bp, Mus musculus
  misc_feature (212)..(212): n is a, c, g, or t
  misc_feature (240)..(240): n is a, c, g, or t
  misc_feature (242)..(242): n is a, c, g, or t
  misc_feature (267)..(267): n is a, c, g, or t
  misc_feature (288)..(288): n is a, c, g, or t
gaggagggcttccagtaagcttcccctgtcgtttcacatgtccatttaccacaaaagtaatctgatacccctccacattcttgttgaagccttttgctctgaccctgaccagggcaaacataaaattgtgcagctctaagattagctcggtagaactgccccgaacatccatacgagttccctatcccgcccgggacacaccgctgttcagngggtgggttgctaagatcagtatgatcngngaggtcccaattgggggatcctgcngctaacttacagatgtcaggngtgagatcaggccaccaagtccagaggggatggactgcagtggttgcccatac

SEQ ID NO: 3423 - DNA, 500 bp, Mus musculus
  misc_feature (83)..(90): n is a, c, g, or t
  misc_feature (126)..(126): n is a, c, g, or t
  misc_feature (142)..(142): n is a, c, g, or t
  misc_feature (174)..(177): n is a, c, g, or t
  misc_feature (322)..(322): n is a, c, g, or t
  misc_feature (371)..(371): n is a, c, g, or t
  misc_feature (405)..(405): n is a, c, g, or t
  misc_feature (413)..(413): n is a, c, g, or t
agagttcctccaacttgatgaaattagcatccacaagataatgttatcccttcttataactgggcagattggccttgactcannnnnnnnttatgcttcctgagtgccaggattccagctggaccngcaggattattttctncaggtgttgcattctagtcagatatagctgannnnagtcagagagaggacttcagaataaaaggaagctttctggaggttagtcctagctcatttggaaggctccgaaatggctaagcaaaattccttctctttccacagtatttactggcacagagctgtctccttccacaaccacagngactttaaagagaaagctctgggttaacttctcagtagatcaataaganaagagcacacttgtgctagggtgagaaaaagatngattgtangtagtatggtggtctaaggagtacgttttgtttctctctgctactgtttttgaagaagaaaagactttcattgtctttcatgtattt

SEQ ID NO: 3424 - DNA, 283 bp, Mus musculus
ggctttccatgttgtctgttcatgttagctaagcggcttggctgactcctttatctgcctagatttcatccctgcataggaaagttcccaaactccaatgaatattgtcttagtgctgtgatatttttatgtatttatttgatttgtcgtgtattggcaggaggagggggtaatacttcaagcttgtgaatttcatatacttgtagatgttcagttctgctgttacaatggagaagtgactggacagtgagcagacaggtatatgtgcttatgttcagtatca

SEQ ID NO: 3425 - DNA, 314 bp, Mus musculus
  misc_feature (128)..(128): n is a, c, g, or t
tagcctaggctgatgatgctaacctagaatgaggaaagcttgaacacaggagtgtcaattccatttctgtgggtctcggcaccactgtatactattagcattttaggttggacaactatctggggcangggaggtgtcctgtgaacctccaggtatgcgacagccgctctaactcaccaagtgtcagcggtactttctccccgcgcttcacagaatggctgtgctgatagccctttgaagggtggcaccagctccatcattaccggaaccggcttccacttgcaaggttttttagtgaccttgggcacgtcctt

SEQ ID NO: 3426 - DNA, 502 bp, Mus musculus
  misc_feature (96)..(96): n is a, c, g, or t
  misc_feature (120)..(120): n is a, c, g, or t
  misc_feature (212)..(212): n is a, c, g, or t
  misc_feature (414)..(414): n is a, c, g, or t
  misc_feature (475)..(475): n is a, c, g, or t
tgcagaacaagttggttgggcctttgtttaaaaccctctgtgaggctggagatgtagttcaggtggtggagtatgtgcctagcgttcatgaagccntgggtctggtccccagtactacanaaaacagatgtgctggcacatgcctgtaatcccaacacgtgggaggtagagacacagggttagaaagaagttcaaggtaatccttggctacntagtgtgtttgaggtcagcatggattacacaagtttctcaaataccccgcaaaaccaaaacaccaaacaaaaaccctctgtcacttacttgctatcttagggaaaaagttcaaatctgctgagtgactcagactggcatggagtggcccctgcccacttgtgatcttgtcttagccattttcctgttagttctctgcacagncattcatcttgtcagtccttggacttggctatgcctctctccattctcattgccctcaggnccactctgcactcagcctagttagtga

SEQ ID NO: 3427 - DNA, 567 bp, Mus musculus
  misc_feature (31)..(32): n is a, c, g, or t
  misc_feature (34)..(36): n is a, c, g, or t
  misc_feature (39)..(39): n is a, c, g, or t
  misc_feature (41)..(41): n is a, c, g, or t
  misc_feature (43)..(43): n is a, c, g, or t
  misc_feature (46)..(47): n is a, c, g, or t
  misc_feature (49)..(49): n is a, c, g, or t
  misc_feature (54)..(54): n is a, c, g, or t
  misc_feature (56)..(56): n is a, c, g, or t
  misc_feature (62)..(62): n is a, c, g, or t
  misc_feature (65)..(68): n is a, c, g, or t
  misc_feature (70)..(70): n is a, c, g, or t
  misc_feature (72)..(72): n is a, c, g, or t
  misc_feature (74)..(74): n is a, c, g, or t
  misc_feature (76)..(79): n is a, c, g, or t
  misc_feature (85)..(86): n is a, c, g, or t
  misc_feature (90)..(92): n is a, c, g, or t
  misc_feature (95)..(96): n is a, c, g, or t
  misc_feature (101)..(102): n is a, c, g, or t
  misc_feature (108)..(108): n is a, c, g, or t
  misc_feature (110)..(110): n is a, c, g, or t
  misc_feature (113)..(115): n is a, c, g, or t
  misc_feature (118)..(118): n is a, c, g, or t
  misc_feature (127)..(128): n is a, c, g, or t
  misc_feature (130)..(130): n is a, c, g, or t
  misc_feature (133)..(133): n is a, c, g, or t
  misc_feature (137)..(137): n is a, c, g, or t
  misc_feature (158)..(158): n is a, c, g, or t
  misc_feature (165)..(166): n is a, c, g, or t
  misc_feature (169)..(169): n is a, c, g, or t
  misc_feature (178)..(178): n is a, c, g, or t
  misc_feature (180)..(195): n is a, c, g, or t
  misc_feature (208)..(209): n is a, c, g, or t
  misc_feature (211)..(211): n is a, c, g, or t
  misc_feature (233)..(234): n is a, c, g, or t
  misc_feature (256)..(256): n is a, c, g, or t
  misc_feature (263)..(263): n is a, c, g, or t
  misc_feature (282)..(282): n is a, c, g, or t
  misc_feature (337)..(337): n is a, c, g, or t
  misc_feature (347)..(347): n is a, c, g, or t
  misc_feature (409)..(409): n is a, c, g, or t
ctgagtcctaaaacatcccatgaaagaaganngnnnaanangncannantcacntnatgaanagnnnnanangntnnnncttccnncaannngtnnataanntggtcntnaannnacnagatctgtnnanacncagntgctcataaatttaacaacangagtacnngcnagttatttntnnnnnnnnnnnnnnnnccagtccaagtcnnantgtgctcagataggtgtatggnngcagagcatcctggagaccttntatatgnagtaatatggggtggtganctgtgataggcagtccggtgcctggcccagctcaggcttaaaaccccagtgaccncagcaggtgnctgtcacctgcaaggaacagcaggcatttggccatgccccttgagctcctgtcacgcagttncagcctcccacgatgacttctgccccagagagctcagtggccatcagtcacataggagcagtgccaagccctcccacatgcagataaggtatctccaagccaatgagaagtacctgctgtcagaccctgacccgccccagcactgtagataagaatcg

SEQ ID NO: 3428 - DNA, 438 bp, Mus musculus
  misc_feature (46)..(46): n is a, c, g, or t
  misc_feature (59)..(59): n is a, c, g, or t
  misc_feature (71)..(71): n is a, c, g, or t
  misc_feature (101)..(101): n is a, c, g, or t
  misc_feature (115)..(115): n is a, c, g, or t
  misc_feature (118)..(118): n is a, c, g, or t
gtgggagcaatatgacgtgacctattttcagtcagtgcccctgacngtgtcattccccntatgtaatctcngctcactctgaagagcatttgtgggtggancgatgtcttcactnacntcttcctctagagaccctaggccatctctttatcattcactttataaggtttattttaccttaatgtacgtgtgtgccttgtactatatgcatacaggagccctctgaggcaggtgactgtgtggaatcccctggagctcaaattacatggctttgtgaagtctcctaaaatggatgctgggaactgaactctggtcttctgggaatgcagcaagcacccttaaccactgaacatctccctatcccaccattctcattttcttgttttattccctttatggttccagtcaacccctccctaattttaccttcgagatgca

SEQ ID NO: 3429 - DNA, 504 bp, Mus musculus
  misc_feature (143)..(143): n is a, c, g, or t
  misc_feature (178)..(178): n is a, c, g, or t
  misc_feature (192)..(192): n is a, c, g, or t
aatgtgaccaactcaatcaacccacagtagagtaggaagagggaaaatcaagggcttccagcaacactgaagcctgtgcaaatgtgactctggggagagctagtagggactcaagggtgacctctaggttttggtgaagagtnaatacagaacacatgaactagggaaaaaaaaaaantcctagattctaangacccgcaagtcgcagcacatcataaaccactcttcacatcttcacatggctccttttgggacaggaaggaagttgtaagaaatcttcaaaggagataaatttagaaaaataaatgaaaatagaattttggcaaactgatcactcttaaacaattgaacttgttgacatcaaatatatgttgtaggacacatttaatcacctcccagtacagttttcttttccattactctttctcttaaatatattcacttattatttgcttctctgaagattatagcattattttgttaatgattgaccagttagcctaa

SEQ ID NO: 3430 - DNA, 522 bp, Mus musculus
  misc_feature (69)..(69): n is a, c, g, or t
  misc_feature (77)..(77): n is a, c, g, or t
  misc_feature (80)..(80): n is a, c, g, or t
  misc_feature (84)..(84): n is a, c, g, or t
  misc_feature (95)..(95): n is a, c, g, or t
  misc_feature (99)..(99): n is a, c, g, or t
  misc_feature (119)..(119): n is a, c, g, or t
  misc_feature (130)..(130): n is a, c, g, or t
  misc_feature (157)..(157): n is a, c, g, or t
  misc_feature (186)..(186): n is a, c, g, or t
  misc_feature (204)..(204): n is a, c, g, or t
  misc_feature (215)..(215): n is a, c, g, or t
  misc_feature (346)..(346): n is a, c, g, or t
caggccatgaacagggagtgcgatatgagagtgtagtgtgtgtgtttatggtttccgttttgacaagcntctcaagntancctnacactgagttnttgnccatgcatccaaagatggcnttcatactcanccaacgatgacttcaaacttctgatcntacctgctcccacctcccaagtgctaggnataatggtggtgctatgncccagcttcangggatgtgtgcatgtgtgaacagcggcatgtgcatgcatgtgttcatctgtttggagaccagaaggcaacttcattgtcattctttaggggaatgattttggtggttgctttggttgagacaagttccctnactgccttggactttgccaagtaggctaagatggttgacatcttcagacatcctgtagctcagaccaactgagccacatctctagcccaaatatattgtaatccttacatatgcataggcttttgctagaagaatacattagaagttggtaatggttgtctccagggaggcagcca

SEQ ID NO: 3431 - DNA, 316 bp, Mus musculus
  misc_feature (46)..(46): n is a, c, g, or t
  misc_feature (49)..(49): n is a, c, g, or t
  misc_feature (54)..(54): n is a, c, g, or t
  misc_feature (64)..(64): n is a, c, g, or t
  misc_feature (105)..(105): n is a, c, g, or t
  misc_feature (107)..(107): n is a, c, g, or t
  misc_feature (207)..(209): n is a, c, g, or t
taaactgtcacctttttatgagaagtcagagttcagataaaaaagntgnccagnaaagactgcnaaatccttcaatgtctccaccagtctgcttggattaggatnancgcccagtgaataacgccctggtcccagtggtttgaaagatgcgatgccccaatgtgggtcattccggagatggcccgctgaagtggctcagatgtgcannntccgccctcttatcacattaccatcacccacccccaacccctagttccataatccctgaggcaggagaagagccacctggtgaatgactcacgggtttcacctcctt

SEQ ID NO: 3432 - DNA, 323 bp, Mus musculus
  misc_feature (211)..(211): n is a, c, g, or t
  misc_feature (230)..(230): n is a, c, g, or t
aaagtgtccttgaatatatcctaacaaggtatgtactagtccttctaccacaaccagcctttgaactcactcattgcaaggatgaccgtgtgttctgatcattagtaactacagcttttcctacccttgtttcattactaaacaagctgcaattagtagtatttgggatttgggaatccttaggagatgaagtcaaatgttattttatccnaaacctagacaacacattnaggtccctaaatatctgcgtgttgcctttgatatcacagaacactaataaatttaactctctaaaactttatggctggatcttccggtagtac

SEQ ID NO: 3433 - DNA, 532 bp, Mus musculus
  misc_feature (26)..(27): n is a, c, g, or t
  misc_feature (59)..(59): n is a, c, g, or t
  misc_feature (81)..(81): n is a, c, g, or t
  misc_feature (127)..(127): n is a, c, g, or t
  misc_feature (141)..(141): n is a, c, g, or t
  misc_feature (148)..(149): n is a, c, g, or t
  misc_feature (159)..(159): n is a, c, g, or t
gaactaaatttgctgttactcaaagnnctccacacaatcttttaaaaaattatgtacangggtgaatatgtggaggcctgnagacaactttgaggaaatgatactcttcttctacaacttgggtccnagcgattgaactcnggctgtnnggcttggctnaggcaatacctttacccactgaaccttttttgttgtccctactcttacttttaaattacagctgacatcacatgcaactaaactcagttagacacaacttaaataccttcaagtatgtattcaattaggaatgtaccagttgattttatagtgtaaaatgttaatgtacactgagcagtggtggcacacacctttaatcccagcactcaggaggcagaggcaggtggatttctgagttggaggctagcctggtctacaaagtgagttccaggacagccagggctacacagagaaaccctgtctcaaaaacaaacaaacaaaacaaaagttaatgtacactgaatataattctagctagaatttcttgttcttt

SEQ ID NO: 3434 - DNA, 352 bp, Mus musculus
cagtgtgctgtcttatggccatggcttggatgaccacactgcagtgagaatcatccgtagcagcaacagattcttacacaactttgcctttctcatataaggagagtgctgttacagtttagcgtcttcatgacacaatatgttcgaaaaagaataccaaagcatattttttaaaagttcaactaacccttttaaccacaatgccttgtctttgcttaactctacaaagagaagctcactgttttcaacacacatcacttcatcctgtcctctgactatgtgagacacctgattaggcaaccagccagagaaagccaactcaacccctctgatccaaactcaatgggccagt

SEQ ID NO: 3435 - DNA, 464 bp, Mus musculus
  misc_feature (31)..(31): n is a, c, g, or t
  misc_feature (57)..(57): n is a, c, g, or t
  misc_feature (80)..(80): n is a, c, g, or t
  misc_feature (83)..(83): n is a, c, g, or t
  misc_feature (109)..(109): n is a, c, g, or t
gaatgtttccaatcaaggcacctccaggggncccttgtaagcatgccacacaccatncaacctgcagggtgccagccctnaantgggacatggatcaaggctgagcctngcagttggcgacccaccttcagaaccttccctagtcaggtcagcaaggtccaaggtacaatcccagttagaggtcacaagctactctccaatccagacttccaaaattatctctgcatgctgaagctcagcttaattagctggttgacctcattaatgttcgaacttcagttcggggaggaaaaaaaagaggtcacacacctacctaatttactacctcgaatttccacgagcaaaccaccaacttcagatgtcctctgaaggcttccaggactgtgcctgcaagcgatctgtaagccattgattggaaaagctccagagacccccacccgtgggctcaaggtactttctcagat

SEQ ID NO: 3436 - DNA, 409 bp, Mus musculus
  misc_feature (215)..(215): n is a, c, g, or t
tgggaatacagctatgcgccactatacctagttgagaagataagatatctattacgtgtactgaggtaaatccttccagagtaagcagcccttgactgttagtgtggttttatttcccccaccccccagcagctctctgtgcctccaaccgatggtttgtgtggttaggtggagaaatgccttcaaaactcatctgtcttcctcacaccattgcncactaatgctggacaaatatttatatcctacaacgccttttaactgtgtctgaacatagggtaagttagaagtcagagtacgtcacggtgaagaaagtttcattgtgtgacaataaccctgcagtaaggactccagtctctttctccagatttgctctgggcccagaataaatcctacatatttgcctcaaccc

SEQ ID NO: 3437 - DNA, 385 bp, Mus musculus
tcttcctgggagcacctggattttcacatggccttggggattcttgtgcctgtgtggcaggcacttcacctaagcagctgtctccccaggcccctcagcatttttattaaacagcagcaaagctctgtttagtagtggttttctcagcacatagcttctttcctgcagggaggcagtggagagggagggacaagcgggattgcccttcctgtcactgccctggcaaatctcttcaagttatgaggtcctgtgccctgaagtcccatgagcaccttggtgtcgcttccatcttaaggagctctgagcatctgtaggagaggtaggagagagttctctagaattaatccagggcagagtgacttactctggtcatctactgctagct

SEQ ID NO: 3438 - DNA, 495 bp, Mus musculus
  misc_feature (129)..(129): n is a, c, g, or t
  misc_feature (137)..(137): n is a, c, g, or t
  misc_feature (150)..(150): n is a, c, g, or t
  misc_feature (159)..(159): n is a, c, g, or t
  misc_feature (205)..(205): n is a, c, g, or t
  misc_feature (331)..(331): n is a, c, g, or t
cccaggtcaagttaccagcacacaacatggtgatttacaactacatataaatctagttccaggggctctgacaccctcatctggcctatgcatgtggtacatagacacacatacaaacactcaaataancagacttnaaaaaggaaaagnaagctgggncagtggtggcgcacggctttaatcccagcacttggaaggcagaggncaggtggatttctgagttcaaggccagtctggtctacaaagtgagttccaggacagccagggctacacagagaaaccctgtctcgaaaaaagagagaagagaagagaagagaagagaagagaaganaggagaagagaagagaagagaagagaagagaagaggccctgtctcatatgtatctcaagactgcctttaacctaaccgtgaggctgaggatgaccccgagcttgtgaccttcctgccttcacttccccagtactgagattatagagatgctccacaactacaat

SEQ ID NO: 3439 - DNA, 500 bp, Mus musculus
  misc_feature (303)..(303): n is a, c, g, or t
  misc_feature (311)..(311): n is a, c, g, or t
  misc_feature (324)..(324): n is a, c, g, or t
  misc_feature (336)..(337): n is a, c, g, or t
  misc_feature (343)..(343): n is a, c, g, or t
  misc_feature (348)..(348): n is a, c, g, or t
  misc_feature (350)..(350): n is a, c, g, or t
  misc_feature (367)..(368): n is a, c, g, or t
  misc_feature (374)..(374): n is a, c, g, or t
  misc_feature (379)..(379): n is a, c, g, or t
  misc_feature (384)..(384): n is a, c, g, or t
  misc_feature (394)..(394): n is a, c, g, or t
  misc_feature (397)..(397): n is a, c, g, or t
  misc_feature (426)..(426): n is a, c, g, or t
  misc_feature (454)..(454): n is a, c, g, or t
tggtgctacatcctcctaggatttagttcacacagactatgccaggatggaggggcacctgaaaactgccctgggagttttggaggaagggcttctaaaatacttaaaaatacgtgaatcacttcagtctgtttaaacggaaaaaaatatttgataccaggtctttatatatatatataaatatatataaaagaatagttgtctcaagaggaataaaatctggagtgtaaaaaaaatgttaaaaaaaaagaatacttgtctcactttataatattttttaaaggaaaaaagaaaacgtttccnatagcttntgtgttctgtganctctcacttttnnacctgnagcantnttctgtagcatgtcccnnagcatnagagnaactngatggtgacnatnatttttgtgcccattatcaggctccagtnatctgtgagaggggataaactaccttgntactaacttaggccttttgtgatctaatgacatagctgagggtggt

SEQ ID NO: 3440 - DNA, 421 bp, Mus musculus
  misc_feature (181)..(181): n is a, c, g, or t
  misc_feature (183)..(183): n is a, c, g, or t
  misc_feature (188)..(189): n is a, c, g, or t
  misc_feature (203)..(204): n is a, c, g, or t
  misc_feature (206)..(206): n is a, c, g, or t
  misc_feature (237)..(237): n is a, c, g, or t
  misc_feature (342)..(342): n is a, c, g, or t
  misc_feature (355)..(355): n is a, c, g, or t
gagggcttgctcgtttcagaagatggctggttcagattccgtgttccccataccagagtctttgctagggttgctcctgtagagtccattggtttccactgcactaggtttccacctcgcccctgaaatgccccccaattctactcatttgtcccagtattttctctctgcgttaaaaagnancgatnnctcctgttcccaanncnccaacgctcccatacccccacccaagaaatntatttcccctttccagggagatccatgtgcccccaacccccatccctcctcgttgcttagtctctcagggtctgtcgactataacttttactttacagctaatantcagttatgttangtacacaccatggttgtctttctgggtctgggtcacctcaagatgatttcgttctagttccatcca

SEQ ID NO: 3441 - DNA, 492 bp, Mus musculus
agtcattcttaactttctcatgggttggtgaatcccgataatataataatgtatttgttttccagcagaacaacaatttgcccaccacctttactttaaaagttcaatgtccataaatacacataacaaatactatatgagcttttaaatatttctgaagatcatgggtgactcagttaacctatgtattcacaactggcaactttaacttattttaacttcaaacactagccagcaacatgcagcagggatgctaggttatgtaagttgttaatggggcaactaaaaataaacaaacagccaaactccatgcaaatatatatttaatgaaaaatattagaaaaggtgggcttacaaagcttttgatttgacattaataaacaataagagattttagaaacgagtctgaagggatggttctgtagttaaggacactgacctctcacacggaggatctagcctcagttaccaacagtcatatggtagctctca

SEQ ID NO: 3442 - DNA, 379 bp, Mus musculus
  misc_feature (120)..(120): n is a, c, g, or t
  misc_feature (122)..(122): n is a, c, g, or t
  misc_feature (132)..(132): n is a, c, g, or t
  misc_feature (139)..(139): n is a, c, g, or t
  misc_feature (143)..(143): n is a, c, g, or t
  misc_feature (145)..(145): n is a, c, g, or t
  misc_feature (147)..(149): n is a, c, g, or t
  misc_feature (151)..(155): n is a, c, g, or t
  misc_feature (168)..(168): n is a, c, g, or t
  misc_feature (185)..(185): n is a, c, g, or t
  misc_feature (200)..(200): n is a, c, g, or t
tttcttgtcctaaggcttacagcttcctggacccagaagctcctggtttctctggctgtctagcatgcaggcagacagatattgttggattatctattctccagtacataaaccagtctnanaaaatcaccnatatatnacantntnnngnnnnnatgttatatattncctattgctctttctcnagagaatcaagactnatataaatatatgatctgacatggagctggaaatgactaagaaatttctatgtcaagagtgaaatagcctatatgttcatcactagaatattgactaaataatcgcagtatatgacagatactatgcagttcaaagtgagttagcgccttcaatgattgctttgcgataaccttcaaga

SEQ ID NO: 3443 - DNA, 534 bp, Mus musculus
  misc_feature (211)..(211): n is a, c, g, or t
  misc_feature (333)..(333): n is a, c, g, or t
  misc_feature (342)..(342): n is a, c, g, or t
  misc_feature (380)..(382): n is a, c, g, or t
  misc_feature (384)..(384): n is a, c, g, or t
  misc_feature (393)..(393): n is a, c, g, or t
  misc_feature (395)..(395): n is a, c, g, or t
  misc_feature (398)..(399): n is a, c, g, or t
  misc_feature (404)..(405): n is a, c, g, or t
  misc_feature (408)..(408): n is a, c, g, or t
  misc_feature (410)..(410): n is a, c, g, or t
  misc_feature (415)..(415): n is a, c, g, or t
  misc_feature (425)..(425): n is a, c, g, or t
  misc_feature (427)..(427): n is a, c, g, or t
  misc_feature (432)..(432): n is a, c, g, or t
  misc_feature (437)..(437): n is a, c, g, or t
  misc_feature (444)..(444): n is a, c, g, or t
  misc_feature (451)..(451): n is a, c, g, or t
  misc_feature (474)..(474): n is a, c, g, or t
  misc_feature (498)..(498): n is a, c, g, or t
agccattcctagaattccactgtcacccattcgaagaactggtccagtgtctgctcatccctcagctcagctttacgcccttagtgtcgtcaggacaaactccccgtagcttttgcttgtttttttaattatctgcttgtatgtctaatcactacactgtgctgggagttttttccaagaatgaagtacatgctaatataacgcaatatanagggactcattgaatatttgaatgaccttggccaccagcttgctgcttccttatgccttctaagaagaaggtcataaggtcactatgaaagagtttgagcttgctaataatctttgtttctnaaataactnagtccttctaatattttttctgattattctcacttctnnnanttatgtttnantcnnatgtnnatnanacagnaaatatattntnttagnaaatngtagttnatagacntgggtgaagtggcatactcagantcccagatgctcaggaagctgaancaggaggatcagctgagctaaatcagtcacacttga

SEQ ID NO: 3444 - DNA, 498 bp, Mus musculus
  misc_feature (123)..(123): n is a, c, g, or t
  misc_feature (157)..(157): n is a, c, g, or t
atgtgcaccgtgtccaatggtcaaatctggataattagcatcctcagcacctaaagtctttcttgttcctttgtggtgaaacaaacagaatctcttctagccagtctgaaacatacaatgtgntactctaatctgtagtctccctatcgttttaganatcaccagaccttcttgctccgatccaactgcaacattgtttaggttgtccaaagtctcccacctctcccaccttccactccttctcggcctctaataactaccactccactctgtacttctacaatgtcaattcttttacattccatatataagggagatcttacagttttttgtatggctggcttatttcacttcacgttaataacctttacattcgttcatgtgagcttgtttagatacctcatacaaagagaagcacttggctagtcattctacatgcttctcaagacatagaatgtctgcgactaaatcacttatctccgtagtcactctaactta

SEQ ID NO: 3445 - DNA, 510 bp, Mus musculus
  misc_feature (33)..(33): n is a, c, g, or t
  misc_feature (43)..(43): n is a, c, g, or t
  misc_feature (55)..(55): n is a, c, g, or t
  misc_feature (66)..(66): n is a, c, g, or t
  misc_feature (70)..(70): n is a, c, g, or t
  misc_feature (99)..(99): n is a, c, g, or t
  misc_feature (130)..(130): n is a, c, g, or t
  misc_feature (180)..(180): n is a, c, g, or t
  misc_feature (277)..(277): n is a, c, g, or t
  misc_feature (303)..(303): n is a, c, g, or t
tgccccacttacatgaccttaagagagtcgctngggcctcatnttggagttgacncctgctgcaanttcncagaaagaccaacaagttagtctcatttnaaaaagaatctttttagaaagtcgtaaatcnctgacttgtgtttgggaccggctggggtctgcaagagaatggtacatttntacagcccactgtgaagtggctgaatgacactcggctctaacctctctgtgtttgtttccttgtcgggtcagcaaaagtagcgtgcagcagttgccncagcacatggcctaacctgtgttatnttatagaaaggaggaggctctgcagcatggtgactttctggacttttagcccagctgattgttgttttcttgtggggaggaagtctgatccacaggctagacaaatgtttgtgggctccctccctgttagcattagactttctgtctctgttcaagaagcaacacagtaaagggagttgaaggtgcaggccagtggcacacttgtaa

SEQ ID NO: 3446 - DNA, 479 bp, Mus musculus
  misc_feature (27)..(27): n is a, c, g, or t
  misc_feature (84)..(84): n is a, c, g, or t
  misc_feature (160)..(160): n is a, c, g, or t
  misc_feature (172)..(172): n is a, c, g, or t
  misc_feature (188)..(188): n is a, c, g, or t
tgatgcctgctacaaccctatctggtnccctacatgtctattctcaggtgggtctctgttttacattttttctctcctaatcanggttccctccctctctatcattccttgctttcattatctgcacttaacacccatccttctgtaattaactccctgnccacagtctccngcgcttgcattgctgnccattatcattacgttcagtcacagctactagcagggtgcttttgaataaatggatatttgttgattaacttaacgctcaagcaaatgttgtggctgaaactttaatattctatatgcattaatattgatggcattatgcttaaatacccttgaaattatggctgagcagatgttaaatatactggtgacttgtggctccctatactttttatatatgcagaaatacatacagacatattgcttctctgagattaaatattttgacatatttctgaagtctatgtaggcca

SEQ ID NO: 3447 - DNA, 420 bp, Mus musculus
  misc_feature (242)..(242): n is a, c, g, or t
  misc_feature (252)..(252): n is a, c, g, or t
  misc_feature (269)..(269): n is a, c, g, or t
  misc_feature (280)..(280): n is a, c, g, or t
taggttctcctcaagattcatgtcttcactattactgaggaattggcgatattcccaggatcaggcatgccattcctcttgttgccattcctcttgttgccattcctcttgttgagagggattccagttccattactcctacctaaattggtcactcctaagatatgcatgccactactgcacccttgagaggatcatgccatggtgctcatgttttggttcttaggtaccatcgattggtntgcttgttgnttgcttccatcttttgnagcctgcatgnctccttctggtgtcagaaaatgtagtcctcaaagaggaggcattcaggcaattctaaaagagtggcctctgggctctgtttctgaagtccatggtttcttcagcaatagggactcaccttccacctttctattggtagat

SEQ ID NO: 3448 - DNA, 397 bp, Mus musculus
  misc_feature (90)..(90): n is a, c, g, or t
  misc_feature (96)..(96): n is a, c, g, or t
  misc_feature (188)..(188): n is a, c, g, or t
  misc_feature (317)..(317): n is a, c, g, or t
agcccctttgagcaggtacagcagagaacctggcacctctgcctcctgtccctggcaacctcttctcaaagcttccctgaattctacccngctggnttctggtctctgtccctgacctatgccctagtgatgcctggccccttgttatcaccatggggagagacagtaactttgatctctcctgtccngtatatatttcaacctaaggagtctttaaatgtcaaattgcacattgaccagagtatacctaagaaatctttacaagcaccttcaggatgctcagtccagggatatagctcacttatggtgagtgtttntctagcatacatgaggccctgtgttcaatcattagcattacataaaactgagcaggggagacacctgtaatatcaacact

SEQ ID NO: 3449 - DNA, 259 bp, Mus musculus
agagtgacccacacctgaaccctgagccagtcctaccctccggggtctgctcattatagcttttgctagagcatccttgtaagcaggagctctctacctgcccagcggttgggagaagcgcgggactccggaggcagaaggctgcccgctctccgggtgtccaggcgctcttcccgctcgccatccccagctcccccagcgcctagccctcgccccggcggcgcccagcagccgcacaaacttacttgcgggtcggcgg

SEQ ID NO: 3450 - DNA, 419 bp, Mus musculus
  misc_feature (204)..(204): n is a, c, g, or t
  misc_feature (275)..(275): n is a, c, g, or t
  misc_feature (293)..(293): n is a, c, g, or t
  misc_feature (321)..(321): n is a, c, g, or t
  misc_feature (378)..(378): n is a, c, g, or t
gatcctggcttctttttattctatgtatgtttgtctacatgtatgtagatcatctgtaagagcgaccagtcttcttaaccactgagccatctctcctgcaacccccccccccatcttatttctgttgacatgataatctctagttctatcaaattccctgccaaggacctagtttcataatttgctgtgactgaatacttgacnatatttatttaccatgttttctttctccagtcatctactgatgggcattaagctaataccatatcctggtngtagtgagcagtgtgatnataagcagatgcacagggatctctgttntcttagagtcactctgatacaaacccggaagtgctttagcttgatcatacggtagtngtattgttaatctttgggagaacttccacattgctttccat

SEQ ID NO: 3451 - DNA, 492 bp, Mus musculus
  misc_feature (224)..(224): n is a, c, g, or t
  misc_feature (229)..(229): n is a, c, g, or t
  misc_feature (273)..(273): n is a, c, g, or t
aaggatgggaatccgctcacactggattctgcctgtaaagtttttctggcagttgcaatgatgtccacacagatgtcagaagaagaatacatccagccttgagtgtggtttttctcctagggtaggaaatgtgtgaagtttgtgatatgccttatctaggaagacctttcccttcctcacagcctgcctgtggtggtgtctacaagatactgaaatggacgaantccanactccctcccaccccactctgcccccaaaggatgaaaaaaatanaatgattcctagccttagttgaagattactttacagcatcctcatagccattcactgcttagaaacattgagcacctactgtccgcttgggaactagaggctccacagtgagtgaaagggcttacttacatagcgctggggaggggtgggaagtaatcgagagtataccagccagctgggcaacctggggtgtcaggaatgcctctaaactcatacccg

SEQ ID NO: 3452 - DNA, 527 bp, Mus musculus
  misc_feature (26)..(26): n is a, c, g, or t
  misc_feature (79)..(79): n is a, c, g, or t
  misc_feature (453)..(453): n is a, c, g, or t
cacagagccctgtggacattctaagnagagccaaactgacgctagccatggtgacatttggctagcatcagacgcctgncacgaacccagcactatgcctatccctcctggaagcctcctgtattttgaaaacaccatattggccacatttattaaagaaaatcaaaatgatcaaagtatcatgccggaagttgtggagtgacagtgacagaccccagatgcagctcaacccacactcttcaccacatcaagcaccacttcccaagagtcctcccgtgctcctgcccaacttggagtagttgactgctaaggagaactaagagtagaaccttctggaacagaatctcctgacaccatatttattcctcaatgctgagaagtaagggactgttacaagaaaaaaaagaccaaaaaccaaaaaaccaaaacattctcagcttcctgggttgacgnaaaatgtgtttactatgttgtctgtgaacacaaatctaggtatgtgctctttgtgcacagagcgcctattcagc

SEQ ID NO: 3453 - DNA, 528 bp, Mus musculus
  misc_feature (35)..(36): n is a, c, g, or t
  misc_feature (331)..(331): n is a, c, g, or t
  misc_feature (354)..(355): n is a, c, g, or t
  misc_feature (457)..(457): n is a, c, g, or t
  misc_feature (497)..(497): n is a, c, g, or t
ctccccaactcactaactgtatttttttttttaanncttcatttctttgttaatgtgatagagaaactatattccaatgcagttcactgttataggttttatggtattcttctcataaatgtgtttgtataaactcaaagatgttcatgaaacctcactacccaaatcgattcttttctctaaagctcgttggaatattgatggctgataatttacatgggtaagagacacatacacttcagagtctcttatatttcctgaactaattttgattagtaaattctcattcttcttaatgatgttgtcacagaggctgaggacccagcttctnagcaactcagtggttcaacacanncctagagcatgcatgaattcctgagttccatccacagcattggcataaagagttgtcactgggacttaactgctgagagatggctcagtggttaagagcatntcctgaggtcaaatcccagcaaccacatggtggctcacanccatctgtaatgagataagcttcccttttct

SEQ ID NO: 3454 - DNA, 478 bp, Mus musculus
  misc_feature (133)..(133): n is a, c, g, or t
  misc_feature (193)..(193): n is a, c, g, or t
  misc_feature (199)..(199): n is a, c, g, or t
  misc_feature (208)..(208): n is a, c, g, or t
gcagtatggtagcttgcaaccctcaaaaagcagccatcaaggctacccaaccttttacaggagaggcaggaggcagccaaatggagggctccccaggaaatttcttgtgtcagagcatcaaatgctcctgagnccttcagctgagaggatgaagctccctccttgatagatagcattgcatgaggtcttgctntgatanttccttctntgaggtccagccatgaagaaaggaaaaagagagcttgctggcctcttgggaaagtgtggatatagtcaatgctacacactgataggtagatagatggtcacacagaggggcattttctgttttaggttaactcaatggaatcactaatcagttgtggggggcttctcattgattttaaaggctacccgagccaataatttgttgatctacagatatttgactttttgtttttgagtaactaatttgctgcctgaaactaaaatccggttc

SEQ ID NO: 3455 - DNA, 464 bp, Mus musculus
aatgtgttcttattcctgattctaaaactttagcagctgggctttcccatgaggagaaatgttgcataaataacccagccaggaagcaggggctatgaaaaagtctaacagagtgataaatggtcttgaatatgctgcttatcacacctggtggagttacaagggactaagtggtcactggaagatcctggtgctggcatgtgccatcagcagctgcagaatctgttacctgggtcatgtgtcacccattcctcagtaactttctttcacagtgttcttctgaaacactccatctatcccatggggaccttttctgctccatccagatttgtcatcctttcatcatgtaatcagagaaaaagatggctctcagaaaacaaacgttacccttaaaatcaaacttgatttgtatataactttaaaaaagcaaatactctgtgtgtcttctacacttatccacataa

SEQ ID NO: 3456 - DNA, 422 bp, Mus musculus
gcccttggtttcactctttgtggaaagtgctaagttttgtacctcaaagcatactaggtcatgtctctatgctatatccctaaaggtccacagctatcctatctaccctgttacctaagatacacagagagtctggaaccttgttgtgaaagggtccttatttttatataatgctatgaagatgctacaaatgagctccgatgaatcttctcgactttggcacatactgtttctatgaccaggaggaccatagaaccccactccctgggaagcatccatcctgaacaacttcagatcagtatcctccccccccccccactggcctcttccaagatgccctgcggggctgagagtccagaactcacagccattttttctccctccacagtgacttcttgattcccctcctctacaagaagaaa

SEQ ID NO: 3457 - DNA, 498 bp, Mus musculus
  misc_feature (118)..(118): n is a, c, g, or t
taaaagatcctcgacactcagcagttatttaggatggttcaggaagatctcaggccgaccaggctggcagggagaactccagatgacgggcttctgagcacagaaaaagtcgaaatcncaagcaggctgatggaatcctccctctgcagtagcctgcttgggctggctcagttatccatggtggcaggagccaagggagaagagatccaaagtgaagaagctactaccggtgagacttagtagatagaggcaggccctgctctttggggcccagcacagagatgagggcctcatgagatgccagctcttctacaaagtcggtctcaccgtcttcaggaaaagccaatacatccctacttagagctgttctgagtgattcttctggcttctcccacactaatcagcttatatgttaattcagtgtttctgtggttgggtcccttataaagctgtgtttcctgagggcaaggaccaagtatgctcatctttctgtgtcca

SEQ ID NO: 3458 - DNA, 330 bp, Mus musculus
gtatgtcccagtatgtctgtatattcattcatatccctgagcatgtaaatttacatgtgtccatgtgtgtacatttgtgtgtatgtaagcccaaagacatctaatgtcatttttcaggtactacccatcaagtctctcactggccttgaactcatgaagtagaggcatttggttagctagtgagccctggggctcctcctgtcctgtctctgcctcccccacagtggcattagaccttgtttcttttcttctgacatgggtcttgcggattgcaaaaaggtccccatgcttgcaaaggaacgactttagtgactgaactatctccccagc

SEQ ID NO: 3459 - DNA, 399 bp, Mus musculus
aagctgtagaactggctcatcggataaggtacttacactgcaaatgaggcccagaattttgagtttccagaaagccaaaaggctgagcagttctggcagctgtctatagtcccaggccttaggaggcagacagacttcctgtacaagtggctcagtgggattggtaagctattggctcacagagaccctaactcaatcaagtggagagccatagaggaaaagccttacttcagctctgggcttccacacctttacacatacatgttcacccacgtgggaacacgagtacacacggcagttagagattttttttttttaatctataaaggattttggttggttggttttgagatggcgtctcactgttgcccacgatgttcctgcttccagctcttgagt

SEQ ID NO: 3460 - DNA, 431 bp, Mus musculus
tatttttcattcatacctgcatgtatgtctatgtgagagtgtcctaagccctaaaactgaggatacaaacaggtatgagctgccatgtgggcactgagaattgaaccttggatactctggaagaagtcagcgctcttaaccactacacagtacaccatctctccagtccccaaagaccagtaataatgaaactgaactacttaaaccaaaacctctttttaattcctaaatagcaatacactattagacagacaagttgttctatctcagtgcctaaaacttttttgtaaaatgaatatgtattaaatgctcagagctattttcctaaaatggctgcacagcacggtggtatgcaaggtttaatcccaacactctagagaaagacagactaacctcttgagttctaggccagcctagtctaaggaagagtt

SEQ ID NO: 3461 - DNA, 457 bp, Mus musculus
  misc_feature (33)..(33): n is a, c, g, or t
agtcagacaacaccatggatcttatgcccccantcgactcgctcatgtgcaacctgggctttgacaagttgtctctttttaaatttaatttaatatttgagccttctgcatactttggtgctatgtgggctgcagcattgatggaacaatagaagatcttgtcagcaagataataccaagcatttgaaaaccatctggggcaaagttctgaaggacatgtgcagcagatattagctctgccttgtggctggggaagctgacatccagaggtatttttaggaacttccataatgttgcttcactaggaagatggccaagatggcgtttgctcctatgtaaaatgcctttgagagccattttctctccatcacccatactgtaaataagagagcgcgcatatgtgaggaatgtggtactcatactcatctcaaaaaggtagcacctctgtactaggcac

SEQ ID NO: 3462 - DNA, 404 bp, Mus musculus
  misc_feature (102)..(102): n is a, c, g, or t
  misc_feature (241)..(241): n is a, c, g, or t
  misc_feature (251)..(251): n is a, c, g, or t
ctcagtgcgcgtagaaggcttgctaaccagcagacatcagtggacacttcagagtcagacccataagcctgcttgtcagaaaagaaaggagggagactgatnctgctctcaagatcttccagaagtgaaccaccccagacttgatgctccagctcaggctgggatcacattcctgctctttccactaaagctcaacatgcaactgcagcagcgggactggctcctgtggagggggcctatntacagttctnccccctgagacctgctgcttctgggacctgttctccacagaggaccgttcttccttgactttggggacctcctagagctgatggttataatctctcccaatctttcttgatttgtatcctgctgcaaatgagagtcttaaggtctcttccttc

SEQ ID NO: 3463 - DNA, 359 bp, Mus musculus
  misc_feature (80)..(80): n is a, c, g, or t
  misc_feature (88)..(88): n is a, c, g, or t
  misc_feature (107)..(107): n is a, c, g, or t
  misc_feature (204)..(204): n is a, c, g, or t
gaacgtgctgttttccacatttcacacccactcgccaaacttttgatacaatgggaagccttctgaaattgctttaaatntggatctntctggtgtagtaagtaagntttgtttagacttaagagtctttcatagaaatggattggtaacaacagtaacaatcccacttgtgaattaattaacatcacactgcttttccacctntgctgcctggcaagttttgtgtagcttgtttggctccaatgactcatccaagaagtgagatgaattgattatattttcatttaaattttatttagtccttgaatgtactaggaatacaatggcattctcatccttcccaacctctttgacaggaa

SEQ ID NO: 3464 - DNA, 334 bp, Mus musculus
gtggcgtggctcgtggtccaaacctgggtctgcacgccgcggctgagcgcccactcgccttgaagagtgagcggtggagaaaccagcgggggcggcggcgggagagctccccgggagtcggaggaggtggcagtcgggagcccagccagaaggagaccaggaggcagacgttggtgccttacaggcactcactcccttctccaaggatggatcctggcgcagtccggcagtttcctggcccgcccgccagagtctgaactgcggatccctattctcctgtggagcaccggactgaaggaggtacagaccgaaggatcctcctggagggacctcg

SEQ ID NO: 3465 - DNA, 278 bp, Mus musculus
tcccttcttaattccgtaaacacagtcaagccattcttagcagcctcattttggtttcttgattatttggggattcacccattagaccataagcctctttctcctctgctgactgggttctgtgtctctccatagctcagagcctgagccagcaccgtgcagagttactgttagtgtgcccccgtgcccagttgccgccctgaaaaacattacaatgttacatgactgtggattaaaaacagacgctgtctgcttcccacatgtaccctagacaggtt

SEQ ID NO: 3466 - DNA, 354 bp, Mus musculus
  misc_feature (75)..(78): n is a, c, g, or t
gactcgctttaaatattcctgtgttcacatgtataacaatgcattttgtttaaatcatcataaaactggaagaannnncatgaactaccaatcaatagttctagtatttaacccatgtaccactccatagctctgcatatctgcattgctcatgccttactaatctgcatattcttgtgttttattttcagggaaaagcagtatgacaatatagcaatttacaaaatagatgaattaaaatagaagatcattttttccataaatctgagcctgtagagctttcttaaaattttattaccaaaagaaatcagcatagatgcagcttggcatgtggatgaatgtgcttgcccaccc

SEQ ID NO: 3467 - DNA, 220 bp, Mus musculus
  misc_feature (34)..(34): n is a, c, g, or t
  misc_feature (39)..(39): n is a, c, g, or t
  misc_feature (170)..(170): n is a, c, g, or t
tactccagctataagctttctgggcagagaaaanctggnaattgatatcttttatatactctgcataacagacatgaggtaccagtgaagttatgcagaccagtacctgggtcaatatgatttaagtgacttgaactgggttcaaactctgtcttctccatgatcactantagctgcctccatccactatgaagaatacacttaacagtgatcaggtggg

SEQ ID NO: 3468 - DNA, 304 bp, Mus musculus
ccaataggtctctctctagtgagaacaacttttttctaaagcgtgataagtatcctctgagcaagtttatccacagaataacatgcagggcaggaggagatgcctccactatcgtcttcaatatttgtggaataacaactggaagccctggtgtcatttttttttaaaaagttctctctcatttgctgttgatgtctcacacttcagccttagactttcctggaacttgctgagtagcccaggctagcttcagactctcggcttcaaaataactgggatgactgggtgtgagcgaacacactca

SEQ ID NO: 3469 - DNA, 115 bp, Mus musculus
  misc_feature (39)..(39): n is a, c, g, or t
  misc_feature (70)..(70): n is a, c, g, or t
ccctccagaccaaggttgggtggctagagacctaggctnttctttccctggaagatgctccctcttcccntctttgctttttactgccctccctttgttcgtgctatgaaatgac

SEQ ID NO: 3470 - DNA, 485 bp, Mus musculus
  misc_feature (349)..(349): n is a, c, g, or t
  misc_feature (451)..(451): n is a, c, g, or t
aatgtgaggctttaccactgtctgagcattctagtttgcttttagtgcagtcaaacaccgatcaaaaccaatgtatgggaagaaagggtttattttcatgaaagaggtgtagtccatcaccacgggaagcaagggcaggcaccccgaggaaccccgaggccactgaggaactctgcttattcgcctgttaagctaactttggtatacaccacagtgtataacaactatcatgggatctttctgcccatcatgggctgggcccttccatatcaaacaacaatagagaaaatgctcccaccgacataaccacagagccagctgatggagacattttttaactgaggtcctntctttccgagttattctagtttgtgtcaagttgacaaaaccaaccaccaccctgcgattatgcctactgtctatgaagttacagtcaaagcctctttacagnatgtattgggggcatttgtccgatttatacctca

SEQ ID NO: 3471 - DNA, 524 bp, Mus musculus
  misc_feature (150)..(150): n is a, c, g, or t
  misc_feature (171)..(171): n is a, c, g, or t
  misc_feature (297)..(297): n is a, c, g, or t
agatccactcgagattccggaggcggggtggggtgaggtgaggtggtgtacttctaatgccttcggactagcttgcgcatcctgttttcttgaccctgctggcagtcactgtcaagctccagacgtggaatgtcactcgagacccaggcntatctcaagctctcatttagnccaaggtcgagcacctggattctctactgcctccctgttctctcgactgggatcggtccgggtctgctaaaggggtctgaaagctcccggaactccaggtaagggttgcggagagcagcgggaatnggtgtgtggctgtgctgggaattaagccgtttagaatacaaagaaaaggagtaaaagacagaaatcaaagataatttcctcggtgacaaaagaaaaatgttccgactccgccgggactcgaacccggaacctttgaatgccttcagcctctagaagtccaatgcgctatccattgcgccacggagccacctgttggaggttccgcgcatctgccgtattaagctaga

SEQ ID NO: 3472 - DNA, 398 bp, Mus musculus
  misc_feature (118)..(118): n is a, c, g, or t
  misc_feature (252)..(252): n is a, c, g, or t
  misc_feature (256)..(257): n is a, c, g, or t
  misc_feature (268)..(268): n is a, c, g, or t
  misc_feature (282)..(282): n is a, c, g, or t
  misc_feature (291)..(291): n is a, c, g, or t
  misc_feature (319)..(319): n is a, c, g, or t
  misc_feature (321)..(321): n is a, c, g, or t
  misc_feature (326)..(326): n is a, c, g, or t
  misc_feature (328)..(328): n is a, c, g, or t
gcaagtccccactgtcctgatgatgctgtttcttcctgcactctgggacgtgggtctgcagctcacagtctttgctggtttgtatttaaaagtcacagcagccactgttggcgacttntactagaactctgttcacagccaatctgaaactttaatattgagccttcaataaattctggatagagaaattgatttaaaaaacaaacaaagtgtgtgccttgggtgttctgaactaatctgcataaataccanactnnaactgtacatntgataagaagatcnatgtataangtagctgatttaaacaaaatagttctantnccttntnttctgaactggaagcccatagcaatgcacaacctaaagaaacaaagcccgactggagaactgagtgctga

SEQ ID NO: 3473 - DNA, 263 bp, Mus musculus
taaaggagccaatcactgagcgagtaggcgggtcttctgggttggagggagggagagaggtagcaggagagagttaggtcctcttggaacagggacagcatatgggtaagatggagcctctagagttttcctgtatcatggcggatctgcaagggtccaccacggaaggaatcagattttaataaggctcgcaaaattaggttttagttgttgtgcccagagattgagttacaattgtttctgaactaagtttgtgttgcgtt

SEQ ID NO: 3474 - DNA, 536 bp, Mus musculus
  misc_feature (294)..(294): n is a, c, g, or t
  misc_feature (296)..(296): n is a, c, g, or t
  misc_feature (308)..(308): n is a, c, g, or t
  misc_feature (364)..(364): n is a, c, g, or t
  misc_feature (380)..(380): n is a, c, g, or t
  misc_feature (393)..(394): n is a, c, g, or t
  misc_feature (406)..(406): n is a, c, g, or t
  misc_feature (423)..(423): n is a, c, g, or t
  misc_feature (425)..(425): n is a, c, g, or t
  misc_feature (429)..(429): n is a, c, g, or t
  misc_feature (434)..(434): n is a, c, g, or t
  misc_feature (439)..(439): n is a, c, g, or t
  misc_feature (443)..(443): n is a, c, g, or t
  misc_feature (453)..(453): n is a, c, g, or t
  misc_feature (479)..(479): n is a, c, g, or t
  misc_feature (500)..(500): n is a, c, g, or t
  misc_feature (508)..(508): n is a, c, g, or t
ggaacccagggataaacaatgtagtatgtatactcaatactgagatcagagaaatgcaaaagatctggtggcagtagagagatatttctagaaagaaaagttaaacattatagagggatggaacagaacaagcgataggaaccaaagccttaccaatgagaagtggtcccatgtgtccacttcaagaaagccaaggctacattttaaaactcagcttctgcatttcaagtagaagcaagacatgatgatttaagttgcacaggcatgcctccaaaggcttcatggaatctctcntnagaagtaagttntcctaggatgactgaaaattttcttagatgacacacacatacctctattgctcttnccttgacaagacgacnaaccaaagagatnncctctgacctcngtatttcagaatccagnanacantgaancagancctntgagaggcantcctgagggggtggaaacctggattntaaggaccatgcccatgcttntcaggctnccacaatcatgaggatgctttaagctgc

SEQ ID NO: 3475 - DNA, 551 bp, Mus musculus
  misc_feature (157)..(157): n is a, c, g, or t
  misc_feature (187)..(187): n is a, c, g, or t
  misc_feature (197)..(197): n is a, c, g, or t
  misc_feature (206)..(206): n is a, c, g, or t
  misc_feature (211)..(211): n is a, c, g, or t
  misc_feature (217)..(217): n is a, c, g, or t
  misc_feature (323)..(324): n is a, c, g, or t
  misc_feature (395)..(395): n is a, c, g, or t
  misc_feature (431)..(431): n is a, c, g, or t
gacgtcctgtataagcatcattgctgacagacagtgccctttactattcctctggaagcccctcaactcagctcctgatctggaaaactgctggcttgtatgtcctgccagcttgccactcttgaccatgaccccactctgttgtgtgtgtctgggnccttgtgcctacacctcctgactggttcgncttcagtggntttccaagntctgnaagacnaggaaacatttgctaatcactaaattcttctgtgattttctcattccatggctgtaggtatttggcccaatgcttcttcttgtggctctctttactgcctccaaannacaccagcttccactccctgtgccttcctcataccttcagacctatatgcagttagtgttctggccactgngctcaatgggagctccacagtacttgctgatgagancacctccaacaggtggccactatgctgtatgtcattcatcatgttaacttcagggacacatgtctcatggtttggaatgtaaaagatttaaacaagagtgtgtcaatatctttccatcac

SEQ ID NO: 3476 - DNA, 512 bp, Mus musculus
  misc_feature (50)..(50): n is a, c, g, or t
  misc_feature (56)..(56): n is a, c, g, or t
  misc_feature (61)..(61): n is a, c, g, or t
accttacgtaatcaccgtgctgggtccttggttgttattctgacatttcnagtttncgctngccttttcccgtgagtcctggaataactgaaccatcatccattaaggctctcccgatactgattctttagtaagtcactctgaattcttttgtgaagtcacccttcgtcactatcatcaaggaggtgtaacaagacatgaatatgtctctgcccctcgctgccctctctgtcgccttttaatctagccatcgggatgatgggatgatccacagagcgctgaatcagggccagcttcgcatgccatgtttaatacggtattagtgtgcagaagctgtgcagcccgataaataataagtaataaataatagcataagcatcgttggcaatggtatattgagtttatgagtccatttaattaggccgtatcaagaatatttttccacccgcctgtccctgtaatctgctgagaactcagataacagtaggtttattagcacgtcaatcctgccc

SEQ ID NO: 3477 - DNA, 487 bp, Mus musculus
  misc_feature (325)..(325): n is a, c, g, or t
  misc_feature (343)..(343): n is a, c, g, or t
  misc_feature (352)..(352): n is a, c, g, or t
  misc_feature (356)..(356): n is a, c, g, or t
  misc_feature (363)..(363): n is a, c, g, or t
  misc_feature (367)..(367): n is a, c, g, or t
  misc_feature (384)..(384): n is a, c, g, or t
  misc_feature (388)..(388): n is a, c, g, or t
  misc_feature (414)..(414): n is a, c, g, or t
  misc_feature (432)..(432): n is a, c, g, or t
  misc_feature (435)..(435): n is a, c, g, or t
  misc_feature (437)..(437): n is a, c, g, or t
  misc_feature (440)..(440): n is a, c, g, or t
ctctgcagaagagccacgaaggtgtacaagtgtttcactgctgtgtacggtgtgcaccacatgcgtgcctgaggcctaaggaggccagaagagtgcatcacattccctgagactggagttataggtggctgtcttagttagggttttactgctgtgaacagacaccatgaccaagcagaaccagagaggaccggttagagatctgcacagctcagaagaagaaagggaggaaagaaaggtggaatctccatatactgtctggccctatagcctcaggctggctggggatgctcctgccatggcacactggccttggataaactgncccctgggccaccatganacagcagcnagtnccacctntgancacatgccctaagtgtntacntatgtcctgatgagtcacccagactnctcacccactacccctgnagntnatntgctgggtccccagcaacttggtatgattcacccttgttctgcagtt

SEQ ID NO: 3478 - DNA, 514 bp, Mus musculus
  misc_feature (32)..(32): n is a, c, g, or t
  misc_feature (40)..(40): n is a, c, g, or t
  misc_feature (43)..(45): n is a, c, g, or t
  misc_feature (51)..(51): n is a, c, g, or t
  misc_feature (54)..(54): n is a, c, g, or t
  misc_feature (57)..(57): n is a, c, g, or t
  misc_feature (66)..(67): n is a, c, g, or t
  misc_feature (70)..(70): n is a, c, g, or t
  misc_feature (76)..(76): n is a, c, g, or t
  misc_feature (81)..(81): n is a, c, g, or t
  misc_feature (83)..(83): n is a, c, g, or t
  misc_feature (89)..(89): n is a, c, g, or t
  misc_feature (107)..(107): n is a, c, g, or t
  misc_feature (188)..(188): n is a, c, g, or t
  misc_feature (230)..(230): n is a, c, g, or t
  misc_feature (257)..(257): n is a, c, g, or t
  misc_feature (259)..(259): n is a, c, g, or t
  misc_feature (261)..(261): n is a, c, g, or t
  misc_feature (263)..(263): n is a, c, g, or t
  misc_feature (270)..(274): n is a, c, g, or t
  misc_feature (276)..(277): n is a, c, g, or t
  misc_feature (279)..(279): n is a, c, g, or t
  misc_feature (289)..(289): n is a, c, g, or t
  misc_feature (306)..(306): n is a, c, g, or t
  misc_feature (310)..(311): n is a, c, g, or t
  misc_feature (316)..(318): n is a, c, g, or t
  misc_feature (329)..(329): n is a, c, g, or t
  misc_feature (333)..(333): n is a, c, g, or t
  misc_feature (357)..(358): n is a, c, g, or t
  misc_feature (398)..(398): n is a, c, g, or t
agctgtgttctcatattgtgtccctgaccccntgtggttnccnnnaattcnttnatncccctcctnnggnggatgncctangntccgcntaatgtttgcttgctcgnactcccatcagttgctgaatgaagtctgaaaaaataactttctacccagtaataaccattatttccttggactatcacccntagaaggaatcagtcagaatatatctatctgtatttaagggntggcaagctggtactgtagttagaacnancnanccaaccnnnnntnncnttgaaaccantgtgaaccagagttctnatcnntcagnnncccagataaantgantgagtaggcttggcagtctgcttnnaacccaagcccagaaggtggagacagatgatccccagagnagcctgttagccaagacttggcatgtcagtgagctcttagtttgaccaagagaccctgtctcagtgagtaaggtggaagagcaaagactcctaacagcatcagtgtctggcctcta

SEQ ID NO: 3479 - DNA, 562 bp, Mus musculus
  misc_feature (217)..(217): n is a, c, g, or t
  misc_feature (229)..(230): n is a, c, g, or t
  misc_feature (236)..(236): n is a, c, g, or t
  misc_feature (246)..(246): n is a, c, g, or t
  misc_feature (273)..(273): n is a, c, g, or t
agaaactaccattaccctgtgactctttgaagtaccgttttttgtttcaacttcacacaacctatagtctcctgggaagagggactctcaattgaagagtcatcttgatcagattggcctgtggacatgtctgtgagagattgtcttgattgctgattgatgtgtgagagcctggctcactatgggcagcactatccctagggaggaggacttgggnctctattagaannctaccngggcatgagnccagtgattgagccagcattccttcanggtttctacctcaagttcctgccctgcttaattaagttcatgccttgacgttcctcagcaatggacgacgatctggaaggaataagatgtagaactctcacctccttcaacaccatgcctgcctggatgctgccatgtttcctgccttgatgataatggactgaacctctgaacctgtcagccagccctaattaaatgttgtcctttgtaatagttgccttggtcatggtgtctcttcccagcactgaaaatgataactaagacgtctttccccatttacacttatgtg

SEQ ID NO: 3480 - DNA, 466 bp, Mus musculus
  misc_feature (83)..(83): n is a, c, g, or t
  misc_feature (94)..(95): n is a, c, g, or t
  misc_feature (110)..(110): n is a, c, g, or t
  misc_feature (121)..(121): n is a, c, g, or t
  misc_feature (171)..(171): n is a, c, g, or t
  misc_feature (181)..(181): n is a, c, g, or t
  misc_feature (183)..(183): n is a, c, g, or t
  misc_feature (189)..(189): n is a, c, g, or t
  misc_feature (202)..(202): n is a, c, g, or t
  misc_feature (211)..(211): n is a, c, g, or t
  misc_feature (214)..(214): n is a, c, g, or t
  misc_feature (258)..(258): n is a, c, g, or t
  misc_feature (330)..(330): n is a, c, g, or t
  misc_feature (334)..(334): n is a, c, g, or t
  misc_feature (357)..(357): n is a, c, g, or t
  misc_feature (361)..(361): n is a, c, g, or t
  misc_feature (367)..(367): n is a, c, g, or t
  misc_feature (385)..(385): n is a, c, g, or t
  misc_feature (407)..(407): n is a, c, g, or t
  misc_feature (439)..(439): n is a, c, g, or t
agctcctgcgggttggcctgtgtactgggtacatgccaagtccagaatcttagccatcgcctgtggcagcttgtccggccagntggccggcggnnactcagctcctgtgnatcccagcagnccccacagttatggctgaggtgggtcctaggtactccatctggagtgctntgctctgatncnagagcngcagctgagctcnataccttgnccngattctctggagctcctgcttgtagccattcctcgtggctttgnataccctaaacctatgaggatatgtggatctaggctgtagaatctgcaccgacaggggcctgcgcatctcanaacngtgtacactcagggtacaggtgnttgnaagaantgctgccaatatcatagnccaccaagaactcgaggaggcntgtacctaaagaaatgggcaaaagctagaatnttaaatgcatctctacctatgaataag

SEQ ID NO: 3481 - DNA, 532 bp, Mus musculus
  misc_feature (189)..(189): n is a, c, g, or t
  misc_feature (194)..(194): n is a, c, g, or t
  misc_feature (297)..(297): n is a, c, g, or t
  misc_feature (303)..(303): n is a, c, g, or t
  misc_feature (315)..(315): n is a, c, g, or t
  misc_feature (319)..(319): n is a, c, g, or t
  misc_feature (327)..(327): n is a, c, g, or t
  misc_feature (333)..(333): n is a, c, g, or t
  misc_feature (337)..(337): n is a, c, g, or t
  misc_feature (344)..(344): n is a, c, g, or t
  misc_feature (363)..(363): n is a, c, g, or t
  misc_feature (372)..(372): n is a, c, g, or t
  misc_feature (382)..(382): n is a, c, g, or t
  misc_feature (394)..(394): n is a, c, g, or t
  misc_feature (410)..(410): n is a, c, g, or t
  misc_feature (455)..(455): n is a, c, g, or t
  misc_feature (464)..(464): n is a, c, g, or t
  misc_feature (477)..(477): n is a, c, g, or t
atgcctatttgttttactccctcaaaatggcctgaccccagtgaatacatttgtgactgctcatgcattcagtcctgtctctaggcaagtctgtatcaggctatcctaagctcaggtcctgaaaaacattacctccctgctatgtgtacccaacaggtaactcattgttacttatattaaacaactcantgaanatgtgaacaaacactggaactgtcaaaattaagaactttgaagcctcctaataaaataccatgatgataaagtcatcaattactagtccatctatgttacatntcctanaaattcctgaantctnacttttcnttctancttntccaatnctgtacctcaaagggcttngacaaactncacttggttnattgtggcaacngtatttgtaatgaccngtcactgtggtttccacaaaacactttgaggatagaccattattntacatcatnccttctgtcagtnaccattctaaagcaggtagagaaagcatcaaagctctgagcggtttctttttctt

SEQ ID NO: 3482 - DNA, 511 bp, Mus musculus
  misc_feature (306)..(306): n is a, c, g, or t
  misc_feature (417)..(418): n is a, c, g, or t
gagaagttggcaccactcttgttgagtcacttgccctcttcgggctcctttattacccacacatgaaagaagagagacacagagtgggagcagagctctaacaactctccaagtgtagcactctacaacatttcaagtaacatagttcagtcaggctatacagagaagggaaagggcaaagatgtgattaagtatggtgacagcagcagccttcacatagctaagagttagcactaggacatttcgatcatgcagagcaactgttaggaacttctgtctaacaatcacaaacaggtttgcggtcancctcaacatgtgcgctgtgcattctatagtcaatttggaaagatctgctcaattatttttcaaaacaaaaatttcaatccagtaaattaatatgtatacaagtcagacaannaaaacacagatactgtacaatagtgtgagagactatgaaatggcaatacttttttaaaccacagatttgtaatatatttgttcactgtgcaga

SEQ ID NO: 3483 - DNA, 515 bp, Mus musculus
  misc_feature (330)..(330): n is a, c, g, or t
  misc_feature (334)..(334): n is a, c, g, or t
  misc_feature (342)..(342): n is a, c, g, or t
  misc_feature (364)..(364): n is a, c, g, or t
  misc_feature (370)..(370): n is a, c, g, or t
  misc_feature (379)..(379): n is a, c, g, or t
  misc_feature (421)..(421): n is a, c, g, or t
  misc_feature (425)..(425): n is a, c, g, or t
  misc_feature (433)..(433): n is a, c, g, or t
  misc_feature (472)..(472): n is a, c, g, or t
  misc_feature (481)..(481): n is a, c, g, or t
tgaaacaatccatttctcttggaaaaaaatgacaagctttagatgatgaaagcttaaattatccatcacttgcaaaatgaattcatataatttgtgaacattattaatgtaaatgagacatttctgcttagatttttttttattttgatgggatcattatatggttgatcatatgtgtgtaggaagctgctgtacaattaacttggagatctgaaaatgctttttgtcctcattgttacagtttcaattgtaatccattgcatctcattttcttgggtgttggcactgtaatatattaaaaaaaaaaatcagtgctcagtattgtaactnactntccctacngaatattccttttcataaatanttgctnccacagggnaattaagttttcatatagaataactagtttcagtagtaagcnttgnaaaattanaaatgtggttcaaggcagatatttttatgaaaagttttntctattgtnaaatttgttgtatatggctatgctactatcatgg

SEQ ID NO: 3484 - DNA, 504 bp, Mus musculus
  misc_feature (150)..(150): n is a, c, g, or t
  misc_feature (185)..(185): n is a, c, g, or t
  misc_feature (207)..(207): n is a, c, g, or t
  misc_feature (296)..(296): n is a, c, g, or t
aacctgtgaacctgcctgtacttggtccctcatgtaagtgtatgcatccgtctcttcatgtctgtctcacctcacgtggtgtggtctctgtggaagtgtatgataagatctttattcctcactgtggctgaataatattccattgcattnccttagcacatctcgtttcgcttctccatcccatngcaggtctgaagtgtttcttantgcgtgatgcaaacaatgctgctatgaacacgtgtgttcaagtctttatgcgaaagtgttttacatagtttatgtacatagagaagagntactacttccagacggtacagtagtttaactggatctgaggagctgcttttgtgtcccgagcccctgttgactacctctgccctgaggccctgtctcagctgatccttggtttttcaagtaggttcttactggtgcgtgagtgagtgagtgagtgagtgtgcatgcgtgttttttttcaagacaggtcttctctgtataacacctcgg

SEQ ID NO: 3485 - DNA, 538 bp, Mus musculus
  misc_feature (27)..(27): n is a, c, g, or t
  misc_feature (178)..(178): n is a, c, g, or t
  misc_feature (215)..(215): n is a, c, g, or t
  misc_feature (385)..(385): n is a, c, g, or t
  misc_feature (391)..(391): n is a, c, g, or t
  misc_feature (404)..(404): n is a, c, g, or t
  misc_feature (406)..(407): n is a, c, g, or t
  misc_feature (420)..(420): n is a, c, g, or t
  misc_feature (423)..(423): n is a, c, g, or t
  misc_feature (452)..(452): n is a, c, g, or t
  misc_feature (454)..(454): n is a, c, g, or t
  misc_feature (509)..(509): n is a, c, g, or t
aacgcctataagtcaggacctgggagnctggcgcaggaggatcaggaattgaacgctagcctgggcaactaaaaaacaaacaggaagaacataagaatgtaagggcaagaagagggaggtttgttaggtgggtgaaatggggcctgagaaccagaggtatagattcctcagaaaaaantgtcgttgggacttgagtatgtgtaccttttgagaangggaaaggagggaaaaatgacaggattcttcctgtctcagctgaaattgtgggagcttctccgatttggagaactaggcaaattcaagtctggggaggccatcagcagtataattaagtaagaaacaaaggtccgaaaggcctaagtgggggacttgtaaaaggcagctngccggnccggaaccgggangnntctggactaaagntgntgatttttaggccattgtggttgaaggcntnaggctgattcccacaagacatacttaaagagatccatggttgtaattccagcacnaggggattgcaccaggctgactgagagtt

SEQ ID NO: 3486 - DNA, 545 bp, Mus musculus
  misc_feature (143)..(143): n is a, c, g, or t
  misc_feature (240)..(241): n is a, c, g, or t
  misc_feature (244)..(244): n is a, c, g, or t
  misc_feature (249)..(249): n is a, c, g, or t
  misc_feature (296)..(296): n is a, c, g, or t
  misc_feature (303)..(303): n is a, c, g, or t
  misc_feature (305)..(305): n is a, c, g, or t
  misc_feature (323)..(323): n is a, c, g, or t
  misc_feature (325)..(325): n is a, c, g, or t
  misc_feature (333)..(333): n is a, c, g, or t
  misc_feature (358)..(358): n is a, c, g, or t
  misc_feature (387)..(387): n is a, c, g, or t
  misc_feature (397)..(397): n is a, c, g, or t
gctttttatccttgcaacatcctagttgacaagtctatagggaacatacatctactggagaatataataacggttccacagttaaccacgcggtcctttgtggtatccatgctcttagaaccaaagaataatcttggtgttgntgtctcacaaaggaacatgtgaaccaagcagaagtaggtcagtgaggcacttgtttttaaaaaggtgcgtaagaacccagactgggtgggcaagctnngangggcncgaagtgcccttgattctgattaaatgagggtggtgacggtgttttncccattntntgggggctgacttcatgntntttcaacnttggttagttttacaagattcaagncaatggaggtgagggaagggacaaagcantcgttacatnaaagtttgattgggtgggaatattaaagcatttatataaaggtctacaagggaaaagataaaaagatttgcataaaagtcttaaaaaggtgagagaaataaaaagaattgaattctttgtcctaattaggttctatagtgtttgacag

SEQ ID NO: 3487 - DNA, 402 bp, Mus musculus
  misc_feature (373)..(373): n is a, c, g, or t
agaacaagacatagcccacatccgggtttctggaatattcagatcaagctaagttcattgatcaatttcacttaaaatgacagtgtttaccagctgttggtcccagaagctgttggccagtatggcatttacacatactttgatgacatttcgcttttaaaacttggattcctgcacataggcaacactgaaatacatttcagtgtagaagagttgaataatatcaagttacgaggtagaaacaggaagcttccgctttaacttgtttgccttttcccttccaggcctcatagcatgcacatacatgcctgcatagctgcagatgcatagctccatagcttcatagctgcatagctgctggtgcatatagttntaataaacaccgtgggatcatactacatg

SEQ ID NO: 3488 - DNA, 368 bp, Mus musculus
  misc_feature (292)..(292): n is a, c, g, or t
  misc_feature (296)..(296): n is a, c, g, or t
  misc_feature (300)..(300): n is a, c, g, or t
  misc_feature (302)..(303): n is a, c, g, or t
  misc_feature (307)..(308): n is a, c, g, or t
ctgtcattcgctgatcctttatgtaacaatacagagaaaggctcttcttgaatggctgattggcttttccaggtaatacctagatagccatcctcctccatcatttccacctgacaaatgggcatctttcttgaggagatatgcagtacacaatttgaacactagtaatactcaatttccatcctcctgtggagaattccataaatctctgattagtgtttgccctctttggaataaacttctaattgatatctaaagattgctgcttgcaaattaaattacacttctcttntccnttangnnaagnnacatcacccagacacttctcctgagcacacattcctcctctgactctcaggcggtgattc

SEQ ID NO: 3489 - DNA, 284 bp, Mus musculus
  misc_feature (76)..(76): n is a, c, g, or t
  misc_feature (216)..(216): n is a, c, g, or t
  misc_feature (220)..(220): n is a, c, g, or t
  misc_feature (236)..(236): n is a, c, g, or t
  misc_feature (257)..(257): n is a, c, g, or t
  misc_feature (259)..(259): n is a, c, g, or t
ggagccagtttgcaactgataatgcacttaaaaagaaaaaagaataaaagctcgtttaaatacagtcaaggaggcnggggggagagttctgtgggtaagaccacctctgcacaagcataaggacccgctgttagaccctcagtgcccatgacataggccagatacacctgtctgatagtccagcactgggcgtgtgtggcagggagcagactttgngacnggacagtatctttcanctccaaatttaatgaggattntntcccatgttagtaaagtgtagagtg

SEQ ID NO: 3490 - DNA, 292 bp, Mus musculus
  misc_feature (28)..(28): n is a, c, g, or t
  misc_feature (70)..(70): n is a, c, g, or t
actggaagattggagctaccattaaatncaggaaggtccttgatttctaagtatgaattctgagcttganctgtagaatccacatttaaaaggccaggaataaaggcaaccatgtctaatctaagtggctggaatgactgagacaagcaggatgctgggcttactggacagcctgactaatataatctgtgatttctgagaaaagacgtgactctgtctcaaaactcaaggttgacagcttaagaagtaaccctgagtttgacttctgaccttgataaaatcatgcactcat

SEQ ID NO: 3491 - DNA, 533 bp, Mus musculus
  misc_feature (270)..(270): n is a, c, g, or t
  misc_feature (344)..(344): n is a, c, g, or t
  misc_feature (350)..(350): n is a, c, g, or t
  misc_feature (378)..(378): n is a, c, g, or t
  misc_feature (382)..(382): n is a, c, g, or t
  misc_feature (395)..(395): n is a, c, g, or t
  misc_feature (443)..(443): n is a, c, g, or t
  misc_feature (449)..(449): n is a, c, g, or t
  misc_feature (456)..(456): n is a, c, g, or t
ttccccgggagatctgccagtcaaaagcggagggtggttcttccggaatgcattttcctgtttccctgtgggacctgcctgtcataagaggagggtggttcttccggaacccttttctctggttccctgtaattaagcaggcttaagtgatttctcctgtgtgctgctgggtactgtgaaggaaactcaggcaagttctgaaagtgcgacatgatgaggatattgtcacttcccacagaggtgaggagcgggatcgggtgtgctgggtcntacggaaggctgggtcggaaccagcagctacatgcaggcacctgtgagttgcctcgtggttttagccgcttctngacccnacggtggcacctgcataacttcgctatntggnctgaatattcacnaaacctttcgagcagggtcctgtgtatagaaacacccttagcaggatnccaaantcagacnggctaagtttctttcgtgtattctacaagttcttctcttggcatttagcattttggttgtcattcatttcgagttaa

SEQ ID NO: 3492 - DNA, 429 bp, Mus musculus
  misc_feature (212)..(212): n is a, c, g, or t
  misc_feature (316)..(316): n is a, c, g, or t
  misc_feature (401)..(401): n is a, c, g, or t
ttctctcttgactccacttacaggtggtgtggagatcctgccttactcaagtctttgaagcagaaaagtgctgtggtcaggttggttttactatttaaatcttttcgatatatccagaactgtgtttctaaaatgcttggctggtttgccttaattctagcctgtcccctttattctcagttcactgtttcctggatatctgttggtctttnccgccagatatcaggtttttcctacactgatttttttctcagaaatggttatccttccttcttaaattgtcagaagccaccagctccactggaggaatcatccntgaattggtacctgcctgtcaaaaggcaacggagcttgtgtctgggagctgctggtttactaaagccaggaggtggtggtttacnctgttcatataaatcagtttccccaccc

SEQ ID NO: 3493 - DNA, 424 bp, Mus musculus
atttctttcatcacattcccagtgggtcataagtttacacacactcaattagtatttagtagcatttcttttaaattgtttaacttgggtcaaatgtttcaggtagtcttccacaagtttctcacaataagttgggtcaattttggcccattcctcctgacagagctggtgtaactgagtcaggtttataggcctccttgcttggacatgctttttctgttctgcccacaaagtttctataggattgaggtcatggctttgtgatgaccacaccaatactttgactttgttgtccttttttccatcctcatgatgccatctattgtatgaagtgcaccagtccctcctgcagcaaagcaccccctcaacatgatgctgccacccagtgcttcacggttgggatggtgttcttcggcttgcaagc

SEQ ID NO: 3494 - DNA, 526 bp, Mus musculus
  misc_feature (231)..(231): n is a, c, g, or t
  misc_feature (247)..(247): n is a, c, g, or t
  misc_feature (251)..(251): n is a, c, g, or t
caggctctgtagtggatctgcccaaggttgccatagtgatggttaagccttgttggtcattctggaactgtgaccctggacagagagagcagaggatgactgtcatttctgggaagcagctgcaaaaatatcgtgatctctgggctgcaatccattatggttgtggggtggggtcgggctggaccaggggccactgtagcatctcaactatgctccagaaggttgtctagnagacagagctctgtgngcanatggaccaggctaatctatcaggctgggttaaactaccacactcaaagtcctcacaaggccctggaagaggaaaagacctggccagctacaaagccaaactcatccccggggctggactacgaatgtctgtggaagactctggcctccagttaaagacaaggcaaatactcggaagagagatgactacacttgaattctagccttgacactttccagaagtgtgactctggttacgtgctgcctataggtaacaccttccggactttacatgaat

SEQ ID NO: 3495 - DNA, 493 bp, Mus musculus
  misc_feature (83)..(83): n is a, c, g, or t
  misc_feature (85)..(85): n is a, c, g, or t
  misc_feature (94)..(94): n is a, c, g, or t
  misc_feature (96)..(96): n is a, c, g, or t
  misc_feature (102)..(102): n is a, c, g, or t
  misc_feature (112)..(112): n is a, c, g, or t
  misc_feature (114)..(114): n is a, c, g, or t
  misc_feature (122)..(122): n is a, c, g, or t
  misc_feature (126)..(126): n is a, c, g, or t
  misc_feature (137)..(137): n is a, c, g, or t
  misc_feature (163)..(163): n is a, c, g, or t
  misc_feature (183)..(183): n is a, c, g, or t
  misc_feature (192)..(192): n is a, c, g, or t
  misc_feature (195)..(195): n is a, c, g, or t
  misc_feature (199)..(199): n is a, c, g, or t
  misc_feature (205)..(205): n is a, c, g, or t
  misc_feature (267)..(267): n is a, c, g, or t
  misc_feature (308)..(308): n is a, c, g, or t
ttcatcagtctgcatcaaagatactaaaactcacagatgagagcttcctataggcacaagatagaattttcaagatggagttncncaatccaangnattgtntcaggcttgnantctccatnaaancccattcctcngagctcaggaaatcatgtggaagagnagaatggaagactgcaaganccagagggnagnagangacacngggaaaacaaggccttctggatcaggatgcaggaagcataagcgtttacagagattgacccngcatgcagcagctcatctgcacttaggttatcgctatcagnattggtgtattcatgggactcctgactttgagaactcatgtgcctgcccttgggactccttttctcttattggttgctgtgtccaatttcagtatgatagttttttctcatggtattatgttttattttgccactttctggttgccctctcttagaggcctgctcttttctgatgtgagacaatt

SEQ ID NO: 3496 - DNA, 459 bp, Mus musculus
  misc_feature (101)..(104): n is a, c, g, or t
  misc_feature (106)..(110): n is a, c, g, or t
  misc_feature (124)..(124): n is a, c, g, or t
  misc_feature (153)..(153): n is a, c, g, or t
  misc_feature (160)..(160): n is a, c, g, or t
  misc_feature (191)..(191): n is a, c, g, or t
gcatttgtgtaactctatgtgaatttatgtgtttatgcatattttcttatgcaaaatttttccttctgtgagcactattctcttcttctcatccaatagannnntnnnnntccatgcttccccntagactgagaagtaagaggcatctggacnaaagagnaaagtctctagcaattaattctttacttaancccatgctattttaggatgaggtgttaagtgccagagaccacagtttcgggtctcagagaaacacaggaggcaggtcagctacagcagcaaagtaacttagacttagataagtaaactttttattattatacagcaactctagatatcttgaaagacagtcttacccctgtatcttgtaatatgaagacttacactccactgatgatctccccactctgctgcctcaccaaaacaaacgaaagagaagaacctgccagggctggccac

SEQ ID NO: 3497 - DNA, 347 bp, Mus musculus
  misc_feature (126)..(126): n is a, c, g, or t
  misc_feature (134)..(134): n is a, c, g, or t
  misc_feature (153)..(153): n is a, c, g, or t
  misc_feature (156)..(156): n is a, c, g, or t
  misc_feature (181)..(182): n is a, c, g, or t
  misc_feature (188)..(188): n is a, c, g, or t
  misc_feature (194)..(194): n is a, c, g, or t
  misc_feature (200)..(200): n is a, c, g, or t
  misc_feature (208)..(209): n is a, c, g, or t
  misc_feature (213)..(213): n is a, c, g, or t
  misc_feature (227)..(227): n is a, c, g, or t
  misc_feature (240)..(240): n is a, c, g, or t
  misc_feature (264)..(264): n is a, c, g, or t
  misc_feature (277)..(277): n is a, c, g, or t
gactatacgaaaaggctctacctctgaagagcatcactgggacatagaacttagcgtataggttctaggaagacataagcttgttgcataacaaatgatatccaaagatggagtcgtctacttcanttctacanttttccttcgtggctgaantgnaaatgactttggagagttgaccctnnatgaanccgctnagctanatccattnnttanttttgctgggttgnatatctgttccanagatgactgctttgtgtgacaacnaacggttctactntactactttcagttggatgcctttcctccggttcactttgtatgctggctgctgtagctggaattccagt

SEQ ID NO: 3498 - DNA, 313 bp, Mus musculus
cacctttgcctcaaaccacttagtttttttggataatggaagaccatagaagaattaaggatctcttccatatttcttctcaccagcaggaaatctggtagaccagtatggataactcagctgggtgtctgcttctgggggatcgccttttttcagatccagaatctgtctgtctgtctatctacttatattatgaatgctaactatgttcctcccaaaactgcctgcacgagtgtctgcatgtagcttctaggaacctgcctcatttggttttgattggtaaataaagatgccaacaaccaatagctgtgag

SEQ ID NO: 3499 - DNA, 530 bp, Mus musculus
  misc_feature (152)..(152): n is a, c, g, or t
  misc_feature (369)..(369): n is a, c, g, or t
  misc_feature (407)..(407): n is a, c, g, or t
  misc_feature (429)..(429): n is a, c, g, or t
  misc_feature (440)..(440): n is a, c, g, or t
  misc_feature (458)..(458): n is a, c, g, or t
  misc_feature (480)..(480): n is a, c, g, or t
  misc_feature (492)..(492): n is a, c, g, or t
gactcccaggttcacaataaacgcatcaacaaacttgacctgctgtcgttctttggatcatcaaatttcctttggaaaattgtctattaagtgggcattacatcctagagcttcattcatcttgagctgagtttgttgacacaaagtatttnagacacttagcacaaagaatgccttttcctgtgggggaaattccctgaggaagccctctgcacaggttgtcccttcttccaaaacccacagagcaagagccttcccctcagggaacatcagggctgtgcaagcttaagatgctttttgcttgtactctgccactctttgaacccttctcattcagctcaaggactgtcactgatgttcctccccatntcatggtcatgcctcatgtgccccctgcccatgaactncctctcaacagacattcattgnatgaacacagnaactgcacatttgcagancttagctgtgctcactgttttncctctaatctgnaagttcataaggtaaatgattcccataatgtgccggtg

SEQ ID NO: 3500 - DNA, 336 bp, Mus musculus
agtgcagctaatgcctgtgtatccagtgcgaggtgctgactctggactactgatggaaccagaggtgttcacatgctctctttgccatgcttgggatgcagtctaggcctcgtgtataaatttcaaatactcttgtgggtgtctgccatactatactgttcatactgagctgcacagtgcccccaggtaggtgctaagcctgtctcgtactcttggagcaacactaggtgcaacttctagaaagttcactgggtagacagctgctgagtgttttaaacagaggaaagaggagactggaaaccaggtggtcaactgctctttcagccaagtttcaga

SEQ ID NO: 3501 - DNA, 570 bp, Mus musculus
  misc_feature (437)..(437): n is a, c, g, or t
  misc_feature (439)..(439): n is a, c, g, or t
  misc_feature (445)..(445): n is a, c, g, or t
  misc_feature (456)..(456): n is a, c, g, or t
  misc_feature (459)..(460): n is a, c, g, or t
  misc_feature (477)..(477): n is a, c, g, or t
  misc_feature (488)..(488): n is a, c, g, or t
  misc_feature (491)..(491): n is a, c, g, or t
  misc_feature (495)..(495): n is a, c, g, or t
  misc_feature (524)..(524): n is a, c, g, or t
  misc_feature (540)..(540): n is a, c, g, or t
ttgcttatactttggctggcactatagctcagtggtacagtatatgttcaagaaaaagagaaatgcatcattcccattcttccaaaagtggactgcatggtcacctgctttttcttttccaggtcaggatagtgagtgtgagggcctgttccattccagctctatctccaccctgttggatgcacagggttttagtgatctggagagaagcacttcttctacgccaggaatggggtctcccagcagggacctgctccacacgagtgctccagaagaggtacgtgtgggattctgacactttatgttgacggggcagtgcctatactgctgtatacatcgccagtgctgtgtgatgtgggttctttccagcagtattacctactggtctattctggtagcttttgtgtactgttggtctcttttcatttttaaatgtntncttccntctttttaatnaannccttggacaaagttaanattgcttatanaantcantaagaacaagacaggtaggttgacttgtncctataatttcagctnctgaagaggcagaacattccttggttagaa

SEQ ID NO: 3502 - DNA, 459 bp, Mus musculus
  misc_feature (139)..(139): n is a, c, g, or t
  misc_feature (153)..(153): n is a, c, g, or t
  misc_feature (335)..(335): n is a, c, g, or t
  misc_feature (392)..(392): n is a, c, g, or t
gaatactgcgtattaccacatcctatagcttcagtatccagagctattctatccttacactacgtgcaggactgtctgcatttgtggagcttaaggagacagctcataggtcacgtaatacagaaaggcacagcccttntaatcaccccccantaggccacctggtgctgagggaattctgctgccttctgaactgggtcacacagtacatgctgatgaagcaagcctcccaggaattatcactaggaaggctgtcctgatgaaaagcaatgaagcatcttgggtaatgtgagtgtaatctttgagtgacattcagattgcaagtgagatacttntgcagtctgaggatggaatgactactgatgcctcttcttattcaatcttaatagtcnagcaagggctttgggaaagttaacttctcatagcagccatgatggttccttcccctgagagtttgga

SEQ ID NO: 3503 - DNA, 486 bp, Mus musculus
  misc_feature (308)..(308): n is a, c, g, or t
  misc_feature (316)..(316): n is a, c, g, or t
  misc_feature (334)..(334): n is a, c, g, or t
  misc_feature (360)..(360): n is a, c, g, or t
  misc_feature (375)..(375): n is a, c, g, or t
  misc_feature (383)..(383): n is a, c, g, or t
  misc_feature (391)..(391): n is a, c, g, or t
  misc_feature (395)..(395): n is a, c, g, or t
  misc_feature (438)..(438): n is a, c, g, or t
atgaaggtgtgttcacgctgctctgtgctaagctgactaagttgttggtagatggttgcagttgaagaaatttggtctttctctcaaagattagttatcttgcctagcttcctttattccctgcctcgttttccaggtggccacatccagcaaagataggtagagtcttttcctgtatctctttgatgccagaggaagttctcagatttggggctcctgaaaagtaacagggtctacctggataaactggtgtttttttcctttgtgtttattttggcaatgtttctaggttttgtttgttctattcnataggctntggaaagtagaggtgganatagctgaggggtagtctaccttctntacttgatgaagtcnaaatagtntaagtatnaccnatgtatgtctttctccacaatacagggggcctttctatgatcntctttcatttgattaaatattttgtaccattccttatgatgtctatga

SEQ ID NO: 3504 - DNA, 310 bp, Mus musculus
ggttgatcccacagacataccaatttcttgatattgattttcgccttcctcatattggccaaggtctccttgtttcccttgataatcttgaatttgcagccatcttcgtgcctctgcaattataattatgatattaataatagttattatttaaaaccacatttggagcaagtggtttgagcaaacactaaggctaaaacttgagtgctgtgcacagtaagcaaccttcacagtaagaaacctgctctctgccctttccaggactgcagagtggatttgaagttgttcacactgagatgagccttggtcc

SEQ ID NO: 3505 - DNA, 172 bp, Mus musculus
aatgtcaccgtccagagcctcctttccttttcttttcttcttgggcctcagctgacacagaacacctcagctctttagctcactggtcccatctatccctgctcagagatgagccagtcctccctgagggcggagggaatgatttaggtgagacctaggctccagccactct

SEQ ID NO: 3506 - DNA, 493 bp, Mus musculus
  misc_feature (391)..(391): n is a, c, g, or t
  misc_feature (463)..(463): n is a, c, g, or t
aagcatggtgctacatagtacttagaaggctgaagtagaaaaatcttaagttcgcctagcctgggctacatggtgtcactttgtctcaaaaaaacctagctataacagaaaatacaaatgttggtgatgaagtggattatgaaaataagtagagggctagagctataggttagaagtagagtgcttattttgtatgtatgaggccttaggttcaattccctgtactgccaaaatgaattgcttcgcttaagctatagaaatattttttatatttttacaatgctttgtggtttcaaaaacaatcatttgtcttattcctactaatagctttaaattcagagaacaggctggtgggattgtcagtggcgtactcccctccatgataaaaacncactaacagcataaagtacttgctgtacaaggccaaaggctgcgttcagttcccagatcctctgtacaaggnaaagagctgattctcagatgttttcctctg

SEQ ID NO: 3507 - DNA, 336 bp, Mus musculus
tttaacccacacatgctgtactttgaatgctcatgatgcaaatttcctaatcaaaccaaatttaatttagcaaattttcttccaaccagcttaatggttgaaagaaatgctcttctgagagcagaaatggaattaggcaatgcaagagttggagcagtgtttgcttccttgtaattcaagtcattaagcgtcaacttagccaaatggaaaaggcctatcttcttcactccggtgacaggaaatattattttcctagagccagggttttggacatgctccacccccaaatctgactcctgccctttaccagtgcaacatgttatttcagttttccat

SEQ ID NO: 3508 - DNA, 346 bp, Mus musculus
  misc_feature (59)..(59): n is a, c, g, or t
  misc_feature (154)..(154): n is a, c, g, or t
  misc_feature (247)..(247): n is a, c, g, or t
  misc_feature (249)..(249): n is a, c, g, or t
tgctctggacacatttgcttgctagttaattgctttggagctggatacaaacaaacagnagcccaggcaattgtgaagccatttgggaaagaatgcacctttccttccgtatgcttgtgtcaagaagacatagatgccaacaaatcagatgctnaaagctgcaagaaacggatcaaaattgtcaggagcaaaagcaccaggcatcacagtttacatatggcagaagagaggtccatgttttgggaantncttccagaacaacagctgtctgtggaagatgtaaccacggtgatgctatggaaaccccacttttatccttaaaatctctggctctggaaaacctgga

SEQ ID NO: 3509 - DNA, 462 bp, Mus musculus
  misc_feature (227)..(227): n is a, c, g, or t
ttcttacccacctgttaaatgaaaggggcagtagagggagaagctaacagtacttaagtctagtgaaaggaatatgaaaaactaatctctaaacaaataaaatataaaagtcagtatgaatgacaggttggtagttactgataggaattaatctcaagttctgggatataacagaaagcaagtgtgcatgtgttgtgtgtaatatatcttaagacatagaaaaacangatcacaaagatattcatcaaatgaatgtcctttgaagagtttctgtctattcaaatttccttcctggtccaaagcatgctctggcctctcctatgggaactcaaatgggagatctttttccttcattcctgtccaaggcttagtggatacagccattccggttttcactttgaacatctagaacaaagaagggcaaggcattgaaaataggcttgttttttggtgatggtacac

SEQ ID NO: 3510 - DNA, 556 bp, Mus musculus
  misc_feature (324)..(324): n is a, c, g, or t
  misc_feature (327)..(327): n is a, c, g, or t
  misc_feature (333)..(333): n is a, c, g, or t
  misc_feature (336)..(336): n is a, c, g, or t
  misc_feature (339)..(339): n is a, c, g, or t
  misc_feature (365)..(365): n is a, c, g, or t
  misc_feature (371)..(371): n is a, c, g, or t
  misc_feature (382)..(382): n is a, c, g, or t
  misc_feature (386)..(386): n is a, c, g, or t
  misc_feature (391)..(391): n is a, c, g, or t
  misc_feature (405)..(405): n is a, c, g, or t
  misc_feature (442)..(442): n is a, c, g, or t
  misc_feature (462)..(462): n is a, c, g, or t
  misc_feature (503)..(503): n is a, c, g, or t
aaggctgcaggcgtccttgcttatacacttcagttctttatacctctacttcctcccctacctcttgtggcaggaggtggagctgtgtaaaaacagccaccaagacaagctgggcctgatggtgtgctatcgcacagatgaggaggaggacctaggcatctacgttggagaggtatggagaggtgctgcagcaggctttggcacaccgagccccagagctgttctagtccagctctgtggtctttccacaaagtctttccaggctttagggctgcccagaggtcctaactacccactaggtgtcacagtaggttgttggtgtcnagnccaggntgnctntggtttcagtatatccaaggagacanccctgntgacctgtacncagncatcnaggatttaatgggncccaccttctctccccattttcttccctttggcagangtctatgtatgctagcactntcctactaaagctactcttccaaatggaaaaggtcccactncccagaacacacaactttatgtattttcattatgaagaagcatctagccacat

SEQ ID NO: 3511 - DNA, 488 bp, Mus musculus
  misc_feature (275)..(275): n is a, c, g, or t
  misc_feature (288)..(288): n is a, c, g, or t
  misc_feature (295)..(295): n is a, c, g, or t
  misc_feature (313)..(313): n is a, c, g, or t
  misc_feature (321)..(322): n is a, c, g, or t
  misc_feature (324)..(324): n is a, c, g, or t
  misc_feature (326)..(326): n is a, c, g, or t
  misc_feature (340)..(340): n is a, c, g, or t
  misc_feature (351)..(351): n is a, c, g, or t
  misc_feature (399)..(399): n is a, c, g, or t
  misc_feature (429)..(429): n is a, c, g, or t
  misc_feature (458)..(458): n is a, c, g, or t
taaagagacagcttggccgcaaccaaacccttgtagggcggcttcaagtcgtcttgtgccctgtttggtcggcgcctctgtcaatcagctgactgccatttgttggctggggcgggagctgtccagtgctgaacccgaggcgcactgaggaggcggaggaggaggcggcggcgctgttttcacccactcgtgttccctgatgactcggaaaccttcaggggtggcaaggagtgggtgggaaataggggagaagtggcgcttttggtggttgaaancgaaggaaacttngactacngaggaggaggaggctgtnggcatctnncntncttagtaaaatcanccctttctttngcctggaaaagagggagaagagagtagttttcatttctgactgaaacnggggaggagggaacgtaggatggaaatgtntccttcttagcatctgctcattttttagncaaattatcaaattctcttccttgtttttg

SEQ ID NO: 3512 - DNA, 525 bp, Mus musculus
  misc_feature (287)..(287): n is a, c, g, or t
  misc_feature (302)..(303): n is a, c, g, or t
  misc_feature (305)..(305): n is a, c, g, or t
  misc_feature (316)..(316): n is a, c, g, or t
  misc_feature (318)..(318): n is a, c, g, or t
  misc_feature (325)..(327): n is a, c, g, or t
  misc_feature (329)..(329): n is a, c, g, or t
  misc_feature (332)..(333): n is a, c, g, or t
  misc_feature (335)..(335): n is a, c, g, or t
  misc_feature (337)..(342): n is a, c, g, or t
  misc_feature (344)..(346): n is a, c, g, or t
  misc_feature (348)..(348): n is a, c, g, or t
  misc_feature (350)..(351): n is a, c, g, or t
  misc_feature (353)..(353): n is a, c, g, or t
  misc_feature (356)..(356): n is a, c, g, or t
  misc_feature (358)..(358): n is a, c, g, or t
  misc_feature (362)..(362): n is a, c, g, or t
  misc_feature (367)..(367): n is a, c, g, or t
  misc_feature (372)..(372): n is a, c, g, or t
  misc_feature (381)..(381): n is a, c, g, or t
  misc_feature (383)..(383): n is a, c, g, or t
  misc_feature (387)..(387): n is a, c, g, or t
  misc_feature (391)..(391): n is a, c, g, or t
  misc_feature (393)..(393): n is a, c, g, or t
  misc_feature (395)..(395): n is a, c, g, or t
  misc_feature (413)..(413): n is a, c, g, or t
  misc_feature (458)..(458): n is a, c, g, or t
  misc_feature (467)..(467): n is a, c, g, or t
  misc_feature (496)..(497): n is a, c, g, or t
tgactagaacttgctcacctgcgagacactgtactaagcacctcccaggatttaccagtttggtcctcctggcaaatctattttgtattttactgaacaggaaaacatataatgcaaacagccatataataaatgacgacgtctcaatgccaggatgtcctgggccattacaagttgccaagccctgggctgacacctggaccaccagcccgttcattcaacgctgacaactactccgggatgggacccttattttacagaccaagagacacaagcaccgaggagcnaatgtacccttatanntntggctggacantngtgatgnnntncanntntnnnnnncnnncntnngnggnanaganaggangattnttaatttgnanccanactngntnacctagtgagacctcatntcaaacaacaacacacaaatgtcagattgaccgcaagtgggtganctgaggatntcagacatattcatgatgtcattatttcnntcataaaccactataccatgttacccac

SEQ ID NO: 3513 - DNA, 437 bp, Mus musculus
  misc_feature (42)..(42): n is a, c, g, or t
  misc_feature (123)..(123): n is a, c, g, or t
  misc_feature (261)..(261): n is a, c, g, or t
  misc_feature (405)..(406): n is a, c, g, or t
  misc_feature (409)..(409): n is a, c, g, or t
tttaaagacgtatttattcacacacacacacacacacacacncgatacatatatacatatatatgagtgttttgcttacatgtatctctgtgcatcacaagtgtgtctagtgcccacagaggncagaagagaacattagagtccctggaacttcggctacagatgtaagctgctgtggggatgctgggaaccaaactgcaagagcagcaggtgctcctgaccagagcatctctccagccccaacagggttaaccatttttnaccccagacttttacttcctattatgtcacatcgttcgatgcaggcctcatattgtcatagttgaaggtattaattggcaaataaaatatcagaatgaaaacagaagtttgaattctaatctctatattgaattagccaataannggncctcagcactgttgctttgtttctgttg

SEQ ID NO: 3514 - DNA, 481 bp, Mus musculus
gacttcacgggtaactcactggatcttctaaccaggactgcttttaccattttagaagcgttagcatttgaaaccagcatctgagccagccagctttgtgagctagctatggctctcaggagggcttggtttctacctaatcgttgctatttaattgagggactggcaaagaggctagctgggcttttttcccctaccccacccccatttggacaggaacccaggaagttggggttccagcctggaaagcggaggctagactccttcctgtgaatgtattgcctttctgaatcggaatctcagaaggaagtggggttacagtttgttccttgagtgtttgactgccttacagcgttacctggtgcatgtcactgaggccgagtcccacttgtctatgactttcacgaaggctggcaagatggctcagtagggaaaggggtttgccaccaagcctgatgacctgggttgatttctgaactcc

SEQ ID NO: 3515 - DNA, 443 bp, Mus musculus
  misc_feature (345)..(345): n is a, c, g, or t
gaacagtctgatgcgagagccgaaaactctggtcctttccaaaacaacaaatgttcttaaacactgagatagccatctctccgcccccaggtcacctgtcatttgacccatttcttaagtacagggatgagccagaggccatgagcactgtcccttggacacggcttcatgctgactcaagcaacgttgacttcctctgtgctcctgtctgacttggagagttcttgagggttactcacatggttcctctgagtggagttagaacgtttgctgccccgacccttcagtgagtccctcagcagttattaggatacgtgggaccaacggccccgtaagaaaacaatntggaactctccaactggcttcctcacagggaagaagctctccaaatgtgttttaacatggtcagaactgatgatggctaaaacgctgctgctcatgga

SEQ ID NO: 3516 - DNA, 314 bp, Mus musculus
  misc_feature (255)..(255): n is a, c, g, or t
tgtctagccgactggtgagtccagggtgctctgcaaaaatgaaaatataaagcactagtaaatacgatttttgctataactatcatttttgtgctggaatgagaaatgttgcttgcccttttctataaataccataccttggctttctggtctcacaaagtactagaagtttagttacttttaaaaaataaaaagtatttaagcctgccacctcttcggtacttagaataaagcagagaaccagaccaactgtcnctgccttcgtgggcttatggttagtttgtcaggaagcaccaccatcagaccgtgaagaa

SEQ ID NO: 3517 - DNA, 464 bp, Mus musculus
  misc_feature (276)..(277): n is a, c, g, or t
  misc_feature (280)..(280): n is a, c, g, or t
  misc_feature (283)..(283): n is a, c, g, or t
  misc_feature (285)..(285): n is a, c, g, or t
  misc_feature (289)..(289): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (345)..(345): n is a, c, g, or t
  misc_feature (347)..(347): n is a, c, g, or t
  misc_feature (351)..(351): n is a, c, g, or t
  misc_feature (359)..(359): n is a, c, g, or t
  misc_feature (388)..(388): n is a, c, g, or t
  misc_feature (418)..(418): n is a, c, g, or t
gggtcttttgtattggccaactactcctgggcatgggatctgccctagagtctcgttgatatacacagtgaaacttcataaaagaatacagatttccctttgccaatctgtaccagtcgtgaatatcttcttggttggggcagggtgtctttttgtccacttctcagtgcttgtcttgattgttctaacagattggggccactttatattgagtccattctgagttcattttaattctagctccccaatcttgggaaatagagggtgagagaactnntantgntnccantctttaanctntcnaaacctgtctccagtgacagttccttaagcaagaccacactntntaancctttccnaacagtgtaggaactgtaatcaaggggtnagatagagagccaatgttatggggaacttnttaatcaaactgctacttttagaatttctcacatgtttgttagcta

SEQ ID NO: 3518 - DNA, 403 bp, Mus musculus
  misc_feature (355)..(355): n is a, c, g, or t
  misc_feature (357)..(358): n is a, c, g, or t
tatgggcacatgagcctaccttaaaggatctcactgacctttccccttcgtttcttagagatgagcactttgttcctcctgcatcttcaacatttagccatttcttctccatatttcctcagtctatcgctctctattgggaactggagtcaccctagcaggaaggctcagctatctttcccagaggacccaggcaggcctgtgcagaaggagagaatctctgagtgtgtgctacaaactctcatgacccacttagccttctgcaacgacaggagatgtgcagccactctgggtaccatggttccagccctctcaagttcaccgcctcctgaagaaactggactgagtctgcctncnncctgtctgtttctggacatcttttcttcaccaactgtactgctca

SEQ ID NO: 3519 - DNA, 543 bp, Mus musculus
  misc_feature (329)..(329): n is a, c, g, or t
  misc_feature (340)..(340): n is a, c, g, or t
  misc_feature (345)..(346): n is a, c, g, or t
  misc_feature (349)..(349): n is a, c, g, or t
  misc_feature (357)..(357): n is a, c, g, or t
  misc_feature (363)..(363): n is a, c, g, or t
  misc_feature (378)..(378): n is a, c, g, or t
  misc_feature (381)..(381): n is a, c, g, or t
  misc_feature (391)..(391): n is a, c, g, or t
  misc_feature (398)..(398): n is a, c, g, or t
  misc_feature (402)..(402): n is a, c, g, or t
  misc_feature (405)..(405): n is a, c, g, or t
  misc_feature (409)..(409): n is a, c, g, or t
  misc_feature (411)..(411): n is a, c, g, or t
  misc_feature (413)..(413): n is a, c, g, or t
  misc_feature (416)..(416): n is a, c, g, or t
  misc_feature (428)..(428): n is a, c, g, or t
  misc_feature (439)..(439): n is a, c, g, or t
  misc_feature (447)..(447): n is a, c, g, or t
  misc_feature (460)..(460): n is a, c, g, or t
  misc_feature (483)..(483): n is a, c, g, or t
  misc_feature (500)..(500): n is a, c, g, or t
tgcctgaaatcccaagggttcttacccacagttccaagttgccaaacaagcttacccatgcaggccagggcaagtgcatgcattgttaaataggactcatgaaaatgccctgtggtttccaggtctccagtggccagctcgctctgtctggccccattcctggattctcagtgcccagcccatcagcacaaagtacctggggagaatgcaggccaggaagaaattgcatctgcaaggaaaatattgttttatagaattcagtggcccattctgtaaacattgtggttctgcctcaggtttttttcctgcctgtcttcagggagcacctncagggagcacntccanngancaccaggnagcacngggcagccagatgcntgngcttaggaanatatgtncttnggntgantngnctnttgcacaggatngacttggggantttaccangcatgtgagagantccaggagtggtgctggttgganttttcctccagaggctnatagagagacagtgtatggatacacacgtggatatgaatgttt

SEQ ID NO: 3520 - DNA, 459 bp, Mus musculus
  misc_feature (64)..(64): n is a, c, g, or t
  misc_feature (296)..(296): n is a, c, g, or t
  misc_feature (305)..(306): n is a, c, g, or t
  misc_feature (314)..(315): n is a, c, g, or t
  misc_feature (323)..(323): n is a, c, g, or t
  misc_feature (342)..(342): n is a, c, g, or t
  misc_feature (362)..(363): n is a, c, g, or t
  misc_feature (405)..(405): n is a, c, g, or t
  misc_feature (415)..(415): n is a, c, g, or t
tctccgcactatacttttgttctgaaaaagtgccgcttttcacttctaatatttcctacacttnttcaatatcttaccatgcctcaaaataactccacagaaagaacagcagacagcaggttgccttgctaacatgaagcggtcacctctgaaccacacctgacttgtgaggctttcatttccttgatgtcatggtggcaaactgcttggttgccgggtgaacagtcgtggtaacagctacaaacctgacggccagttctgagaaagctccttctgcccttgagggaacttccacnggaacattnnccattggnnaagtgagnacccaagtttttatctttnactgagagcagaaaggcggnntctcagtacattcttcactttctatcgcatctttgatgaggnacaacccacncattgaccccggctttggaagacacagcatggttactctgccac

SEQ ID NO: 3521 - DNA, 540 bp, Mus musculus
agatgtccccatccaggcatgaaacttggccttggtttgcttctgtgaaatgctcaaagatgtagtgtagaatgcagtgcatctatggcattgttgcgtgggttgtggatctgtggtagagtttctgcccttctgtctttgttgaagaatctagatgtgttgaagacagctgctccagagtttagcacctggactgtgtgtgggaaagttcatttgctgcagctaggactctaaagctgcccagcttctctgaatcctaggtgaatgtgtaattaacacattttgttccatgcccctgaggtttcggggttggttgtttttgtggtactccaataacagtatagtaggtaactgagacagtgggttcctcttgtaaattgctaacacatggtcaaatgctaggtcagtttgggattttgtaccttgagtgtggtgaggaaaagatgggaggaacacaataagtgttcattttagccaaagaatattggttctgatagttgtatcccgagatgtcctggctttcccacatggactctgtaa

SEQ ID NO: 3522 - DNA, 505 bp, Mus musculus
  misc_feature (113)..(113): n is a, c, g, or t
  misc_feature (120)..(120): n is a, c, g, or t
  misc_feature (128)..(128): n is a, c, g, or t
  misc_feature (166)..(166): n is a, c, g, or t
  misc_feature (173)..(173): n is a, c, g, or t
  misc_feature (248)..(248): n is a, c, g, or t
  misc_feature (264)..(264): n is a, c, g, or t
  misc_feature (273)..(273): n is a, c, g, or t
  misc_feature (275)..(275): n is a, c, g, or t
  misc_feature (305)..(305): n is a, c, g, or t
  misc_feature (316)..(316): n is a, c, g, or t
  misc_feature (437)..(437): n is a, c, g, or t
tcaggctggccggaattcatagagatttgcccgcctctgccttcagagtgctacggttaaaggcatgcatcactccctgcctggcctcttttaagactgaaaactatacctantaaacantgactatntagttttcagtctccataacattaataaccatgtctgnttatagntggaaacataataatacctaggttttttgtggctggcttattatatagcccgtggtcctttcatttatggacatngtagtatatacttgantttcctttntnaaagctgaatagctgtatattcatcacatntttgtttaccnaatgatagatatgtaaattgtttcacattttagctgttgtctgtgtgctgtgaatagagtgaaagaaattctcttttcaaagcactcttttcagtggaacaaggatgtatgcctttaaccncagcacatgggaaagggaggcaagtggatttctttgagtacaggtctccctgcctagatagtgatttc

SEQ ID NO: 3523 - DNA, 550 bp, Mus musculus
  misc_feature (188)..(188): n is a, c, g, or t
  misc_feature (217)..(217): n is a, c, g, or t
  misc_feature (241)..(241): n is a, c, g, or t
  misc_feature (288)..(289): n is a, c, g, or t
ggctgttagctttatgggctgtgcatgtcattgttccccaagaacaacaggcttctctccagtgttaacatatgatccctttctcattcattgtgacttgtgtgtaggagtaactactcctaagaagatgataatctctgaacacattgcatatgtaaatgtagatacttcttgagcaatatagtganctatgacttcacatacacacacacacacnccatctgtatgtactgtacacatnttcctgaatccccaattctctgcttaatcataatggtttgaaatctnnatctacaacagtggtggatgttttagacagtaggacattagctggctgcttctttaaatgtacctgtattgtctgcgtgctccttttgcggagacaagtttttgtattggatgtttgggccaatgggaggcttcaagctacaacatattttcccagtttaaatatattgaacttatgacaaaccccagacaaggcttttaatctgtaaagaactgcagtgttgggtggtttatttacaaaccgttttcaatgttgtccatt

SEQ ID NO: 3524 - DNA, 535 bp, Mus musculus
  misc_feature (259)..(259): n is a, c, g, or t
  misc_feature (265)..(265): n is a, c, g, or t
  misc_feature (292)..(293): n is a, c, g, or t
  misc_feature (314)..(314): n is a, c, g, or t
  misc_feature (339)..(339): n is a, c, g, or t
  misc_feature (353)..(353): n is a, c, g, or t
  misc_feature (365)..(365): n is a, c, g, or t
  misc_feature (390)..(390): n is a, c, g, or t
  misc_feature (393)..(393): n is a, c, g, or t
  misc_feature (405)..(405): n is a, c, g, or t
  misc_feature (443)..(443): n is a, c, g, or t
  misc_feature (485)..(485): n is a, c, g, or t
  misc_feature (489)..(489): n is a, c, g, or t
aaggctttgccctaacaaatctcctttgccaataaggttccatttacctcacactctgtgcagctttcctcagtccccagtctgatagaagatgccaccatgcttgcagttaacccaccactttctgctacctcctacaccttatatagttccttcttaacgctagtgatgctttcaacacacaaacctgatcttgcctcctgtcacttaccaaccgctgacggctctcctgaacattaagatgaaagcagcattcctnatatancataaccccacagggctgacttcctcnnacgttccaacctggtacacantcccctgcaccagcattgctggccnccttccatttgctngaagatgctatntccctcagccccagggaatctttcngtntaatggttcctntccgcagtgtaattttagctcttgctcaccacacaccnatcaatgcaattgccacttccccagggaagtggactctgatntccnacctagaccacatctcgttttagatgttgtcacagcaatgggttct

SEQ ID NO: 3525 - DNA, 535 bp, Mus musculus
  misc_feature (140)..(140): n is a, c, g, or t
  misc_feature (158)..(158): n is a, c, g, or t
  misc_feature (160)..(160): n is a, c, g, or t
  misc_feature (164)..(164): n is a, c, g, or t
  misc_feature (186)..(186): n is a, c, g, or t
  misc_feature (203)..(203): n is a, c, g, or t
  misc_feature (215)..(215): n is a, c, g, or t
  misc_feature (219)..(219): n is a, c, g, or t
  misc_feature (242)..(242): n is a, c, g, or t
  misc_feature (253)..(253): n is a, c, g, or t
  misc_feature (264)..(264): n is a, c, g, or t
  misc_feature (276)..(276): n is a, c, g, or t
  misc_feature (293)..(293): n is a, c, g, or t
  misc_feature (296)..(296): n is a, c, g, or t
  misc_feature (301)..(301): n is a, c, g, or t
  misc_feature (339)..(339): n is a, c, g, or t
  misc_feature (381)..(381): n is a, c, g, or t
  misc_feature (450)..(450): n is a, c, g, or t
  misc_feature (460)..(460): n is a, c, g, or t
  misc_feature (468)..(468): n is a, c, g, or t
  misc_feature (482)..(482): n is a, c, g, or t
  misc_feature (488)..(488): n is a, c, g, or t
  misc_feature (505)..(505): n is a, c, g, or t
  misc_feature (509)..(509): n is a, c, g, or t
tgccaagggctctccgccatgtaatgggcactctatccacgttactcctccctcctatgagcagtgtggttccaggctcgtttacccatgcatgccctgacactccgccccttgagcaggggtctggagcactcatttancagaattaggctctaaananagtngggcagggtggggtgctggtgnaagataccaggaaacgnattgttaaaggnccanagggcaaatgccaaaaacccaanctggtacggtnaggctcgtttnaaaatgtcaganaaaatccgttccatgcnaantggcnctgcctccaagctacaaaggatcccctcccccaaggtncccactggagttttgggggtggcccaggtagggcattaattnaggtgggggctgctaaggggccgtttgccagagcttgtgattggcaggcaggctgggaagcccagatanctgggccctntcaacttntacccattctagtntgtganggtcccaccttgccctntggncagtgtcccttggtgatcctcactcc

SEQ ID NO: 3526 - DNA, 481 bp, Mus musculus
  misc_feature (255)..(255): n is a, c, g, or t
  misc_feature (263)..(263): n is a, c, g, or t
  misc_feature (271)..(271): n is a, c, g, or t
  misc_feature (286)..(286): n is a, c, g, or t
  misc_feature (288)..(288): n is a, c, g, or t
  misc_feature (297)..(297): n is a, c, g, or t
  misc_feature (319)..(319): n is a, c, g, or t
  misc_feature (322)..(322): n is a, c, g, or t
  misc_feature (344)..(344): n is a, c, g, or t
  misc_feature (346)..(346): n is a, c, g, or t
  misc_feature (376)..(376): n is a, c, g, or t
  misc_feature (406)..(406): n is a, c, g, or t
  misc_feature (435)..(435): n is a, c, g, or t
  misc_feature (448)..(448): n is a, c, g, or t
  misc_feature (450)..(450): n is a, c, g, or t
  misc_feature (453)..(453): n is a, c, g, or t
caccttagcacatttataatgcctaaagtgaatcacaactgttatcacttgtgttaaactttttatcagggacaatgattagaagttgtgcaaaaaacaacagcaaataccctaagccaagttttaaatacagttcctttctggtatggaatgccatcactgaagttttacactaagccaaaggaaatcatttgtgagtttatgaacagaccacctgctggttgcatggcttaacttaccatctctagatgatanctgtgatnataattgntaatgtttacttctntntgtgctaantccccgatatgggttacccctntcncccaatgaggtgaatggtgttntntcttcattcaccaaatctaggtggcctganagcgttggtctaagaatgagtttgaggctnagctgggtaatttagtaagaccaggtttnaactaaataatantnatnatcatcttcttagtaattcatctgtctc

SEQ ID NO: 3527 - DNA, 339 bp, Mus musculus
acaccagacatttttgatgcccaagcatccagtgcccttttagtctgtctttatttctgtagtttgggttagaacatgggcagctcaagggaagggtttccagtccactgcattgtcgtgggtgagaaagcatggctgtttaaggcatctaccttctcatgagcccatctctgttatttgcatatttcaccctgacttatcatgtggaaactgtcatttctgtgtcatcctgggcttgtggctttattcatttagtccctggtctgggcaggtctgcttaagctctgagtattcatgcaagcataaagtacctttcctgggccttagaaacactatcct

SEQ ID NO: 3528 - DNA, 346 bp, Mus musculus
agctggtgatgaagctccgagccaccagaatcgtgatagtattgggctttgaggatgatcacacgtgttctcttgcaggtgtgaaattcctgcttgtggccttttgaaccattgtgagccatattaaaggttgaatttgtagtattgcaattatattgttattcacttgacctggatttcttgttttttttaagttgataaagttagaatatagctagttcatctctgacctccagactacaagtgagtgcgctctcgggtgagcatgtggtgagtaactataatgcaggtggctcctacactgactgactgtgcctccctcagtccaacagtgctttccagtaga

SEQ ID NO: 3529 - DNA, 543 bp, Mus musculus
  misc_feature (344)..(344): n is a, c, g, or t
  misc_feature (347)..(347): n is a, c, g, or t
  misc_feature (349)..(349): n is a, c, g, or t
  misc_feature (351)..(351): n is a, c, g, or t
  misc_feature (354)..(355): n is a, c, g, or t
  misc_feature (370)..(370): n is a, c, g, or t
  misc_feature (372)..(372): n is a, c, g, or t
  misc_feature (381)..(381): n is a, c, g, or t
  misc_feature (386)..(386): n is a, c, g, or t
  misc_feature (388)..(389): n is a, c, g, or t
  misc_feature (395)..(395): n is a, c, g, or t
  misc_feature (397)..(397): n is a, c, g, or t
  misc_feature (416)..(416): n is a, c, g, or t
  misc_feature (458)..(458): n is a, c, g, or t
  misc_feature (472)..(472): n is a, c, g, or t
  misc_feature (479)..(479): n is a, c, g, or t
  misc_feature (484)..(484): n is a, c, g, or t
  misc_feature (489)..(489): n is a, c, g, or t
gacaagagattttaccatgggttcctggggtggggggggcttccctttcttcatatggttcctcctcacacaggttcttgctcccaggtctgcctagggtcaccctagagcagcagctcttaacctgtgggttgtgaacctatttgggctgcgctcttcagtttcagatggctcagtcggtaaagaaagaaaagaaagccaggcgtcttgtggtacacaggtagtcccagtgaacaacctttccacagaggttacctaagaccattgaaaaacacaggtttttacattatgattcataatagtagcaaaattacagttatgaagtagcagtgaaaataattttntgncngnggnntcatcacaacatgangnactatattnaaggntnncagcantnagaagagtgagaaccaatnccctagagggaacaccctagtccacagagtgattgttttctnttccttgtctagcntccccancctgnaagtntccccagctgctctagggttccatctatctttaggaaccacacccatttatttg

SEQ ID NO: 3530 - DNA, 495 bp, Mus musculus
  misc_feature (298)..(299): n is a, c, g, or t
  misc_feature (301)..(301): n is a, c, g, or t
  misc_feature (463)..(463): n is a, c, g, or t
atgtcaagtcctggtcttgtgactctgattgtgaaaggtggtgtcatgtcccccctctgtttgagggatggatgggattttcagtgttggagggaggctgcgcacatcttccctaatcccaagagcacacactggttctgactccctagagagctggtatcttgcaagagaatctgcaggttggaaatagcccgtatctggattttacctctctgacgggctcacttgagaagtgggctgtctggaaggactgcctaggtgtcagggccttccttctttctgcccttcctcctccctnncncagtttccattccttggagaagtcagagactgtgagcattgagcagcctttacctcagaacccctggataccccagcccctcagagggacccccgcacgttaataaagactgggccacagccccctgtctctccttgctgtggtaagcgtcttgtcctgtgnccgattagcagtgttggctatccgtgtagcaa

SEQ ID NO: 3531 - DNA, 461 bp, Mus musculus
  misc_feature (207)..(207): n is a, c, g, or t
  misc_feature (212)..(212): n is a, c, g, or t
  misc_feature (214)..(214): n is a, c, g, or t
  misc_feature (217)..(217): n is a, c, g, or t
  misc_feature (228)..(228): n is a, c, g, or t
  misc_feature (240)..(240): n is a, c, g, or t
  misc_feature (259)..(259): n is a, c, g, or t
  misc_feature (263)..(263): n is a, c, g, or t
  misc_feature (266)..(266): n is a, c, g, or t
  misc_feature (268)..(268): n is a, c, g, or t
  misc_feature (296)..(296): n is a, c, g, or t
  misc_feature (307)..(307): n is a, c, g, or t
  misc_feature (323)..(323): n is a, c, g, or t
  misc_feature (329)..(329): n is a, c, g, or t
  misc_feature (339)..(340): n is a, c, g, or t
  misc_feature (349)..(350): n is a, c, g, or t
  misc_feature (356)..(356): n is a, c, g, or t
  misc_feature (372)..(372): n is a, c, g, or t
  misc_feature (375)..(375): n is a, c, g, or t
  misc_feature (384)..(384): n is a, c, g, or t
  misc_feature (396)..(396): n is a, c, g, or t
  misc_feature (404)..(404): n is a, c, g, or t
  misc_feature (406)..(406): n is a, c, g, or t
  misc_feature (429)..(429): n is a, c, g, or t
  misc_feature (436)..(436): n is a, c, g, or t
tggatgaaagcacttgccacacagtgtaacaacctgaggaaatatcctcagagctaagtaaggattggattcagtagcacaatgatagtatccccagtgagtatccccaccaggagctgagaggcaaagacagcaagtctggcacagacagcagtgaagaataagggaccccatttcaagctctgacctgcacatgtgttctgtggnacctntnganccatattcacnacacgaacactnatgtatacatcatacacanactncantnagaagagatgatgttgctagcattaagnataaagtgtanacagttcatagatgtngtctcnagacattagnntacacagtnnttttantaaaagaaatttgaantcntccaaggancaaatgtgtttnacagaaananatagaagcataaaaataatttcntttactntagctatggctgtctgtaggtttat

SEQ ID NO: 3532 - DNA, 454 bp, Mus musculus
  misc_feature (189)..(189): n is a, c, g, or t
  misc_feature (236)..(236): n is a, c, g, or t
  misc_feature (278)..(278): n is a, c, g, or t
  misc_feature (284)..(284): n is a, c, g, or t
  misc_feature (305)..(305): n is a, c, g, or t
  misc_feature (307)..(307): n is a, c, g, or t
  misc_feature (347)..(347): n is a, c, g, or t
  misc_feature (354)..(354): n is a, c, g, or t
  misc_feature (380)..(380): n is a, c, g, or t
  misc_feature (388)..(388): n is a, c, g, or t
ttggatcacactgaaagctgccctggatggcacagtgacagagaccaagacaccctgtggagcccagcaggtacagatggagcttgtgtctgagcaccattgaggcccagctgacacagtggtggaaccaggaaggaggaccaacaacagttctggacacagagctggggctggagcaggagagtaccncctactgctgcatggttagagtccagcactggcactgcaacagcctnttgtctacagagacctctgcgtcgacagggtcctggctcctntgcttntgtgagaaaggccccattgantnttgagcttcagggaaggacccttgagcctggctcttcctnttatctnccaataaggtttgttatgagttgttnctggtatntcaggcctgtaattatagctatttgagaaactgaggcaggggaatgggaacccaaggcttgcctgt

SEQ ID NO: 3533 - DNA, 472 bp, Mus musculus
  misc_feature (180)..(180): n is a, c, g, or t
  misc_feature (193)..(193): n is a, c, g, or t
  misc_feature (223)..(223): n is a, c, g, or t
  misc_feature (278)..(278): n is a, c, g, or t
  misc_feature (297)..(297): n is a, c, g, or t
  misc_feature (306)..(306): n is a, c, g, or t
cttaggtttagcttgacttcagagatcacacagggagcactcccttctggccttctctgagcccgaccaccctctggttttagctcatgcgtgcccttccttccttcctctgcttctctgtatatccctgggctgccgtagcaggccatcccccacctcagtctcatccactgtccactngtgcactgagtgntgggtttggagctccttctctgggctcccnagtacttattgctgtgtctcttctagttaaactcgcacttctttgaaacaggttntgagttacgttcaccaagnataactaangccacccagctttatgcatctacgtgtagtgctatgacaactgttaaggtttgagcatgtgttaagattataattatacaggtttaattgcctgccttttaaatggcaatctgtaaacaactagcaagaagacagatttgcaagcacaatggcacgggcacagtct

SEQ ID NO: 3534 - DNA, 282 bp, Mus musculus
  misc_feature (183)..(184): n is a, c, g, or t
aaatgactaccgtgtcttcaatccctggaggcgtctatgcacccggtaactgcctggtaattgaggtatttaggtatatatccgtaggtattctgggatgctgctgtacctaaatcccttcaccaccctggaagatggtggaagtcatgatgtttctctactcaacttgattcataccacttnnttccttccaattcatccatgaaaataccccagccctggtgacattctgtcagcacttcgtatgtaccaggctcagcccatatgcctctactcagtaag

SEQ ID NO: 3535 - DNA, 475 bp, Mus musculus
  misc_feature (164)..(164): n is a, c, g, or t
  misc_feature (176)..(176): n is a, c, g, or t
  misc_feature (179)..(179): n is a, c, g, or t
  misc_feature (192)..(192): n is a, c, g, or t
  misc_feature (198)..(198): n is a, c, g, or t
  misc_feature (201)..(201): n is a, c, g, or t
  misc_feature (209)..(209): n is a, c, g, or t
  misc_feature (235)..(235): n is a, c, g, or t
  misc_feature (244)..(244): n is a, c, g, or t
  misc_feature (267)..(267): n is a, c, g, or t
  misc_feature (293)..(293): n is a, c, g, or t
  misc_feature (353)..(353): n is a, c, g, or t
  misc_feature (356)..(356): n is a, c, g, or t
  misc_feature (428)..(428): n is a, c, g, or t
gtccaccgatgagcttgcttactgtgatccctttcatgtgggaggcaggactgtgagcgcgcatgtgtgtgtgtgtgtgtgtacatgagtgcgtgcattggactttttttttttttcctgcactgactttaaaattgcaaatgatttggatgcacatccaaagnagagccccctanttntagaggaactgcnatttancanacaggttnctggaagaattgtaagaatcccaggntgtggtttntgctccaggccaaggtcaatgtngtttcaattgtccagctcctgagaanacctttacaaacacaatcttaagcacatgggattttgggtctttgtgttgtaatgaaaancanggtttttttccttcctactgacattagaaattattttcaccttttaagatgtcttcttaaggaagaatcatngataatacttcaaaatgaccattactaccagcagtgctttggtcccc

SEQ ID NO: 3536 - DNA, 522 bp, Mus musculus
  misc_feature (277)..(277): n is a, c, g, or t
  misc_feature (299)..(299): n is a, c, g, or t
  misc_feature (365)..(365): n is a, c, g, or t
  misc_feature (381)..(381): n is a, c, g, or t
  misc_feature (404)..(404): n is a, c, g, or t
atttattcaggtgtcttttggcaagaattgattgtccaaccagaaccaacacctcctgagggtcattgtgccatctgaaggcacaaatgcccaaaatccttattttaaatgtgagttctgtgcaactcttttgtctcttaggggacaaatttgggccctttggactcttggcaaggcctatcagtgagttagtatgtgttgagatcaggcctgccttgagccacgataccacaagacccaaaagaccccatccgctctatctaattgggtagctcantagaaggggaaactgaggcagncaggcaggataacttcatgagcttcattcacagacagtggagccattcagaggcaaacaaagagcnagaggacatcttcttngccttgccagggctgtgctcatntctgtctgtggcctgtgaaatgtcctttagcacataacgtgtcaccttaagggcttgtgctgttctgagagcacaccgtgccaggaccaggaaggaaagccgtttcctctatgaggct

SEQ ID NO: 3537 - DNA, 541 bp, Mus musculus
  misc_feature (26)..(26): n is a, c, g, or t
  misc_feature (28)..(28): n is a, c, g, or t
  misc_feature (31)..(35): n is a, c, g, or t
  misc_feature (37)..(37): n is a, c, g, or t
  misc_feature (117)..(117): n is a, c, g, or t
  misc_feature (119)..(119): n is a, c, g, or t
  misc_feature (164)..(164): n is a, c, g, or t
ggttgtatgggtagctccagttcaananagnnnnncncccagcgtgcctgaagccccaggacccatcccagcattgcattaactgggcatggtggctcaagcctgtaatcccagcantntagaggtggagacagaagcctccaaagtgaaaggtcgggctgganagatggctcagcagttaagagcactagctgctcttccagaggtcctgaattcaattcccagcaaccacatggtagctcacaaccatccgtaatgagatctgatgccctcttcaggtgtcttctaaagacagctacagtgtactgtcatatacatacataagtctttaaaaataaattcaagatcatccgtggcttaacagcaagatccactgcatctcaacaacagcatacaaacctggctaatggggactggctttgaaggaagcaggggtgactcccctggagtgacagaacccaaaggcttgagcagcatgaagtagaagcccctctccagggaagcctgggctgcaccaccaagccttatcaccgcaaagaag

SEQ ID NO: 3538 - DNA, 527 bp, Mus musculus
  misc_feature (27)..(27): n is a, c, g, or t
gatttgtgaagaccctttgatctgacntaaaggcaatatttttaaagatttattttcattacttatgttacgtgtgagactgtatgaatgtgtatggacaaatgagcatagatgcccttagagatcagaagagggtgtcacagccccgggagctggcagtggtgagccacctgacatgagttctggaaactgaggtcttgccctcccccaaagcagtggacactcttaactgacttaatgtcatcattagaagctgtttgtgttctttaaggataaacaacttgcctcagattgggcattagtctgttaggtacaggagttcttgcaatgagcattttaaaattaatgtatttgataatcacaatcaagtttatttgagtttaaaaaaaaatagtcatggcatgcaaatactgctgaggaacaaatttaacaaggctcttttttttttcttccagtgtggcctctatggtaaaaaatagtaaaatgtgaccttctaggtcttaaaatccattattcttttgaccttg

SEQ ID NO: 3539 - DNA, 519 bp, Mus musculus
  misc_feature (271)..(271): n is a, c, g, or t
  misc_feature (273)..(273): n is a, c, g, or t
  misc_feature (277)..(277): n is a, c, g, or t
  misc_feature (279)..(279): n is a, c, g, or t
  misc_feature (286)..(286): n is a, c, g, or t
  misc_feature (288)..(288): n is a, c, g, or t
  misc_feature (290)..(290): n is a, c, g, or t
  misc_feature (292)..(292): n is a, c, g, or t
  misc_feature (301)..(301): n is a, c, g, or t
  misc_feature (303)..(303): n is a, c, g, or t
  misc_feature (306)..(306): n is a, c, g, or t
  misc_feature (308)..(308): n is a, c, g, or t
  misc_feature (310)..(312): n is a, c, g, or t
  misc_feature (320)..(320): n is a, c, g, or t
  misc_feature (322)..(322): n is a, c, g, or t
  misc_feature (348)..(348): n is a, c, g, or t
  misc_feature (350)..(350): n is a, c, g, or t
  misc_feature (354)..(354): n is a, c, g, or t
  misc_feature (357)..(357): n is a, c, g, or t
  misc_feature (366)..(366): n is a, c, g, or t
  misc_feature (368)..(369): n is a, c, g, or t
  misc_feature (384)..(384): n is a, c, g, or t
  misc_feature (403)..(403): n is a, c, g, or t
  misc_feature (417)..(417): n is a, c, g, or t
  misc_feature (444)..(444): n is a, c, g, or t
  misc_feature (451)..(451): n is a, c, g, or t
  misc_feature (454)..(454): n is a, c, g, or t
atcttcctgtcttatgtactgggcctggagatgtatcagtgacaaaaggcttgtcagtacaaggtcctggattcaacctcttatttttatttttttgttttttgtttgtttgtttgtttgttttgagacagggtttcctttttatactcttggctgtcctggaactcgctttgtacagccttgggagttctggaactctttctttagaaaaactttctctttcaggctggcctagaactcatagagatctcacccacttctgcctcccggntnctgngnttaaagncntnanccactacancntgntntnnnttctgatnantcattcttttttttaagatttatttntnattnatncatatatananntatgtaccacatatntgcaggaacttacagagancaaggacacaagtntcatggaactagaatttcaggtggttntgaggcnccngacataggagctaagaactgatatgtgacttcttggccactaaaccatacttcaccattcttaca

SEQ ID NO: 3540 - DNA, 315 bp, Mus musculus
  misc_feature (47)..(47): n is a, c, g, or t
agctttcatccccaggaaactgctggcttacagcaagaatggatacncagagcagaagcagaaaagcagaaatacaaacaaggttttgcctttacttgcttttctctttaatgtataagtttaagtacctgattgagattatataccgcatgcatgcaggagcctgcagagacaagaggacattgggggccagaggagttgcagggagttgtgagctgcctggtgtgggtgctgagaaccaaagactgggtcatccccaagagccgtaagcgctctcaatcactgagccagctttctagccccaagaacgatttt

SEQ ID NO: 3541 - DNA, 273 bp, Mus musculus
gacctttctgtcaattcaagctttggaaaacgcttgcaagctaaacaagtttggcttctactcagcccattcattcatggaaagtaggggacaagtgcatggccgtgtggagtgaagacggacagtaagtgtagagccaccctctaactgtactgagttaataagatacaatggtaagatgctactgctcagcttgtactactcctatcgtgatctgtgtaggtgaggtggtttatgaaacgaggctaattcttgggtggttgccattaacac

SEQ ID NO: 3542 - DNA, 501 bp, Mus musculus
  misc_feature (314)..(314): n is a, c, g, or t
  misc_feature (327)..(327): n is a, c, g, or t
  misc_feature (329)..(329): n is a, c, g, or t
  misc_feature (363)..(363): n is a, c, g, or t
  misc_feature (382)..(382): n is a, c, g, or t
  misc_feature (409)..(409): n is a, c, g, or t
  misc_feature (457)..(457): n is a, c, g, or t
taggttggtgtctctattgctccaataagattccgcctgagtagaagaggtgggctcttcaggttccatatccccaatgtagtgaatcacagctaagatcacctacattgattgtagtgcccctcccttatctcaggtctctgtcttgttcgggagatgcccctcaacctcgtcatacctatcagttgcacgtttacattaattttcatggtcatctagctatctctcctcttggtttttcagaaacccatatatgtgaggtgaaattgtagtcacctgtgctttaagatgcaattattaaagctgatggtttngcatccccactcntngacggtgctgaggaccctgaaccctgatttcacngactatttacccaacctgnatctaggatgttctaatggcaacattnggatatttacatgggagagatgctacagggtcattgtttatttctgcntcttatttaaaccaaattcctgttttacacagaccttccttaat

SEQ ID NO: 3543 - DNA, 343 bp, Mus musculus
  misc_feature (80)..(80): n is a, c, g, or t
  misc_feature (190)..(190): n is a, c, g, or t
cacagagacacaccttgacacaatgtgcccccaacatacagttctatgtataagaggtagttataatacccaaatttatnaagacagaaagtaaaatgttctttgccagaaattggtaggaagagaaaagtggttgtttcatgagtattgattttcacagctttggattttcaagataaaaggagctctncagctttgctgcacaatttgaatgtatttagccttattaaaccttgcacttaaaacagttaatataaactggatgtggtagttcaccagtgactaaaacctagaatcagatgcaggaaaatcaggaattcccgggcatcttcaactacatagg

SEQ ID NO: 3544 - DNA, 295 bp, Mus musculus
  misc_feature (79)..(79): n is a, c, g, or t
  misc_feature (103)..(103): n is a, c, g, or t
  misc_feature (148)..(148): n is a, c, g, or t
  misc_feature (217)..(217): n is a, c, g, or t
gcttggtctccattataagcttggtcgagttacaggacagccagggctacatagagagcccctgtctcaaaaacaacancagcagcaacaacaacaaaaccangtttctgttggtcatggtggggcatgactataatcccaaaactcnggaagccagtgaaagtggggagattgagaattcaagcccaccagtgctacaaagtgagaccctatctcnaaaaaacaattaatcaataaacaaacacacaatgtgccttcatgtttaatcctctcttcaagacacaactgtgtaatt

SEQ ID NO: 3545 - DNA, 424 bp, Mus musculus
  misc_feature (36)..(36): n is a, c, g, or t
  misc_feature (116)..(116): n is a, c, g, or t
  misc_feature (214)..(214): n is a, c, g, or t
  misc_feature (216)..(216): n is a, c, g, or t
  misc_feature (218)..(219): n is a, c, g, or t
  misc_feature (232)..(232): n is a, c, g, or t
  misc_feature (251)..(252): n is a, c, g, or t
  misc_feature (254)..(254): n is a, c, g, or t
  misc_feature (274)..(274): n is a, c, g, or t
  misc_feature (288)..(288): n is a, c, g, or t
  misc_feature (296)..(296): n is a, c, g, or t
  misc_feature (320)..(320): n is a, c, g, or t
  misc_feature (352)..(352): n is a, c, g, or t
atgtgtgtgaggcaatcgttccgtcccactaagccnccatgttttaagtacataccactatcctttaacatccctttgaactttgatcttcttagctggaagctatccagagaacncaacctatgggggtataggtatcttcatattagatatgggtacaagaagccccactgtggggcttaaataccatctatgccctcccattcaactgccnantnntctataaaagctntttgtttgatattcctganntncatgtcatattctggggagnatcattggaacttnatccctcnataggaagaacatttttttttctntattagacattcaatttttgttcttaacatcnggatgtgcattcagtgaccctttgacaaaaagtggagcaggctgttgagatttcttggtgtgctggtgtatt

SEQ ID NO: 3546 - DNA, 287 bp, Mus musculus
ggccaaattctttcagactgatcctctcccgaattaacctggtagatgacatgactgtatcatgtcagggtacttccaaatgagcactcctatagtgggttgggaccacatccctttcctctctttgcaactagcctcacctcagcatgatctctggactctgaggtatgcctctaagaagcactctgaaggtcacctgtcctctccactcttgtcatcagtgacctctagtatgtcctttcagctactttaatgttcaaaactatctgtcagttgtcctattttat

SEQ ID NO: 3547 - DNA, 381 bp, Mus musculus
  misc_feature (26)..(26): n is a, c, g, or t
  misc_feature (31)..(31): n is a, c, g, or t
  misc_feature (62)..(62): n is a, c, g, or t
  misc_feature (111)..(111): n is a, c, g, or t
aaatctaccatcatgtggtcttccantagantcatggtcctctgtaacttgtgaggcctggntacattgtcctctaccacaggccgggctgtttccactgcccgccttttntacagcggtgtgctgtgcccctgaatggtgggacaaatcagtgccttccctctcatctgttgtttagaaaaaagtcaaccaatacagaagcagagacctgtctgtccctgaatctaaaaatagccatggattttatcactgaaagccccatcatatgtcagatgtcaggagcccatctcccttcagtcaggagctccgggagaagaccagaggcaaagcgcgctgagcttttctgagaatacagaggaacgctcaagcaaccatgttttg

SEQ ID NO: 3548 - DNA, 452 bp, Mus musculus
  misc_feature (110)..(110): n is a, c, g, or t
  misc_feature (138)..(138): n is a, c, g, or t
  misc_feature (158)..(158): n is a, c, g, or t
  misc_feature (211)..(211): n is a, c, g, or t
  misc_feature (214)..(214): n is a, c, g, or t
  misc_feature (216)..(216): n is a, c, g, or t
  misc_feature (239)..(239): n is a, c, g, or t
  misc_feature (256)..(256): n is a, c, g, or t
  misc_feature (279)..(279): n is a, c, g, or t
  misc_feature (296)..(296): n is a, c, g, or t
  misc_feature (307)..(307): n is a, c, g, or t
  misc_feature (313)..(313): n is a, c, g, or t
  misc_feature (322)..(322): n is a, c, g, or t
  misc_feature (426)..(427): n is a, c, g, or t
agatgggacccatttttctgtgcatgctttcatttctcatgaggtcacagagaccgttccattgcaatgggaaaatcaacccaacatgccaccgagacttgctgaacacnactcatgtttgtgtgctcagaagtgttnaaaaaaaatcttcttaacangattcccacgacagagccattcctaatgtgttgactctgtgctagttgtgggnctntngcatttcccaaagacacccagantcattttcaaagctgtnttcaacactggttacctttggantgaaagcattttatcancctgtatctgngtaagnatttgtggntccagtgttttggaggggtctttacatgagtgttttctagggttctccttagagagtctactattcatcaagtccttctgcctgtatgtgtgtgtttgtctaannccttagtcattcattctcttatcct

SEQ ID NO: 3549 - DNA, 372 bp, Mus musculus
  misc_feature (103)..(103): n is a, c, g, or t
  misc_feature (238)..(238): n is a, c, g, or t
  misc_feature (290)..(290): n is a, c, g, or t
  misc_feature (306)..(306): n is a, c, g, or t
  misc_feature (315)..(316): n is a, c, g, or t
  misc_feature (332)..(332): n is a, c, g, or t
  misc_feature (346)..(346): n is a, c, g, or t
accattacctcattacctctttgaaagcatcaagctgtaggaatagaagggtttttatcatggcatctggcagagagcaggtatacatattattactattggnttttttcaagtcagggtttgtctttgtagctatggctgttctggaacttgttctggagaccaggctggcctgaaactcacagagctgcctctgtctcctgagtgttggggttaaaggtgtggatcaccactgtcnggcagggtttgtgttattaacaggtttggtttctgcttgtgaactcctacantttagaagaagatatnctaagatcnnaaaacaaaaacatacntgttaattactcanatctttggtgtgttaagtcagaattc

SEQ ID NO: 3550 - DNA, 420 bp, Mus musculus
  misc_feature (320)..(320): n is a, c, g, or t
  misc_feature (330)..(330): n is a, c, g, or t
  misc_feature (334)..(334): n is a, c, g, or t
  misc_feature (339)..(339): n is a, c, g, or t
  misc_feature (369)..(369): n is a, c, g, or t
aactgttctcagactggttggctctgctctaccacaggatgggggctcctgcaccacactcctgtgtactgcatcttggatatcaccaaaataggcaacatctgtgtgtctttttcctcttttgtagactaggtataaaaatgcaggctgaggggtggggtggggctgggagacgcctcagtcagtaaagtgcttgctatggcaagaaggaagacctgagttcaatcccctgagccacacaaaaagtgaggtatcatgcttcatgttggcattcccaaagctggggagtgggagacagctcccaggaactcactggtcantcagcgtgtnttgntcatngatccccagattaaatggagagagcttctntcagaaacaaaacaaaacacccaacaaacccaaccagattgagtttcctga

SEQ ID NO: 3551 - DNA, 380 bp, Mus musculus
  misc_feature (44)..(44): n is a, c, g, or t
  misc_feature (101)..(102): n is a, c, g, or t
  misc_feature (134)..(134): n is a, c, g, or t
ttgtaagtactcctgtttctaatcttatgagagttgatactgcngcttcatcagacagcaataaaactttccacaaaacaccaaaatacgaggtaattaanncccaaacaagaacattcagaccaacatttggnactactaattaaatttaaatgttttagacattcatttctaaaaatagatgatgctcttctggcatcaagtgtttctctgtctcttcctaaaattcaaatagccagtgacaaaatgtagggaggggctggagagatggctcaggagagcctggggcttaatgttgggttccctgcacccacagcaggcagctccaggagaactgatgccctctgctgacctcttcagacacctacacttaagtatgt

SEQ ID NO: 3552 - DNA, 391 bp, Mus musculus
  misc_feature (36)..(36): n is a, c, g, or t
  misc_feature (43)..(43): n is a, c, g, or t
  misc_feature (48)..(49): n is a, c, g, or t
  misc_feature (62)..(62): n is a, c, g, or t
  misc_feature (303)..(303): n is a, c, g, or t
attcctttagcacattgcttctcagacttcaatggntcaaacnaagcnnagtgagaggcttnctaaaatgcagatgctaaccctggacagggttctctattaatgttgtgctacgaacaccattttgagaggtggaccctggttcattccaagttataccataccaagttataccaccccatcactgtgagcctctagcaaacccaaaacccttcagcttctctgtgccagcttggtgaagcagctgtctgtggtcttatttagtccctcctgttatcgctggggatatggaggggaaaccanaaacatgtcacagcttgtttacagcaagcctaagaaaaggtaaaagtgcaagtttaaaaaaaaaaatgtatcatcagctcctaagaat

SEQ ID NO: 3553 - DNA, 116 bp, Mus musculus
gaatactatgatagcagctggaagttgtgataaaatgattcgtgtctggtgtcttcgaacctgtgcacctttggctgttcttcagggacatagtgcatctattacatcactacagt

SEQ ID NO: 3554 - DNA, 424 bp, Mus musculus
  misc_feature (28)..(28): n is a, c, g, or t
  misc_feature (68)..(68): n is a, c, g, or t
  misc_feature (75)..(75): n is a, c, g, or t
  misc_feature (93)..(93): n is a, c, g, or t
  misc_feature (113)..(113): n is a, c, g, or t
  misc_feature (130)..(131): n is a, c, g, or t
  misc_feature (134)..(134): n is a, c, g, or t
  misc_feature (147)..(147): n is a, c, g, or t
  misc_feature (166)..(167): n is a, c, g, or t
  misc_feature (171)..(171): n is a, c, g, or t
  misc_feature (180)..(180): n is a, c, g, or t
  misc_feature (197)..(197): n is a, c, g, or t
  misc_feature (220)..(220): n is a, c, g, or t
  misc_feature (222)..(222): n is a, c, g, or t
  misc_feature (226)..(226): n is a, c, g, or t
  misc_feature (236)..(236): n is a, c, g, or t
  misc_feature (240)..(240): n is a, c, g, or t
  misc_feature (250)..(250): n is a, c, g, or t
  misc_feature (253)..(253): n is a, c, g, or t
  misc_feature (263)..(263): n is a, c, g, or t
  misc_feature (267)..(267): n is a, c, g, or t
  misc_feature (297)..(297): n is a, c, g, or t
  misc_feature (331)..(331): n is a, c, g, or t
  misc_feature (381)..(381): n is a, c, g, or t
tctgaagaagcccttcgggtttctgagnagacacctggtggccactgagcctggtgacctcaatgggnccaaaantggtgtttatactcaccntgcccagcgtgaagtgatcntactttcacaggccctnntgncctcggtcttatnttaaaggatgttatcttgnnaggncatcacttntaattaatggatgatanttgtaattgactaaagtcctcgntntganccgtttgttntggntccgagagcnctnacatgtgaancatngtgagcagcgagggaactgacaggatgtgnccgtggccagtgtggctttagtgtttgcatcagncagccaccagctccatccgtgttcttactgctttacaaagtttgactaantttacacattttaaaaatgctgattgtcttcgtttaaattata

SEQ ID NO: 3555 - DNA, 438 bp, Mus musculus
  misc_feature (169)..(169): n is a, c, g, or t
  misc_feature (393)..(393): n is a, c, g, or t
taaccggtgccgtatccagatttttagggtggatgtggcaaccgtgagaatgttcctgaaccacaggcaagaaggaactgctgcaatctattcctcttggacttgggctgacactagaattcaagaattgggcactgtaatcatgtcgaggacacatgactcgcaaatnaagcaaggcagaagttgcccttcaggttctgctgactgctgagacacaggaggagctggggtttccactgttgaatcttccatgactaatggtaccatatatttgctgttaaagatgcagcttaagggtctcccagatagctgaggagataaatgcactgaccatcaagcttgatgacctgaccgtgaacctaacggtggaaggatggaaccacactctggaanttcctatctggccttcatacgcatgctatagcttgtgtgcgcaca

SEQ ID NO: 3556 - DNA, 419 bp, Mus musculus
  misc_feature (96)..(96): n is a, c, g, or t
  misc_feature (110)..(110): n is a, c, g, or t
  misc_feature (115)..(115): n is a, c, g, or t
  misc_feature (133)..(133): n is a, c, g, or t
  misc_feature (162)..(162): n is a, c, g, or t
  misc_feature (202)..(202): n is a, c, g, or t
  misc_feature (214)..(214): n is a, c, g, or t
  misc_feature (219)..(219): n is a, c, g, or t
  misc_feature (223)..(223): n is a, c, g, or t
  misc_feature (227)..(227): n is a, c, g, or t
  misc_feature (242)..(242): n is a, c, g, or t
  misc_feature (257)..(257): n is a, c, g, or t
  misc_feature (271)..(271): n is a, c, g, or t
  misc_feature (274)..(275): n is a, c, g, or t
  misc_feature (281)..(281): n is a, c, g, or t
  misc_feature (354)..(354): n is a, c, g, or t
  misc_feature (388)..(388): n is a, c, g, or t
cagattgtcccagttagctttaagacatctctacatggttttgtgcatctactgtggcctttcagatttgacgatccatgcctttgggagcccttnggctatgacaaagnactgngtaagtataagatttaanctcactggagtccaaaggcagagacaatntgaacatgcgtgtgttaattttccttctacactgaagcanatattgtcatgnttttnatantccnatggccttttcattntggcagatcaattantcaaatacaattanttnnatatanatgccaatacaattattaaataccctttcctttcaggtaagcatttacaatacttttcaatacttgagaaaanaaaattcacccacattccttgctcccaagccctntgacctactactacctgatccgaaggtctct

SEQ ID NO: 3557 - DNA, 451 bp, Mus musculus
  misc_feature (197)..(197): n is a, c, g, or t
  misc_feature (225)..(226): n is a, c, g, or t
  misc_feature (313)..(313): n is a, c, g, or t
  misc_feature (316)..(317): n is a, c, g, or t
  misc_feature (319)..(319): n is a, c, g, or t
  misc_feature (322)..(325): n is a, c, g, or t
  misc_feature (327)..(329): n is a, c, g, or t
  misc_feature (331)..(334): n is a, c, g, or t
  misc_feature (341)..(341): n is a, c, g, or t
  misc_feature (344)..(344): n is a, c, g, or t
  misc_feature (373)..(373): n is a, c, g, or t
  misc_feature (375)..(375): n is a, c, g, or t
  misc_feature (378)..(378): n is a, c, g, or t
  misc_feature (381)..(381): n is a, c, g, or t
  misc_feature (385)..(386): n is a, c, g, or t
  misc_feature (391)..(396): n is a, c, g, or t
tcacctgtaaggcaaagagcccctggagagctagcatgcagtctccctgtctcacatgtccctgcaattccctttgtgcctgttagactgtccgtagcagaactcagcaaatgctcgaacgactagctttaggtaccatgttgctgaaaagacaaaactttgcttcccaatctgccgctgaccatgacacccaaggngagcagatgtcaggaacactgtgttagnntctctctctctctctctctctctctctctctctctctctctctctctctctgccctgtgtggggttgctcacaaaggaatctttgcntcnnanaannnncnnncnnnnacctccngtngctgacccccacaaagagagggggagaantntantanaccnntcctnnnnnnggaaatgcaattgcagaatcctttgagccccaagcctcctttttcactgggagga

SEQ ID NO: 3558 - DNA, 442 bp, Mus musculus
  misc_feature (210)..(210): n is a, c, g, or t
  misc_feature (297)..(297): n is a, c, g, or t
  misc_feature (301)..(301): n is a, c, g, or t
  misc_feature (321)..(321): n is a, c, g, or t
  misc_feature (332)..(332): n is a, c, g, or t
  misc_feature (343)..(343): n is a, c, g, or t
  misc_feature (345)..(345): n is a, c, g, or t
  misc_feature (354)..(354): n is a, c, g, or t
  misc_feature (361)..(361): n is a, c, g, or t
  misc_feature (366)..(366): n is a, c, g, or t
  misc_feature (385)..(385): n is a, c, g, or t
  misc_feature (392)..(392): n is a, c, g, or t
  misc_feature (394)..(394): n is a, c, g, or t
agcatatagtgtgcacctgtccctccatttccttgtgagccatccctttgtaccctgtgtgtgttattcattgtatccattgttgacttttgcatatagaaacagaatacaacttgccataaaccccaatctctgccttgatgttgttttcatactgttttcttttttcgttcttttttttttttaagatttattatttatttacttacngtatgtaagtacactgtagctgtcttcagacacaccagaagaggacattcgatcccattacagatggttgtaagctaccatgtggtngctnggatttgaactcaggacctntggaagagcantcagtgctctnancccgtcganccatctntccancccccttcatactgttttntatagtntnttatgtgtcaacaaacgttggttttcctcagtgtatagacagcagtgt

SEQ ID NO: 3559 - DNA, 448 bp, Mus musculus
  misc_feature (210)..(210): n is a, c, g, or t
  misc_feature (219)..(219): n is a, c, g, or t
  misc_feature (227)..(227): n is a, c, g, or t
  misc_feature (242)..(242): n is a, c, g, or t
  misc_feature (250)..(250): n is a, c, g, or t
  misc_feature (252)..(252): n is a, c, g, or t
  misc_feature (259)..(259): n is a, c, g, or t
  misc_feature (261)..(261): n is a, c, g, or t
  misc_feature (265)..(265): n is a, c, g, or t
  misc_feature (272)..(272): n is a, c, g, or t
  misc_feature (282)..(282): n is a, c, g, or t
  misc_feature (297)..(298): n is a, c, g, or t
  misc_feature (300)..(300): n is a, c, g, or t
  misc_feature (308)..(308): n is a, c, g, or t
  misc_feature (345)..(345): n is a, c, g, or t
  misc_feature (379)..(379): n is a, c, g, or t
  misc_feature (382)..(382): n is a, c, g, or t
  misc_feature (415)..(415): n is a, c, g, or t
aaatgcttgccttggctgggtcttatcttagctgtttatttgtggattcagttctattgacttatgtgtctgactccagatgtcagtccactaggtttcatcttaaacatcatggtgagttttaagttgggtattgagacctccagctttgtgcctttttggaaagttattttgtgcgatccaggtcttctcatttccacatgaattctntcgtccgtnttccactntctttcctctccctntccctctntntgccttntnacanaccacanacacacctanctaggaccttggcanntntggactgnaccttctgagttagctgggggacaattggctctatgnacattgatctaagtatgcatttatttagcatatnttntcatttctctcgggaatgttttataattttcantctttcaaatgttttatcagattggtccttatg

SEQ ID NO: 3560 - DNA, 310 bp, Mus musculus
  misc_feature (38)..(39): n is a, c, g, or t
  misc_feature (134)..(134): n is a, c, g, or t
  misc_feature (136)..(136): n is a, c, g, or t
  misc_feature (143)..(143): n is a, c, g, or t
  misc_feature (149)..(149): n is a, c, g, or t
  misc_feature (158)..(159): n is a, c, g, or t
  misc_feature (177)..(177): n is a, c, g, or t
  misc_feature (209)..(209): n is a, c, g, or t
  misc_feature (211)..(211): n is a, c, g, or t
  misc_feature (222)..(222): n is a, c, g, or t
  misc_feature (237)..(237): n is a, c, g, or t
  misc_feature (242)..(242): n is a, c, g, or t
  misc_feature (275)..(275): n is a, c, g, or t
gatgaattcacatcccacttcaatccaaccccgacctnntaaaattagtttcacagaaaaacttaaggctgaagcctggttggcttggagcagtgttgaaaagaagccagtggcaacaacccccacccctagangnagcagcngagctntcagaaagnntcaggctttgtgactccnttattcacaggtgccttcagctgcactgtggnanccagcttcacnccctagtcactccanccttngctttcttagtaactctctaaatcttcttgggnaaattgtgtaagacaaactgactaaatcctcaaaa

SEQ ID NO: 3561 - DNA, 157 bp, Mus musculus
ctgaagtttaattacaactgggcagggtggctcacagcacaaagattcgtgctggagaatggaatttgaggctatcctggctatacacagagaccctatctaaaaactaatttattaggtctagtatctcacacctctaatcgaagcactgcagaga

SEQ ID NO: 3562 - DNA, 430 bp, Mus musculus
  misc_feature (173)..(173): n is a, c, g, or t
  misc_feature (177)..(177): n is a, c, g, or t
  misc_feature (185)..(185): n is a, c, g, or t
  misc_feature (187)..(187): n is a, c, g, or t
  misc_feature (197)..(197): n is a, c, g, or t
  misc_feature (201)..(201): n is a, c, g, or t
  misc_feature (217)..(217): n is a, c, g, or t
  misc_feature (219)..(219): n is a, c, g, or t
  misc_feature (281)..(281): n is a, c, g, or t
  misc_feature (285)..(285): n is a, c, g, or t
  misc_feature (311)..(311): n is a, c, g, or t
  misc_feature (344)..(344): n is a, c, g, or t
atacccgtattgatgagtgactagggcctgaggagagtgggtgacagagtcctctgagatgaacacctcaggcaagctgcttgattgacatctgttgacatctgttggcaactgctagccattcctgttagatgtggttgaattgagggaagagaacatttgaccccatcccnttantcattttngnagttggtttnattnattggccctgttattnanttctgtttgctggatattttctgcccacctgtgataaggtccagacaagttcacgcccaccncttnccttggtgacttaggctgtggtccanccccagacagcagcatctggaccccagtgtacncgagcgatgctaggaactgctactgctttacaaatacctgggcgcgcgcgcatgcccagagttagctcgcgtttctgatggcaaaa

SEQ ID NO: 3563 - DNA, 381 bp, Mus musculus
atatttctcacatcaatgctgccacggggaccagtgccagccttgtctacagactggtttcaaaagctggggatgcccctctggtgaaagtatcgagtagcactggggagattttcacaacctccaacagaatagacagagagaaactctgtgctggggcttcatacgctgaggagaacgagtgcttctttgaacttgaagtagtgatcctccccaatgactttttcaggctgatcaaaatcaagatcattgtcaaggataccaatgataatgcccccatgtttccgtctcctgtcatcaatatttccatcccagagaacactttgatcaacagccgctttccaatcccatcagccacagaccctgacacgggcttcaatg

SEQ ID NO: 3564 - DNA, 382 bp, Mus musculus
gtgtcacctgctcccgaactagaaggagagagacaatggttggggccatgcctatcccactggactaccactcctttgtcttatttgtctccaaattaccagatggactcagtgactccttagaacttgaagccttgggctcagtcagaagatgggatggagagaccagagtctgcgctggcttcttggccaatggggcctgtgctggagtgtcactctgcaggtggcacccagttaggaggctatcagatagttatcaatccccatgcctacacttgggctacctccttaatgttgcacccattcactgtatgaccttagtggggtagctttacctccagagccctgccacccaatgacagaaccatccaaagtttcccag

SEQ ID NO: 3565 - DNA, 197 bp, Mus musculus
  misc_feature (97)..(97): n is a, c, g, or t
  misc_feature (107)..(108): n is a, c, g, or t
  misc_feature (113)..(113): n is a, c, g, or t
  misc_feature (123)..(123): n is a, c, g, or t
  misc_feature (133)..(133): n is a, c, g, or t
  misc_feature (137)..(137): n is a, c, g, or t
  misc_feature (152)..(152): n is a, c, g, or t
  misc_feature (163)..(163): n is a, c, g, or t
gcttctccacgcactggggaagggagagctcctttggtggcagctgagagcgatgcctggcccacctagtcatcacagggctccactgaacatggtnggaaggcttnnatctngtgcttcctntcccagcttntccnaggccagccaagccngtatggaagancttctccctgtgtggtacaagcatggagaccaca

SEQ ID NO: 3566 - DNA, 203 bp, Mus musculus
  misc_feature (97)..(97): n is a, c, g, or t
  misc_feature (107)..(108): n is a, c, g, or t
  misc_feature (113)..(113): n is a, c, g, or t
  misc_feature (123)..(123): n is a, c, g, or t
  misc_feature (133)..(133): n is a, c, g, or t
  misc_feature (137)..(137): n is a, c, g, or t
  misc_feature (152)..(152): n is a, c, g, or t
  misc_feature (163)..(163): n is a, c, g, or t
gcttctccacgcactggggaagggagagctcctttggtggcagctgagagcgatgcctggcccacctagtcatcacagggctccactgaacatggtnggaaggcttnnatctngtgcttcctntcccagcttntccnaggccagccaagccngtatggaagancttctccctgtgtggtacaagcatggagaccacacagtct

SEQ ID NO: 3567 - DNA, 324 bp, Mus musculus
  misc_feature (116)..(116): n is a, c, g, or t
  misc_feature (164)..(164): n is a, c, g, or t
  misc_feature (173)..(173): n is a, c, g, or t
  misc_feature (243)..(243): n is a, c, g, or t
  misc_feature (255)..(255): n is a, c, g, or t
actgacggagtgtagactggtttcacagagggcagtctggagctagccactctaccctggctttattgtgtctgtgccccagtgcctggtgcgtttctgtcatatctttacaaccnattccttgggaattggttgccagctgactgccaggctccagcattaantcatacccnaatctgacctccatgcatggctttgctgctgtgggctctcctgctcttcactatttattaagtacaccanttttgttttggntttttggttttttttttttaaagcggtttgtaagatatctttaaaaagccgggcactggtgacacatgc

SEQ ID NO: 3568 - DNA, 349 bp, Mus musculus
  misc_feature (90)..(90): n is a, c, g, or t
  misc_feature (96)..(96): n is a, c, g, or t
  misc_feature (102)..(102): n is a, c, g, or t
  misc_feature (151)..(151): n is a, c, g, or t
  misc_feature (182)..(182): n is a, c, g, or t
  misc_feature (189)..(189): n is a, c, g, or t
  misc_feature (192)..(193): n is a, c, g, or t
  misc_feature (198)..(198): n is a, c, g, or t
  misc_feature (200)..(200): n is a, c, g, or t
  misc_feature (220)..(220): n is a, c, g, or t
  misc_feature (235)..(235): n is a, c, g, or t
  misc_feature (238)..(238): n is a, c, g, or t
  misc_feature (259)..(259): n is a, c, g, or t
  misc_feature (320)..(320): n is a, c, g, or t
ggtgagggcagtgtgctggtctcctgctctccactgctgtgtttcctgaaagaatcaagagctcagggcattgaccacttggcatcattntatggnacaganttaatctctgtgcttggctctggtctctaggtccccagtctaggtgttnagcccttgggtacaccagggtcagtatgacntgggagncannatccntntctgtaaagcctgtataggnagtgggtgggagctncanccagcatggagatggcactgnctgtttgcacagctaagttaaccccctttagctttttattaatttaatcaatagttactcnaagtgtttaacatgcactcggtatgtttg

SEQ ID NO: 3569 - DNA, 328 bp, Mus musculus
  misc_feature (97)..(97): n is a, c, g, or t
  misc_feature (125)..(125): n is a, c, g, or t
gctactgggacttccttagggtgtaggctgaggccagcatgggtgataggcagtttccaaagttgagtgcgccagacctcttgaagtcctcttttgngatttaaaggagtgggaatgaccttccncattatgtcccaccctcctctcctttcttctctgtgccctcaaatttcagagctcaaacctactttcaaaaatctgagagtcttatacaggccatatatacacaagggttacatatattcagcgcagaactaggccaccaaagtgcacaggtgtcttagaagtgagcagcgatctctcaatatccaatattctgcccttcaga

SEQ ID NO: 3570 - DNA, 387 bp, Mus musculus
  misc_feature (351)..(351): n is a, c, g, or t
aaatcctttggcttgcagtatctgttgggcggccagcacgtagtgtcctgttaccgatggcactttctccactttcccatagcccgtaagccatcctaatgaactgaaaaaaaggatcagtaatacaacgaggataccgatcgctgcgagtatgtttacccaaatggattttccagtaattcttttaaccaggttgctcatgcttacttattaattaaggacttcatctatcaatgcagaataaaaatctttcaggttccatcccatgatcttcacctgttgaggaatgatgctggcttcactttgtcccggaaccgtattcacttccagcatatagggttgtccctgtgnttcgttgtaaataaaatcgatgcgtaccacaccgcg

SEQ ID NO: 3571 - DNA, 319 bp, Mus musculus
acagcgcgtgagtcagaatttccgaaaggcataattttagtgccccttcttgcggttgcctctccaggctgtctctgaaaggggaggcctccgcgggcggggtttcctgtgctcaattccagagatgacaacggggctctccccaagccgtttgccagtattttctttccagatacgtttttaaacttggtagcagccgttaatgtcttcttagctgagaatttcgccccacgcttgtacagcgtccttcttccaaatgcgtgggctgctacgaagtggaaaaggagatggctgagtgtcaaccgcgtttgctgccaag

SEQ ID NO: 3572 - DNA, 352 bp, Mus musculus
  misc_feature (76)..(76): n is a, c, g, or t
  misc_feature (97)..(103): n is a, c, g, or t
  misc_feature (106)..(110): n is a, c, g, or t
  misc_feature (116)..(116): n is a, c, g, or t
  misc_feature (123)..(123): n is a, c, g, or t
  misc_feature (134)..(134): n is a, c, g, or t
  misc_feature (158)..(158): n is a, c, g, or t
  misc_feature (178)..(178): n is a, c, g, or t
  misc_feature (327)..(327): n is a, c, g, or t
tgcaccctgaaagctggacccaaagcaatattaaacacatgaggaagcagctcgaccgcctcggcctgtgcttcangctgggacagggtgagtcagnnnnnnnctnnnnntctgtncaggganggcccggctgngtgagccccttcctccagtctcgnttgggagaaggaaaaggaantggcggacctctggagagaaggcttagcactccacaaactcaaaagactccagagtgggtgttttgcctgtatacaaataattttctgggggatgaagctaagagagctcacttcttatttgactatgtgtggcaatgactttgcacanggatttctggcacacagcaacagtt

SEQ ID NO: 3573 - DNA, 307 bp, Mus musculus
  misc_feature (37)..(37): n is a, c, g, or t
  misc_feature (55)..(55): n is a, c, g, or t
  misc_feature (64)..(64): n is a, c, g, or t
  misc_feature (75)..(76): n is a, c, g, or t
  misc_feature (89)..(90): n is a, c, g, or t
  misc_feature (93)..(93): n is a, c, g, or t
  misc_feature (102)..(102): n is a, c, g, or t
  misc_feature (110)..(110): n is a, c, g, or t
  misc_feature (112)..(113): n is a, c, g, or t
  misc_feature (116)..(116): n is a, c, g, or t
  misc_feature (121)..(121): n is a, c, g, or t
  misc_feature (124)..(124): n is a, c, g, or t
  misc_feature (173)..(173): n is a, c, g, or t
  misc_feature (175)..(175): n is a, c, g, or t
  misc_feature (184)..(184): n is a, c, g, or t
  misc_feature (191)..(191): n is a, c, g, or t
  misc_feature (205)..(206): n is a, c, g, or t
  misc_feature (223)..(223): n is a, c, g, or t
  misc_feature (232)..(232): n is a, c, g, or t
  misc_feature (235)..(235): n is a, c, g, or t
  misc_feature (237)..(237): n is a, c, g, or t
  misc_feature (250)..(250): n is a, c, g, or t
ttcccgtggccaggacactgctgtagatgcctttgtntaaactgcatcagcggtnatctgcttnacctttctctnntctttttcttctnntgntgcatgtanaccactcntnnatnagacngantgctttgcggaagaggaggggctgtcaccagagttccctccagagtgcngnctgctcttnccttggntctctttagttggnnacggcttggttcatcanacactggcnacnantcctctctaatgnatgtaactttaaatcagatttcccacctgaagcaagggagacttggattcctctgct

SEQ ID NO: 3574 - DNA, 210 bp, Mus musculus
gaaagagattctaccagttaacatagaatgtgaaactgtcaggaagaaacaaagaggggagggagccggatagattgctcagtggttatgcacacttaaagctcctgcaaaggacccagttttggttcctagcacctatactgggcaacgcacaactacctgtaactccaattcctcaggcacctgacttcctctgacactaggcacaca

SEQ ID NO: 3575 - DNA, 284 bp, Mus musculus
aggtcctccctggagtgcaggtcctccctgggcaggcattttagaaattggtaggttttgttttaaaaaataagcctcatttttatttctcctgttttcagtatggaaataatatgtttgtagataaaggagaatggaaatgagcttcaagctttgacctttggtcctcctgcctcggcctcctccaagtgctggggttacaggtgtgttccaccatgcctgctctccaggggcccttaacacaaatataccaccatgcattctcttctggtcccaaagttgaa

SEQ ID NO: 3576 - DNA, 47 bp, Mus musculus
tatatctcccaactttctatctgaatccaagcctttagaataattta

SEQ ID NO: 3577 - DNA, 258 bp, Mus musculus
  misc_feature (134)..(134): n is a, c, g, or t
  misc_feature (136)..(136): n is a, c, g, or t
  misc_feature (141)..(141): n is a, c, g, or t
  misc_feature (143)..(144): n is a, c, g, or t
  misc_feature (146)..(148): n is a, c, g, or t
  misc_feature (151)..(151): n is a, c, g, or t
  misc_feature (179)..(179): n is a, c, g, or t
  misc_feature (216)..(216): n is a, c, g, or t
agaccctcccatttcagtgaatcaaagcccctggacccttttcttccagcctgcctttagggcatctctgtgcctacgtaagacctgggaggagggaggatttacggagtacctgctacatgccatgctctggncngagcngnngnnntcntggggggggggggagtgggatgtgagancaccccgacctccacccacaggatgttacttaggacncacactgctgtttgcctggctttctcatgatccacagtagta

SEQ ID NO: 3578 - DNA, 159 bp, Mus musculus
  misc_feature (46)..(46): n is a, c, g, or t
  misc_feature (52)..(52): n is a, c, g, or t
  misc_feature (60)..(60): n is a, c, g, or t
  misc_feature (62)..(62): n is a, c, g, or t
  misc_feature (64)..(64): n is a, c, g, or t
  misc_feature (72)..(72): n is a, c, g, or t
  misc_feature (79)..(79): n is a, c, g, or t
  misc_feature (81)..(81): n is a, c, g, or t
  misc_feature (93)..(93): n is a, c, g, or t
  misc_feature (98)..(98): n is a, c, g, or t
  misc_feature (126)..(126): n is a, c, g, or t
accttttttcacttccaatatgaaggccttccctgcaccaactganccactncttaattnangntgacatgnctgatgnantagagacaggantattncattagagaggacaggttattcatagantcactcaggatttcctgctgaggatacagtcag

SEQ ID NO: 3579 - DNA, 241 bp, Mus musculus
  misc_feature (53)..(54): n is a, c, g, or t
  misc_feature (56)..(56): n is a, c, g, or t
  misc_feature (59)..(61): n is a, c, g, or t
  misc_feature (84)..(84): n is a, c, g, or t
  misc_feature (108)..(108): n is a, c, g, or t
  misc_feature (123)..(123): n is a, c, g, or t
  misc_feature (159)..(159): n is a, c, g, or t
  misc_feature (213)..(213): n is a, c, g, or t
gaggtcctgctccactactgcgaggttttcctgcacgcggcccggctggtgcnncncgnnngcgggaaggtgtggaaagtgcanttcgtgacgccgaccttcgacccnccgggctcaggctcntgtgcggggcccgacggcggcagcggcggcggcaangacgcggaggcgggacaggaagcgggcgcggccccccaggcccggctgtgcccntgcgtgttcggggtgacccagcacgacc

SEQ ID NO: 3580 - DNA, 246 bp, Mus musculus
  misc_feature (53)..(54): n is a, c, g, or t
  misc_feature (56)..(56): n is a, c, g, or t
  misc_feature (59)..(59): n is a, c, g, or t
  misc_feature (61)..(61): n is a, c, g, or t
  misc_feature (67)..(67): n is a, c, g, or t
  misc_feature (70)..(70): n is a, c, g, or t
  misc_feature (74)..(74): n is a, c, g, or t
  misc_feature (86)..(86): n is a, c, g, or t
  misc_feature (95)..(95): n is a, c, g, or t
  misc_feature (97)..(97): n is a, c, g, or t
  misc_feature (99)..(99): n is a, c, g, or t
  misc_feature (113)..(113): n is a, c, g, or t
  misc_feature (120)..(120): n is a, c, g, or t
  misc_feature (124)..(125): n is a, c, g, or t
  misc_feature (128)..(128): n is a, c, g, or t
  misc_feature (136)..(136): n is a, c, g, or t
  misc_feature (146)..(146): n is a, c, g, or t
  misc_feature (205)..(205): n is a, c, g, or t
  misc_feature (216)..(216): n is a, c, g, or t
gacaagaatgggaccatccatggacattccctggcagcaaatgaaacatgggnntnagntnccttgnacnagtnagatgaaatggntctttgagntnantctgagagacaganttacttngacnnatnacactgangcagattagnagctagtatcacccattgggattggcaatgccttcaaaggctcctagtcaaatgatccnaacctttaacntcgtttctgatggtacccaagttcacattt

SEQ ID NO: 3581 - DNA, 199 bp, Mus musculus
  misc_feature (74)..(74): n is a, c, g, or t
  misc_feature (84)..(88): n is a, c, g, or t
  misc_feature (97)..(97): n is a, c, g, or t
  misc_feature (102)..(102): n is a, c, g, or t
  misc_feature (104)..(104): n is a, c, g, or t
  misc_feature (115)..(115): n is a, c, g, or t
  misc_feature (131)..(131): n is a, c, g, or t
atctctgtagagatctaccacctctctgaaccgtagccttgacactggacattgggcctcgggctagacaattntgaagttcannnnngagattccncaggngnatggagagacnagaaggtggtctcccnaggcttgtctggaaccaaatccctggaaggaaacctttccctgaggagagatcttaaacccctcaggg

SEQ ID NO: 3582 - DNA, 132 bp, Mus musculus
  misc_feature (28)..(28): n is a, c, g, or t
  misc_feature (47)..(47): n is a, c, g, or t
  misc_feature (63)..(63): n is a, c, g, or t
  misc_feature (67)..(67): n is a, c, g, or t
  misc_feature (107)..(107): n is a, c, g, or t
aaacactgaatctgagttcccgattcantcttaaaggttttctgcanccattccttcctgtgntctntcgctgttaaatgttgcttccctgaagtgatgctttcatntctggcatttgtgatttgtgggaaa

SEQ ID NO: 3583 - DNA, 234 bp, Mus musculus
  misc_feature (55)..(57): n is a, c, g, or t
  misc_feature (59)..(60): n is a, c, g, or t
  misc_feature (62)..(63): n is a, c, g, or t
  misc_feature (65)..(69): n is a, c, g, or t
  misc_feature (71)..(71): n is a, c, g, or t
  misc_feature (75)..(76): n is a, c, g, or t
  misc_feature (78)..(79): n is a, c, g, or t
  misc_feature (81)..(85): n is a, c, g, or t
  misc_feature (87)..(95): n is a, c, g, or t
  misc_feature (97)..(103): n is a, c, g, or t
  misc_feature (105)..(108): n is a, c, g, or t
  misc_feature (110)..(112): n is a, c, g, or t
  misc_feature (114)..(115): n is a, c, g, or t
  misc_feature (118)..(118): n is a, c, g, or t
  misc_feature (122)..(122): n is a, c, g, or t
  misc_feature (129)..(129): n is a, c, g, or t
  misc_feature (142)..(142): n is a, c, g, or t
  misc_feature (151)..(151): n is a, c, g, or t
  misc_feature (155)..(157): n is a, c, g, or t
  misc_feature (185)..(185): n is a, c, g, or t
  misc_feature (201)..(201): n is a, c, g, or t
  misc_feature (209)..(209): n is a, c, g, or t
tcgttatcattcaaagctgaactgtctctcacaaattcatcttttgaaatcttcnnncnnanncnnnnntncttnncnnannnnntnnnnnnnnnannnnnnncnnnncnnncnngtncagnccagggnggtaccttgaaanttatacccnccannngaacagcatgcaccacgcgttcccaatntgtagacggacttatntccccacncctctctgtgacaatgggctaaaac

SEQ ID NO: 3584 - DNA, 220 bp, Mus musculus
  misc_feature (28)..(28): n is a, c, g, or t
  misc_feature (39)..(39): n is a, c, g, or t
  misc_feature (43)..(43): n is a, c, g, or t
  misc_feature (45)..(45): n is a, c, g, or t
  misc_feature (81)..(81): n is a, c, g, or t
  misc_feature (83)..(83): n is a, c, g, or t
  misc_feature (85)..(85): n is a, c, g, or t
  misc_feature (92)..(92): n is a, c, g, or t
  misc_feature (104)..(105): n is a, c, g, or t
  misc_feature (123)..(123): n is a, c, g, or t
  misc_feature (127)..(127): n is a, c, g, or t
  misc_feature (129)..(129): n is a, c, g, or t
  misc_feature (141)..(141): n is a, c, g, or t
  misc_feature (154)..(154): n is a, c, g, or t
  misc_feature (159)..(159): n is a, c, g, or t
  misc_feature (173)..(173): n is a, c, g, or t
agaccagactcacttcaaactcataganatccacctgcntttncntccagagagctaggatcaaaggcctgcatcactacnancnggctaanctgttattttcnnttttgatgttcataattngacntntcaaatgagtantcttagagagttnttttntgcaagttggagantcatgttttctaaatattcataaaagagaaacataatgttgcttctt

SEQ ID NO: 3585 - DNA, 170 bp, Mus musculus
  misc_feature (41)..(41): n is a, c, g, or t
  misc_feature (48)..(48): n is a, c, g, or t
  misc_feature (54)..(54): n is a, c, g, or t
  misc_feature (63)..(63): n is a, c, g, or t
  misc_feature (78)..(78): n is a, c, g, or t
  misc_feature (92)..(92): n is a, c, g, or t
  misc_feature (94)..(94): n is a, c, g, or t
  misc_feature (99)..(99): n is a, c, g, or t
  misc_feature (109)..(109): n is a, c, g, or t
  misc_feature (111)..(111): n is a, c, g, or t
  misc_feature (117)..(117): n is a, c, g, or t
  misc_feature (132)..(132): n is a, c, g, or t
taaattctgacttccttgtgggttggtactgataagcaccnagcattntatccnggatactanacttgatggtaaccngaatttatttcttntnttttnagctatatcnantcattntattatagttacttnatatgtaaatatatttctgtacatgtggctttatttaa

SEQ ID NO: 3586 - DNA, 42 bp, Mus musculus
agatggccattttcccttgcacagggttgacatagaaagcct

SEQ ID NO: 3587 - DNA, 178 bp, Mus musculus
  misc_feature (33)..(33): n is a, c, g, or t
  misc_feature (54)..(54): n is a, c, g, or t
  misc_feature (75)..(75): n is a, c, g, or t
  misc_feature (112)..(112): n is a, c, g, or t
  misc_feature (125)..(125): n is a, c, g, or t
  misc_feature (146)..(146): n is a, c, g, or t
tcagtgtgggttgatgggaccttcaccctctgntccctcctctgacctgggatntccacattaagagatggaagnagacctgcaagtcagggactctggtagctcacagccnatgaactgctttnccatgtttttatttcctagtnccatatacaaactagtggcccaagagctatgg

SEQ ID NO: 3588 - DNA, 69 bp, Mus musculus
taccctaacgtgctaccatcttagatttcctctgggacccctggatgctcaatttccaccttgagcaac

SEQ ID NO: 3589 - DNA, 39 bp, Mus musculus
gaggacagcttcctgagttttcccaaggatgttccttgc

SEQ ID NO: 3590 - DNA, 94 bp, Mus musculus
aaaggcttgccagaatgtgaagaatgtgacaatacatgaggctaatcccagcacttgtgagatggaagcagacagatgtccgtaagttccagga

SEQ ID NO: 3591 - DNA, 389 bp, Mus musculus
  misc_feature (331)..(332): n is a, c, g, or t
  misc_feature (338)..(339): n is a, c, g, or t
  misc_feature (341)..(341): n is a, c, g, or t
  misc_feature (350)..(350): n is a, c, g, or t
  misc_feature (364)..(364): n is a, c, g, or t
gatacttctaatcctgtcaacatatcttttagtaaaagctcaaaaactgtagtccatatttttattagtgttattataagtcaagcttccaaagtggaagtcctgagaaaagtcaggctgagatgacttggaagaaagaccaagagctagctttagttgttggatgggctctggaccttaaataagatgacttatcccacaatttctttcatgtttaaaaagatttttatcctctccacacatagtttgttttgttgatccgcctccgtactgatttctttcatcttcaatgttagtttgctccatgacccaaagacttgcctgcattctnntactgnnancaacaccantaagattatttttnaaaaccatacctttcatttgatagt

SEQ ID NO: 3592 - DNA, 226 bp, Mus musculus
  misc_feature (109)..(109): n is a, c, g, or t
  misc_feature (144)..(144): n is a, c, g, or t
ggcagccatcttgtctgctaactgaactcctgcacaacaagatggaggtggctggccttcatgtgacctattgtttcaggtcgctttggtttctcccttcaccgggttntagtggcccggtttgcaagtgcagaatggtgaggnggctccctaaagcagcctcgaccatccacagacagcctcacgtttttctcctactttttccttatgcttttaaatggcagac

SEQ ID NO: 3593 - DNA, 538 bp, Mus musculus
  misc_feature (28)..(28): n is a, c, g, or t
  misc_feature (52)..(53): n is a, c, g, or t
  misc_feature (78)..(78): n is a, c, g, or t
  misc_feature (85)..(85): n is a, c, g, or t
  misc_feature (97)..(97): n is a, c, g, or t
  misc_feature (103)..(103): n is a, c, g, or t
  misc_feature (108)..(108): n is a, c, g, or t
  misc_feature (117)..(118): n is a, c, g, or t
  misc_feature (131)..(131): n is a, c, g, or t
  misc_feature (169)..(169): n is a, c, g, or t
  misc_feature (177)..(177): n is a, c, g, or t
  misc_feature (227)..(227): n is a, c, g, or t
  misc_feature (267)..(267): n is a, c, g, or t
  misc_feature (485)..(485): n is a, c, g, or t
acagactaatgtgtgcaggttataagcnctgttaaagtggtgggttgagganncggctcatttgatgaaagaaatgcnacttggntaccaccctcanccccancatanagggcatannagctgtaatcctngcatggacctctgtgggtgatggctgaagggccagaanttggacancctgtgtcttggagctagtttcaaggctagagcctgggacaaagagactntcaagcatcaatcaaacaaacaaaggtcatatgttaggtnccgtgttcctgtaatcccagcaccccaagcaggaaataacaaatttgaggtcagtttgagctatatgtggtaaaaccttggctctgaaaatgaaactgtaaaaagaaactgaagacaaacatttaaaatggtgctggagagatgactcagttgataaaacacgtgctatgtaagcaggaagacccaaattcagatccccagctcctactggactgtanacctctcctggggtggaagagtcagacagattcctgaaggtcactggccaagc

SEQ ID NO: 3594 - DNA, 359 bp, Mus musculus
  misc_feature (27)..(27): n is a, c, g, or t
gagcctgggaggaagctaatgctttanataccagaggagggaggggcctgtaggagtctggactgcttgcactgtgcactgaggtctggggcaggggcaggttttcgttttctaggtgtccactgtggatattggagtatatttatattccttatggagatgggggtgggaggaatctgtgagatctgtgttttcatttgcattttttctcagtaggacaggggcgtggacaaatggacccgagggctcctttctgcaccagcttttttttctactgctgatgccatccgttagtgtgtcatatcttacagaaacgcctctctggctgggtggtgcagcctgtgctatggagtaagttc

SEQ ID NO: 3595 - DNA, 463 bp, Mus musculus
  misc_feature (289)..(290): n is a, c, g, or t
  misc_feature (312)..(312): n is a, c, g, or t
tgaagaacacatggccgtgcttggtgtctcggtttaggacggtcacctgtgcctgtgggctgaggtgttcagcagcaaggagacggcaggccccacctgtaccccaccttgtgctctggctgcaaacaggagccattgtctgtttaccctgttcctgactctcttcctcccctgagctagtggtgagaaatcacttgggcttctgtctccctgcagactctcccatggttgctgtttcctgttctgttttgttttgttttttaagatccattttgtattctgtggcaannttgatctagttgcttgccaggnactttttttcaaacacactagcagggctgagagtggggctcagtggacagagtatgtatctaacacacaggaggtcttgggttctgaccccaggaccacatacatcaactgtggtggtacacatctgtgtgattctagcacctggcaggca

SEQ ID NO: 3596 - DNA, 492 bp, Mus musculus
  misc_feature (47)..(47): n is a, c, g, or t
  misc_feature (256)..(256): n is a, c, g, or t
ggaaagattaattatctgcttcggggcaaagtcaacagagatattgnctgaaatcacatatgcttatcacaggttagatcttagagctgatgtagaatggaaaacctgggagggaaatttatgttcttcatattaaatatatcataatgtttcgttgaaacctaagtttgcagtgcacaggagactttagttacttcttcagaatttattagcacaacaggcatatggaaaactgtaaaatgattccatttcaaancaaattatgataaacagaagaaatagggatgaattgtactaaatacaatgttttcatacacattttaaattaaactttaatagccatatgctataaaacaatacatgcatttatgttgctttaaaatttttgtgaatatttttacaatgatgattctcacaaatctttactttggaacctaaaaacatctcgttttatgacctgatactgaaagagctccagttacatgggtgaaa

SEQ ID NO: 3597 - DNA, 519 bp, Mus musculus
  misc_feature (336)..(340): n is a, c, g, or t
  misc_feature (416)..(416): n is a, c, g, or t
  misc_feature (467)..(467): n is a, c, g, or t
  misc_feature (469)..(477): n is a, c, g, or t
  misc_feature (479)..(481): n is a, c, g, or t
acacagaaagttacatctcatgtccaaaaatgaccttattacttggccctaatttagttttgcatgaatttttaaagcaggaatcataaatggcccaagtgtcttaattcaaattcttacctgactgtggagaagaaatcattgtgatttttgaacacacataattatggtttaaaaacaaactaacctgaatttgtttgaatatagtttttcaactttctctgatactaataaactcatcagccagttggaaattgctttccagaaaaaattctcattgcttatatgttcatatatttgtacatgtataaaagatttcaaaaacttggaataagnnnnnaccattcttaataaggatattaatggatatttaaagtgcctgtcttttcagtgtttggaaatttatttagtgtttnttcagggcgtatcaaatcaataaaatgtccatgtctgtgatgactaggaanannnnnnnnnannntctttctcttgctgcataacctgtcttattcagaacta

SEQ ID NO: 3598 - DNA, 494 bp, Mus musculus
  misc_feature (193)..(193): n is a, c, g, or t
gtttatctctatttcagtctgtcccctgcccctgaaggccaaccctttagggaaggaggccctgaggctgcaagtttacacaggctagtagtcccgaaggtgccttttttcaatggatgggggccacagctagtttttaggtgcctgtggtcagtattgctgcataggacaccagaatggctaagggaaaccnagccagatgtgactcagaaaaaataaacactctcacctcccagaagctctggtttggacacacattcaacaggtacacttctttgtggccattcatcattttcaggtaaagggggtttatagtaaactctagcacagtctagtagggcaagaaactgcagtgagccccagggtctgtgctttagggagacaggataataggggtctgtagcttgagctcaatgtatacatccagatggagagagccattaagctgatgttgttatatatatgtaactatgacaacaatatccccacttctg

SEQ ID NO: 3599 - DNA, 539 bp, Mus musculus
  misc_feature (38)..(38): n is a, c, g, or t
  misc_feature (80)..(80): n is a, c, g, or t
  misc_feature (88)..(88): n is a, c, g, or t
  misc_feature (509)..(509): n is a, c, g, or t
cagctatttgtaacccttcctcagctgtcccagtaggnggagtttacagcatgtgccatgtgcggccatacccagtcatntgactacncctcacaatctaaagccgggtctgaggtagctgatgttactcctgtggtttgagctgggaacgactcacggataaaaatatatagtgtgtaactagtagaactaggaaacaccaaggcaagacatttggcaagtttaataaaaactattctttggttgttgtatatttttttaaaacttgtattttgctgcattgtttggtttgaaacatatcacctgtgtaagccatatcttgaatgaacttaaatgttcgccataactatttgaaagttaatatatatggttaaatttcttgctgataccaaaagagatcatttggagataaaaacaacctttgcttgtaattaaagttgctgctgcttctgtatgtgtactccctcctccccgccccccttggtaaagggtaataaaacgactacacnaaaagtaaacttttgtttacttatctcagg

SEQ ID NO: 3600 - DNA, 468 bp, Mus musculus
  misc_feature (90)..(90): n is a, c, g, or t
  misc_feature (327)..(327): n is a, c, g, or t
  misc_feature (337)..(337): n is a, c, g, or t
  misc_feature (347)..(347): n is a, c, g, or t
  misc_feature (359)..(359): n is a, c, g, or t
  misc_feature (363)..(363): n is a, c, g, or t
  misc_feature (377)..(377): n is a, c, g, or t
  misc_feature (394)..(394): n is a, c, g, or t
  misc_feature (400)..(400): n is a, c, g, or t
gatagcaacttgtgtgtttctccagggttttcagtcctgctcaatgcagcgtgtggatgctgctccctacacattagagttttttaaaanaaaaagaaaaaaaggaagaggaaatgaaagggaaagggaatttgtcaagaaagcacatgactttgaaagatggggagatttacattgttgttgttgttaatgtaactagtacattaaccacattaatattcactttagtaactttaagaacagccttaagctgacttgtgctagcaaaggaccatgaagctttcattcagtcctggccgtaccagtaacaaatagtgtcattttgtntaccagtganccttttgggntcattggaaccntttnccaaaccaggaggncctcgactctaacttanccccantttaagatggctaatttgggcttcctgatgatagacttgggttccaagggtgtttgtggattccctgt

SEQ ID NO: 3601 - DNA, 468 bp, Mus musculus
  misc_feature (86)..(86): n is a, c, g, or t
  misc_feature (113)..(113): n is a, c, g, or t
  misc_feature (376)..(376): n is a, c, g, or t
  misc_feature (378)..(378): n is a, c, g, or t
aactggtgtgctggacctttttcaaaccactgaggaataagaatatagtgtgccctctaagtcagaatgaagtacgaaaggcagcngtgccccgtgctggtgatgatcagttnttccaactgtattccctctgcctccaccttccagatcctcccagagtcctgatggaggctgagcaggtttctgcttagaagtcttcctcgggatgggcatcccaggattctgctaaagtgcctactgcaaagcaatggcaccaagggaggggtgtgactcagtggtagaacacttgcccagtaggtacaaagccctcactttggtccccagcaccaggtcaaaaagaagaaagaaagaaaacattagtaactcagaaaagtcngncaccccttgggaagtactactgagataagaatcacatcactgttcaacagttagttaagtaccacaacacaccagataaactgtccccag

SEQ ID NO: 3602 - DNA, 382 bp, Mus musculus
  misc_feature (174)..(174): n is a, c, g, or t
agcaaaaggccttccctgcatggactcggcaaggagaagccagccacgacctggggcagcgggggaccctgctcccccacagcactatcagatatagactccgacacgctctctcagggaaactttgaggttggatttcggtctcagaagtcaataaaagtcacgcgagagcancaaccagaggccgaagtgggtgggcagccaggtccaagccaggactcaaccagccatgcctcggacacagtggcccggctagctagatctgaggacggtggcccagctgggtctccaggggcatctgatttccagaactgcagccctggctggtccagtgccttctatgaggctgactgctttggagccgatgtctacaactacgtga

SEQ ID NO: 3603 - DNA, 554 bp, Mus musculus
  misc_feature (229)..(229): n is a, c, g, or t
  misc_feature (300)..(300): n is a, c, g, or t
  misc_feature (379)..(379): n is a, c, g, or t
  misc_feature (446)..(451): n is a, c, g, or t
  misc_feature (495)..(495): n is a, c, g, or t
aatccaggccaagtgtacattgcttttcatcgcagcaggtgcacaggaacatggatcttcaaggccaacccagtcaacagagttccaaaccacttagggccatacagttctttgaggggactagaccagttcccagcacccatgctggatggttcacagttgcttttagctccagctcctccaaggacctcagggtgcctgcactcactgcacaggcacaagcattaancataattaaaaataaaacctaggggtggggagatggcactgagtgtacagtctttccccttgcaaagacanggaatcagtagctcagttctcagcatccgtggtgggtgggtcagggtttcctaactttagcgccctcttctggattctncaggcaccggcaaacctgaagtggttaaatacagttaataggagtagggctgggtgttttatttttnnnnnnttattttccccctgcctgtgaggtataggggtgggataaggtcnccctgtgtagctctgcctttcctggaactcaccaggtagaccagagatccatccatcag

SEQ ID NO: 3604 - DNA, 338 bp, Mus musculus
  misc_feature (252)..(252): n is a, c, g, or t
gtgcgtgtgttggagaatcacccacattgtagtgtgcagtggaggtcaaatgctaccctttaagggtttgccgtgatcctccaggctagctggctcatgagcttcctatagtctcagcacagggatgctggcaccagggttcacaccctacctggcttttcacttttaaaacatgggtcccagggcttaaacggacttcttcaggcttatgcagcatctttacccacagggctaagctcaggctccactgtnggctttaacacaaattcatagattctacccacactgcatgggctctgtgagggaccctgtccctggcttgggaagtcttttctgga

SEQ ID NO: 3605 - DNA, 408 bp, Mus musculus
gtgcaggtttccttacagcttctgatacccagaccaggaagcttttgacccttgtcctccctcctggcagcagcatggggcttctgggacaccacctctcccttaggagggcgtgctttccctaaggaaggaagctgggctgaagaggggttggtgtctgctcaccctcacagcacatcggctgagcatcggctgtgctggcctctggaaggggtaggtccacaaccgcactgtgctgaactcatagggatctctcaagtgcttgacagtgagtattcacaccgctttagtctgatgaggagaacagggcaagagatatccatggttctgtggtcctgaaccataggaaaatgtcgctttccaacgtgctcactaaaatgggagcactattaggctagggtgtacctc

SEQ ID NO: 3606 - DNA, 525 bp, Mus musculus
  misc_feature (41)..(41): n is a, c, g, or t
  misc_feature (142)..(142): n is a, c, g, or t
  misc_feature (325)..(325): n is a, c, g, or t
  misc_feature (360)..(360): n is a, c, g, or t
  misc_feature (376)..(377): n is a, c, g, or t
  misc_feature (382)..(382): n is a, c, g, or t
  misc_feature (457)..(457): n is a, c, g, or t
  misc_feature (496)..(496): n is a, c, g, or t
aaagatgctccaaagtagccctcccccaaattatatatccntaaaagtgctttaacacccaaacttacctgtaagcccaacactgaggaagcagaagcaagatcagaagttccagatcagattgtattacatgagacactcnaaatgagacgaaataagcaaaacactaccactaacaacaacagaaacaacctatgacctaggtctgaatgttggtttttcttttggcttagaacaccctatgaagaccaggctagcctcactggagatccacctgcctctgtctcttgggtattgggattaaaaggaagcccatcttacccancctctctggacattttcatatacagtattttggtnaacttttttccattcnnagggntaagttgtttacagtataattgttaaaatttaacatttggtatatattgctaaatagctgctcctgatagttctntcatttgagacttcccagcaggtctgtgatccttgacanccttggccatcacatgtggcatttccaac

SEQ ID NO: 3607 - DNA, 425 bp, Mus musculus
  misc_feature (278)..(278): n is a, c, g, or t
  misc_feature (280)..(284): n is a, c, g, or t
  misc_feature (286)..(287): n is a, c, g, or t
cgtaggttgcgcatctggagcccgagcttgagccaccgggagagcacgagggaggaacccaccctaagaaacttctcctcgcttggggagaggaggcacagtgcggagcgacgtgggcttcaggcgaagttggagctgctgagcttcggggcggcgttcgaggccccctcccacttgcgcgctgagcgcagctagcggcgtcgggcgaggagcaagcggcggtcctttccgcgagggtcggctgcccgactgagggcagccgggaaggccgcggcccngnnnnnanncccctctaccctgcacgcggccacccgctttgcgtccagagaaggaggtaacgtaagctgccaggcgggttcgtaggccgatcgtcacccccaaaagtcctcctgagtctccggggttcgcttctatatccccggagt

SEQ ID NO: 3608 - DNA, 251 bp, Mus musculus
  misc_feature (155)..(155): n is a, c, g, or t
gcttcagcgaaacattcctccttcaccaggctgccttagcctttcacctgtgaccactttgacggaaggttccttcacgtgtctgccccagctaaacaccatccaaccgactttccaaagaacccttaagtttccactttggtcctcagaggtgntccccattcacctaactatccattttacttctgtaaaagtccaccgatgctggagagctggctcagaagttaagaacacttactgcaggttgcaga

SEQ ID NO: 3609 - DNA, 230 bp, Mus musculus
aacagtatcaactaatctggacctgtaggagctcccagagactgagccaccaaccaaacagcattgtctggtctatggcccctgacacatatgtagcagaggactgccttgttggcctcagtggaataggatgtgcctattcctgtagagacctggtgccccagcgaaggatgacgctgagggggcagtgaggtggaggtggatgtgtgtagcagcaccctttcagaggc

SEQ ID NO: 3610 - DNA, 365 bp, Mus musculus
  misc_feature (47)..(47): n is a, c, g, or t
  misc_feature (98)..(98): n is a, c, g, or t
aacggccaagcttgtggttctgagcttgcaatgctgcccagtgcccntgccagccccccgccaccccggtcgttcacctcccatgatgcctggcgtgngtgaggccgctgtgtactaggctggctatctgtctgtccatccatctacctggggtcaggctgatggccgaggctgtgagtgcctggcccccatggatgttccccgtgctcgctccctcacccctcactggggatgtgagagccctcatcagatacccaaagtgtcactcacttccagatgtgctgtgcaaggagggccggggcgtgggtgtggagcgcccagaggcttaggtgcgccatccattcgactgttgtcagctgtcactg

SEQ ID NO: 3611 - DNA, 444 bp, Mus musculus
  misc_feature (39)..(39): n is a, c, g, or t
  misc_feature (128)..(128): n is a, c, g, or t
  misc_feature (170)..(170): n is a, c, g, or t
  misc_feature (189)..(189): n is a, c, g, or t
  misc_feature (280)..(280): n is a, c, g, or t
  misc_feature (298)..(298): n is a, c, g, or t
  misc_feature (364)..(364): n is a, c, g, or t
  misc_feature (374)..(374): n is a, c, g, or t
tatcctgtctcctctggttaaagcctgccagagagcccntcagccctcgggtaaacagtgagatgttcccttcaccccggtggtcatgggagaacacttcccagatcccctccccatcctcagggctntgggctgtcctcctgctgctggaacagggtccttcccacagncctctggagggagggattnggatctggtcatcagagcatcctcagtaaactctgctggctttcaagccctcatacccttctccccacctggcttcctagttgcttgaacntgtgtcaaaaagaaacanggaaaggaaagccagcaaagaagcttaacagataaagcttgataacgtgagtttaactcccagaanccatgtgggnagaaagaggaaactgattcccacaagttgtcctctggcctacacacacattcacacgcacgttaataagt

SEQ ID NO: 3612 - DNA, 537 bp, Mus musculus
  misc_feature (298)..(298): n is a, c, g, or t
  misc_feature (307)..(308): n is a, c, g, or t
  misc_feature (310)..(310): n is a, c, g, or t
  misc_feature (319)..(319): n is a, c, g, or t
  misc_feature (325)..(325): n is a, c, g, or t
  misc_feature (329)..(330): n is a, c, g, or t
  misc_feature (371)..(371): n is a, c, g, or t
  misc_feature (374)..(374): n is a, c, g, or t
  misc_feature (390)..(390): n is a, c, g, or t
  misc_feature (397)..(397): n is a, c, g, or t
  misc_feature (407)..(407): n is a, c, g, or t
tgaaactttcatggctattgtatctagttggctgccagcatccatctcaattgtttctgaaatgtaaataccatattttcttgttagataaagaaatgtaaattactgtaacctgagatgctgtcatttttaaaccttctttatcaaggaataaattaaaacatttgcaaagatgtatattttaaatataacaatggaagatcagcaaaagctatgggacttctaattaagcacagacaattatgacttcttgacctaagacaaccaagaggtaaatttaagttataatgattacaanagaaaattnntnttccatttngtcatntatnnatgtgagagttcaacttttttcattttctttcttctccttnttnttcttcttttgttttnatctganacattctttngtaggcaggttgacctcaaacccattgtgtaagccaagaatgatgtcaaccttcttgtcctcctgactctaacttcctgtttggattacaggattacagacatgcacaccacccttggatttcttctgtg

SEQ ID NO: 3613 - DNA, 434 bp, Mus musculus
  misc_feature (299)..(299): n is a, c, g, or t
cacagactgtttacacttcctatgttggcgtcactcggtgagcttagacgtgagtcctcaaaacacttagttctgcttgacagagaaatcttaatggcaaaacttctcttctatgctctaagttagccgtcctcagctttagagattttcatcatctgactacagccagaaaataggcacacattaccagtctggcgaggaggaaatgggtatatcacttggacccaaagctcagcaccagaagaaagagtttaggcaaatatattcttaggcacaagaggcatttgtaacacgatggncgcagttgtttatcaaagagtaagacctgggttggggtgggggagatgcaattatatataataattaatcactttgatagagttctataaagcagttcaatatcagaagccagtttgggccctggacattagaaa

SEQ ID NO: 3614 - DNA, 403 bp, Mus musculus
gttcagcctcagaagcaggtgctcaactatccttgtactctggagtcaggaccaggctctgaatgccagcattgttctacagagatctgaacctgggctggtgggcagctcaacctggccgtcccttcactactggagagaacatcctgctagcctgctctccctgaggccaacaggtcaggggtggcctgaccaagccatcgtgattgtcagtcttggacctctgcattgggctgtggccatttgggcaccatagcctcggctggcatgtggcgggaaggcaggctgctcatttccagtgagcctctttttctcccaggcaattattctgacttccttcaagactttctgaagagttatgtgttactcagtctttttaaagtggaacccatgctcactcaaa

SEQ ID NO: 3615 - DNA, 377 bp, Mus musculus
  misc_feature (96)..(96): n is a, c, g, or t
  misc_feature (229)..(229): n is a, c, g, or t
  misc_feature (243)..(243): n is a, c, g, or t
gagtttataactccagcaatcatggaaaagccaggcgtgacagtctgtgtctgtaaccttggtgctgtggagaacagggttggtaggacacagggnatcccagggctggctggctggccatttagccaaatcagtgaactcggattcagcgagagaccttgtcttaaaacataaggaggagggtaatggaggaagaatcctgtgtcaacctgtggcctccacacccaantgagttcacacacnttgactgtacacatatgcacacataaaatacaaagtactgtatgtgctaacattgtatagacacatagccatccgtcttgaagtcaaacctcagattttcagtcaggcctggttgctcaccctttaatgccagc

SEQ ID NO: 3616 - DNA, 536 bp, Mus musculus
caacttggaagtgccaacgcgggtgggatttttaacacacagcgaccataaccaacttctacccccaactcctcccaaaggccttatccctcctggtccccactacttggcatctgttggggcatcagactacttggggtggtctgctcacagccaaatgtctgggaggagagggtactggaattggacacaaagccagtcacctctggaagtcagtttcacatccctattccgggttcccttggggtccggggctagcccccagccacagcccaaagctgcctgggaactttgcaagagtttcctcggcggcgcccaggcccggaggggaagggagaccaggtccacttggcttgcgcagcgcggccctgcggggacgtccccacgtgggagatctgagatggggacccccgggaccggcgagccgcagcatgccgcccacagaacccacgaggccggggcactgcaacttcttccaaggggtctcccgagggccgggggaaggaacccgggagtcgctctcatcgccaggaagc

SEQ ID NO: 3617 - DNA, 229 bp, Mus musculus
  misc_feature (123)..(123): n is a, c, g, or t
actctacgtacaaaatgtcccctgtctgtctgccttttcctcagcaattgctgagccagtcattggaaagcggcaaggcaaaacacccattaccaagatgtagctaccaaaggactgagattngggatcagaaattcaatacctttaccccagcccttgtggacaacttcctcctgtgggactgaggactctaagaggtcaccagaaagttatatatgagctcctccat

SEQ ID NO: 3618 - DNA, 505 bp, Mus musculus
  misc_feature (34)..(34): n is a, c, g, or t
  misc_feature (59)..(59): n is a, c, g, or t
  misc_feature (62)..(63): n is a, c, g, or t
  misc_feature (67)..(70): n is a, c, g, or t
  misc_feature (75)..(75): n is a, c, g, or t
  misc_feature (189)..(190): n is a, c, g, or t
  misc_feature (193)..(193): n is a, c, g, or t
  misc_feature (284)..(286): n is a, c, g, or t
  misc_feature (288)..(290): n is a, c, g, or t
  misc_feature (298)..(298): n is a, c, g, or t
gcactaggtttctaccacacagcgacccccactntgctcagggcaggtgcgccggcgcnggnngcannnnaccgntggtaggtcgagttcttatcacccaccctcgcactggagttgtgagagcaaaagctgactttgaaaaggtggcggtgggcctgaggcttgagagaccggaatgtgattgcggannggnaggggcagaggggtcgtcctgctgagccgcactaccgctggagagacgacgcggctctggaagcgcaagaaaccgaatagtccagccggannntnnntatatcgntcctgctgttctccacctccggggatcaaactgcccacgtcagcttccggaatcgaagggaagatagatgtgtgtgtgctacccacctggcaagccctaaagttgagatgtggaaacgtgggtgcactgaatgtctgttctactaaagagtgttgttcttctgaccttgggatgaatcgcttcccttcttgggcctgtttattcaag

SEQ ID NO: 3619 - DNA, 368 bp, Mus musculus
  misc_feature (307)..(307): n is a, c, g, or t
gatggcaacttctttatgtcagcctgtcctcacacactgatgttgtccaacatcctcccagccttgaacacttaccctagtcagctgccatcaacttatccagaggtctccctcataggcctggggagagatacctcccatgatgtgtttgtctgagatacattggagctttatcttgttgctgggatactagcttcatgtatactgctgagctgcagctgggctccctaaaagggaatctggaggtggtgttgtctgtagctgtaattcaggcaccccaaggctcgctgacactgggatcccatanctgaagacacccttggggcatgtgtgctgctaagtctttcctcatccctagacctgaataa

SEQ ID NO: 3620 - DNA, 476 bp, Mus musculus
  misc_feature (83)..(83): n is a, c, g, or t
  misc_feature (88)..(88): n is a, c, g, or t
  misc_feature (97)..(98): n is a, c, g, or t
  misc_feature (244)..(244): n is a, c, g, or t
  misc_feature (292)..(292): n is a, c, g, or t
  misc_feature (363)..(363): n is a, c, g, or t
  misc_feature (384)..(384): n is a, c, g, or t
aaatgcatcaatagctcagtctaagagtcatcagaatgtagtgaggacattatagaccatttgatgctagtgtttccttttgnacttngaatcactnnctaagctccacggttctttcagtcacaaacagggtggatagcatggaaaagtagagactcatcagtgggtggtggctgggcacatggaaggctcagtaattcctctctttgccaagcagggctgtgtcttatccatggttcagaanccacagcatgatccaaagcaggatgggagctggtggacagtggagctnggcaggcgatgcttcagaactaactgttggggaaacgacatcgttttttaaaacaaaaagaaaattgaaanctacagaatattcagaggatnttacatgagtatcagaagtgctatcagcaagaaaagagaagatctctcacacaccagagagctaaatttaagacttggcaacatgggctgga

SEQ ID NO: 3621 - DNA, 367 bp, Mus musculus
  misc_feature (111)..(111): n is a, c, g, or t
  misc_feature (117)..(117): n is a, c, g, or t
aacgttgccatcagagaggctcctggaaagtgtgacagtttgtccagagtccctctatcaaggacattcgagtgcgaagataccatgattgtgttcttttgaggtcatgtnatgctngtccttgtaatgagaattccctctctttgaaggtacccagcctagcctccaggcctcaacatttggcgtcctacagattcttaatggcctatcctatttaatgattccctctttttgttctgggtggcagtgatatagatgtccttttaaaaatcaggctacaaagtttggcccaagaatcatctctaaaatcccaggacctcagtaacaaaaaattctaagggctatctgccccaaatagactactcta

SEQ ID NO: 3622 - DNA, 434 bp, Mus musculus
gcacgaccttgcacggtggctgcttgcgttcagagttcgttaacttaggagcaaatcttgcgggctgtgggtacccgtagccgcagcggcgccctgcgtcgtcttaagccccatgcaagtgaacagtgagtgactgaggaccaaaccaagggtctcaggggattcaatcaggaacgttcattttgttctcacgtttgcaaggatccgtgtcctttttttttcttcttcgactttgcccaccttctggggccctttgtaaacatcttgaatgaattgatgaaccaagccagatagctatgtcttaggcactcttgtctgcataagaaaatagttgatttgcaggccgggcggtagtggcacactcccttttttgccagcttgagtgaggcagaggccgagcatctcttgagtgccaggcagacctagtctacaga

SEQ ID NO: 3623 - DNA, 494 bp, Mus musculus
  misc_feature (64)..(64): n is a, c, g, or t
  misc_feature (71)..(71): n is a, c, g, or t
  misc_feature (87)..(87): n is a, c, g, or t
  misc_feature (99)..(99): n is a, c, g, or t
  misc_feature (109)..(109): n is a, c, g, or t
  misc_feature (119)..(119): n is a, c, g, or t
  misc_feature (123)..(124): n is a, c, g, or t
  misc_feature (137)..(137): n is a, c, g, or t
  misc_feature (170)..(170): n is a, c, g, or t
acagctcttggatcaagcccaggaccctggaatgattgcctatcccatcatgtctcttgtcctntgatttnatttattgtttttatncagtgagacccntccccttttntcctgagagntaanntggattcatgatntccatcccacacttaaggctgttgacttttttnagaactggggttggctgtcgtggatgtagagagatcattgctagtggactgccaatcttgtctggacagcttgctctgacatcctacagcagcacttctgtgcctggaagagattgaagactgaactgcacagactctgagccatcttccaaccatacatgggcagagaggacctcactgctcctctatagcaatgaaaaaacgaaaaaaaaaaaaaaaacaaaaaactcacagggactaagtttcaatggctggctgctaagtggtgatgagacaaggtcagaggctgaggaaacccttccatcttcttccagtggtgactga

SEQ ID NO: 3624 - DNA, 551 bp, Mus musculus
  misc_feature (428)..(428): n is a, c, g, or t
  misc_feature (430)..(430): n is a, c, g, or t
  misc_feature (432)..(439): n is a, c, g, or t
  misc_feature (442)..(442): n is a, c, g, or t
gcccctaccttgtcataagtgctgaggattgaacccatggcctcgttgcatgtcaggtgctgggaacattaaatcttcatgtctggaggacaagaaaactaaaagtttgaaggcagcaatgtgcccagtgttcattttcccaatgttgacggttgtgctgtggttttactgaagaatgccccttgaagggatgctgtgtaaccaaccagccacctcgtgcttctgccactgttgcttccccactgtgatagactgtgcacactcaaactgcaagccaaaataaaccccaccctccttagttgcttttcccaggaattttgtcacagcagtgctaacataagccaagcttggggttagggtcattaaccctaagagggaaaaaaatgtctgttcaaagaaagagttataaacaaataatagacattaananannnnnnnnaangtaatttgtgtctgtaaagaataattctttcctaaatctctgccttagcttccctgtatactacctgtatatgcatgagtactcagagttcgttttgattgggcaatcc

SEQ ID NO: 3625 - DNA, 413 bp, Mus musculus
  misc_feature (341)..(341): n is a, c, g, or t
  misc_feature (347)..(347): n is a, c, g, or t
cacgtaaacatgacttggccttcttgcttgaattcagtccaagtgagggtcccatggcttcaccagggctactctgggccaggaggtctgacagcaggctcccacagaggacagaagtttggggagcctgcattcacccctgacctctgtcagtacaagccccaactcaggcaaggcagaaaaggaactgtctcggggccttgctggacttccccccgcttgaggatttggggttccttatctgtaacaacaggtatgtcttgcccgatggggacttttccaaacttcctgccctctgagggggtctagcacacaccagtgtctgcagagggaggtctgtnccacangcgtggtggagggggaaacctcacaaacccacttctctaacttctcccaccccttgaaaacagagg

SEQ ID NO: 3626 - DNA, 497 bp, Mus musculus
aggcacacagggatgctttgctctcctgggacgtttgcttatcttttgattccgttttgttgtttggaagacaggtattgttctgcatcaggttccaaggttccgggaattacaggcatgggctacagtcttggcttgctagttttgttttgttttgctttgctttgtggtgtttttcgttttggtttggttttgtactgctggggctcaaacccaggtgttctgctctgccacagttatgctgtcgtggctgctgttactattattggcctttcgtcctttgatcctgggctttatttttaacttttattacacttttaaattagtttatttctgtgtgaagatcagaggacaacttgcaggatttggctctctcctgtgtggattccaggtgtcaaactcaagttctcggtggcaagctactttatctgatgagccctgggtttgagtgtctgctctgccttttcacccggtgcaatccctgtgttcggaggaga

SEQ ID NO: 3627 - DNA, 424 bp, Mus musculus
  misc_feature (43)..(43): n is a, c, g, or t
attgcctctggaatctagcagcttgaaataacagccatttgtnccgattgcaattctgtggcttcggctgtaggttaggctcggcaggtgggggcttgctgcagtatctgtggtccagtgactgtctggaggggcaacatcagtggaaacagctggcattccttggtgtcctcttatgttcagaaaggtaaacgccaaccgattacgaggcctctggttcagaacctaacaccatcgttgccatcccattggctggaggaagtcacatgaccggcccaagaggtgggggccctggctctacctcttcctgctctcaacccaccttctcttccttacagtcttgctcttaaggaattcacgtgctgtgtcttcttcacagccccctccctcttttctcctttctctttcattgcgttatcccaga

SEQ ID NO: 3628 - DNA, 441 bp, Mus musculus
  misc_feature (110)..(110): n is a, c, g, or t
aggtgcagtgcctttagacttaccgtatcaggacactcctagcctagagcagggaaacaatgcagatttaaacaattcagtgataagggtgaatcatcaaaggcagtgcnatcttgttctgactccatgtggggattttaaaacaattctcagccctctatacccagaacagtcatatctaccttggcaatgcaattgagatttctgacagatggaccatggtccagatcactaaccaaaataatgtttctacaaatttaaactaaagcaactgaagaaggtacaagtcaaaagtgaccatcgcattacatgtaaaatagttcctatgatctgccagaaacggatgcttcaaggttactctgaccttcgtttaacttcgaggtaaattatgatcttagtggttttgcctttcaaaacattgtattcctgagctttggcaac

SEQ ID NO: 3629 - DNA, 505 bp, Mus musculus
  misc_feature (128)..(128): n is a, c, g, or t
tagctcagggcctagtgacaggtttagacatgatcataggtatggatggcacagagatgtgctcgggtaagtgcaaacaagatgcctttctgtggaactgtcatgtcagagctcagggcacaccagangccccagcatggtcaatccgcctaaggtttctcccactcctgatgagccactctcttcagacactcaacagagagtactcgctactaaatatactcctagcttcatttaagtagtatttgtgtctttctgagacagtctcactatatatatatagcccaggctggccctccatccttggcgttctcctcccacctcagcttcccaagtgctgagatcacagaagtgggccatcatacatagctaacaagtatttaagtaacagattctaagcatactttctccccctggccaaagggtcctaacatccaaggccagtgactttgttctgtgactctcttgagaaacacagctgctgaaccccaatagaccaatgttt

SEQ ID NO: 3630 - DNA, 506 bp, Mus musculus
tcgtctggactctgtgggaacccgccctcatgaacacttacccacacataaccacacacacacaattttaagataatcaaaataaaccttttaaagccttaacacacaaatcactgtcataagagttaggagggagtaaggctcttcatcagcttgcccttggtgagccggtttctactgtatttaccaaggacaatgtgattgagaatttccacaccacagcagggtctccgctgattaaagcttccgtgatgtggggtggttagaactacaggtccagagcccagtgacagtttctccaggtgatctctagcctaaagagtaattccttgcccacctctagcatcctgataaacaagttggaatgtgttcacttaacggaataattcttcgccaatcaaagggctaaatgtcacatagcatctgaggcctctgcctgagtaacctgcttctctgatgtttccacaaatgtatttttttaagccttgattcatacctttctttgt

SEQ ID NO: 3631 - DNA, 435 bp, Mus musculus
  misc_feature (253)..(253): n is a, c, g, or t
  misc_feature (268)..(268): n is a, c, g, or t
  misc_feature (299)..(299): n is a, c, g, or t
  misc_feature (311)..(311): n is a, c, g, or t
  misc_feature (316)..(316): n is a, c, g, or t
  misc_feature (322)..(322): n is a, c, g, or t
  misc_feature (331)..(331): n is a, c, g, or t
  misc_feature (345)..(345): n is a, c, g, or t
gggccaaatcaaggtgtcagattccctgcagccagagttatagacagttgtgagcctccatgtgggtgctatagatcaaatccaggtcctctaagatagcagccattgttcttaactgctaaggcatctttctagcacctgagaactaagttgtgactttaagatgggtgcatgcaggtttggaaattccagaaagaagaaatgggaaattccacacgtaaaggaggagagcagaaaggtagcgtggtggatnttacccttagtggtnttcggggttctccaaatctgtatgaggtggnagtgtcagaaangggancatcanttcctagantgtgtactcttggnaaatctagcctttctcaggtttgacgtgggctagcccttcctttagaaacctatgtagcatttctgtccttcagaggctcacagtctgga

SEQ ID NO: 3632 - DNA, 327 bp, Mus musculus
  misc_feature (48)..(48): n is a, c, g, or t
  misc_feature (65)..(65): n is a, c, g, or t
  misc_feature (191)..(191): n is a, c, g, or t
  misc_feature (198)..(198): n is a, c, g, or t
  misc_feature (222)..(222): n is a, c, g, or t
  misc_feature (241)..(242): n is a, c, g, or t
acaccacaccctcagaaaacggagatgtgccgagccccaagtcaaagntcccttccaagaacatncggctcagagggagagtttccccctcagatgctgactcaacagtcagcgaggagtccagcgagagggacgcgggagagaaggcgccggctgctgcccctgagaacaaggctctcagagctccgcangagtggngcccccctgcccagttcaggcaantgagcagcattcctcagcnnccatctttgagcacgtggacagggtttcgaggacctcagaggccagccgccgggtccccagtaagatccagctgattgccatgca

SEQ ID NO: 3633 - DNA, 484 bp, Mus musculus
aagagctctctacatgtgctgtcatttgaattttttatcttagccattctgataggtgtaagatccaatctcaggatcattttgatctgcatgttcttgataattatggacattgaacacttatctttttattaatttatttattcacttgctttatgtcccaatatcagccccctcactcctttctcacacagatcctcatcccacttccctacccctctcctctgaggtgaggaaatcctccctagttgtcctcctccccctcccaggtttatcaagtcactggaggactaagtgcaagaaaaccaacagagttgactaacctggatccttgtggcctcccagagactgaacaatcaactaaagaatgggcaggatctagacacatttatatcagaagaacagtttgatcttcctatgggttccccaaacaactaaagcagggctgtccctgaatctgttgcttgcctgtgaatccaattcc

SEQ ID NO: 3634 - DNA, 558 bp, Mus musculus
agtaccactgaaatgttaccttctgatcatgagtccaatagccaccggctaaagcaagcctttgtcctgttctaggaaatcacacaagctctcttgaaaggttgtagcaaaaaaacaaaacaaaaaacaaaaaaagattgttgatcatgtaggatgttatgagtaatatataaaactgtaagcatagtatataagcacagtaaaattctaatttgatagaaattggttgtgatggtatgtacctatagtcacagctactactgaggctgagtcaggaagattgcttgagactagccctttgggggcagcctgggcaacaggggaagatactcattctcatattctctttctctctctctctcaaaattttattataatttttagtgtgtgtgtacccaagtgtaggtatgtgcacatgagttcagatgtccacagaggccagaagatagaattggatccttgggtcagaagttaaaggtagttgtaaagcatcttgacataggtgctagaaactgaacttggatcctctgcaagatcaccaagcattcttgatggccc

SEQ ID NO: 3635 - DNA, 524 bp, Mus musculus
  misc_feature (115)..(115): n is a, c, g, or t
  misc_feature (123)..(123): n is a, c, g, or t
  misc_feature (201)..(201): n is a, c, g, or t
  misc_feature (320)..(320): n is a, c, g, or t
  misc_feature (332)..(332): n is a, c, g, or t
  misc_feature (334)..(334): n is a, c, g, or t
  misc_feature (338)..(338): n is a, c, g, or t
  misc_feature (348)..(348): n is a, c, g, or t
  misc_feature (362)..(362): n is a, c, g, or t
  misc_feature (366)..(366): n is a, c, g, or t
  misc_feature (480)..(480): n is a, c, g, or t
  misc_feature (483)..(483): n is a, c, g, or t
ggaagacatgaccacaggagtacgaggtcacctggagtccacagtgagaaagcaggcaagcgagcgctcgtgctcagcttgctttctctaagcctaggatcccagcccacagaancgctgcancccacccaccgcctggctcttcatcagaaatgaaatccttctggaatcgccctcacagacacactagaggtgtgcttnctcagtgatcccaaaatctagccagaataggtattcatggaagccaagaaaagttactcaacccctgaggatcatgacccagacagggctggccttggatgtgtcttgcaagacacacnggtgcgccaccnancttnaccatggacnaccacatcatgganaacngacatgctgagaaggcctgggatttccatccccgaccctcctgcagcagttgcatgggacatccgttagactttgcccagctctcttcgagacttgctcagagttcctgcttcntcnccttccagagcatcacagtccatgttctcatagctttatat

SEQ ID NO: 3636 - DNA, 484 bp, Mus musculus
  misc_feature (421)..(421): n is a, c, g, or t
aagatcagaaccagaagcccttcctcctggctccagtgtggttggaaccacgtctgtgggattgagtttccaaggatactttctgccaagtgcaaagatgggagtccagcggaggagactctggtgacttctaagcacaggcaggacccggaggcctgaccttcgtgctcctaccgcctgggtgctctcccgggacgctcaggtcaggcagaagcagcctgcgacccagcttcttcgagggtatcttgcgcctggtggagctgcctgggagaggcagaggcagagacagtcctggggaacctggttgctgtcggggcaggggcatttgctcaggaaatgtggaactggccaagagagtcagtctccaacatcctctcacgttgtcgccagagcccttagatcctgaatttggaacccagantaggacggtgcaccagctgccccgtgggcaaggagctctgggctccggtttatggcagccgca

SEQ ID NO: 3637 - DNA, 515 bp, Mus musculus
  misc_feature (259)..(260): n is a, c, g, or t
  misc_feature (264)..(264): n is a, c, g, or t
  misc_feature (266)..(266): n is a, c, g, or t
  misc_feature (275)..(275): n is a, c, g, or t
  misc_feature (278)..(278): n is a, c, g, or t
  misc_feature (283)..(283): n is a, c, g, or t
  misc_feature (298)..(298): n is a, c, g, or t
  misc_feature (301)..(301): n is a, c, g, or t
  misc_feature (305)..(305): n is a, c, g, or t
  misc_feature (403)..(403): n is a, c, g, or t
  misc_feature (436)..(436): n is a, c, g, or t
tgtcaaaactgaggcttgctaattttgtttttgacatcaagcagttaagaaattatctgagcctctcaactttatgcctactttcttgacttggaattaaaattgagattagatggagggaatgaagatccaattctactttgctgatttggctgtttgcaaccaattgaacatcagtaacaccaaaatggcaaaaaaaaagaacattttcagaaaaaaaatgcgagttgcttttgttctctatgtaagactgaacacnngatntnatattcagntcnctttntatcttgtttctgcnttntacntatctgatgaagaggtccccacgtgtgcttggaattagagatggtttttagccaccatgtgggtgctggggacggagccaggtcctctgctagagganccggtgagcttcactgctgagctttctctccanccccatattcttttcttttctattaatttttttcatatgatacgttctgatcacactttctattcttaactcctaccag

SEQ ID NO: 3638 - DNA, 369 bp, Mus musculus
taaatacatggtactggcatacaatttcttatccccatgctcagcaaaagttacgaacataataagatatgaagcaatttaacatttaattatttttctataaaaatggctacatagtggaattgcatctgatatgtaaagaatttccttgactacatgaaccatgtatagcactttctcttataagtctctttaagtaaaaatcaacatgatcgtgtttatttatacagtgaagtctgatacagcgtatctcaaaagtattgtgtagccgtcattgttgagcacccagcgtagcttaaagtttacctattcagtaattgaaaactgtggagagcctctgaggagagccataagatggcgctagcctcc

SEQ ID NO: 3639 - DNA, 483 bp, Mus musculus
ttgtgctggaaagaacccgggcccagcccagagccacgttgcagggctcaggactgctctgaaacactgccacctagtggcgtgatgagggttgtagctcaggaatcctgggagaagcatggaagaatcttctagcatgtggggactctcgggacccaagagggagagtaactcctaaagacgtggaggcttctagtgcttcaggacagacaatgggtctgaaattcttgcttggggccatatggattggccgcgcagggaggaaattatattcagctttctgtttctgctcaactctttccactgggtaagtgggccctttgaagtggcacttgccttacctcacattctgacaggaatgactgatcgcctttcagtccacacaagataaggagccacgtcggagctgtcttaactaaacaatagcgaaccacccagagcactcttccaagacgggagagaattccccacatgtgttaagca

SEQ ID NO: 3640 - DNA, 424 bp, Mus musculus
  misc_feature (39)..(39): n is a, c, g, or t
  misc_feature (41)..(41): n is a, c, g, or t
tgcgtaaacacgagcgccgggtcaaggagctcgtgtacnanactgaagaggacaggaagaacctggctcgcatgcaggacctggtggacaagctgcagagcaaggtcaagagctacaagcgtcagtttgaggaggcggagcagcaggccagtaccaacctggctaagtaccgcaaggcccagcacgagctggatgatgccgaggaacgggcagacatggcagagacccaggccaacaagctgcgggcaaggtccagggatgccctgggccccaagcacaaggagtgacacccaggctctgaggagggataccccacccctgcgatcctgttgtctctttccatctgccactccaccctccctgagcccctgaaccccaaataaacaccctgtctgcagcagtagccactgtccttatttcttgg

SEQ ID NO: 3641 - DNA, 487 bp, Mus musculus
  misc_feature (262)..(262): n is a, c, g, or t
  misc_feature (268)..(268): n is a, c, g, or t
  misc_feature (274)..(274): n is a, c, g, or t
  misc_feature (282)..(282): n is a, c, g, or t
  misc_feature (304)..(304): n is a, c, g, or t
  misc_feature (349)..(349): n is a, c, g, or t
  misc_feature (416)..(416): n is a, c, g, or t
  misc_feature (435)..(435): n is a, c, g, or t
ctgtcttctcttggcactacaaataagtaccatgctttctcttagttccctcagcctgaggactacattagtgcctttcttccagtgaccctgttttcatttgtgcgcctgttagtccaaatcagatagatacaaggggaagaggcttggctcctctcagctagtggagtgaactagagaccagcttcatgaagaatggtgtgaggcagcaagctcctttcatatactagagccaggaatggatgttggaaccattcttttngaagantcattngacaaganttcatctggtgtcaatttagtncctttttcccagcttttatcgacagaaggttgttccaatgaggtntcttttccactagtagttgcagctaccagttaagaatgggtcaaaaatggctcagtggttaagagcncctactgctcttccaaagntcctgagtttgaatcctatcaaccacatggaggcttccaaccattcgtaatg

SEQ ID NO: 3642 - DNA, 518 bp, Mus musculus
  misc_feature (213)..(213): n is a, c, g, or t
  misc_feature (225)..(225): n is a, c, g, or t
  misc_feature (229)..(229): n is a, c, g, or t
  misc_feature (238)..(238): n is a, c, g, or t
  misc_feature (240)..(240): n is a, c, g, or t
  misc_feature (249)..(249): n is a, c, g, or t
  misc_feature (252)..(252): n is a, c, g, or t
  misc_feature (259)..(259): n is a, c, g, or t
  misc_feature (265)..(265): n is a, c, g, or t
  misc_feature (295)..(295): n is a, c, g, or t
  misc_feature (300)..(300): n is a, c, g, or t
  misc_feature (341)..(342): n is a, c, g, or t
  misc_feature (352)..(352): n is a, c, g, or t
  misc_feature (357)..(357): n is a, c, g, or t
  misc_feature (424)..(424): n is a, c, g, or t
aacaatgagctttccttttgagtcataaggaagattctttttatcagccagtcttgtcccgagagtatgatgccttaagccgtaagtcgagggtctgggaccgtcagatgaggcggtctttgtctggaacaggtgaaagggccgcacagttcagccagggtttgaattactgcccagggtcattgtcccaaagtaattcatggagtgatttcnagcttttgaaantgtncgccttcancntcctggggntcnttaaaancctgancagggaaactggccaaacaggcctaaagtngatancttagcaaagaaataggtttatcagatcgacccaaaaggtnnggtgtgatgntgcanacctgtgatcccagcccccaggaggctgagtaggcaggattagagatcagcctgggctacacagtgngttctaggccagcctgggctacataggaagactctgtctcaaagaacaaacagaacagatgtggccaccctgtcattctctctgcatgcacatg

SEQ ID NO: 3643 - DNA, 502 bp, Mus musculus
gaggacccaggactgagcacccacatggaagctctcaactatcgaacttcatttccaaggtatcttaagccttcttctgggctccttgggtaccaggcacacaaagacatgtatgcaagcaaagcactcataccataaacaataaaataattaaaaaaaataatagaaaacctcaccatgagcaaaaagaatgtaaagaaggctttatttttggcttagggttccaaaaggttagaggccataatggagacaacatggcagcaagaagcaattatgctggccagagcaggaagctgggagcttacattttcacgtatgatcaggaagccaagagcaaattggaagtggtgctagggcttttaatctccaagcctgcccccgatgatgtatttcctccagcaaggctgcaccaaccaggcctccccaaacaactgaggtccaagtgttcaaatgcctgtgacactgggggacatttcttatgcaaattactacaccatcccca

SEQ ID NO: 3644 - DNA, 537 bp, Mus musculus
  misc_feature (54)..(54): n is a, c, g, or t
  misc_feature (61)..(61): n is a, c, g, or t
  misc_feature (104)..(104): n is a, c, g, or t
  misc_feature (120)..(120): n is a, c, g, or t
  misc_feature (130)..(130): n is a, c, g, or t
  misc_feature (153)..(153): n is a, c, g, or t
  misc_feature (230)..(230): n is a, c, g, or t
gggatttgctttaaaccttggagagtaacttgagcagcgtttgctgccttccanggagaancaacactttcaccttcttcatctcttagatagtgttggtgaancctaaatcacctgtgncccattcagnccagctggagtccctgattctgntcagatagtcatgagactttgactatgagatgagagcagaaagtatgacactgaaatccataccattgcctgaactnaaaggattttgaaaatgtgcaaagggaacagctgtttttccaccctcctgtgctcagagtgaaaggtttagtcaggttgaactaataagaagcttgaaatccctttatagagaataagtctgcccatgcaggcaaaagacaccactgaggactcccacttgcaagatgttgggttaagaaaaagacaagtgtgacaacagctgaaaaaaacaaaagaaaacaaaacaaaacacagagtgaaattgggactacctgaagggggaggggcaactcctgaaagggatgcagtggctgtttactgagtgac

SEQ ID NO: 3645 - DNA, 515 bp, Mus musculus
  misc_feature (226)..(226): n is a, c, g, or t
  misc_feature (382)..(382): n is a, c, g, or t
  misc_feature (424)..(424): n is a, c, g, or t
aggtatcattgctcttacttggtgcagctataaaatataacctggaaatcattctttttacagttagaattaagaatagaggaactgaataaagaaattaaagcttccaaagatcagctagtcgcacaggatgtcacagctaaaaatgcaattcagcaaatccataaagagatggcccagcggatggaccaggtatttcctgccactattaatttgatcatttggngtttcatgtttattggactgtaccacttgggtgatgacatcgctggagtttacataaaagcttttcaaggaaactaagggctggaaggatgactcagctgtgaaggcgctccctggtgtccccgaagtccagttggctttctagcatccagccacnagacccccaaccacctgtcactccagtgccagggctctgacnccctcttgtggcttaagagtattcatatgcatgtggtccagcagacaagcacaaaaacataaataaaaaagacatctcaaacagtagcaag

SEQ ID NO: 3646 - DNA, 445 bp, Mus musculus
  misc_feature (121)..(121): n is a, c, g, or t
  misc_feature (156)..(157): n is a, c, g, or t
  misc_feature (373)..(373): n is a, c, g, or t
acaagtctgaagctaggccactctttgctctaggcagtagtttcagtctcctgcctcagggcttactctggttttccagtctaccctaaacccctcactcaggcagaggctcagacctgancagtttgtttcctccaatggagcctcctgtgtctnntttctcccatggctcaattagagctaagggatggatgccctgatggtggtagtggcttttcttgttcctgattttgatggaaaatactcttgggttttgagggtgccatagccctcaggaggaacctgtgggcaatacgagagccttggtgcctctgaggcttctccaggctcaggaaggaggggtttggtgtggatccatcactgactagcccancggctgctctaatggtgtcctgtggacctggatctgagatttggaggtggtgggatgttctcccaacttttt

SEQ ID NO: 3647 - DNA, 484 bp, Mus musculus
gaatggacttttcatgacctcttaacatttcagcccagaaaccaccatgcttttccttgtaacacttgtgaagcctttagatcccacagagccctgattgtttaaatgcccactggttccttcctgggatgctcagagccctgcaaagagactgtaggagaaagaccaggtgctgctccacctctgagggaagcctagggaccatcctcctgtgcagcattcaagcatgtttatatttccatccctgcaaagaagggtctggcgtgctacatatgaaggtagctcccatataggtactagaggccttaagtcaaaagacaggcgacccagctgggccaaaagcaagccaactacacactggacagagacacagtggaccggaagcaaagtgatggggcaactacagtgtgccaacaggaggtatcatgaagccaggtgtccatgacaccaccatcacgggagactgcatatacacgctgtcact

SEQ ID NO: 3648 - DNA, 311 bp, Mus musculus
  misc_feature (280)..(281): n is a, c, g, or t
gggttggctttatgtctgcagtatctgctcactggggtttctcacacgtgctatttctttttccttttctccctagttgactctgatctgctcaggtcagtgatctttgcatctcagagctcacgtggtgctgacctgctgactgctctttcaatgaattggcatcaagttttttctgacagagctataagacattgagaaatgcacatcttggtaatgaccattcttattacattggaaactgaaacagaagcctggagtcaatgcaggcttgtccccnncccccacccctgaaagtgtaagccctgata

SEQ ID NO: 3649 - DNA, 519 bp, Mus musculus
  misc_feature (40)..(40): n is a, c, g, or t
  misc_feature (94)..(94): n is a, c, g, or t
  misc_feature (118)..(118): n is a, c, g, or t
gaggtctttctgtgggctttgtcaagatgttttagctctntaagccatggatataagtaagatccggtgaataaaactgcagacagttgctaangtggtaaactgacacgaagctccncttgacatccttagcacagagctttgcttaaagctgctcccagtgaataactagtgttgctattgtaactatgacgattgtggctgcccctggaaatatgaatcctagctctctaaacatagggaagcatttctttcggttattctgcctgtataacgtccttctatggaagtaaagaagctggagttggtggctcaagaccctaattccaggacatggaagactgaagcaggattgtactaaattgagaccagtttgagaggcaatattgagttttaggctagcctgttttgctaagcaatgttatatgctaattaattagtcagttgactaaattagataaatatatggttgccctgaccagtttaccattattaagcaatttagctccttatgggatg

SEQ ID NO: 3650 - DNA, 392 bp, Mus musculus
agctggagtgtcttggccttaggaaagggcttggccagtgtcccacatgtctgcaggtaatcctcctcctcccacttttacaaaggactttgaagtctacatgtctcttaactgacaaaatttgccatagacgcgggacggttttctcttggtcaggaaaggcttttgcttggaacctgggtcttgcagtattgcccacactgacctcaaatgctgggcccaagggttcctctgccaccagctttccgagaagccgggcctaggaactacagcttagaataattacttacattaaaggagataattttaaacctgagttttgctatctatctcaggttagcctccacttcatcatcctctgagggatacaacattgtgttcagcctgcaagt

SEQ ID NO: 3651 - DNA, 512 bp, Mus musculus
  misc_feature (32)..(32): n is a, c, g, or t
  misc_feature (94)..(94): n is a, c, g, or t
  misc_feature (155)..(157): n is a, c, g, or t
  misc_feature (324)..(324): n is a, c, g, or t
  misc_feature (327)..(327): n is a, c, g, or t
  misc_feature (332)..(332): n is a, c, g, or t
  misc_feature (340)..(340): n is a, c, g, or t
  misc_feature (384)..(384): n is a, c, g, or t
  misc_feature (441)..(441): n is a, c, g, or t
  misc_feature (459)..(459): n is a, c, g, or t
  misc_feature (462)..(462): n is a, c, g, or t
agcacagtatcctcactgccaagtgctcttcnggtgtccgtctctgccatcagtatttttagcatatggcctttggagcccgaagaacaacgtncacctcccagaactggtcctccagctgacagataggactgcatgaaagagggcacttcagnnnaggccaaccgagtcggtgcaaatcagatgctaacggcaacccctccgcccagaaatcccaagtggaaggacgcctctcgtgaaattgccttccgtgacagttacagacagcctgaagggaatacctgtccaggtgatacgggacaagaaaaacaccacgatgtaagnatngtttntacagatntcacaacaggccccaagccaaccccgttgggattcgtatcatgntttgttgcaccagatgaagtctgatctgggaccgtgccagaaaacacggaaggaagncgagaaagggtgaagagnttntaaattagattctgctggggccaggaaagcagacacgactgccgtggaga

SEQ ID NO: 3652 - DNA, 428 bp, Mus musculus
  misc_feature (215)..(215): n is a, c, g, or t
  misc_feature (305)..(306): n is a, c, g, or t
gcgaagtgcctccattagtgagctctgctagttctggttctttctggactttgtctgagagtacaacttgttcacagtttttggaagcttctggactctatatagtttttgttttattctaacctcctcccagagttttggtttagctttttggcctttttagttagctttagaatttgacaggtgtctttggatagaaactagtcatatatacnctcagggctcattttggttttctgctttgtcagattatcctgtctgcttctttcttcagctatggttgtctgcttagggcctgccataannctcagtctaggcacagaattgcttgagaaaccacagctttggaggtcagctctttttttcctagttctctctaaattcctattcccctttctgttactttgacaactcttggctgcctgtaa

SEQ ID NO: 3653 - DNA, 408 bp, Mus musculus
ttagtgaccctcaaaaggagcctataatatgttaggtaatacagatatttttacagtaggctggtcctgtgcactcattactataaatagctgtaagaattgttctcttaaggaacttctccttatgtggcacatagctattaggatgatgaagagaaatgaacacctaagtgccttctgtttgcttctcttgctccactcctgtttctcatcctattctctggttgacttagttacttgaactgtatctgtggacttctttcccctctgaaatgatcaaattatttccctgctcctttttatttggattgctcctagctgactgggttatcctaaactcctcctttagtgtagcctgtgctgatttccaccccagatcctccagtcttcctacagctctagtgctaa

SEQ ID NO: 3654 - DNA, 504 bp, Mus musculus
  misc_feature (148)..(148): n is a, c, g, or t
gcttcctctaagacattaaacgcttttgttcttcagtggaaaacaaggctcccaccctgcctcatgcttgctggccctgcctgggagtttcaaattctgaaaaaaatactcaaaatacagaaaaatacagatgcctctgggaaacccntccctggggtggggaggtgtccaatgcccttccttccctgaggccagttccatccctcctgaccagtcccttcgtccttggagggctttctctccaagcccaccaccgttaaccttttgcctgttgctgctggcagaagacaaacttaccatgtccctgtgacacgtaacccatcagcactaacattataaacacgagaattttcacacggagtctctctctcttccaaagaccacaatccccacgctccgacctgtgttgggaaagcggtggatggattgaaataggtagcgccaattcactgaaacctttctaaagcctgagcaagagaaaccagccagatcagtgtctcagtg

SEQ ID NO: 3655 - DNA, 510 bp, Mus musculus
  misc_feature (203)..(203): n is a, c, g, or t
  misc_feature (210)..(210): n is a, c, g, or t
  misc_feature (227)..(227): n is a, c, g, or t
  misc_feature (238)..(238): n is a, c, g, or t
  misc_feature (244)..(244): n is a, c, g, or t
  misc_feature (263)..(263): n is a, c, g, or t
  misc_feature (269)..(269): n is a, c, g, or t
  misc_feature (277)..(277): n is a, c, g, or t
  misc_feature (286)..(286): n is a, c, g, or t
tcgaaactctggcataggctatttggtgactgtagttaaggcagacgattatgatgagggcgaaaatggccgagtcacctatgacatgacagaaggtgaccgaggtttcttcgaaatagaccaggtcaatggagaagtcagaaccactcgtacctttaatgagaactccaagccttcctatgagcttatagtggtggcccatnaccatgncaagacatctctctctncttctgccctngtcctnatatacctgtccccagctnttgatncccaagantcaatgggnctctgtgaacttatccctgattttcattattgctctgggctccattgcgggcattctctttgtcactatgatcttcgtggcaatcaaatgcaagcgtgacaacaaagagatccggacctacaattgcagtaattgtttaaccatcacttgtctcctcggctgttttataaaaggacaaaacagcaagtgtctgcattgcatctcggtttctcccaatagtgagg

SEQ ID NO: 3656 - DNA, 418 bp, Mus musculus
  misc_feature (257)..(257): n is a, c, g, or t
  misc_feature (260)..(261): n is a, c, g, or t
actgttcatgatattcttcctttagagctttacatgcttcttctggtatcacacaagctaattctctgagaggagtttggtgtattttgagatagggtctgtctgtattactagctggcctagattccgtatgtagatcaggctggccttgaacatagacttgccctgtttctacctcatgagttctaggtttgaaggcttgcatgaccttgcccaatgaagcgtaactgtttctgattactttgtttgttggtatnttnntttgaagagacagggtctaaccttgactgactttgaactcacaggatctgactgcctgtcttctgagtccttgggattaaaggctttcacaaccactgccaagatttaatgtcttgacaattccagaaagtaagggcacaacccacttgatagaaat

SEQ ID NO: 3657 - DNA, 389 bp, Mus musculus
tgcttcatttcctgcgaggtctcaggcagctcataatgtttctctgagccttgcatttcccatctgaagcagaagcaggcttagattccatcgtctctggggccttccagtcctgatgcactaatgtccctgagctgtaaagggatagatgcttgtgcccaacaaaagacaagcccagaaaaatgtcacccactctcctgagaggaccttcactacaagatcttaccggaggcggggggaggagaagaagaggttttaggggaactggagagatgactcagtgccaagagcactgactgctcttccacagatttgatccccagaacccacatggctgctcacaattctgtgtaactccagttccagggaattacatcctctcttgtcct

SEQ ID NO: 3658 - DNA, 448 bp, Mus musculus
  misc_feature (382)..(382): n is a, c, g, or t
gggtgccaacctgacaagatctgtgtctagtgtctggaacgcaggagacatttgtccctcacttgttctaggtcacatagacctgtgatcacacttctaaccctgcagggtctgaagcagaggctgcgcaggcctagcacaaagtccaagttacagggctcgatggggcaggcctgctcccctaaccctggtctgtctgctgcaggcagctcaagctactcatgcagcccagcagctaccagtcctcccaagttggaggcatactgagcctgtattaactctcatggtagcctgcactccagaagacatcatacacttaaatagcctcctgtgagttcttaacttgtctgagcctcccttgaccttgacatcagaaagtggncctctctcattcacccagctttagtttcctgttttgatggtgtttctgcccagcttttcaagacaa

SEQ ID NO: 3659 - DNA, 465 bp, Mus musculus
ggaggtccttatcctaaatcaggtttctctgtcaaagcagtcaacctaactggaggtgggggttgactgatacacagggacacactctcaagtgcttatgtaggcatctcatgctatttcaggatttgtaatctctcaggtcctaagacagtttacagagtatgtatgtgtgtatgtatatgcatttgtgttttgagggtcatggaatttcaactgcttgtgatatgactgttgataattctaaggataaagaaaatttagtgtgtctaactttaaactaatttaggcttgtacatttctagaactgtatgtcacagtaaattgcaattttggttatgtgacattagctgacagtaaactttgttagctagacagtattcaaagaaacagtaaattttcatgtgacttatatatctgaaaatatcatttatagaatacttgttacggaccagacaagctctgtat

SEQ ID NO: 3660 - DNA, 406 bp, Mus musculus
agaggtcaggacagcttttctaggttctgtcctgagggttcaaactcaggatgtctagcctaccagcaagtgcctttacctacaaagcattgcaggtccttctttggtgtttttaaggacattcacatagataagtaatatcgctacatctatctccagaactctttggcatccagtttgtaaaattgaaactctggaaacatggttaagggtgcttgcttccagggacccaggctcagtttgtagtacccacatctggcagctcacaacccctgctccagaggatctagtaccctctgctggcttcttagggcacttaaacatacatataaataaaagttaatctttcttgttataaataacaagaaaatctgaacccattaaacagtaattcctcttgcctcag

SEQ ID NO: 3661 - DNA, 492 bp, Mus musculus
  misc_feature (86)..(86): n is a, c, g, or t
catgtttagtcctttccggaagagagagggacaaaaaaaatattttcttgtcggtctaacaatagaaaggttcatttgtctccggnatggagaggatgcaattcatagtggaaaggagtaagttctggaggcttccgtagatggatgggagcagagagatggcatctagtgctcagctagctctctcctttacatataatccaaatggcaccagcaacatttccatagatcttccttttcagtgaagccttcctagaaatatcttcacagacactcaaaggtgcctctctcaggagatcccaaatccagtcaacttggcagtgaagtctgatgatcagggacaaagatggaacaaggaagagatgggcaaacaacaccatgacgggctggagagatggctcagcagttaagatcactgactgttcttccagaggtcctgagttcaattcccagcaaccgcatgatctgtaatgccttttcctagtatgtctg

SEQ ID NO: 3662 - DNA, 467 bp, Mus musculus
  misc_feature (218)..(218): n is a, c, g, or t
ggtattaactctaccatcatttcatttcaaattctctttctccacaccgttatttgaaatctttagttcttggggcttgacaggcttcgaattttacttctttccttcttgctggtttgtggttgtttatgtaccaaaattctagagggaaactgttgacatatctgtgcacatatgtgcacacagctcatcttatatgcacacatatattagatacncttttatatactatatataagataagtttgcataatttatggacaatgattatattaataatgataattaataactatactatctagcataatggcctgtagtgatgtatgggattgagcacagtagaatagactcaattcatagttagaaggacagggctgctgttttgaaacagctagccaagccacaaagagtcatgctggaccagaagcataaatgaagtgaaaaaagccagtccagctttctag

SEQ ID NO: 3663 - DNA, 232 bp, Mus musculus
agcacaaagacctgtttagctgcctagatgggggaaaggaaaattaagaaaaaaaaaaaacaagacagaagaaagaaataaagaaagagagagagaaagaaagaacaacaacaacaacaacaacaacaacaacacaactttccttttctttattccattgaaataacaaagaaagtaagcacaacataaaagataaacatcccctaaaagaaacagcacaaagacctgttta

SEQ ID NO: 3664 - DNA, 422 bp, Mus musculus
actgtttggcagcagtctgactggcagaggagtgaggacgggggaagagctgagctgcggtggaggcagtgtttagtgtcctgaatgggaatgtttaagtcatggaccttcagtgtcagcacatctccttgtagcccaggagaagattggaactgccacttggtagtcaggccttgccgtgagtaaccacagtgccagtactgaagaggctgaggtgggagggtggtttgggcaaaataacatgaagctccatctcagagaggagtccttccttagctagtttgaacttggcagttttaagaaactctagaaatggtcaaatgttttgttgctggtcatcaaattagctttgattacagataatagaattgattgttatgtcaagtgctcagaaatgttttcccatttgtgcgccatgtggt

SEQ ID NO: 3665 - DNA, 441 bp, Mus musculus
  misc_feature (71)..(71): n is a, c, g, or t
  misc_feature (157)..(157): n is a, c, g, or t
gaagctcaaaacctccattcaagggactcacaactccacatgcatgctatgacactcaggcatccatcccncgaaaacacaaatataacttaaaaacttttaaatagtgagtatgagaaaaatacttggtaaaatctaggcatttctagagactttntaagtaggttggaccttcctcctctccagaccctggactcactttcactgagctctctctaccttcctcgagtttctgacccaaatgcacttttgggtttgtttgccataacagctccttcccttgggttctagcttcagtaccatttcccacacaggaactccagatgaaagcttctaacctctcaccaactccttagtacacctacatgctatcataaagtctacaatactgactggacaggtaaaatctgagcatctactaagtgcttactgtatactcag

SEQ ID NO: 3666 - DNA, 506 bp, Mus musculus
  misc_feature (104)..(104): n is a, c, g, or t
  misc_feature (173)..(173): n is a, c, g, or t
  misc_feature (288)..(288): n is a, c, g, or t
ttagaagtgggtggagcctcctcttcataattcctacagggtttaatactgaggagaaactttgtaaagtaaaggatttttagggttggggcggtggcacagtnggtaaagcgctcgctgtgtcagcctgaggacccgggctggtacttacaacaaagcatggtatgatcatnaataatgccagcacagttgcataacgacgggcacatccccggggaatcagctgccagccaatctcatgctaggttcagtgagcaatttctccccaaaaataagctggagaagganagaggatgacgctgaactttgacctctggcctccacacacatgcatgagtgagtgcacccacatcaacacacacacacacatgtgaaaaacaaatcttttaaaataataatatgggttcctaagtactggaattgagaacagtgcctacatcccaacgtttgtaagatgtcagtggactgcagaataagtgtggggatagtcctcatggtaattattt

SEQ ID NO: 3667 - DNA, 464 bp, Mus musculus
  misc_feature (28)..(29): n is a, c, g, or t
  misc_feature (32)..(32): n is a, c, g, or t
  misc_feature (39)..(39): n is a, c, g, or t
  misc_feature (50)..(50): n is a, c, g, or t
  misc_feature (58)..(58): n is a, c, g, or t
  misc_feature (62)..(63): n is a, c, g, or t
  misc_feature (67)..(67): n is a, c, g, or t
  misc_feature (124)..(124): n is a, c, g, or t
cctcacaacccctggtgagtgagaagcnnggntcttcancacatgacaanatctgtgngcanncatntcttcatgcaccctgaggcagggagttaggttggtgtcgggaagcctgcacagggtntctggcttatgatagttcctattttcttaaagagaaacttgaatggatgtgtttattttccaagcataaaacgagacaagttttcaacgaagaatttcacagtctctttatttttatgaacatttcctttctttcttccaatacttaggtattaattactacagcaaccctcagtctcacgctccacttttgtctcctgttctcttaaaggggaaaaagtttaagaattttctactggtctcaaactctgatatcttcggtgttgactttcgcaccaactgtattctgtacctttgagtagtaaagggcaatgtgcattcatttatggtcacatgctgac

SEQ ID NO: 3668 - DNA, 469 bp, Mus musculus
  misc_feature (142)..(142): n is a, c, g, or t
  misc_feature (144)..(144): n is a, c, g, or t
  misc_feature (293)..(293): n is a, c, g, or t
  misc_feature (314)..(314): n is a, c, g, or t
  misc_feature (416)..(418): n is a, c, g, or t
  misc_feature (421)..(421): n is a, c, g, or t
cacgcgtgtctcatgtttgtgcatgaccccccccccccaagctcaaaagcaagggcgtggagggatcatcccccagagagctgtgtttactcatttttttttaaatccctcggctatgtatggcaagtgttacttgaagatnantcatcggccttctctagatacttccaggttttgccgtaatgatctgcagaagagagctgccatcactttctcacatcccaaggtgttggcggaactcggagcgaggggagagtgcctgtaatgcttaattgccaaggggagggcggggngccactcgggaccccgggcgnggcttggggaggtaaggtgcaaccaaggaggtctttctggacgctggactcttcagttggagaatatttggacaaggtatgattgcctcccacctcccaccnnncanctcttttccccaatgcctttgggggagaagtgatacccttgtgtaaca

SEQ ID NO: 3669 - DNA, 275 bp, Mus musculus
  misc_feature (186)..(186): n is a, c, g, or t
gcctcgttttacaatacacttagagctctctgaaaacatagtttaaagatatgggattatacagatcttagtaaataagatagattgactaaaataactttttcctaattatagtgtgatgatgaaaggatataaataagaggagttagccattagtatttgctattcataaaaagagcagttttnctgtttgtctggagcactttaaaactgcaaatgccgaaagcctaaaatcaagctgccatataattaacatgtttgttttggaggagaca

SEQ ID NO: 3670 - DNA, 179 bp, Mus musculus
  misc_feature (43)..(43): n is a, c, g, or t
  misc_feature (110)..(110): n is a, c, g, or t
ggacaatcgagaacctctggaccctggactgtcacttggattntgcggacttggctcctcatccttccaagggcagtgcttacactctgccgtctttccaacaggcatcnttgctatcttcttccttgttaattaattagagaaataatcttagtcaagtagtggtggtcacaccttta

SEQ ID NO: 3671 - DNA, 329 bp, Mus musculus
  misc_feature (270)..(270): n is a, c, g, or t
tgaagaggacaccaggcaatggaaagatttatgctcctgaattgacaattaaatattgtgaaaatgaatgtactacaaaaataatctctgcttaatgcaatcctcaagaactgaggggaggtggggtgtggatcctaaattcatagagcaatgcaaaaggacatgggtagccaaagcaattctaagcagaacagtgttgctataggcatcgtgttacctaacctcaaactataccacacagccatagtgaaaaagctagcgtgctgcttntacacagacatgaggaccaatgggacatggtagaaaccgaggagcaaatctgcacagct

SEQ ID NO: 3672 - DNA, 337 bp, Mus musculus
gatcaatggcttacagatggtcttcatctgagttgtcttcacagggatggaaaagcttcactctgttgtgcctgggagcgtctggggctgcgtgtccttacagtctgaccttgctggtcccaagccatacacaagtgacctggaaagtcacaagtgtcagtgttgtggaaaatgttaaggaagggtctccactttagtttcagagacagagcttctacaaacacatgccctgtgtggatcttacctggaggcagcttgaacaaaccaactgagaaaatacatcttaaagataatctgggacatttgcttgtgggctgagtattgttcttctttctag

SEQ ID NO: 3673 - DNA, 307 bp, Mus musculus
gaatgcatgtgctatttatttagaaaataggagtgtttaaactgaaattggaaccagggtatctgctgctttgtccttttcttcccttcagaatcttaacctcaaccccaataaaataagacttgatttatcttttccttttcaaagaagcccttggctcacccacactcaggaacagttatgtgtcagagatgctggtgaaaaccaccacagggtccctgtgcacagcttgataggtcagttgagacatttgccagggtggtgttgtgtttaagtaatgagaactgtggcaaatgtggtggtgcac

SEQ ID NO: 3674 - DNA, 320 bp, Mus musculus
atgactgccgtagttagtggaccctcaatagagacccagaaaagcttggccctgaaaagctcatcacctttcgacacaccaaggactcaggtgctggcacctgtgtggggcatagtaattcctaagcaggtataatctggttgtgtctggccctttctgacccagacactagctaacatgatgtcctgggaaggaattttcagaccattgctattgatctcaaagcctctgctttttccaagtgacttcagacggctccattctgactgtgactctactggccttccaggcaaagcatcttgggaggtttcttcttgtag

SEQ ID NO: 3675 - DNA, 326 bp, Mus musculus
  misc_feature (117)..(117): n is a, c, g, or t
  misc_feature (128)..(128): n is a, c, g, or t
agccagccacggtactttaccaggggcggatccactgaagaatataccctgttttttttgaggaatccatttcccaccctataaagaatgaacacactgtcagacttttgaagaacnagggttagttntcccttcccagtcctcccaggagctaccagttgaacttgatgtttcttctcagctgccctgtacctaccgtctactgtgggctgtagcagcctgcagttattactcgtgagaattatctgtagagctaagtccgtggttccctgcttcatgcatgtctcctgcatgtgaggaagctgactcttcagtatttcctggaa

SEQ ID NO: 3676 - DNA, 314 bp, Mus musculus
  misc_feature (56)..(56): n is a, c, g, or t
  misc_feature (86)..(86): n is a, c, g, or t
tgccgccctcattgtgaccttgggtcctcagcacatgctcgcacttgtgactacangacttcccagctctagaactacatgctaangtctgtgtgccgcagacagaacgaagagggcatcagatcacttggaactggagttaaagacagctgtgagtcaccatggagatgctgggaattgaaactaggccttctgtgagagcagcagctggcagagccgtctctccaccacaaagttttaaacataaataccctaccgattcacaactgcacctgtcgtgcaagtgtgcagtcccttagttcgctgtttctact

SEQ ID NO: 3677 - DNA, 237 bp, Mus musculus
gggtactgaaaagatggttcctaagtttagagcacttgacgctcttaaagaggaacccacaagatagctaataaccatttgtaactccagttacaggggatccaacattgtcttctggtctttttgggcacccagcatgcatgtggtgcacagacatacatggcatgcaggaaaaatacccttatgcataaaagaaaaatattgctggaaatgctattgtattctatgtaacagtgt

SEQ ID NO: 3678 - DNA, 155 bp, Mus musculus
cagaatgtttgaaggccgcccgggactgttttagggccgacattccaagataagctgcaagaagcctgcaatcagcatctgccccagatgtccatcccttttctctgtattttattatactccctcgacttctccctattttctctcatggtgtg

SEQ ID NO: 3679 - DNA, 108 bp, Mus musculus
tagaagtcataacaggattacagctttggaaaatgctgcttccacttctggttcacagatatatgaataaaatgtagaattaaaagacattttacacgccgggcggtg

SEQ ID NO: 3680 - DNA, 529 bp, Mus musculus
  misc_feature (108)..(108): n is a, c, g, or t
  misc_feature (114)..(114): n is a, c, g, or t
  misc_feature (123)..(123): n is a, c, g, or t
  misc_feature (134)..(134): n is a, c, g, or t
  misc_feature (151)..(151): n is a, c, g, or t
  misc_feature (211)..(211): n is a, c, g, or t
  misc_feature (220)..(220): n is a, c, g, or t
  misc_feature (223)..(223): n is a, c, g, or t
  misc_feature (231)..(231): n is a, c, g, or t
  misc_feature (249)..(249): n is a, c, g, or t
  misc_feature (253)..(253): n is a, c, g, or t
  misc_feature (256)..(256): n is a, c, g, or t
  misc_feature (270)..(270): n is a, c, g, or t
  misc_feature (295)..(295): n is a, c, g, or t
  misc_feature (308)..(308): n is a, c, g, or t
  misc_feature (310)..(310): n is a, c, g, or t
  misc_feature (337)..(337): n is a, c, g, or t
  misc_feature (403)..(403): n is a, c, g, or t
  misc_feature (407)..(407): n is a, c, g, or t
acactcagagttcccctgacagagccagtgtaaactggttttcacagcatgagctgtattcctgctgaagaactggcttttacagaatttgcaaagctagcaattagncaactnacacccatnccactgtgttnttaaagggaacattcantattgctagagaccgagaaaggctctctgcagcgttgtttttatgggaagaaatatgtangtagagaanccnacagacantgcagggctaaatccatntccnctncccttggtttctgntttactttaaaaagctccatctgtntcatcttcacaantnaaccagttcccaaagtataatgcattntaagtatttagtatattgataacggcttgaaatctacagaatacctgtgatttttctcacagccgnaaanacccgaactattatgtgttcaaccaaggagagctttaggctgggcccactattccactaatcctcattgtttgagacgcagcgataaatggggagtggtaggccaggcctgtgttccaagaa

SEQ ID NO: 3681 - DNA, 448 bp, Mus musculus
  misc_feature (63)..(63): n is a, c, g, or t
  misc_feature (84)..(84): n is a, c, g, or t
  misc_feature (95)..(95): n is a, c, g, or t
  misc_feature (136)..(136): n is a, c, g, or t
  misc_feature (150)..(150): n is a, c, g, or t
gttctgcttcactgggtgacagggtgctggttctggagtgggtctgctggagcttgggagaanccatcttgaagtggagcagancccagagtagntttactccatgttccagacacggatacctgaggccacctgngagaatgggttggnaagcagccaagagaacccaaagcaaaacggaatgagtacagccagccctgcttgtggtgagcgtggggcagggaatctgttacagccactcatccactcatcatgtccagcctggccacaggagggtgcagaaccaggagaggacccaacactgccacagagatttgcacacaagggttgttagatgatgtgtgcattctaacacgtgacattgctcatcccaatggtcatagctagggctgtaccttgaccacctaccatctcacaccaaaggattagagtacctaggaagcccttt

SEQ ID NO: 3682 - DNA, 525 bp, Mus musculus
  misc_feature (312)..(312): n is a, c, g, or t
  misc_feature (325)..(325): n is a, c, g, or t
  misc_feature (366)..(366): n is a, c, g, or t
  misc_feature (371)..(371): n is a, c, g, or t
  misc_feature (384)..(384): n is a, c, g, or t
  misc_feature (409)..(409): n is a, c, g, or t
gaagacagtgtctcatctgcgtctccgaagcactcagagctaacggaagagaagacccttgaggtggccacacaagcagtgttatctgtgcgtgatccccagctcccttgtcctggtttaaacagaggaagaaaggagttgggtgacgtgagtcacggtggtcataaccccttctttcaggaagccccgagcacctattttcctaaccctgaaagcaaaggtcaagccacagatagaagtgaggaagaacaagagatggtgtctgaaaaagaacattgtgaagcagatgcgtggaggcctgcggggggagcntcatcagatgggncgctgtgctgatgataatcaagaagcctgtgggtctgcagntgcanccgcgcttccagntgagaccccctcgcctcctgaaatnctggaagaaagaacggcaggaaagaaaaagaccattggaaaacaaaaaggcaaatcatctttggaaaaaatccccaaacaagagctatcaaattttgttggtgactggccagttga

SEQ ID NO: 3683 - DNA, 383 bp, Mus musculus
  misc_feature (158)..(158): n is a, c, g, or t
  misc_feature (165)..(165): n is a, c, g, or t
  misc_feature (209)..(209): n is a, c, g, or t
  misc_feature (219)..(219): n is a, c, g, or t
  misc_feature (249)..(252): n is a, c, g, or t
ttctttcgcagtgtgagtgcttagaaaaccaaaagtacagcattgctattagcgctgactttgtaacaagaaaagcctgaggaagtcagaaaacagagcagctctgcagaccagtggtggaaagaatgacgcctttcacatcatgcagtacatttcanaactganaactgacaatcggcgagagtggagaacagcaggctggataatanttggagactncattgaatgctaatgactaagccagtgcannnncaaaagtatttaaggaaggcagaaacccgatcgatcattataggtttatttttaacaggctagttcttttcatatgctcttaaattgaattctaacatccttctctgtttctccggaacacatgctgtgac

SEQ ID NO: 3684 - DNA, 283 bp, Mus musculus
  misc_feature (45)..(45): n is a, c, g, or t
  misc_feature (57)..(57): n is a, c, g, or t
cagcacacacctggcagttcacagccatccgcaactccattgccnaggaaatccaantccctcttctggtctctaagggtactgcatgcatgtggtgcataaaaataccatgcaggtaaacactcacacacatagaataaactaaataaaatctctatttaaaaacaaggggtaggagagttgtctccttggttaagagcacttcttgctcttgcaaggaggccccaggtttacttctcagcacccacacgcaggctcatcacctccttggacaccaagcata

SEQ ID NO: 3685 - DNA, 398 bp, Mus musculus
  misc_feature (39)..(39): n is a, c, g, or t
  misc_feature (45)..(45): n is a, c, g, or t
  misc_feature (49)..(52): n is a, c, g, or t
  misc_feature (106)..(106): n is a, c, g, or t
  misc_feature (250)..(250): n is a, c, g, or t
cgcgtgtaaagccactgtatgcatgtgtccaccattaantaaatntaannnnattttaaagtatattaataattatatgtaataagttgaaaattattcataaacnatagaaataatttataaatttcaaagcaataggaaaaagcaaagtaagaaacaaagcaacaaataaccaacgtataaagttcagtacagttatcaagatagacccttgaaattcagaaacgcagcagctggacggatggctccncagtcaacatgtactgctcttgcagagacacaggttctgtggactggctcacaactacctgtgactccagttccaggggtccaatacctctgattgtgcaaacacctgcattcatgtataacacccatcccatgcacacataatttaa

SEQ ID NO: 3686 - DNA, 506 bp, Mus musculus
  misc_feature (35)..(35): n is a, c, g, or t
  misc_feature (216)..(216): n is a, c, g, or t
  misc_feature (341)..(341): n is a, c, g, or t
  misc_feature (343)..(343): n is a, c, g, or t
  misc_feature (345)..(345): n is a, c, g, or t
  misc_feature (378)..(378): n is a, c, g, or t
  misc_feature (380)..(380): n is a, c, g, or t
  misc_feature (422)..(422): n is a, c, g, or t
  misc_feature (455)..(455): n is a, c, g, or t
  misc_feature (458)..(458): n is a, c, g, or t
aagagcagagcagtaccaggactcctccacctggncctccctccccagagcaagggtcagccacaggggagagacccacatcctacctgtccctgacccacaatgaggatgtgtctctgacatcagcaaagccgagttcacacacacacacacacacacacagacacacacacacacacaccccatcccctgttacatctgttctgagagtgctcnaatactatttaccaaggagggattttaatctagccacacaggggagagctggctggtcctcactaaactggctcccagtagacaagtgagtgcttcccgtgatacatgaagatttttgttccctntntntggcagtgtagtgatttttcagtgctgttaatntntggttgtttacgtgacaacagtgtggtgttatgaagtcagtntccctcctggaagggaatcacgccaaggatgtnttnttgtccattggtttgattgatcagtagctttgagcaatcctgttaact

SEQ ID NO: 3687 - DNA, 497 bp, Mus musculus
gaatggcttacttatggactctttagacattccctcatttaagcctcttgagtcttgtaacaggtgcaagcccacacctggctttctcttgtcctattaaatatgcataccctgtctcagaatctaggatcatctaggagacagggctctcaggaatcctgtgagagagttccttggttatgctaattggtatgggaagatccatcttagttgtgggcaggaccattgcctgggcaggggtcctcgactgtctaacagggagcagcagggtgaatttacccctctactctctgattgtggatgtggcaggaacagctgcctaaagttcctgctgccttcctttttcattacaagggactgtacttgaaatgtgaaatgtgagctaaaagaaacccattcttttttaagatgctaaaaaaccaaacccaacccctttaatatatatatagtatatatattatatgtatataatatatattacactgccatttcccatt

SEQ ID NO: 3688 - DNA, 487 bp, Mus musculus
  misc_feature (314)..(314): n is a, c, g, or t
  misc_feature (416)..(416): n is a, c, g, or t
ctggattgggttttcatgagcggctgtctcctgcaggtggcaagtctgatatctcctggagttgggcccatttatcttcttaacttcactttggttaggatctgtgtatcaccatatgacttaagaaatggcagaaacaggcatcttctcttgctcctgttttccaggaaagttttcagtcttttcactactaggctttttgttttatgtctgtacgctttctggatcaagttctctccagcatgctgaacaagtctaatgccaccactcccacctcagcccttggatgttttacgtagttgctgtacccattnttagaaatgccattttcagggttggggtgtggcccagcagtggaagctggcctgtcagtcattacaagtcctggactccatccccagctgctggtgtaagantagcacattatactctctaacctgcagaatgctctctttccccttcagtgctgtcaacttttgcttggtgt

SEQ ID NO: 3689 - DNA, 540 bp, Mus musculus
gcacacatatgccatggctctcaaatggaggttggatgatagcttttgggcactgtgttagtcatttttctgctgctgtgataaaaataccatggccaaggcaagttatagaattgtatgatactctaaagggtttatctgggcttacttaaggttccaggaataagagtcctccatctcggggcggcatggcaacaggcagcagtagaagaaagctggaagcagacaactttaacctaagcccaaagcagagaacataactgcagggaggcaatcccgttctctccttctaccatgtgggttcctgactgaactcgagtcgccaggcttggtggcaagggcctttccttgccgagccatctcactggctccctttccttcgtttctgaagattctacagtaaactgcatattcgttctggcttgtttctttgagtcttgctacgtagcccaagttgccctgaagctcacggcctccatgtttctgactgctgagattacaggagagtgggcatttgccttcatgctgaaccttacaaca

SEQ ID NO: 3690 - DNA, 487 bp, Mus musculus
  misc_feature (50)..(50): n is a, c, g, or t
  misc_feature (125)..(125): n is a, c, g, or t
  misc_feature (179)..(179): n is a, c, g, or t
atttgagttcgaatctgcagggcttatgccaagagctaagtacacagtgncctcccagactcctggctctgtggaagcagaccctggaggatcccggaagcctgctgggcagctccaggttcagngagagaccctgtctcaaaacataaggaggctagcaattgagaccaccaccagtntctggctgcctgcctcctgccgagtacacacacacacacacacacacacaagcataaaagacgctggcacagctgcacacatctgtaattccagcattctggggactgaggcagggccatagtgagttagcaaatacctttgcgctgtccctttgagagtaaagaatggggtgtttaccaccgatggtgaaacccctctgagggtatcagttccctgtctgccccccccccccaaagctcacagggaaataagacagttgtgtgcatctttgtgtgcaggtgacctctctcttggacaggtgggcaga

SEQ ID NO: 3691 - DNA, 332 bp, Mus musculus
  misc_feature (29)..(29): n is a, c, g, or t
gtgcagcaaagacagaaccccgatgcccntctgacttacaggaatcactcaccagaacagccagttgcaggacaggatctctcagatagccaggctcctttctattctcagtctggtccagagcatgagaacagacactccgaggacctagatcatatccacgatgtagcttatattatgcaatggtgggacaagggccgcctggatatgcttgcaaggtggaaccctctgaaagagacatagtttgttctgtcatccctgtgaggttcaccaaagccttaagctcttgtagttcattgtcttatgcgtatcctctccgtatctgatgaaca

SEQ ID NO: 3692 - DNA, 497 bp, Mus musculus
  misc_feature (255)..(255): n is a, c, g, or t
  misc_feature (270)..(270): n is a, c, g, or t
  misc_feature (288)..(288): n is a, c, g, or t
  misc_feature (294)..(295): n is a, c, g, or t
  misc_feature (299)..(299): n is a, c, g, or t
  misc_feature (312)..(312): n is a, c, g, or t
  misc_feature (314)..(314): n is a, c, g, or t
  misc_feature (322)..(322): n is a, c, g, or t
  misc_feature (325)..(325): n is a, c, g, or t
  misc_feature (327)..(327): n is a, c, g, or t
  misc_feature (329)..(329): n is a, c, g, or t
  misc_feature (403)..(403): n is a, c, g, or t
  misc_feature (429)..(429): n is a, c, g, or t
  misc_feature (444)..(444): n is a, c, g, or t
  misc_feature (463)..(463): n is a, c, g, or t
  misc_feature (466)..(467): n is a, c, g, or t
tcacttctcactcttgtcccgtgagcttcccacagctcatgtggccattaatccccttgccatgtggtcttagcatcaacccatcctgagaaaggggaggtgacactttcctgaaagaacaaggggaaggatggcaaaacagagagtacaggagagtggccttccccaaagacacccttctcccactgctgtgacattgcccccactctggcccccagcactctctcgagtgggatagggtagtacctgcatagnacgggtcttggagcntcaggagctggggctttntcacanntggnttggccgaggggntnttggatgntgntntncatgctgagaaaggtggtgctggctggagcaggaccagcttgagctacccccaaggccctttaaagcccctttntccccagagctggcagctgaatgagntcactgggctgtttntagaacatgcccccctccnttnntttccctgtcccacaactcttggtgtgata

SEQ ID NO: 3693 - DNA, 564 bp, Mus musculus
  misc_feature (104)..(104): n is a, c, g, or t
  misc_feature (121)..(121): n is a, c, g, or t
cataggaagctaggccttggcacctgccatattggcctctttcataggcctggagagtgagagttgacgctgtggacagaactgaggagagcaggagcaagcgngggcctagggtgtcctnttcgctccgggggttcagtttctaggctcagtttgtctcttttcctccaattccagtagttttctcattgcgctgggcagttcaagggaggccaccccagctcttcaagactggtagaatcgtggaatggctctcgtcccacgtagattacatgcgctcaccggtgtgcgccgccgggctccgtgagctccgactgccgcgttaaaactcaactccgaaggtcggagcgcacgggggcgcctgggggtctgcgttccccgggctttggggaggcaccagcatctgagcctgcgcacctctcaagggaggccaaatctctgaaggccgagtaagctgtggaagttggagggggtgtggggggatatattgttattaattacttcaggctaggcctaatgcttccaaccctcagaggtggttggcatggacgtcctgcggatttt

SEQ ID NO: 3694 - DNA, 527 bp, Mus musculus
  misc_feature (188)..(188): n is a, c, g, or t
  misc_feature (208)..(208): n is a, c, g, or t
  misc_feature (239)..(239): n is a, c, g, or t
agtcatcctgtctggcacatagaggccccatttagtgagagaccgacatgttaactattggggctatttttcattcttcgatgcgtaaatacagatgactcaacatctagcctaccaagctggctacctatcagtttttattcttactgcgtcacaattactggagaagaaggaggtgaagaaaatgnccctcagtccagactctatntggatttcagttccctagctatgagagtggntatcgggattaattctaaagctctggggttgattacaccgtgcagcctggatgaagagctagatgtaggtacttctgtgtccactgatataacataacacacctgggaggacggtctgctcgatccctctgttgagtctccggcccggaggggatggggtgggggggacagccgactggcagggatgctgtgacgacgaacccaaatactgctccaggggaacaactgcgaccagccccacaagactgtacctcgcggtagttttcgaactgttcagggtctgcgacc

SEQ ID NO: 3695 - DNA, 410 bp, Mus musculus
  misc_feature (56)..(56): n is a, c, g, or t
cctcagctgacctttgcaagactagggaagaagagtcgccataaatgtgcacattngatcgcgcataatttatggtgcccttaattgtcactacaaattgcattcctgaggagcaatttagcagctggatgctagtggatgctagcagatgcaggtttgcacctctgctgagttggctcagctggtcccctcattagctgcaggaggccgagccctggaaaggagggaaggataaaggcaggcggctcagcccttcctcctgtgtactgatgtcaccatgccctgcttctgcctccacagatccagctctatttcgcatgcttgccagaggaaaaggttccttatgttaacagccctggggagaaacacaggattaaacagctcctgtaccagttgcctccacacgataa

SEQ ID NO: 3696 - DNA, 510 bp, Mus musculus
  misc_feature (64)..(64): n is a, c, g, or t
aattcatagtctcttcattgctccttggtagaccaggcgggtgtgtctgttagtaagcgtgttntcgtaaaagctcacaactacaaattaatacatgtgtgtagaactatcacatacataactgtttaactctgcatggcttctcagaactttaaaattatcactaattgtatatcacaactgataaaccacagtaaaattagggactgggttaggaattaagactcctctgcccactcagatttcttttgcttcaaacataatttagatatatctactatttattgtcatttatgaaatacaaagtaacatccaaattaacctaaagattgggccaactatgtctgccttagaaaatagtgtcacttgtgctcagttcatcctatcttcactgtccgttacagtcccgatggcagcctcgaggctctggattacccctggacactgagctcagggagaactatgtgtggctctctgtaggggtcactcttctcgtaggtgtggctggca

SEQ ID NO: 3697 - DNA, 312 bp, Mus musculus
  misc_feature (76)..(76): n is a, c, g, or t
ttcggccgcgtctgcgcagagctcagggcgccgcaggggaggccccgccctccgtgtcggtgacgtcacggccacnaagtggtttttgtgttgtaccctgaggctgtttgctgaactcaaggtcctgccggttcccctgagttgtcttcacatattggtggagagtccactttgaaatacttttgtgggagttgtaaactcttaagtttttgcttatttatgcctatgttggatagtatttgtgaagacaattactctcctgagtttaatttgctcttttaaaagaacattgactattttgtgaggttcttt

SEQ ID NO: 3698 - DNA, 444 bp, Mus musculus
  misc_feature (29)..(29): n is a, c, g, or t
  misc_feature (37)..(37): n is a, c, g, or t
  misc_feature (61)..(61): n is a, c, g, or t
  misc_feature (65)..(65): n is a, c, g, or t
  misc_feature (95)..(95): n is a, c, g, or t
aaccatttctggtttctcacagagaccantgacatgnaagtccctgaacaaattccctggnaaanttgcgcggccacctccatcctccagctcgnccagttccaagggaaggggtgacaacctgatgaaggagctgctgtgcagatgccctgggttagtgtcaccttggaaagtgactgaggagccggcagacatttttttttctccatggcagctatttcttgaggtctgagtgactggccaggggctgggttttcagctttccacagtccacctccaagctagtcagggggttgattgaagtcttgagagtaggtgaagctcttgcaacagtctccaggatgtctttctgctctcccaagcagccctggtagcaacacctgacctgtcagaagcaccaggagaagggtgaggacccagtgctggtctaactagaatctccct

SEQ ID NO: 3699 - DNA, 546 bp, Mus musculus
  misc_feature (44)..(44): n is a, c, g, or t
  misc_feature (46)..(46): n is a, c, g, or t
  misc_feature (73)..(73): n is a, c, g, or t
  misc_feature (167)..(167): n is a, c, g, or t
  misc_feature (179)..(179): n is a, c, g, or t
  misc_feature (186)..(186): n is a, c, g, or t
  misc_feature (189)..(189): n is a, c, g, or t
  misc_feature (191)..(191): n is a, c, g, or t
  misc_feature (197)..(197): n is a, c, g, or t
  misc_feature (200)..(200): n is a, c, g, or t
  misc_feature (223)..(223): n is a, c, g, or t
  misc_feature (435)..(435): n is a, c, g, or t
gccatgggaactcagcagcgtctaaacatgaatgactgatttangncccctgattaaaaccttggctttcccngtgctttctcagagctgagtggttggtctctgtttctctgcttttctccaccactcagtcacagcaatgacctcatcctttcaagtgccagagnaggcaaactaanccccagnagnancctggnagnagagcctggctcccatttcctgnctttcagggaatccatccgctaagcctggcttctgggcatccctcgaagctggcggagctcaattgcggcaggaaatttagaaacaggaaagttcctcagttgccaccgggaaggacctgggccaagggctggagagctagctttttggtagccagccctaaggaagcaagacagagtgacaggagatcttttcaatcggggtgctacattncgctacaagctgagcgacaacaagcttgttctggtgacttaggaagcgtcccaaagccattcaagctgcctgactgtacttggggaggacccaaggctttacatggctaaa

SEQ ID NO: 3700 - DNA, 479 bp, Mus musculus
  misc_feature (49)..(49): n is a, c, g, or t
  misc_feature (165)..(165): n is a, c, g, or t
  misc_feature (435)..(436): n is a, c, g, or t
  misc_feature (438)..(439): n is a, c, g, or t
aacggtaccgcagaccattcaaactcctctacctggcaccgtctccatncccatcgatggcacctctgggcagaacagcaaaactaactctgggatgagcaaatcggcttcctttgcgtttgagttcccaaaggacagaggcagattggaggcattctcaccccntcccccacctccaaagtcaaggtgagtaccccggggctgacatggaaagagtcttaagaaaaaacacctgtctgtagggcctttcccagaaacctttgcatttgctgcctctcaggaaagcctcgggcccatcctcgagtactgcctgtcaggcaccagtgtctgcccaagggccattgtgcactatgtaaatttcccagaggcccagctcagccttgagaaagcaggaactcctgtttggtgtgtgtgtgctctgcaaacaaacctggnngnngtgtgtgtgtggtgggggacgactggctatttgaaatgaa

SEQ ID NO: 3701 - DNA, 505 bp, Mus musculus
  misc_feature (236)..(237): n is a, c, g, or t
  misc_feature (254)..(254): n is a, c, g, or t
  misc_feature (263)..(263): n is a, c, g, or t
aaggcatggctatcacttgtggcccctgaaagtgacagtattgtccagcatgttatcaggatggtgtgacctggacctaaggatctcagcctgggtgccattgaggctgaagatggctgggttgtgggtcctgcaggatctttacagctacctccactttcacctgtctcatgcttgggctaccatcctgtgcctctccaggcatgcacaacagcatctctggtcattgccatgtnntctcagaggtgctgtgntgagaaggnaatccccccagcttggaaactgctggcctgagggacaaaaagaaaacaggggaagaagtgtgagctgtgaccaagagtaaaccagtgggctagggagatgcgactcagcagttaagagcactgtatgcttttccagaggacccaggttcaatccctaacacccacatggcagctcccaaccgtctgtaactccaatcccaggagatgcaatgccctcttctgacctccaaagacactgcatt

SEQ ID NO: 3702 - DNA, 504 bp, Mus musculus
  misc_feature (72)..(72): n is a, c, g, or t
ctctgctcttggactctagggcaaaccaagagtctaatgcagctcctgtcctgcagaggtgatgaacaccangcacaaggtcacagagactctgcccacatcatcttggttatcaaactcaagtagaactaatactgctcgaagacaaatgtctttaaagtcccactgtccagttacaaataaacagaggaaggagagagatggggaggtggtacagagtgccttggggacagaaggaagaaaatacccagagcatgcacaaagccaagtggtgacgaactctggaggacttatctcatccaagagagagataagagtggctggaggaaaccgggcttgggagacaccccagtctctaaagtgctggccccacaagcatgaggacctgagtttgatcgccaaaatatacactttaaaagtcaagtttagcagtgtgcacttgtaattccagtactgggaaggctaagacaggccgctactgggtttcaccagacagacagccta

SEQ ID NO: 3703 - DNA, 544 bp, Mus musculus
  misc_feature (39)..(39): n is a, c, g, or t
  misc_feature (45)..(45): n is a, c, g, or t
  misc_feature (134)..(134): n is a, c, g, or t
  misc_feature (140)..(140): n is a, c, g, or t
  misc_feature (156)..(157): n is a, c, g, or t
  misc_feature (165)..(165): n is a, c, g, or t
  misc_feature (167)..(167): n is a, c, g, or t
  misc_feature (172)..(172): n is a, c, g, or t
  misc_feature (181)..(181): n is a, c, g, or t
  misc_feature (206)..(206): n is a, c, g, or t
  misc_feature (214)..(214): n is a, c, g, or t
  misc_feature (253)..(253): n is a, c, g, or t
gggatctgcctaaatatgtcctatctgagttaatgggtngggtgntttgagttaagaatgacaacatcccacccactttgttctacatgaaggtcaaacccaagtgtgtaaggatacacttcccttacacttanccaacntgacttcagaaaaccnnggactttngncctgntctacaggncataaacttttagctttacctcagngtacacanttatatattatcagtgacaatcaaaatcttctcacttanctctaggtcttttgttcacttggctatatgcacatgttctcattttactggctcattgaataaatgaaattataatttctgctagtgttcaccaactttctttctttgagatacatggaaagccctccatctctttactttatcctttgtttttcatatttattgacatatgtgctgtttggcaattttaaaaattgaaatataattatattgttctcgcccctctgctcatctaccacccccacactattcctcttgatttctttcaaagtcatggcctttgtttcttga

SEQ ID NO: 3704 - DNA, 420 bp, Mus musculus
  misc_feature (145)..(145): n is a, c, g, or t
  misc_feature (155)..(155): n is a, c, g, or t
  misc_feature (170)..(170): n is a, c, g, or t
  misc_feature (178)..(178): n is a, c, g, or t
  misc_feature (181)..(181): n is a, c, g, or t
  misc_feature (189)..(189): n is a, c, g, or t
  misc_feature (206)..(206): n is a, c, g, or t
  misc_feature (209)..(209): n is a, c, g, or t
  misc_feature (221)..(221): n is a, c, g, or t
  misc_feature (226)..(226): n is a, c, g, or t
  misc_feature (233)..(234): n is a, c, g, or t
  misc_feature (249)..(249): n is a, c, g, or t
  misc_feature (255)..(256): n is a, c, g, or t
  misc_feature (272)..(272): n is a, c, g, or t
  misc_feature (317)..(317): n is a, c, g, or t
  misc_feature (333)..(333): n is a, c, g, or t
acgcgcgcacacactcagaggaaaagagaacaaatcttttatgcttgagaacagttcttgctgccactcgacagaggaagggcctctaacatgaagtcaccaacatttggggactgtcattaggaaatcctcaaatgccttttgnaaggtaacgnaatctggttctaaanatgggggnatnctggcatnccttcacagtgcagtgnagncgtcatgtttgntctgntttgggnntttggggggggtgcnatttanngacagagtctcactcntttagtccaggttagtcttaaactataattcttctgtcctgtctncctgcttttagaacangcatgtgccagcctgtggtctcagtgctgtcccttacgtctaacatagagtatccatagtcagtatggccattaaccagtttaaagc

SEQ ID NO: 3705 - DNA, 530 bp, Mus musculus
gttactgaatgatcagcccactccatgactcaaatgggtagttttagaactgtgtggtacttaaaacctgtaatccaaataatgcggagtggattcaggaggacagcaatagcaatgccctgtggggctacacatgaggtcaagtcaaccttagaaaacaatgttagactttaataaagaaaaatctcttcagtaaaaacgagcctccagctctggctaacactaaggggagccggaaaaaaaaaaacagatatgctaacgtacatacacaataagtgtatgcattctgcatatgctgtcaaactgaagaaatgctgtttactgccctccggctatcatggctccctatcgaatacaactcaggacaacctgcacagaagacctgggtttagttcccagcactaacacgatgacacaaagttattgagatcctgtggcagagcatctaatggcttcttctatcttctgtggaaaccaaataatcaaatgatgaacacacatacatgggagcaaatcacccatgcacatga

SEQ ID NO: 3706 - DNA, 544 bp, Mus musculus
  misc_feature (101)..(101): n is a, c, g, or t
  misc_feature (126)..(126): n is a, c, g, or t
  misc_feature (157)..(157): n is a, c, g, or t
  misc_feature (170)..(170): n is a, c, g, or t
  misc_feature (204)..(204): n is a, c, g, or t
  misc_feature (210)..(210): n is a, c, g, or t
  misc_feature (213)..(213): n is a, c, g, or t
  misc_feature (222)..(222): n is a, c, g, or t
agttatcttggccatggtttctcttcacagtaacttcccttagcctctctccatctcccttggatgacacaggtcatcactttatacctgcccttcacctnactcattgtgttatcccagcccctnatcttcagtgtgccctcctttcaaacccagnagaactttctagntgtgaaaagcaatgaccctaacttcagatattcnaaatcnggnccaatattnccatgtctaatctctgagtctcatccccacctctgtatctgactttctgttgtcgcacctcctcactctgtcaccatttttaagagactatgaagatccttgtgtaaaccgcattttcttcccttctgcaaactcccttcctttttattaggacaggctcatttctaagtgtgaactcttaatacccataagcactgttttcttgtaatgtgctgtggccacatgtattagaatctcagaatttccctaccagggaatatcatgcctaaagcccagcatggaaacacaatcaggagaatatgacttccctggagtctagcaa

SEQ ID NO: 3707 - DNA, 494 bp, Mus musculus
  misc_feature (26)..(26): n is a, c, g, or t
  misc_feature (38)..(38): n is a, c, g, or t
  misc_feature (84)..(84): n is a, c, g, or t
  misc_feature (133)..(133): n is a, c, g, or t
  misc_feature (140)..(140): n is a, c, g, or t
  misc_feature (152)..(152): n is a, c, g, or t
  misc_feature (184)..(184): n is a, c, g, or t
  misc_feature (251)..(251): n is a, c, g, or t
tgtgtttcttttgggctgtttactcnccatttagctcngccccagagagaccctggtgggattggtacctctctcctctcctcnggacctgccagccttgccagcaggagagggaaccagagacttagtaaancatatcnaagcatgctatncccaggagtgctgcatacacagctgcttgggntcttctgtagggccctggtatttgcaggctgtagatccaacacaacgcttgtgtgtaatcacagacntcatacttctgagacactttctggacctctcttttcacttcagtttcttaagacaaacttcaaaatcttgatctcaacacttgtaatgaccagtttaatggtcaactttgcatagcatagaactgtctgggaagagagtctcagtgaggaattgtttacattggccggtggatatatctgtggaagatatgtcttaataaggttaattgaagtgggaagactcagtccactgtgagtggcacc

SEQ ID NO: 3708 - DNA, 325 bp, Mus musculus
  misc_feature (26)..(26): n is a, c, g, or t
  misc_feature (39)..(39): n is a, c, g, or t
  misc_feature (145)..(145): n is a, c, g, or t
cattttgccctcactgggacaggtgncaaagttctaagntcgggaaaagctgtgtcgcctggtgtaagcatcttgcattttggccccgaagtattagtcccaactcatatgttggacctttccccaagttatctgagttcagtgnacattagttgtccaaatagaaaagggggagaaacaattcctatgtttgtatgtatgtgtgattatgatattctgtgagaataacctaccactcgctgggcatcttgggattgtaacttttaacaataattagtattagtagttttttgttattttaatcccatgtccagtttaacttcaa

SEQ ID NO: 3709 - DNA, 309 bp, Mus musculus
  misc_feature (97)..(97): n is a, c, g, or t
  misc_feature (100)..(100): n is a, c, g, or t
  misc_feature (109)..(109): n is a, c, g, or t
  misc_feature (125)..(125): n is a, c, g, or t
ggcttgcaagcttacattttccattttggtaaggttccttatctcttcttactaaaagagaattcattgcttctgttttgaaacttttcttgggtgnaanttgagcagnctttttattaaaaggnaatatttattaaaattcagcttagacttttaaactgtctcttgaatctataacaatttacatttgccttttaattcacaattattttaggttcatttaaataattctcttaatgacattttatgacctaaagctttatctaaatatttaacatcaaatttgctcccttataaaacacagatgta

SEQ ID NO: 3710 - DNA, 553 bp, Mus musculus
  misc_feature (73)..(73): n is a, c, g, or t
  misc_feature (117)..(118): n is a, c, g, or t
  misc_feature (131)..(131): n is a, c, g, or t
  misc_feature (142)..(142): n is a, c, g, or t
  misc_feature (151)..(151): n is a, c, g, or t
  misc_feature (157)..(157): n is a, c, g, or t
  misc_feature (164)..(164): n is a, c, g, or t
  misc_feature (169)..(170): n is a, c, g, or t
  misc_feature (176)..(176): n is a, c, g, or t
  misc_feature (178)..(178): n is a, c, g, or t
  misc_feature (181)..(181): n is a, c, g, or t
  misc_feature (202)..(202): n is a, c, g, or t
  misc_feature (226)..(226): n is a, c, g, or t
  misc_feature (239)..(239): n is a, c, g, or t
  misc_feature (248)..(248): n is a, c, g, or t
  misc_feature (276)..(276): n is a, c, g, or t
  misc_feature (337)..(337): n is a, c, g, or t
  misc_feature (375)..(375): n is a, c, g, or t
aatagccaacatttgtacaggactaatagaaagtcttcactatgtcttgcttctttggttttgttttgttgtngggggttttgtagacagacactccaaatgaaggccaggctgaanntggactcaagtantttcctgcttnagaatcctnactacntgaattnaaggnncccagnanctnactgtgtgttctgtagctcanttctttccttagagccattcaganggggggttattanttctagttnaacaggtgaggaaacactgtgctaattncccagtgtccagaggctgattgaaatactgtatgcatgccttttgttgatgcttcttcggngctgtttgctttggttttgaggcaaagtttcacacagncccaagctgctgaccaaaattcatgatgtagctgagaatgaccttgaacgcctgtgactcctccttccacaggaggtacaggcatcttatgccactcctggccgttgtttatgtttaaaaaaaaagcccccaaggattcactaaacacctcaccataaatcatggcttcatcacaaga

SEQ ID NO: 3711 - DNA, 460 bp, Mus musculus
  misc_feature (122)..(122): n is a, c, g, or t
  misc_feature (137)..(137): n is a, c, g, or t
  misc_feature (294)..(294): n is a, c, g, or t
  misc_feature (323)..(323): n is a, c, g, or t
  misc_feature (373)..(373): n is a, c, g, or t
  misc_feature (382)..(382): n is a, c, g, or t
  misc_feature (415)..(415): n is a, c, g, or t
ctgtaatccccgttcttatgagtgaaggcaagaggatgaggtgttgaaggccagtctttggttctctaatgaatttgaagtcctgtctcaaaaaaaaaagtaaaaattttggtagaagaganttaagagtaagaggncagcaagatatgataatgcctgcctatatttctagcaatgatgtggggagtggtggcaaagtcaggatttctacgagttccaggccagcatgggctacatagttgtaggtgggagagaggaaagaggaaaacaaaagggaaaagagtgagggtgtcntgcttggtatggacctcatcagtatcagnctaggatgtatttgggcatgtagcctttttctagtctctcttttcttccnctgttctcnttgtgaccaggacaccttgattgtcacttaagnctacatgctttctgtcaagtagaaatcctagctccagcagggcaa

SEQ ID NO: 3712 - DNA, 527 bp, Mus musculus
  misc_feature (32)..(32): n is a, c, g, or t
  misc_feature (49)..(49): n is a, c, g, or t
  misc_feature (81)..(81): n is a, c, g, or t
  misc_feature (109)..(109): n is a, c, g, or t
  misc_feature (129)..(129): n is a, c, g, or t
  misc_feature (149)..(149): n is a, c, g, or t
  misc_feature (164)..(164): n is a, c, g, or t
  misc_feature (211)..(211): n is a, c, g, or t
  misc_feature (219)..(219): n is a, c, g, or t
  misc_feature (221)..(221): n is a, c, g, or t
  misc_feature (223)..(223): n is a, c, g, or t
  misc_feature (230)..(230): n is a, c, g, or t
  misc_feature (235)..(235): n is a, c, g, or t
  misc_feature (241)..(241): n is a, c, g, or t
  misc_feature (251)..(251): n is a, c, g, or t
  misc_feature (253)..(253): n is a, c, g, or t
  misc_feature (268)..(268): n is a, c, g, or t
  misc_feature (276)..(276): n is a, c, g, or t
  misc_feature (283)..(283): n is a, c, g, or t
  misc_feature (287)..(287): n is a, c, g, or t
  misc_feature (290)..(290): n is a, c, g, or t
  misc_feature (302)..(302): n is a, c, g, or t
  misc_feature (321)..(322): n is a, c, g, or t
  misc_feature (403)..(403): n is a, c, g, or t
  misc_feature (448)..(448): n is a, c, g, or t
  misc_feature (470)..(470): n is a, c, g, or t
  misc_feature (487)..(487): n is a, c, g, or t
gagcttagcatacaggatgactggggtttgtnccccagcaccaagagtnaacctgtcaatctgcattgacaaggggaaacntccttcgccagtctctcaacgggggctntcaggcatcctgtctagcantaggtcctgtatctcaagcngaagttgcagtgtcntcaccacatgcagttattgcttgccataaactggagatggacacacnaatgcccnantnccatatncgaanccaccnttttattacnancccccctgccccaantttcagangtgcgcntttnctncacatttttggntttggtttggtttttgttnntttttcatgtgtgtggtgtcctggtttggatgaaatagaaataaagggaagctaggttctggcagctttggaaattacagnccaagatcttccttatcatgaaattcaaacccagggtagtcaagnaagtggcactgtccttgcatgnctagatcttctcttctncagcaaaagcctgacaccttggctactgggggatgacact

SEQ ID NO: 3713 - DNA, 502 bp, Mus musculus
  misc_feature (213)..(213): n is a, c, g, or t
  misc_feature (220)..(220): n is a, c, g, or t
  misc_feature (222)..(224): n is a, c, g, or t
aattctgagcttcacttatccatcaatgatacacaggaaccaactgatgttttatataagaaataatgcgatttctttattcactttagtctgtttaatatttcctttctattaatttttggttgccatacagagtactaggtctgatcatgacatcttcttacataggcccttatgctttcttctggttcaccctcttccctttctgtcctnccccccncnnncccgttgtttcttctgttctaccaggctcctcttcttccctcatcagtcctccctgttttcctattgcatgtataccatccctccctcatttcccacttcctttgaggtctcttcctcttctctcattacccccgttctgggcttttgatgtataaataaacttatataatcacacataacatacatacctatccccacgctgcaaaaagtttattattatatagtttagaattgtaaactctgactctttttaactacttgtcattgcagaatttgg

SEQ ID NO: 3714 - DNA, 513 bp, Mus musculus
  misc_feature (27)..(27): n is a, c, g, or t
  misc_feature (29)..(29): n is a, c, g, or t
  misc_feature (51)..(51): n is a, c, g, or t
  misc_feature (64)..(64): n is a, c, g, or t
  misc_feature (82)..(82): n is a, c, g, or t
ctttctgtggcatgtttgagtcccccncncatttaatttgggggaaaaccnctgcaactttagnctttaagaaaattgttcnctgcatacagctcagaatttacgttttcctttgacatctgggtgtgagcacctccctgtgtgggacagtgatagaggcctcaagtagacatggagaaaatacaaaaacagaacgtccctgtcctccaggagctgcttctgaacagagaaggctgggcaaagtggataaacaattaaaccgttccttgtattatgacaggtgctgcggggaaagtctttcagtctaaacatgctgggcacctctgtggatgaaggcgggaaatgaaccagcagtccgattaatttggtgggggcgtaggtgtgtctcagattccacgacgaatggcggggcactttgagtcacctcattcagtgtctcggcttagatgcattttgaacttcctagtggccaactcttctccagttccaaaggatgcttatcactctgtcacc

SEQ ID NO: 3715 - DNA, 486 bp, Mus musculus
  misc_feature (141)..(141): n is a, c, g, or t
  misc_feature (192)..(192): n is a, c, g, or t
  misc_feature (400)..(400): n is a, c, g, or t
ggaacaagccagtaggcagcctctctccatggcttctgcttcacttctaagatgaaattagccctttcttccccaggttgcttttggtcatggcctttatcaagctataggaatcctaactaagacacccagcatggctgnatgtcttaaccagaggaatggactgatctgagttcatgcagtagcctggtngattatcctttttcatttaaggttctcttacaatctgggtcctgcatctttaaaaaaagaaaaccacagaggtgagatagggctatcattcagtggaagggtgattgctagtaggtgtgaggccccaacactttgagaaaattaataaataaaactaaccaataaatctcaagagcggtatcctcttggtcaacagcaaatgccatanctttcttatcactcgactgttagacacatagatgtggtttttgttttcctggtggtgtaatgagccttgggcatagagttgtacgt

SEQ ID NO: 3716 - DNA, 289 bp, Mus musculus
agacccgtttctatcatctttttcttttaaagacagggtttcgtgcagcccaggcttactgtgaactcactgtgtactagaggatgattgtgaactcctggtcacccggtttctgcatgcaaggcctggaattacagacatgcgctactctacccaatttctctctacttgagtacaaaaagaatgaagagcaagcagacagtcaaatgatttacttatggtcgtacatctaagaaaccgacacccttgatggtctgaggatttgacaagtgatcccatcaagccagtg

SEQ ID NO: 3717 - DNA, 520 bp, Mus musculus
  misc_feature (201)..(201): n is a, c, g, or t
agtcatctctctatcactgttctgagacaggccttacactgcagcacaagctggctcccttgcttcagatctggttataaggagagagccaccattttggtttctggctagttttattttgttcagcatcaacctatatgtaaagaatcaaaaatactcaaaagattgttagactgaatggtaaactaaaaccaactcagntcaaccaataaactgtcaatgtcaacgaaccaattaaagggacgggcctgcctagtgtgctacttacatttgtaaccctggtactccagagtctgaagtttgaggctaactggcctgcagaataaacaaatacagcaagaattaaatggaataaagtcgaggaggagagggagtgaggagtcatgcaggagtaggagagttgtgatcacttcagccaaggttaagtggccacagaatggagaagacataagtaggctattcagaaggaggtgaggaagaaggaagactccccaaacaggtacctaacagctgcggagta

SEQ ID NO: 3718 - DNA, 417 bp, Mus musculus
gctcatataccttagttggctcccactgcttatagaatatagcccaaagtcctcaatacaggttcaaagccctctgctacctgaccttacttctttcagagatatattaaataagttcacaagcaaaggagaagagatagagagctaaagagaagtcctgagaggaagctttcacgtttggggatagtcacaggagtggtgctgcctttgatagatgaggggccaggattcatgctttcatgctgctcttagaaccaaaaaaatctgtcaccaatgaaagagccacagggcagcacgcagtgtctgtcttctgatatctaaggcaagagaccgcaaagctcaggaaatgagaagaaatcgagaagcccctactgaacacaaatacatatctgtaattagccctgctttgaccctaat

SEQ ID NO: 3719 - DNA, 462 bp, Mus musculus
  misc_feature (41)..(41): n is a, c, g, or t
  misc_feature (75)..(75): n is a, c, g, or t
  misc_feature (89)..(89): n is a, c, g, or t
  misc_feature (99)..(100): n is a, c, g, or t
  misc_feature (107)..(107): n is a, c, g, or t
  misc_feature (115)..(115): n is a, c, g, or t
  misc_feature (124)..(124): n is a, c, g, or t
  misc_feature (145)..(145): n is a, c, g, or t
  misc_feature (197)..(197): n is a, c, g, or t
taatactttgggtgtcttctctctgcaacacagaaatcttnagatttctgtaggggttgcagttgggtgtctatngagacccagagtcnttcctctgtnnaaaccangatctatnaactgatcnaccctcttttggcaacttcanctgcatcatctctgatctatgtcctaagtataggtactccttttctttcctnaaacagaaatggctcacctatgtgcctatgtgtgatcagagtgtcatactcttatggtgagggtagaacgcaaaacagtctttgtgactgcctgtaattatcagaaagctcccactgactgccaaagaatttagaggtatacactcactctgctttccttctggaaagacaaccagggcaaggttggatctgccatgtgcccagtatgtatttggacagtgattacttctctgaagtaaagctccagaatgcttggatgtgcctt

SEQ ID NO: 3720 - DNA, 481 bp, Mus musculus
  misc_feature (31)..(31): n is a, c, g, or t
  misc_feature (33)..(33): n is a, c, g, or t
  misc_feature (48)..(48): n is a, c, g, or t
  misc_feature (187)..(187): n is a, c, g, or t
  misc_feature (203)..(203): n is a, c, g, or t
  misc_feature (208)..(208): n is a, c, g, or t
  misc_feature (417)..(418): n is a, c, g, or t
tgagccatcaaatactagccccgaattaagncncctgtcttgatagancccttttacaagcaggtccctcctttaatattctagaaaatatccaaagggctaaaaagttttgctttcaaagtagtgaaatgtgtaatataaggctccagagaatgcataaggtttgaattttaactaaattttaacntttcattagtggcttnaagtnaatgttaacatttggatcatgaaaatattcaaggtctttttgactttctgacatactacttgatgtctatattttagcagaaatcgcctttcttaatcagaagcctgctttaaaatttctcctaatgacaccaagggatcctactagctctccacagtcaaagtctttatgtcttttcctgtcttgtgtgagctgtcttccacttacannccctgcctggccaagcccaggagttgtagagtcttctctgtgccaaattacttacctgccctt

SEQ ID NO: 3721 - DNA, 537 bp, Mus musculus
  misc_feature (36)..(36): n is a, c, g, or t
  misc_feature (73)..(73): n is a, c, g, or t
  misc_feature (288)..(288): n is a, c, g, or t
  misc_feature (426)..(427): n is a, c, g, or t
gggttcatgcctaactgactgtatttgtggccagcntcatgtgacttagtatgaacggcttcttcatcccctntgaacaacgcccactgttactgtggccctttaaggttttttattcatttttgttttgttttgttttaacatttttttctatttttattttttatttttatttttccttaaatttcatgtgtatgagtattttgcctactgcatggtctgagtactgtgtgcatggctggtgcctgaggaagccagaagtgggcattggatcccctagagttacangtggttgggagccaccacatgggtgctgagacctgaacctgagtcctctgtaagagcgcaagtgtccttaactggtgagctctctctccagcctcttagttactgattttgtgtatgtgtatgtgtgtgtgtgtgtgnnagtgtggggtcagaagacagcccacggggtgttggtccttctacagtgtgtcttccagggctcaccttgtcagatttagtggccagcatctatatctgctgagctgtctc

SEQ ID NO: 3722 - DNA, 456 bp, Mus musculus
  misc_feature (78)..(78): n is a, c, g, or t
  misc_feature (109)..(109): n is a, c, g, or t
  misc_feature (157)..(157): n is a, c, g, or t
  misc_feature (245)..(245): n is a, c, g, or t
  misc_feature (263)..(263): n is a, c, g, or t
aaatgttcatactcactgccaaatgatctacctagttacaccctgtctaggtggagaggcctgcatacctattttgtntgtggtggcttcagatggaacccctgtgccntgcacacgccaggcaacctctgtaccactgagctacacccctaacccntttcgaatatatttgagaccgggtcttgactaagttgctcaggttaatcgccaacttgcaatcatcccgtctcagcctctggtatacnacagcactcatcttacantatttgaaaaattattaatggtgataatagtttattgaaattctttttcagttttagtcatggctttattttttaaagaaagcaattgccaaaacttctgtatttaaaccctgttttttccttccttctttaagaaatttcttggctctcacttttcaagtttaaaaaatatccgatttgtgctctagttaga

SEQ ID NO: 3723 - DNA, 528 bp, Mus musculus
  misc_feature (44)..(44): n is a, c, g, or t
  misc_feature (107)..(107): n is a, c, g, or t
  misc_feature (143)..(143): n is a, c, g, or t
  misc_feature (206)..(206): n is a, c, g, or t
  misc_feature (279)..(279): n is a, c, g, or t
  misc_feature (304)..(304): n is a, c, g, or t
  misc_feature (351)..(351): n is a, c, g, or t
  misc_feature (390)..(390): n is a, c, g, or t
  misc_feature (420)..(420): n is a, c, g, or t
cgggtttcactttagtggtgccaatttaatttgagtcttatttngttatttctgatcttccaaggttagacaagagtgaattgtaaaaatgagcattgtattggagnatgtaaaagtgtaaaacaaataacagtaaaaacttnataaattctcctcttcgggggatagtttcgatgtatctgcatatcttttaattatatatacanagttttaaaaaaaatgtaaacggagatgttttctaagtaaaatgttctgattgtgtgtgttctctttgtaganagtggcatccagatgaactgtactngtacttgtctaaactaatcacagtcactgatttatcaacctgcactnaaaagcctttagataggaaggactgtctgaagagacagngtttaaacactaagctattgagcccacagnagacaagtctagatttgccttgtggtctttaggcactggttttctatctctgtgtcacaatctctgttgtttaacttctatcctcaaggttaccgtgtggtccaaaat

SEQ ID NO: 3724 - DNA, 538 bp, Mus musculus
  misc_feature (90)..(90): n is a, c, g, or t
  misc_feature (101)..(101): n is a, c, g, or t
  misc_feature (110)..(110): n is a, c, g, or t
  misc_feature (121)..(121): n is a, c, g, or t
  misc_feature (127)..(127): n is a, c, g, or t
  misc_feature (129)..(129): n is a, c, g, or t
  misc_feature (133)..(133): n is a, c, g, or t
  misc_feature (154)..(154): n is a, c, g, or t
  misc_feature (162)..(162): n is a, c, g, or t
  misc_feature (192)..(192): n is a, c, g, or t
  misc_feature (200)..(200): n is a, c, g, or t
  misc_feature (229)..(230): n is a, c, g, or t
  misc_feature (247)..(247): n is a, c, g, or t
  misc_feature (338)..(338): n is a, c, g, or t
  misc_feature (380)..(380): n is a, c, g, or t
tattgctccaggactgaactgctgcccaagaagatggagctcacccccaaagaactgttgctaaacggaaacgattgcagagttggcaangcatggagagnttgagactngaagtcgaagntgcttngnaagnaagaagagccagggggagaanggagttcnggcttggtgaatgagactgggaaaggaccncacgatgnaaagagaaaagaagataggctggaaggannatattgtgaatctatcnaagtaaaacagaatagaagaaccaggtggtcttctcttggcaccattccaacaggacaagtcctcctcagaaaggaactctgggtaaggcnacacctgtcttctgctaagccctgcctatgccagttccagcnaagctccagctgtctagcacctctgcatccagagttccactgttctatggtcctcttgcttttaacatctacaccaaggcatctgagcatccttaggtcttccagtcttgcacaacccttcaccgacaactcggactacaatcatcactacacactgg

SEQ ID NO: 3725 - DNA, 485 bp, Mus musculus
  misc_feature (38)..(38): n is a, c, g, or t
  misc_feature (52)..(52): n is a, c, g, or t
  misc_feature (116)..(116): n is a, c, g, or t
  misc_feature (125)..(125): n is a, c, g, or t
  misc_feature (132)..(132): n is a, c, g, or t
  misc_feature (150)..(150): n is a, c, g, or t
  misc_feature (154)..(154): n is a, c, g, or t
  misc_feature (157)..(157): n is a, c, g, or t
  misc_feature (178)..(178): n is a, c, g, or t
  misc_feature (191)..(191): n is a, c, g, or t
  misc_feature (194)..(194): n is a, c, g, or t
  misc_feature (203)..(203): n is a, c, g, or t
attgcctactgctatcttgattcatgagcttacactgncattctcaaactgnaggaaatctcccagccttccttgcagtatcctcatcatccttttttcataaaccgggagcaaanttcatcttnatgttgncaatcctgcagagatgtncccngangtctgcacccggctgatttcnagctagtaaattngcnagctagggnaaaaaaacatcacatctctgcaagtttctatatcttgtgctacctaagtcactatatagttactaggaagctggaaatccctctgatgattcctgtgacagagacatggtgatgctggcagggtgcgctaaactagtcctgatccctccttcctgaggcttttgagtcagcttttggccaagcagaccataactggcttctatgagtcaatggaacacattcaggttaccatgtcatgaaaacaaagccattgatttaacatgctgttaaactcaggccaag

SEQ ID NO: 3726 - DNA, 524 bp, Mus musculus
  misc_feature (45)..(45): n is a, c, g, or t
  misc_feature (55)..(55): n is a, c, g, or t
  misc_feature (72)..(72): n is a, c, g, or t
  misc_feature (163)..(163): n is a, c, g, or t
  misc_feature (221)..(221): n is a, c, g, or t
  misc_feature (241)..(241): n is a, c, g, or t
  misc_feature (339)..(339): n is a, c, g, or t
tcatgttttgcataactctgcccggcataagtacttattgtgttnacaggaagancaagagggaaggaaggncaatagggggaggcagaaatagcttcaactcctaggagcataagcatctcaaaatcttcttgggaactgttaaaaagatatttctcggctncagagtgcgtcatatccagaatcactctgaattttgtaaaccaccagaaaccgtccancaggaagcgaccagctgggncactaagtcccgggtctgaagttggccagggacaggtcatgtatgaatggctgtgggtagtgtgttcctcaagtttgggttttggtctccatttttcngtcctccaccttcgtgatgttgggtgaggtccttaacctttctgggtctcattttcccaccttgtaagatgagggtgatgaccccgtttgcctgcgagagtcattacagatatggtatgagttcagagagtctaaaacgcagacctgggatgtagtaaaggctaaagctgcttctgtttctaagg

SEQ ID NO: 3727 - DNA, 249 bp, Mus musculus
gttctgtatatagaactctcaacttcttcagtgtcatgtctgcctgcatgtcaccacacccacaccatgatgacaatggcctaaacctgtgcacctgtaagcaagccccagttaaatgctcccctttctaaaagttgctgtggccacggtgtctctgcacagaaagagaccactgactagaacaggaccagaatgtattaggagaaaaataagggtttaatatcatcacagtctaaatgtttacacaaa

SEQ ID NO: 3728 - DNA, 539 bp, Mus musculus
  misc_feature (253)..(253): n is a, c, g, or t
  misc_feature (279)..(279): n is a, c, g, or t
catgaaacatgccttaagcccctcacctcctaaagtctagcagtatttcccagtatctcccagttccagccctcagggaaccaagctccaataatgaactttagggatcaaactggatttaaataatagcactcagaggaaagtgataatgagtgaaggtaaagaattcctgaaacataaaaaaagaaacatagaacacctaggtgtggtgtcctagagcttaggaggccaagaggatgattgtgaacccaangccctccccagtgaatctgaagctancctaggctacatagtgagagcttgcttcagcccaatcccttccaaaagaaagatgaaaagaagaaagcagtattttcatttaccatttattgatgttaagaagtgcatttgctcctcaagtaaacagacaatggaaaggtttattacatgcttaaagaaagttctggaatgatctgtgtcggctaaagatgtgaaacatggattgggccaatatatcacttggtaccttgtttagaaagagttgataagctcctgggcag

SEQ ID NO: 3729 - DNA, 341 bp, Mus musculus
  misc_feature (151)..(151): n is a, c, g, or t
  misc_feature (170)..(170): n is a, c, g, or t
  misc_feature (199)..(199): n is a, c, g, or t
  misc_feature (203)..(203): n is a, c, g, or t
  misc_feature (225)..(225): n is a, c, g, or t
accctgggcatcgatagctaagtcactgccctacacaggaatttaccattatctaggaagaaggaagtttgtgacctaaggaggaaccagagtagatacttagaactataggtagctgagctacacccattcacaaacaagtatttacaanggcctagggggaaggtggnactatacaatagactagagtaggaactanggcnaaggcacgaagcccttgccccnggcttctaagattaagtggaccttaggtggggctacttttgattcccaactgttaacattgagttttatcccagttggttcctgccagttcttccctgttcgcattcctctgtttt

SEQ ID NO: 3730 - DNA, 222 bp, Mus musculus
  misc_feature (166)..(166): n is a, c, g, or t
  misc_feature (168)..(169): n is a, c, g, or t
cacgcccagcttcctataaagttttaagagaaagagtcaaatgaagatttgtgtttacctctcacttctgagtataggcacagaaaaccacagttccgatctttctggagagtgctgtgcgcagctggagaggacagcctggatgcccatagcagaaagctagtancnnttcatcatgttgccaagcaactgtttccttaatgtgacgcctccaggtgacct

SEQ ID NO: 3731 - DNA, 499 bp, Mus musculus
  misc_feature (96)..(98): n is a, c, g, or t
  misc_feature (100)..(100): n is a, c, g, or t
  misc_feature (102)..(103): n is a, c, g, or t
  misc_feature (105)..(106): n is a, c, g, or t
  misc_feature (108)..(108): n is a, c, g, or t
  misc_feature (114)..(114): n is a, c, g, or t
  misc_feature (123)..(123): n is a, c, g, or t
  misc_feature (155)..(155): n is a, c, g, or t
  misc_feature (179)..(179): n is a, c, g, or t
  misc_feature (191)..(191): n is a, c, g, or t
  misc_feature (243)..(243): n is a, c, g, or t
  misc_feature (268)..(268): n is a, c, g, or t
  misc_feature (339)..(342): n is a, c, g, or t
  misc_feature (344)..(345): n is a, c, g, or t
  misc_feature (347)..(347): n is a, c, g, or t
  misc_feature (410)..(410): n is a, c, g, or t
gaatataacttctcagcatctcacagtaccttctccaaaactgaccatataatctgtttacaaaacaggcctcaactgatacaagaagtttgaaannncncnntnncnaatgcntattatcgnatctgtagtcacactagtgtgtttcagtgtgnattcttgaggtagttccccttagnccacagatctgncagccactcagtgtgatttagatttacctaaaccaggtaaatgtttacctgnataatgttagttaatgttgtctttnaggaagcagcaatgtcctcacttataggaatgttccacacaattaaaaaaataattaattaatcacagggnnnncnntnaagaacactttgctttccaaagggcttgagatcagtccctagcacccacagtgagtggctccncaactgcctgtcatatgagcgctagcagatgcaatgctctcttctgctctctgaggctacccacccactcatagcatatacgcacacag

SEQ ID NO: 3732 - DNA, 507 bp, Mus musculus
  misc_feature (27)..(27): n is a, c, g, or t
  misc_feature (29)..(31): n is a, c, g, or t
  misc_feature (37)..(37): n is a, c, g, or t
  misc_feature (42)..(42): n is a, c, g, or t
  misc_feature (45)..(45): n is a, c, g, or t
  misc_feature (54)..(54): n is a, c, g, or t
  misc_feature (78)..(78): n is a, c, g, or t
  misc_feature (88)..(88): n is a, c, g, or t
  misc_feature (93)..(93): n is a, c, g, or t
  misc_feature (106)..(106): n is a, c, g, or t
  misc_feature (111)..(111): n is a, c, g, or t
  misc_feature (128)..(128): n is a, c, g, or t
  misc_feature (139)..(139): n is a, c, g, or t
  misc_feature (143)..(143): n is a, c, g, or t
  misc_feature (150)..(151): n is a, c, g, or t
  misc_feature (154)..(154): n is a, c, g, or t
  misc_feature (190)..(190): n is a, c, g, or t
  misc_feature (289)..(289): n is a, c, g, or t
aattttcaattgcttcttagcacagancnnnttattncacanatnacgtgaggncatactttatgagtggtgctttgnttttgataantattnaagccttcatttncactngtgaacaactaattttnggttacttttncaanggtatgnncangggtcttactaagataacaaatgcataaaccaaaanataattaacatttgacttcattatgaagagttccatatgagcttagggtacttctatttcattttgtcctcttaacacaaggataattatgacataaangaataaattcattagcatatgttatcactacctgtatgtagcagaggggttttattaggaaaaaagtccacgtttttctagaccgttactgatttaatcatgaaattaaactactatattacaaaataatgcaacacataaaaatatttgccactgtaataactttgatgtctgagtggattagtccaccatctcaagtggtacctttttatttcaat

SEQ ID NO: 3733 - DNA, 481 bp, Mus musculus
  misc_feature (136)..(174): n is a, c, g, or t
  misc_feature (255)..(255): n is a, c, g, or t
  misc_feature (277)..(277): n is a, c, g, or t
  misc_feature (292)..(292): n is a, c, g, or t
  misc_feature (315)..(315): n is a, c, g, or t
  misc_feature (339)..(339): n is a, c, g, or t
  misc_feature (358)..(358): n is a, c, g, or t
aggctttatggcctttttcagacataatttggttttgctggtcttcctccccctgttgccttcttccttctccccgtcctctccatgtgtatctcctccatcagtaaccctggccaacttccctatcacgtgtgtnnnnnnnnnnnnnnnnnnnnnnnnnnnnnnnnnnnnnnncctggactactctctggttttatgacttatgtctgtgctcacaccttcatatataagatatgcatatgagaatgtgacatngtctttctgagtctgttacctntgcttaatgtaattnccagatgtatcatcttccttaangttttataatttcattcttctttnggctgaataaaattccatngtatacaagtaccacatgtttactatccattcattgggtgtaatttccttcctttggtgactggtgccgcagtaatcagctatagtgagatatagagtgtacaggttatatgcccaggagtat

SEQ ID NO: 3734 - DNA, 470 bp, Mus musculus
  misc_feature (274)..(274): n is a, c, g, or t
  misc_feature (296)..(296): n is a, c, g, or t
  misc_feature (324)..(324): n is a, c, g, or t
  misc_feature (376)..(376): n is a, c, g, or t
  misc_feature (440)..(440): n is a, c, g, or t
gaagagctctgtccaacaagccagcaaagaaagctgaccttgggctggtgtagatgagtgggtagtgcacttgcataaggctttagggattgcatctgcagtaccttaagaaatattatcgagtcttggagtaacccagttggttggcattttgtttgagctatctgtgctgcggttctgcatttgcagtctgaggatctgccaagatagtacaggctgtgcccagttctccctctaagactttatccatgtatctctgcctggaagtgggctncctttctctcattctaccctgnccagcccaacatgggtgtgggagggcancttgtcagaccttctccaggaagctcactgccctctgttccttccttctctntgggctacactctcagagagtcacctggaacgtctcacacaagcctgacactccgtgtctatgncaactttgctgactttgctttctgtcccag

SEQ ID NO: 3735 - DNA, 566 bp, Mus musculus
  misc_feature (41)..(41): n is a, c, g, or t
  misc_feature (44)..(44): n is a, c, g, or t
  misc_feature (61)..(61): n is a, c, g, or t
  misc_feature (81)..(81): n is a, c, g, or t
  misc_feature (92)..(92): n is a, c, g, or t
  misc_feature (94)..(94): n is a, c, g, or t
  misc_feature (103)..(103): n is a, c, g, or t
  misc_feature (105)..(105): n is a, c, g, or t
  misc_feature (126)..(126): n is a, c, g, or t
  misc_feature (136)..(137): n is a, c, g, or t
  misc_feature (150)..(150): n is a, c, g, or t
  misc_feature (182)..(182): n is a, c, g, or t
  misc_feature (192)..(193): n is a, c, g, or t
  misc_feature (208)..(208): n is a, c, g, or t
  misc_feature (483)..(483): n is a, c, g, or t
atgtttccgcatccttcaatgtgtgacctggtgatcacccnggnccaagatgccctggcangctacatcctggtcaatggntaccgtgaagncnaggtcagantncgggggtctatgtgagtctcnggtggtctcnnagttagcaggacngaatgaagacagcatcaagtgcttattgctgnagctgggacnnccatagctcaccagntctgctctacaaggtgagtttgttctgattttagatggcatacacctgaattgcgagtctgatttacaaaatgggaccctaaactgccagccaggatagcctggagttccagtaagcaagactatatatatttttaatgtaggaattagaggagaagaagaaaaccatagagcagcaaggtcccgctggtgaccatgacttaggggttacctcaaaacagagagatttaccatccagtctgacatcaactactctgtggaggacctttgacccanaacagagtgcacagcacaggcctggggtgcaagtttcccatacgcatacccaccccacaacagcgcacctccacaaggtttta

SEQ ID NO: 3736 - DNA, 505 bp, Mus musculus
  misc_feature (152)..(152): n is a, c, g, or t
  misc_feature (161)..(161): n is a, c, g, or t
  misc_feature (179)..(179): n is a, c, g, or t
  misc_feature (222)..(222): n is a, c, g, or t
  misc_feature (231)..(231): n is a, c, g, or t
  misc_feature (271)..(271): n is a, c, g, or t
  misc_feature (322)..(322): n is a, c, g, or t
tttaagttcccttgttctcactccatctgtcacctatacgaattactttacccatagtcgttggggaacatggactttcatggtggtcctatatatagtgtctgacctgcaggcacgtctgtgtcatagacacccgtgtaggaccgtctatntaatggcancctgttgttcagtgacanagtactgtaaagcagcaatgacacaaacacttatttcaagtcnggggaaggnaaggacattttatcccaaccaacacttggaagtcttgttnaaaagaatgaaagatccatctatgtagctttattgaataggggtggtgaanggtggggtagcaaacgtctttctctagtgatgaacagtgggaaagctgtttgctttatctgctaatttgagctgctggctcgtgtcctggcttgtgtgtgctttgtctcagctggtctacctgagaacccccctcccccaaatgaacccctagtccccagtgtgactccatttctactccaac

SEQ ID NO: 3737 - DNA, 560 bp, Mus musculus
  misc_feature (216)..(216): n is a, c, g, or t
  misc_feature (270)..(270): n is a, c, g, or t
gaaaggattggctctctgatcatttattaatattctcaaacctgtcagaattctacaaattgcctttatttccattactaaggaatctctgcctctccattggaatttcgagacaggatctcagtctgcacttcaggaaggccctgagctcacagaaatcagcctcagcctcctgggtgctaggatgacaagcatgggatagaatgcctctctgtnggaatgtttcctatcatcccatctataattattgaaatgagtaagaaaccaatncagaactatgtgagtaaccctgagaaagccagcatgtttcttgagaattacttccacaaacttaatgatgaagagacatgatagaaaagatccccaaacttggccaaagatcattttgaggaaaatatagtccataggacctaagtccaaaattctttgattcagcctggaccaattgagacctctttatttacacaatgcagttattcagatgacactagaacagtctccctagcagcagagaatttaatggtgaacaatctgattagatgtgcttgccagactctgaa

SEQ ID NO: 3738 - DNA, 546 bp, Mus musculus
  misc_feature (125)..(125): n is a, c, g, or t
  misc_feature (226)..(226): n is a, c, g, or t
gcagcagttcaaatggagcccactagagccagctcttctgctggggtacaggtcctcaggggcatagatactgaagtgcacctcggaattttgcagaagcaaagtaccagacagggaaagtgaantgcgtcctctcatctcctagacggctgatacttatacgctccgactttgccagccaatagagttgctcacagactgtgctgaagcgaaactgaagcagcangtgcccctcatgtctgtttttccatcttttccagttggctcacgtcttacccacagaagagaatttcttgctgctctttcgatgccagcaactgaagtcctgcgaggaattcatgaaggtaaaaataatcctcttccctgcaaggaaaatgctgggcgttgggaaattgttgtgttttgttgatttattgaaatctggtttccacctccaaacttcttacagacttggagaaagtatgatactgaccacagcggcttcatcgaaaccgaggaacttaaggtgagcgagtgaaagctgaggctcagtgtgctccgtccaga

SEQ ID NO: 3739 - DNA, 401 bp, Mus musculus
  misc_feature (45)..(45): n is a, c, g, or t
  misc_feature (208)..(208): n is a, c, g, or t
  misc_feature (210)..(211): n is a, c, g, or t
  misc_feature (213)..(217): n is a, c, g, or t
  misc_feature (219)..(225): n is a, c, g, or t
tcccaagccatgctattcgtggttaactgggtcctgtaagcatgngtagacaagcctgagacagacaaggaacgtgcttgttaggcctttgaaagctgcttctggccagcctcttgagccaagacgtgttagaatcctcagatgtttttccccccttgagaaagtcattcccaataaaatcccaaacgctaattgtgttgaccctgcnannannnnnannnnnnnttggcattctctccccgctaccacagcgtttcctctgcccatcagctttgctgggcccctcgacaccattagtttcacactgagtgtggtgagtcgctgtcagtgaaggtgtgtccccgtctcagacagctccacttgtgaatggcatgtgaattttgcacagttgcttccggaca

SEQ ID NO: 3740 - DNA, 550 bp, Mus musculus
  misc_feature (31)..(31): n is a, c, g, or t
  misc_feature (75)..(75): n is a, c, g, or t
  misc_feature (282)..(282): n is a, c, g, or t
  misc_feature (291)..(291): n is a, c, g, or t
  misc_feature (298)..(298): n is a, c, g, or t
  misc_feature (326)..(326): n is a, c, g, or t
  misc_feature (338)..(338): n is a, c, g, or t
  misc_feature (340)..(340): n is a, c, g, or t
  misc_feature (367)..(367): n is a, c, g, or t
  misc_feature (387)..(387): n is a, c, g, or t
  misc_feature (394)..(394): n is a, c, g, or t
  misc_feature (399)..(399): n is a, c, g, or t
  misc_feature (420)..(420): n is a, c, g, or t
  misc_feature (427)..(427): n is a, c, g, or t
  misc_feature (437)..(437): n is a, c, g, or t
  misc_feature (472)..(472): n is a, c, g, or t
  misc_feature (510)..(510): n is a, c, g, or t
ataggatcacactaagttgcccaggctgacntggacctcattctgtagcccaggaagatcttgaacctgccgtcntcttgcctcagcatcctgagattacaagctttctctaccaggcttaatacttttagtctcctaatacagtagtagcagcaaatgaagatagaacacagctgacttaagctctgccctccccactacccagtaccctccgtacactggaagttgagtatggcacattttctagacccagcctcagaaacttctttgacagcagtcacnaccaatganatgagancaatcactaaactgaagtttcatagggngttgggaggaancnaaactgcgatatgctgaagtgtctgancaagaattgatcaaggaggngaggacngcatntcaggtagcttagggatatanaaagggnaattgcttanccggtccaccaaggtaatggttacttttcctccancagaatatgtttccaaagtcatcttaatatttgtccancaaacaagccagataaaacaatacccctgtgtaatcccat

SEQ ID NO: 3741 - DNA, 526 bp, Mus musculus
  misc_feature (86)..(86): n is a, c, g, or t
  misc_feature (99)..(99): n is a, c, g, or t
  misc_feature (106)..(106): n is a, c, g, or t
  misc_feature (108)..(108): n is a, c, g, or t
  misc_feature (114)..(114): n is a, c, g, or t
  misc_feature (148)..(148): n is a, c, g, or t
  misc_feature (160)..(160): n is a, c, g, or t
  misc_feature (173)..(173): n is a, c, g, or t
  misc_feature (232)..(232): n is a, c, g, or t
taagcccatgtccaagcagttttctttgcatcaatatatgaccaagatgctctcattggtccgagtaaacaaggtttgggaatccntgatctcaggtcntcaggcntngtggcnggtactcttacctgccctgccctcctttctgagnaaacttgcttgncagaaggaagagnaacagaatttccccagctcagaagttaaccatgctgttggatgcttaagaatcctgccnaggacagtttgcttgcctattcttctataagggctctgcagctgttgagctaaactgggctttctggtcccttctgctctgacagcattttaaaactcagtgtaaagagggaagaagaaatgactcagtggctaagagcatgaaccattcttacagagtaacagatacccctacttctgttcccagccctcacactggtcaatttacaactgtctgtaactccactaggaggggtgcgggggggggggatcggatgctgctttcccctcaggcagcttcactggtgtgcacata

SEQ ID NO: 3742 - DNA, 346 bp, Mus musculus
  misc_feature (82)..(82): n is a, c, g, or t
  misc_feature (136)..(136): n is a, c, g, or t
  misc_feature (147)..(147): n is a, c, g, or t
  misc_feature (159)..(159): n is a, c, g, or t
  misc_feature (161)..(161): n is a, c, g, or t
  misc_feature (165)..(167): n is a, c, g, or t
  misc_feature (174)..(174): n is a, c, g, or t
  misc_feature (214)..(215): n is a, c, g, or t
  misc_feature (229)..(229): n is a, c, g, or t
  misc_feature (231)..(232): n is a, c, g, or t
  misc_feature (243)..(243): n is a, c, g, or t
ggagatctggtgttcattgccttagtaagaatcttccttccttaacctctcatcagcttcagtgtctgctgggttcttcatnccataccctgtcctggagacgtgtgctcacccagagcaatcttagcaggaatcntgctcacttanccagaatgcttntnactnnngatgtcnaccctgagtagatgtccatagagccctcctttctccttgnntgtacatccccagntnntgggccacatncaagagcctgtttgcatggcccctgcccttcctgcaaggtcttgaatgaagcctgttccactgtgttctacaaagtgtcactgaaatgatgtccttttaataa

SEQ ID NO: 3743 - DNA, 529 bp, Mus musculus
  misc_feature (276)..(276): n is a, c, g, or t
  misc_feature (285)..(285): n is a, c, g, or t
  misc_feature (288)..(288): n is a, c, g, or t
  misc_feature (293)..(293): n is a, c, g, or t
  misc_feature (308)..(308): n is a, c, g, or t
  misc_feature (310)..(310): n is a, c, g, or t
  misc_feature (314)..(314): n is a, c, g, or t
  misc_feature (317)..(317): n is a, c, g, or t
  misc_feature (327)..(327): n is a, c, g, or t
  misc_feature (343)..(343): n is a, c, g, or t
  misc_feature (347)..(347): n is a, c, g, or t
  misc_feature (350)..(350): n is a, c, g, or t
  misc_feature (357)..(357): n is a, c, g, or t
  misc_feature (381)..(382): n is a, c, g, or t
  misc_feature (392)..(392): n is a, c, g, or t
  misc_feature (453)..(453): n is a, c, g, or t
agctgtctcatgcatctctgatgataaccagtctgcagaaatgacagagtgcctcaagcagatgaatggcatgcctccccttgtgcaggaatgcaccattccctgtcgggacgactgcaccttcaccccttggtctaagttcactccctgctccaagaactgtgaagcaactcagatcaggaggcggcagctaacagggaaaagcaggaagaaagagaagtgccaggatgcgtccctgtaccctctggtggaaatggaaccatgtccctgtgatangtttatgtntcntcctnatggaaactggtcancntgcnttntaccagaagncaaaagggatgctcancaangangattgtnggtgcaaggagatgacaaagaatnnggagaaggcntgcgctttcgagcaatagcatgctccaatataaatggaagaccggttgacccctcattctncaacagctctggttacattcaggaagcatgtgtcatcccctgtccgtttgattgcaagctaagtgactggtccagc

SEQ ID NO: 3744 - DNA, 482 bp, Mus musculus
gtactagtaattctttttgcccacttactatatacattaccaacaactctcttcagtgcatatattctacttacagactcaaaagcttgttggttttccttcatatatgagacacaagctctcctgatctgtaaatgatggatctggctgtgaaacaactataaaaaaaaaagactagctcactgccatgtcatttcaaatagacgttcctaaattaagacaatgaattagacacaagtttcctaaactagagcacatgttggaaacagagaaattaagtgcagctgctactacacctgatcttaggcaaaggcaaagaagccatgcctccttatgttaaaaaatggtcatctttattgagattaagggctaatgactctatcctggactttcaacctcaactttcaacttgtaagggtacaagctataaatcgttttcttatgcataaacaaaggagtagggcatgcttaccaaggactga

SEQ ID NO: 3745 - DNA, 363 bp, Mus musculus
  misc_feature (174)..(174): n is a, c, g, or t
  misc_feature (183)..(183): n is a, c, g, or t
  misc_feature (185)..(185): n is a, c, g, or t
  misc_feature (191)..(192): n is a, c, g, or t
  misc_feature (221)..(221): n is a, c, g, or t
  misc_feature (232)..(232): n is a, c, g, or t
ctgacagtttcttatttggcatatttttaatccctaactgcagtactatagtaagcagtgcttgatgggggcgtcttccagtattgacccttctgcatctggtgggctggaaatcatttctgagatagtgtaacaaacatgtgcagacaattatgtctgattacataacctcancaccccccncnaaaaanngggactagaaacaccatttgagccactcntgtgaattcantttttttcctgtaaattgtaataacttcatttctgagtctttaatatacaggctgagtgcatcaaaggacagtggtcctatggtacgttgcttcggtgtcaatttttaaatggcccacctacaggagacga

SEQ ID NO: 3746 - DNA, 412 bp, Mus musculus
  misc_feature (27)..(27): n is a, c, g, or t
gatttagatcttctctggtggcaagtnactggtctgttgacataatacattcccaaagttgccccggtggggaacaagatgagaattcagatccagacagggttgacaaatggctactatactaaaatgattaagagaagtttggctgtggatctgcaaatttctaactctccacaatcaccaacttctcatcaggcagttggtcttttggtacctttaacataggtatggtttttgtttttgaaatcagctcattctaatttgtgccctaaaagccactgctagagctgagtccaacttaaatcttaagcttcagttgttgtactgcatttaattttcccataactggtcaagacagaagtcctatgattcccaccatggagcaaggagttcttttctgtccaatcatctt

SEQ ID NO: 3747 - DNA, 504 bp, Mus musculus
  misc_feature (192)..(192): n is a, c, g, or t
  misc_feature (287)..(287): n is a, c, g, or t
  misc_feature (316)..(316): n is a, c, g, or t
acaaagtttgtgtctatctctctctctctccctctctctctctctctctctgaactgaagcttggacacatgttaagttaactttctcttggaatcacaggtaatcatcatttcctttatgatctacatgaatattcacataatttattttgccttttcaaattgaagattggatttgaatccctttttttntatctgtcctttctcagagcatctccaaggtctcaacttgtacaaggagggtgctagagcaatttcccacccactggtgttcttgcttagctganccaaacccttagatgattttaatgtgaanaactacttcacatcggtaacatgcagctacaaatgaccatctgcactggcacacagtcaagcctatggccaaggaacgagtgaaggatactgcaacttgctcactcccctattggctgttttgtctgcatcttctttctgtaacactcccataataagtttgtgtcaaacaatcctcttgcatctgat

SEQ ID NO: 3748 - DNA, 445 bp, Mus musculus
atctagctcagctctactggaaggaatagcagctattgctcttaacaaccactgaaccatctctccggtcctagaggtagccttgaatctgcctgtgttatgccttctggtctctgtagaactttggtttctttgatgttagatgttggtatattcgtcaattaaaaagaagacatccaggctcagattttattttatctatctcaagaggtaagagaattactttctcataggtttggtgcaggattgcatctgagtcctgttgtgaccttgtggatttgactatatctgagtccaccaaaagatgccaccagagtggttccctcatttgttgttaggtaatatccttcccatcacaggaagtagaagaaattctgggagaaagaatatagccaccatggcagttttgtgctgtttagaagacctctgaatggtggctcatgcc

SEQ ID NO: 3749 - DNA, 284 bp, Mus musculus
  misc_feature (224)..(224): n is a, c, g, or t
  misc_feature (232)..(232): n is a, c, g, or t
  misc_feature (242)..(242): n is a, c, g, or t
agattactttcagagacttgttagaaagtgatttatgtggctggagagatgctcagagattaggtattcatacagttctttcagaggatagacagttggttctcagaactcatattggacagtgttcaacagatgttaacttcagctcttgggacattcaacacctttggcctgtatgggcaccttttcataggaccacacacagattacacacttacagagantgggaganatagacctcnttagagaagaatgtaccatgtggtatccaactatatccattg

SEQ ID NO: 3750 - DNA, 479 bp, Mus musculus
  misc_feature (68)..(68): n is a, c, g, or t
  misc_feature (217)..(217): n is a, c, g, or t
gggtaccttaccaatctgatagtgctccaaaatacgcagtgctttttcttctgccactccatagccanggatctgtcagacctgtactcccatgggctctggtgagtaagccagtatgggtgctatgcttggtattctggagtccttccaaggacttgatcctctctgcctggtgaagagtagacagttcctgtctttgtagccacccgtgcgaagnctcttatttcctctctcgggttttccctgtgagtgcctcagtcctgtggttctgctgtagtctaggcatagtcacaggaaagtccactctagcatgtctgcataagggcttagtctctagcagcagcaccatatgcaataggtgtggaggtgcgtgcctctggaggtagaggcaggaggatctaaagttcaaggtcatcttcagctaacagtgactttgaagccagttaaggatgtgtaagaggccccatcaagttgcagat

SEQ ID NO: 3751 - DNA, 525 bp, Mus musculus
accttctacacttatacatctcacggtacaatgacttctatttcataagacagtgatggtctgcagggaaaggaggaagatggcggctgcgacaaggactcagtactagggtgcatgcttacattgtgtaaggccgggggttgtacgtacatagtatattctgtgtgttccccgggagaaagaggctactggaacacatggcagcagctactgtacagacaggaaagaactggccatacaccacacagacacaccagaagagggagatggatcccttagaactggagatacagatggctgtgtgctggaaattgaagttgggtcctctcaaataacaaatcaggttgttgcaggcttgtatagcaactcctctatccactgagcctcttacccctctcacccagatctttgttttcatcttttattttccttacaacatacactgaactatcttcattaaaaactaggttttgtttttgtttttgttttggttgttttgttttagtggttttgctcagtctttta

SEQ ID NO: 3752 - DNA, 422 bp, Mus musculus
  misc_feature (34)..(34): n is a, c, g, or t
  misc_feature (123)..(123): n is a, c, g, or t
  misc_feature (134)..(134): n is a, c, g, or t
  misc_feature (137)..(139): n is a, c, g, or t
  misc_feature (144)..(144): n is a, c, g, or t
  misc_feature (153)..(153): n is a, c, g, or t
  misc_feature (159)..(159): n is a, c, g, or t
  misc_feature (193)..(193): n is a, c, g, or t
  misc_feature (209)..(209): n is a, c, g, or t
  misc_feature (214)..(214): n is a, c, g, or t
  misc_feature (235)..(235): n is a, c, g, or t
  misc_feature (250)..(250): n is a, c, g, or t
  misc_feature (254)..(254): n is a, c, g, or t
  misc_feature (262)..(262): n is a, c, g, or t
  misc_feature (272)..(272): n is a, c, g, or t
  misc_feature (319)..(319): n is a, c, g, or t
  misc_feature (354)..(354): n is a, c, g, or t
aacattaagttcacctctgctgtcttcacatttntgatgagttcctgacaagatgcctgacaaacagctgtgagtcaagtcctgaggagtctggcaggaggatcaaaaccatgtgggctggtntccccaaacanacnnnaaccnacaaccagngcctgnaaagatggctcagtgagctgagagtaaactcttntcccaggaatcctganttcanttcctagcaacttgccagatntctcacaactacctntcantcttgctnctggctagancctctgtgagcaccatgtgcacatactgactatagttaaactaacantaaaagaaaaaagcaggaaaatgaggcagagcttntgaagagagctgttagtactttgtaaagctgagaatccaaattcaatctacagctattttgtgggttc

SEQ ID NO: 3753 - DNA, 446 bp, Mus musculus
  misc_feature (32)..(32): n is a, c, g, or t
  misc_feature (34)..(34): n is a, c, g, or t
  misc_feature (73)..(73): n is a, c, g, or t
  misc_feature (182)..(182): n is a, c, g, or t
  misc_feature (421)..(421): n is a, c, g, or t
gaacagtgctgaacccacgtgctggactcgcntnggtgcagcagtgatatcaggatctaggaacgtaacaggncagtcggtgcagcttccagaagctgctttttaggtgagagagataaagggattggacttaataatcaggcggattggccgcagtctaagaactgcatcaggtgggaggnaaactctcccagagacagagagaatcagggactccctgctttattctctctgggccctacagcagaagttctctgccctctttgtgattttgtctaaggtcttctctaatgtctggtgcaccagtctgtccacgtgttcaattcatgtgtgttcgtgtctagtcgtctgaatgtctgaatggtctgtgctcatgttagaaaacaaaagatggctggtataagcaaagccgagagtgtcnacactctttagccaggatcaggcac

SEQ ID NO: 3754 - DNA, 416 bp, Mus musculus
  misc_feature (356)..(356): n is a, c, g, or t
  misc_feature (385)..(385): n is a, c, g, or t
gtagttctctacagtttcatccatccactatttacacacagcagctgcgcaggttttagctactgaggggtttgattgcttttgagattcagaagaaaagtaaccacagctgccatgagaggagcagaatggctctctttgtggctttgctttgtgggatgcacgtcataccagtagcccgccaacagcatgttcacctaaaacggttccttttataaacaagaaaggcggcttgagtggtatacatcattttccaagctaataagataatccacttttcatttcaaagcctgagctctaatctgaaaacagaagtctccttctctgctccttgcagcagtccttggataaagatnatgttatcataatcctattaaaatgtacncccttttgtggcatgcctccataatagtatt

SEQ ID NO: 3755 - DNA, 540 bp, Mus musculus
  misc_feature (160)..(160): n is a, c, g, or t
  misc_feature (163)..(163): n is a, c, g, or t
  misc_feature (167)..(167): n is a, c, g, or t
  misc_feature (173)..(173): n is a, c, g, or t
  misc_feature (180)..(180): n is a, c, g, or t
  misc_feature (183)..(183): n is a, c, g, or t
  misc_feature (188)..(188): n is a, c, g, or t
  misc_feature (194)..(194): n is a, c, g, or t
aggaatactttcacagtttctgagtcatgaaaaccttagatttcccttttatttcaggaattttaatgcaagaaaatgttaatgtattttgatggaagaatgagattgttcccattatcattcataaaaactttctctgctggctactatggagaaaacngantganccatcnggaaggnttnggagnttcagnagttggcctgagctgcatagtgcatttattacaaacctgggtctctcagtcagggttactattgctgtgattaaacatcccaagatggcttgcttgagcagcctacttcctcatagaatgcagaaaaatcagcccggggggggggcatccacagtgggctaagccctccccaacagatttctaattaagataatgcctttgtctgcttacagatgggtcttctggaggcattttctcaattgaagttccctcctttcagatgactatggcttgtgtcaagttgacagaaaatgagcccgcacactgggctattaaacaagacaccgtgtctctaaaagtcaaccct

SEQ ID NO: 3756 - DNA, 504 bp, Mus musculus
  misc_feature (46)..(46): n is a, c, g, or t
  misc_feature (104)..(104): n is a, c, g, or t
  misc_feature (182)..(182): n is a, c, g, or t
  misc_feature (190)..(190): n is a, c, g, or t
  misc_feature (194)..(194): n is a, c, g, or t
  misc_feature (214)..(214): n is a, c, g, or t
  misc_feature (217)..(217): n is a, c, g, or t
  misc_feature (220)..(220): n is a, c, g, or t
  misc_feature (222)..(222): n is a, c, g, or t
  misc_feature (225)..(225): n is a, c, g, or t
  misc_feature (231)..(231): n is a, c, g, or t
  misc_feature (239)..(239): n is a, c, g, or t
  misc_feature (241)..(241): n is a, c, g, or t
  misc_feature (264)..(264): n is a, c, g, or t
  misc_feature (268)..(268): n is a, c, g, or t
  misc_feature (321)..(321): n is a, c, g, or t
agcaactactgcatattaacacaaaagacagcttatgaaactgcanacatatatacactcaatgcttgggccacagtatcacaggacaaaattggtgatcattnagtgtcagagaaacctgttacaataatgttggatgatgacaaaaaccgctgctatacttgcataggtcattcaaaccnaaatctancaangaaaaatcaaggttaaatcnaanccntngancaaatnggatatgncnggatatctacaaagtcttatggncaancagaaatgaaatctgtatgcaactcagcatcccttaaaacagtttctaagatnaaacacagtctgtgttacagaaaaagtattaacaagagtgtaataataagtcacttaaattgttactacgcataataataagtaataagactataaaaagtaagccttgacccttatcaagttacagaaaaataaagctagtatttaatagcaagaaaaacgcagaagctactcaaatacttg

SEQ ID NO: 3757 - DNA, 538 bp, Mus musculus
  misc_feature (49)..(49): n is a, c, g, or t
  misc_feature (103)..(103): n is a, c, g, or t
gtacttgttcacatgcactgacgagctaattagcagcagaagtggtttntggaatgatgaacaccttaatcattctgttagaacagattagacagttcctacntcagcattttcagaaaacacactttcaaggccaaaagccatcatcatcagtagagtctccccttgctgagacctaattatctccggggttccatcctttacctcagcttctgtctagctgggttagtcagtgaggcctggaacactgttgctctttcatactaatgccaacatcaccacattttgttctcccattgatccgtaaaataaataatgcattaatgcttcttcattggtaccccccccttttttttgagacagagtctcactatgtaggcctgactgttttttgagacagagtctcactatgtaggcctgactgtcctacaactcactctgtataccaagctggccttgaattcatagagatctgcctgcctctgtctcttccaactgctgggaataaagacatatgccaccatgcacagaccatcaa

SEQ ID NO: 3758 - DNA, 516 bp, Mus musculus
  misc_feature (354)..(354): n is a, c, g, or t
  misc_feature (363)..(363): n is a, c, g, or t
  misc_feature (366)..(366): n is a, c, g, or t
  misc_feature (372)..(372): n is a, c, g, or t
  misc_feature (374)..(374): n is a, c, g, or t
  misc_feature (381)..(381): n is a, c, g, or t
  misc_feature (384)..(384): n is a, c, g, or t
  misc_feature (406)..(406): n is a, c, g, or t
  misc_feature (472)..(472): n is a, c, g, or t
aggagacaggtgtgtgtcccttaccctggaggcatgcactgtggacggcactttcaatggcctcccgagaggcctgcagcaggtcttcacccacacagtcagcatactcgatcttggccacagcacagggctcttctgctggccggacttccagctccgcactcaccaagtgccgcttgtctccaagcaccctatcgagggtgtctgcggacaaacacatggaaatgcgtgaagaataaggagggcctgcactcgaggctcaacgtttgccaggataatgaaggaagccaaagaaagatgccaggaacaggctgccccaggagactgtctgcccttgctgagattgcttgtatntgagacccntcnaaactnantctttanaantaccaaccttggggaaaaggtnacactcaaattgtatgacatctagagagtataaaaagctgataataaaaactataaaccttgttcntctgccaatttccaaatttaaatttcctatattccttcagcaat

SEQ ID NO: 3759 - DNA, 552 bp, Mus musculus
  misc_feature (181)..(181): n is a, c, g, or t
  misc_feature (185)..(185): n is a, c, g, or t
  misc_feature (187)..(187): n is a, c, g, or t
  misc_feature (193)..(193): n is a, c, g, or t
  misc_feature (198)..(198): n is a, c, g, or t
  misc_feature (235)..(235): n is a, c, g, or t
  misc_feature (262)..(262): n is a, c, g, or t
  misc_feature (517)..(517): n is a, c, g, or t
  misc_feature (520)..(520): n is a, c, g, or t
atcttggcattcatgattttatagatgattttgatatatgtatagtcttgattatgatgtgtgtgcatgtgtgtatgtgtgtgtgtgtgtgtgtgtgtgtgtgtgtgtgtgtggttgtgtgtgtatgactgagagagaaagagatagagggagacaaagagacaaagacagagagacatancacngnaagagnacaangattaattcctttggtttttttaaaacaaatcttttnagtccatatttcctagactatagaacnggaggtaaaatttaaaaagtaatatttcttctttgtacttggaagaacagaatacctttatatgctattacataatcacataatactttatatatacagtgaattttactttgtgtctttttagattcatttgagaaaaaattgtgacttaagtaaccttctgtggaatatttttatttactgtgtttgacttaaattagtattactgtaactggcacttaggatttgctttatgcaaaaacattgactgactcntcncttgaacccacaagacactttcagttcctgga

SEQ ID NO: 3760 - DNA, 485 bp, Mus musculus
  misc_feature (193)..(193): n is a, c, g, or t
tgccattctccccttaactgggaaatctggtgacaacacactctgaagttgaaatgatcttgattcaagaccaacacagatgtagatttccccaaattctgaataactctgatttaatcctacaggtatgtaacagaatttgtaaacctaggcaatgtttcagctcttcgaactttcagagtcttgagagctntgaaaactatttctgtaattccaggtaagaagaagccggtataaggtggtaggctccttatatctccaactgtttcttgtgttctgtcattgtgtttgtgtgtggactccctattacagatatgtgacagagtttgtggacctgggcaatgtctcagcgctgagaacgttcagagttctccgagcattgaaaacaatatcagtcattccaggcctgaagaccatcgtgggggccctgatccagtcggtgaagaagctgtctgacgtcatgatactcactgtgttctgtctga

SEQ ID NO: 3761 - DNA, 420 bp, Mus musculus
  misc_feature (320)..(320): n is a, c, g, or t
aacgatccccttgagactgttctgtatcagtattttcatctgtgttctagtttcaatgtaatacccagtgtgactcaggcctatagaaggtgcaagcccatgacgttagtgcaggccagaaacaatggcatggggttctttcagaagtttctctgtatggctatcgtaagttctaacaacctcgcgtgggcattctttcagtgaattgatttctttgtactaaaatctctagttttctaagcctgttccacatattaaacagttttatacatttctccaaggcggtacatatccaaagacatgatgccagggaaaaaaangtgcttgtttttctgatgaagcaatggtctcctcctttttcttctttgcatgtatttgtgtagctaagtctgaatactcatgtaatatttctgctgcaga

SEQ ID NO: 3762 - DNA, 384 bp, Mus musculus
  misc_feature (289)..(289): n is a, c, g, or t
  misc_feature (296)..(297): n is a, c, g, or t
  misc_feature (319)..(319): n is a, c, g, or t
  misc_feature (333)..(333): n is a, c, g, or t
  misc_feature (346)..(346): n is a, c, g, or t
  misc_feature (359)..(359): n is a, c, g, or t
gcaagtggtatccttgagcatccctccccagctgccaagctgaagcctaagagaatgatgtaatcatggcagtgccttgtggggcgggggtttgtgcctgggtagtctcagctgtagctgagcagggctatgctgcatccaggtcttgatggagagctctgaatggtttagatgaggccccaggggcagtgaccactgccttgaggaaggcattctacccagctggcttattgtacccacgggaagtgctggatccacgtggacaggtgcctggcctgttagatcctcntgttccnnaggaggtttcagcttctgtggncggaccctacagtngtattgggtaaancccttgtgtagcntggatgaaccttgggtcccatccac

SEQ ID NO: 3763 - DNA, 550 bp, Mus musculus
  misc_feature (59)..(59): n is a, c, g, or t
  misc_feature (69)..(69): n is a, c, g, or t
  misc_feature (73)..(73): n is a, c, g, or t
  misc_feature (89)..(89): n is a, c, g, or t
  misc_feature (104)..(104): n is a, c, g, or t
gtgtattcttcaaataacttcccagacactgtgagatacacatctcccagacagatggnccaaccgacngatngggaaatcatctgagnccaaaacagctgtangtgggacaattggacaacccaacctggtgcaaacataggaaattattgctttctaaaagcatagaatcatagttggagataatactataaactttgctaaagtattttattaaaaaccagagtgtctggctctgattatggagataaggatatagtccagcagttgtatcatcatcacatagcttataggtagaagaggcagttattatacatacatacatacatacatacatacatacatacacacatacatatgaatatatatacatatatatacacatagtatatatacatatgtacatatgtatacatatgtatatatacatatatagttggcatatatatatatgaagccaactatagtggctattgaaagcaacagcaacaagaagataagtaactgctttcttagcacagaagtgagtccagacacttgctatagagca

SEQ ID NO: 3764 - DNA, 467 bp, Mus musculus
  misc_feature (227)..(228): n is a, c, g, or t
  misc_feature (230)..(230): n is a, c, g, or t
tgcactgccgaggtgtccatcaaaggtgacggacaaaacaatgtggcacatacccagtggcactctgttcgacagacgtttgtggcaatgcggctgagtggggacacatgaatcgaaataagccttcctcctcttcgaagtcctgtagcccagaaaaagtgacttccgtgagctagcctcagactcgccggccatgaggaaatgaacctgttgatgttttattaatnntngtaaggtggagaaaggtccctcatttccctctggttaaaaaacgatgattccagtcgaggaccactaacacgtaaccaagccattctttacctgtctgctgctggagcctctcttcccacggggtgaagctggcatataacacagcctggcattccaatcttgtgatgggtctagacgaggggccacgcttgcatttgggccataggagtctgacgaagctgggtttttctggacaa

SEQ ID NO: 3765 - DNA, 431 bp, Mus musculus
  misc_feature (93)..(94): n is a, c, g, or t
  misc_feature (97)..(97): n is a, c, g, or t
  misc_feature (107)..(107): n is a, c, g, or t
  misc_feature (159)..(159): n is a, c, g, or t
  misc_feature (235)..(235): n is a, c, g, or t
  misc_feature (290)..(290): n is a, c, g, or t
  misc_feature (378)..(378): n is a, c, g, or t
  misc_feature (383)..(383): n is a, c, g, or t
  misc_feature (388)..(403): n is a, c, g, or t
ttttgaagcccagctccagaacctggagtgaacctgggcagtgttcagcccctgtctgtgtaagtttcatcatctgtaatacagatttttttnnccnactgtggggnttttgctcatcattttccttctcggttccttcacatttctctaatctggtgntcactgaaagttagggccgactttcactgttaaattgaagcataatttttcaaggtttagaacttgagatgggaanatgtttttctcccttaacatgtaaaatagtccactctgctcttctttttgcccgncttctgacctcttcttctatagtgagttttctcatcaccatgtatggtgtgttttttacaccatggctgtatgttttgttttgttttnttttnttttnnnnnnnnnnnnnnnntttttacagatactcttcagcaacttga

SEQ ID NO: 3766 - DNA, 495 bp, Mus musculus
aactgcaccttggaagcatcgctgggatggccctgtctgacccaatttcctttcgtttcttcttggtttgcagaatttttccccatttaacttaaagctttctctatcgagtcagaggtgaattcctacagcaagtctgaacttccatgaggataggatctagatattaaacaagacttacatttctgaattcaaaagcaattacccgtctgtggtatcttctctcctaggcctctcccctctgctgatggaaagataataaaacctgatataactgcctccggccctggagaccataaaggactgctcattctttgttttatgtgcctgggtttcaccagtggccactgcagcccttttgcagagctcctcgttgctcctaagtgtttcgtctatccttgcctaccagcctacccctgtgataggagcctttctctgagtccagaaatacacttgatctgcttccattggctgcttcaagcctatgacacttct

SEQ ID NO: 3767 - DNA, 401 bp, Mus musculus
  misc_feature (158)..(158): n is a, c, g, or t
  misc_feature (165)..(165): n is a, c, g, or t
  misc_feature (180)..(180): n is a, c, g, or t
  misc_feature (186)..(186): n is a, c, g, or t
  misc_feature (195)..(195): n is a, c, g, or t
  misc_feature (198)..(199): n is a, c, g, or t
  misc_feature (212)..(212): n is a, c, g, or t
tcagttgctctctgccttaagttctgcaaaaaggtctctcattgaatctggatctcatctctttggttaggctgggtggccaattatctcctttctcattttcccaacccagagctaggggattagattcccttttcccttgggtattgactattaanatttggntcttcttggtgcatnggcaanccattctantgnnaatgagtcctttncccaagctctatttcttgattctttttattttttataggcactcataccttttatttttaattttttaaatagaaaatgttttttcatacaaaatatagtgaatagagttacccctcctccatctatactagatcctccccacatcactgcccattcaaacctaaaacctgtctttctctatatcatta

SEQ ID NO: 3768 - DNA, 295 bp, Mus musculus
  misc_feature (40)..(40): n is a, c, g, or t
  misc_feature (252)..(252): n is a, c, g, or t
gcacataattggcaagagctctcccagccatttacatttnctcaaagtgctcttttcaggatgaagtacagtaattgcaaatataaattagataggcataccactctctgtgatctcttaagaatacagtactgattcccacataatttagctctttctaaaactgtttctgctgaatctatatattataggcagtacaataatttctcattatatacatttgttccatacaatgattttgaagtaaccttntcttcaacatggatgtaatcacttgttcaagggctctagcaat

SEQ ID NO: 3769 - DNA, 454 bp, Mus musculus
  misc_feature (242)..(242): n is a, c, g, or t
  misc_feature (282)..(282): n is a, c, g, or t
  misc_feature (297)..(297): n is a, c, g, or t
  misc_feature (316)..(316): n is a, c, g, or t
  misc_feature (371)..(371): n is a, c, g, or t
  misc_feature (419)..(419): n is a, c, g, or t
ggcgatagatcagtggcccagcacttgcctagcatgcaaaagaaaggccctgggtcctttctaacccctgcactgcaaaacaaagaacttgctccagctagggcttcctggtcctcaaactcatcctacagggagggctagtcccctctgccatttctccctactctctgctaactccaactcaaaaagatgagtagacaccttccctgttccacgtagctcttgcattggaacctacatcntgcctggtccctgttctctcccctcctagctggagccctntgctccacagtcgtnagctaacccatatgacatnagggatgaagccagtgaggcagctcctccaacttctgccagactcaaacccagtnccagtctccctcacagaccctgggacttgtttctagcgcccaggagancccacctgctgggacagactcaccctggtgcgatt

SEQ ID NO: 3770 - DNA, 563 bp, Mus musculus
  misc_feature (65)..(65): n is a, c, g, or t
  misc_feature (89)..(89): n is a, c, g, or t
  misc_feature (175)..(175): n is a, c, g, or t
  misc_feature (188)..(188): n is a, c, g, or t
  misc_feature (190)..(190): n is a, c, g, or t
  misc_feature (200)..(200): n is a, c, g, or t
  misc_feature (260)..(260): n is a, c, g, or t
  misc_feature (330)..(331): n is a, c, g, or t
  misc_feature (449)..(449): n is a, c, g, or t
  misc_feature (457)..(457): n is a, c, g, or t
  misc_feature (470)..(470): n is a, c, g, or t
  misc_feature (503)..(503): n is a, c, g, or t
  misc_feature (511)..(511): n is a, c, g, or t
agcagcagacccttaaatgtgtaatggtacgtctagcaactaagatcttatatgccttatgaggncacttaggtttttaaatgagaaanagaagagtcaagctaaactagaataataggacatacctaatgagctgtcttcaccagacgagaagctatgggctggtgtgtagctnaggacccttgttngnatccccaggnttactaagaagaaaagtttttaatctaactgggacagtgagagtcctgtattggccatcnaaaattgggaactgttttaaatgagataagttctgacctaaaattgaattttccttttctcaaaattttnnatatttactcttattcatggtctcatctgggaatcttaactaatagggagccattcactaactccttggtttctttcctgcatcaagataactgatggtatagtatgtgtcaccaganatgatttncaggctaatgacnattagaatatttatattcagctggaaatcttgnttttcaancagaatgagtttatggtatgcttttctcaaagctgctatgttctcaatgaaa

SEQ ID NO: 3771 - DNA, 366 bp, Mus musculus
  misc_feature (331)..(331): n is a, c, g, or t
taccggcagtggacagtgccccggcccagccacatggactacggcaacagagctgagggccgtgtggacagcttccacccccgcaggctgctgctcagtgggccacctcagattgggaagacaggtgcctacctgcagttcctcagtatcttgtccaggatgctgattcggctgacagaagtggatgtttacgacgaagaagagatcaataccagcttccgagaggaatcggagtggcgttacctccagctggccgacccctggccagacctggagctcttccagaagatgccttttgattacatcattcatgacccgaagtatgaggacnccagtctgatttgttcacaccctcagaccatcaag

SEQ ID NO: 3772 - DNA, 564 bp, Mus musculus
  misc_feature (175)..(175): n is a, c, g, or t
  misc_feature (178)..(178): n is a, c, g, or t
  misc_feature (183)..(183): n is a, c, g, or t
  misc_feature (191)..(191): n is a, c, g, or t
  misc_feature (232)..(232): n is a, c, g, or t
  misc_feature (242)..(242): n is a, c, g, or t
  misc_feature (247)..(247): n is a, c, g, or t
  misc_feature (257)..(257): n is a, c, g, or t
  misc_feature (272)..(272): n is a, c, g, or t
  misc_feature (276)..(276): n is a, c, g, or t
  misc_feature (292)..(292): n is a, c, g, or t
  misc_feature (298)..(298): n is a, c, g, or t
  misc_feature (310)..(310): n is a, c, g, or t
  misc_feature (336)..(336): n is a, c, g, or t
  misc_feature (338)..(338): n is a, c, g, or t
  misc_feature (341)..(341): n is a, c, g, or t
  misc_feature (353)..(353): n is a, c, g, or t
  misc_feature (357)..(357): n is a, c, g, or t
  misc_feature (385)..(389): n is a, c, g, or t
  misc_feature (393)..(394): n is a, c, g, or t
  misc_feature (460)..(460): n is a, c, g, or t
  misc_feature (466)..(466): n is a, c, g, or t
  misc_feature (468)..(468): n is a, c, g, or t
  misc_feature (519)..(519): n is a, c, g, or t
agttcagctttttacacagacccacaactgtaatgattgaacccatcattctttttgacatgggtcgttgagcacaggattttcctctaactcccgctcttggcttgctgtcctatggtctgcaggtactgcagccttgtcagcgagcccttcccattcagatatgtgcgagagnttntgctnacagtacntaggtacagcctcagaaaattcagaaaaggtctctctcacnaaggaagggntgganaagtgcagancaaggggaggaaggnacanctgaacaacgtctatngaacanaggagtaataangagagccattcctccgggctgcactntnacncaaagactaagnaaantaatggacactgaaggggacccagctgnnnnnacannataagaagcctccagtaccacaaggaaagaggaaaggatgagcagaaggcagatgcaaaggagagncatgantnagctctctgtcccacgtggtcatatagcacaagcttggactcatgaggagnaatattcaaccacccatagtaaaccatgggagatccgggcagaac

SEQ ID NO: 3773 - DNA, 444 bp, Mus musculus
  misc_feature (221)..(221): n is a, c, g, or t
ggaccagttgtacacagcagcctatagatcctcccctcccacctgcgcatctctgcattgcagggaaggacaagttcaagactgaaaccagaagggactcgggacaacccaggccaggctagaatgcttacactccacctaactcggttcttgcttgcacacagaacaattcctatcaagagtctaccaaatctcacctctgccctcaaaggccagtaggngaaagagacttctaggagcttctcctgaccctcctctgctcctgccaacccttgccaagctgggtttgcaggtcatccctctccagcctgtatcccagtcactctgacccttacctcgggaagcagctcagtcagttactaggaagcctccttcaacctgcttccacatctgtaaaatgggggcaatagcagacacctttgcgagggtgttctgaagctttct

SEQ ID NO: 3774 - DNA, 561 bp, Mus musculus
  misc_feature (34)..(34): n is a, c, g, or t
  misc_feature (41)..(41): n is a, c, g, or t
  misc_feature (45)..(45): n is a, c, g, or t
  misc_feature (51)..(51): n is a, c, g, or t
  misc_feature (61)..(61): n is a, c, g, or t
  misc_feature (63)..(63): n is a, c, g, or t
  misc_feature (67)..(67): n is a, c, g, or t
  misc_feature (72)..(72): n is a, c, g, or t
  misc_feature (76)..(76): n is a, c, g, or t
  misc_feature (80)..(80): n is a, c, g, or t
  misc_feature (96)..(96): n is a, c, g, or t
  misc_feature (109)..(109): n is a, c, g, or t
  misc_feature (135)..(135): n is a, c, g, or t
  misc_feature (138)..(138): n is a, c, g, or t
  misc_feature (142)..(142): n is a, c, g, or t
  misc_feature (145)..(145): n is a, c, g, or t
  misc_feature (147)..(147): n is a, c, g, or t
  misc_feature (169)..(169): n is a, c, g, or t
  misc_feature (275)..(275): n is a, c, g, or t
  misc_feature (347)..(348): n is a, c, g, or t
  misc_feature (350)..(350): n is a, c, g, or t
  misc_feature (379)..(379): n is a, c, g, or t
  misc_feature (384)..(384): n is a, c, g, or t
  misc_feature (407)..(407): n is a, c, g, or t
  misc_feature (453)..(453): n is a, c, g, or t
  misc_feature (484)..(484): n is a, c, g, or t
acagacatttggaacaccaagagataaaaatggntatgggnatantgtaangtattgatcncnttcnaggantganccgnttttcaaaaggctttngtgagcaggcggncacacgggggagcgtttctcacgccnccnatcngangnagttgctgactgagaggagccnaggcctttatgatgctgagggctccttgcataaagacctggagtgatatgtgtcttagaggcaacctgaataaggaaaaattctgtgaacacccttttaaaaatgnggtatacctccatagatgggttgaatttgttacttgacaaattgtaatcctatttagagtggagggacacanntnagggttaaaggaaatagacatttaccagncagantactaaaccttgagtctcatatnccaccactataaacttaatttttacaacaactagagctgaatgaanatgggactgtgtatgggtatttccccccccnaaaagtcatgagaattgtaatgttatataaattacagcaaaatgtgtaggtgtgtgttgttcctgttttaccatgta

SEQ ID NO: 3775 - DNA, 377 bp, Mus musculus
ctggcactaacttccactcaaatgaacaatagcttagttctgcttagcatgggtcaacgtgttaactattcagaatacccttccatggtagctccgagggctcagaccatctgctgtggtgtcccaagttctcacttgtggctttcctagacactcagcttgcctggcctctctctggacctgaagagggaaaggctcccttctaaatgtcttactcagaggcgacttgaaggatggctttcattttcaaataaggaaatgtcagggttcctccttctaccacaggcttccatgcaatagcaacagaatgctctcccctacaatcgtgagaataattatgagccaggaactgaagcgattcacacagggagcccagg

SEQ ID NO: 3776 - DNA, 476 bp, Mus musculus
  misc_feature (138)..(138): n is a, c, g, or t
  misc_feature (340)..(340): n is a, c, g, or t
  misc_feature (348)..(348): n is a, c, g, or t
atggtccatggccattctattggatattgatccagctgcatttttagtatgaggactcttagcagaacaggactctgcttcctgtaggttaatctaatttgctcggttcgttttgttgttatattatgactgaagggnaacttgaaaatggagatctggaaaatggagacctggatgaagaagtgggtcattgggccaggtccttgggagtgtattatccttgacagcttcctgccactatatacactttctcatctgccatttgtgaacatggctttcctcattaagatagactgactatatcaaaactgaaccaaaggaaaccttttcacttctcagncatgttancaattcggtaatagtagtggaaaagtaattaatactttttctttgcctatgatgtcctgctcacagttgactgaatgtggaccccaactgggatatatattctcggcacctggtatattgtcctgata

SEQ ID NO: 3777 - DNA, 477 bp, Mus musculus
agcttcctatccttgcactggaatttctgaagtaaggagtgaaatgcgtctttttaagaccctctatgcaattgacagagataagtagtacaatgggaaagaacttcatgccaggtggagcagagccagtcagaacaatgctaacacatctacaggcagggcccttcgtgtaaaaggaagcaaaatccccatcactttgcaagattagttgccctgggtcaccacttcagtgtaccagtccctggtgctctctgaaaattctaccttcccaaagttacactcttgccaacctaatgcatcctcaaacagtaagttaaattacttccaaatgcagagggaccaagtcagccttcatttcccacttcaaggtatataatgggtacagttaagggacaggcatctctattttcctgctgaatctcaaaaatgttgtagctcttttgtctagctccttagtaccaactccttcattctgtc

SEQ ID NO: 3778 - DNA, 403 bp, Mus musculus
  misc_feature (357)..(357): n is a, c, g, or t
  misc_feature (360)..(360): n is a, c, g, or t
gtctcctctataaccaccaaagtttcatagttgggcctttcttcaacacctccatttcctttctcttgaggaaaccttgcttggtcctccttcagacctctgagtgggagtgggactgtctgtgactctctgacaaaagttttatcagtgtgtgccaggaggtgtcttagcagcaggtcccatgttatggaagatcagggccctgtgaacatgtcttccctttccagacacagtaaggttatctcaagccagggtcttacacacatgtatatgtgccccaccacacatacatgcccataaacatacaaggcacacacacacacaggcatggacccagccacgggaaggaatgagatnaanaagtccatggccagtggggaggaatgacagaaaccccaccgta

SEQ ID NO: 3779 - DNA, 364 bp, Mus musculus
aattgtgagatacttgtccagaccattttagcttttagagtctttgttgggaagttggtgtaattctgatcagtctgccattctatgacacctggaattgtccccttgccacatttaatattctatcattgttctgtagattttgattattatgtggcaggatgatgttcttttctggaccaaattggtgttctaaaactttgtatgtttatagatgtggggacgtggactgtgctaggaaacttggtacagctgagtgggttcagaatcctcggcatccagctgagaatagtaggtgtttcacctgctcccaaccagtttcctggcctgggacatgtggttataacgccccacagaaagaatg

SEQ ID NO: 3780 - DNA, 486 bp, Mus musculus
  misc_feature (175)..(175): n is a, c, g, or t
gcaggcacagtgtatcacgcaggaaagtcaggacagtaacctggaggcaggaaccgaagcagaagccatggagtaacgctgctgctcactgtctgtcctcctcatggctttctcaacctgctttcttatacaactcagtaagtactccctgcccaagtggggacagcacccatcntggatcgttcccacatcaatcctgaaccaagaaaatgcgccacagatttgcctataggtattttctcagctgaggttccatcttaccaaatgtggtttgaatgagttgtcccccatgttcttgggcatttgaatatgtggtctgcagttggtggtgctcttgggggcctctttaggaggtgtggcctcggtgaaggaggtgtggcctcggtgaaggaggtgtggcctcggtggaggaggtatgtcgtggcagaggtgaactttgacgtctcaaaagctcatgcctcgtttgcactccttgtgggtactgac

SEQ ID NO: 3781 - DNA, 373 bp, Mus musculus
  misc_feature (45)..(46): n is a, c, g, or t
  misc_feature (163)..(163): n is a, c, g, or t
cttgttttgtccctcatctagggagaaagacatttattcttattnnttcttttacaagaaatatcatggttgtgggtttgccgtttattgggtaaataaattatttttgacatttattgttatttgtttggagttttgttctgctatggggtgtttgtttttnagaagggtctcaaagggtcagtgtaagctgcctggatttgctttgtggctgagcttggtcttgaacttactgcctcctcttccaggtgctgctgacatttcaggcacatactaccatctgtccttgccattttcccccttttggctactagaaatctaccttggaagtcttatacatacacacacatatatccacacctgcatgcacata

SEQ ID NO: 3782 - DNA, 409 bp, Mus musculus
gagcgctcacgtctgtatgtgatgagaatctggttttttttagaaacccagttatgttatgtgaatgcggttttgctttaatcctaggcgtgggataagagactgcttcgcagcaggtgactatgatttgcctcatgctctagcaagggtgtgcttttgccagcagcagctagttactataagtgtgtaatgtttggaattctggaaacttttcaagggggtataaatggcagagccctgagcggggctgagctcactctgaggaggctgttgctccccactgctgctggctcctgttgtggtggtttgtcaagtggttgggagcaaagtgaaaagaagaaattgtagatatccttacaatgacaaagactgaacttaccccaaggaactcgacaccttaaatcagcag

SEQ ID NO: 3783 - DNA, 401 bp, Mus musculus
  misc_feature (45)..(45): n is a, c, g, or t
acggatcttctcaaagttcttgctgagctggtactggcgaaaagnggtttgaatggtgcacgcggcgcgtcgggataccaggtggcccccgtatttgtgttctagcatttcaatctgcagcagggacagagagaagggctcagttaggggaatggtggaggtagcgctgattagaccagtacagcccaccgtaagatccaggttctgactcctcagtgcataagtgcacagctttattgggagcctacatcaaaagaccccaagcctgacatgcctgagatgccaagtctttggaaagactcctaggggcgagatggaagattccacgcaggatttgtgatgtcccctgtggcggtagacagaggcgttaggatggaagtcccatttagacagtgtcctga

SEQ ID NO: 3784 - DNA, 465 bp, Mus musculus
  misc_feature (93)..(93): n is a, c, g, or t
  misc_feature (97)..(97): n is a, c, g, or t
  misc_feature (100)..(100): n is a, c, g, or t
  misc_feature (162)..(162): n is a, c, g, or t
tccatagacacctcactcatatgtgcacaggagtgtgtgtacatacgtgtgcacgtgtgcgcagacatacgcatacacacacacacacacacncacnccntcatacgcatacacacaaacacacacacaccatcattaaaaataaaataaatcttaaaaaanaaatccaagaagataagaatttgaagagataaactggttagtaggccagaaaagacttgactccaattgaataatggcattgccacctttaaagaaagagtgctgccactcttccagccctggccagttcagtaagtcaacgtggataatcaggtgtgctccacaggtctatgtactgtgttaaaatagttatgtctgtgggctggagagatggctcagtagtagttgagagcattggttgcttttccagaggttctggattcaattctcagcagccacatgtggctcacaatcatatataac

SEQ ID NO: 3785 - DNA, 508 bp, Mus musculus
gtgttctctccaaagatcgaatgtgaagctccgcaccttccctcctgcccttttgcccgctgggccaggccggacctgccccccttggtttcactccccagagtcccagttgcctttgggatgacagtgaccccttctgcaggtttggccctttgttatttgcacagggatgtttctaagaaacgcggagagtggtgctcttggccgcaagccagcaaagccgacaggctgctgcagatttttaaaggcagtgtccacagtgacctggggcaaccaagagggtgcatgctccatctccacatggacacttgctattctcaactgaagcttcaaaccctggagtcccagagggccacggggaaggatttcgctgcctgaatccttcttcctcctctggtctgacttctggaagccccacttgcacctgtttcctgtctgttccctggcactgcctcgccctagaaaacctctacggaactgtgaatagcctgtgtgtagaccatgagag

SEQ ID NO: 3786 - DNA, 381 bp, Mus musculus
  misc_feature (168)..(168): n is a, c, g, or t
  misc_feature (187)..(187): n is a, c, g, or t
  misc_feature (322)..(322): n is a, c, g, or t
aagaattgttgctgcagtcttcctgctgtgcctggtagtagattttgggtggagtttccccttgtatatcttggaacttgtctccctcatttgcagggctacctagcagggcccccagagaatggtgtcctcatagcctcctaccatttgctcttctcatctacccanggatgacatctgttttccncagaccatggcagggaacagggtgggatgtaccaactgagtataaaaaagtgggtgggctcaggccttcctcagtcagcatgtggagccgtgcaagtttcagaaaggcatttcttttggacacctctactctccnctaggaaactggcctctttacaaccggaaaactggtgctagtttgaatgggcccactca

SEQ ID NO: 3787 - DNA, 486 bp, Mus musculus
  misc_feature (274)..(274): n is a, c, g, or t
  misc_feature (350)..(350): n is a, c, g, or t
  misc_feature (375)..(375): n is a, c, g, or t
  misc_feature (413)..(413): n is a, c, g, or t
  misc_feature (425)..(425): n is a, c, g, or t
  misc_feature (456)..(456): n is a, c, g, or t
aggcccaatgcccagtagtgggaaacctgggaggccagtcatgcctccacctcaagtgcctttgcccacatcttccatctcaccggccaaaatggccaatggcacagcaggtactaaggtggccctgaggaaaaccaaacaggcagctgagaaaatctcagctgacaaaatcagcaaagaggccctgctggagtgtgccgacctactgtccagtgcaatcacggaacctgtgcccaacagccaactggtggacactgggcaccagctgctcgantactgctcagggtatgtggacagcatccctcagactcgcaacaagtttgccttccgagaggctgtgagcaaactgnaacttagcttacaggagctgcaggntgtcttccacagctgctggtgtgcctgggacaaacccngtccttaataanttattgtcgtgtgtacaggaaattagcgatntggtgcagaggtagccatcgtcggctgagt

SEQ ID NO: 3788 - DNA, 422 bp, Mus musculus
  misc_feature (50)..(50): n is a, c, g, or t
  misc_feature (58)..(58): n is a, c, g, or t
  misc_feature (70)..(70): n is a, c, g, or t
  misc_feature (83)..(83): n is a, c, g, or t
  misc_feature (95)..(95): n is a, c, g, or t
  misc_feature (139)..(139): n is a, c, g, or t
  misc_feature (147)..(147): n is a, c, g, or t
  misc_feature (149)..(149): n is a, c, g, or t
  misc_feature (155)..(155): n is a, c, g, or t
  misc_feature (186)..(186): n is a, c, g, or t
  misc_feature (196)..(196): n is a, c, g, or t
  misc_feature (222)..(222): n is a, c, g, or t
  misc_feature (225)..(225): n is a, c, g, or t
  misc_feature (235)..(235): n is a, c, g, or t
  misc_feature (241)..(241): n is a, c, g, or t
  misc_feature (244)..(244): n is a, c, g, or t
  misc_feature (285)..(285): n is a, c, g, or t
  misc_feature (358)..(358): n is a, c, g, or t
ttgctttgtaggtggctagttcagtgataccataaaggaaaatcagatgnatttcttntcagttccaccngcattcagaatgnttagaaaagctntaccccatagtccttcctgtaatggatcttttagacatacttgntccattancnctggtntggctttcaaacccatgaagtacatgtgggnttgatgaagntagctaatggctgctgtatttatggncanttgacctagnactagntanccagccagtttaagcacttgccttctgagaatctagaattnatgcacataaaattctgatgcctttctgaacactgatttagacaatccctttgattttaccatgcttcatctnttgagtttaagttgtcttttttaggtgggcaggggcaccatctgtcttccgttacacttacata

SEQ ID NO: 3789 - DNA, 264 bp, Mus musculus
ttggtctgtacgtttgtatatgcaaaagtcagtgatcctggtgaggccagaagaatgtatcagatcccgtggagctggagttacagacttacgtagaactggcttgttaatgttggtgctaggatttgaactctggctgtcattatgcagctggtgcttttaacacctaagctgtcttttgagcccttgttttgttctttgaggctgaggtttcactatgaagttccagactggcctcaatttggtgattttctgcctttgtct

SEQ ID NO: 3790 - DNA, 410 bp, Mus musculus
  misc_feature (26)..(26): n is a, c, g, or t
  misc_feature (196)..(196): n is a, c, g, or t
  misc_feature (224)..(224): n is a, c, g, or t
  misc_feature (274)..(274): n is a, c, g, or t
tagtaaagccttgtctttcgtgtgtncctatagttccatgggcatctctgaccaaggcaggcagtattgttagcactgatacacaaccaccacttgcagtttcccttatttgcaagctgaaggtttgaatcagtgtgaatggaacactatccttggtgtgcctggcaccaactccttcggaacaatgttttggttnaattacccttgtggtagtttcaataggnatggctccccccagactcatgtgtgtgcatgcttggcccatagggaatgnaactatcaagaggtgtggccttgttgggggaaggctttaaggttttataagtccaagtctggccagtgtgtcataatctctccttgctgcctgtggatcaagatgttgccctctctagcccggtgtggtgacgcac

SEQ ID NO: 3791 - DNA, 515 bp, Mus musculus
  misc_feature (232)..(232): n is a, c, g, or t
  misc_feature (276)..(279): n is a, c, g, or t
  misc_feature (288)..(288): n is a, c, g, or t
  misc_feature (292)..(292): n is a, c, g, or t
  misc_feature (391)..(392): n is a, c, g, or t
  misc_feature (412)..(412): n is a, c, g, or t
  misc_feature (416)..(416): n is a, c, g, or t
gtttatgggatgtgactggcccagtcttggctcacagagctggctccataatattgggtagtgttgttgttgttgttgttgttgttgccattgttgctgctgctgcagatgatgatgatgatgatgatgacgcttcactgtggatctgaaatcagttctcagggacttgtggggaatataggcaggacagagccagagaaaagcacggtagaatagagctcagagatccttnaatctcttcaccagcacttagcaagagaaatggctcctcaaagnnnncacattttnactngtgtcccaaacattcaggaagaaaaggaaatgtggtctagaatgacccaaagattctcagcattccctggtaaatcagaaatgcataaccatgtccccnncctagcttcaggatccacanctgngtcatgggaaggacgatgtctgcctgaacatcagttgtgagaaatggatgagatgacatctggagagtatttgggtcattctagaccacatttcctttt

SEQ ID NO: 3792 - DNA, 255 bp, Mus musculus
gtagagcactttcctggcaggtccaaggttctattaatccctagcaccagaaaaacaccaaggctttgtaggctaaggcaagtagactagggcttgcctgatgtgtctaaagcatttttgtttaatccctagaaaacagactcatttctcaccatctgtttttccatgttcaagagaatgtcaaggttttatagtgctactctataccgtccccaatgagaagactgtaaaaaacattctctgattgtacaagga

SEQ ID NO: 3793 - DNA, 427 bp, Mus musculus
  misc_feature (32)..(32): n is a, c, g, or t
  misc_feature (49)..(51): n is a, c, g, or t
  misc_feature (99)..(99): n is a, c, g, or t
tgaacacagggcttagctccattccacttccnggtccctcccccttctnnntctccgctccccatttcccctcaaactgtacattttgtatcttccctngctcagcttgctcctcttcattatagattttcataagagtgaacattaataaccacatgacagagtcaatactaggttgttctgagatttttttttttctgccaactttgtaattaatccaaaactcttcaatttagcctcaggcagactctttggacaagagcaaaaagcagccatactctttgccaaactatcacaagaacagtctcttggccacatacgaaaattctactctgaaacctcttgagctggatccccagagttcaaatcaccttcagtaccactgtcttccatgttcctactggtatggctcattaagctcctattt

SEQ ID NO: 3794 - DNA, 502 bp, Mus musculus
  misc_feature (97)..(97): n is a, c, g, or t
  misc_feature (152)..(152): n is a, c, g, or t
  misc_feature (157)..(157): n is a, c, g, or t
  misc_feature (161)..(161): n is a, c, g, or t
  misc_feature (164)..(164): n is a, c, g, or t
  misc_feature (168)..(168): n is a, c, g, or t
  misc_feature (171)..(171): n is a, c, g, or t
  misc_feature (179)..(179): n is a, c, g, or t
  misc_feature (189)..(189): n is a, c, g, or t
  misc_feature (271)..(272): n is a, c, g, or t
  misc_feature (282)..(283): n is a, c, g, or t
  misc_feature (285)..(285): n is a, c, g, or t
  misc_feature (431)..(431): n is a, c, g, or t
ggagctgtattcttcatgaccattaagttagtgcattcctcaacccccattagagaagctactttttgcagtagatgtcaataatacagggactctnaactgatcagtgtacagagtaagatactatggcattctctctctaagacagccantctcnatantcngtgntcntctaaggncctaggaagncatcagggaagagagagcagaaagatggttaaggaccagaggtagtgtttgcctgctgtgaaaatgtttgctggacacggannggctgttgcnngnatgaactcgaagcagctacggctctgtgtttaagacctgagtaagatcaagccagcccatatccctgcctcaccccttgttcccatggataccaaagtctgggatgctcatgtccatgcaaacagcatatgcagtctttccacatnaagctttgctcttccgacatacagttaggtcactctgggtaacccataacccctgataccatatgaatgct

SEQ ID NO: 3795 - DNA, 316 bp, Mus musculus
  misc_feature (137)..(137): n is a, c, g, or t
  misc_feature (163)..(163): n is a, c, g, or t
  misc_feature (166)..(166): n is a, c, g, or t
  misc_feature (169)..(169): n is a, c, g, or t
  misc_feature (174)..(174): n is a, c, g, or t
  misc_feature (176)..(176): n is a, c, g, or t
  misc_feature (180)..(180): n is a, c, g, or t
  misc_feature (183)..(183): n is a, c, g, or t
  misc_feature (186)..(187): n is a, c, g, or t
  misc_feature (191)..(192): n is a, c, g, or t
  misc_feature (198)..(198): n is a, c, g, or t
  misc_feature (218)..(218): n is a, c, g, or t
  misc_feature (221)..(221): n is a, c, g, or t
  misc_feature (277)..(277): n is a, c, g, or t
ccaatcaagtgcaggtaaattcatgggcagagggtagggtggctctggccgagattatcctgcgctttgaagaggtgtctgtgtgtggacacattcatgattacggagagatagctttgaaattgatgtaagatctncaagtcagggatatggcccaggatcntgngtntctgntnctgntcnttnngccnnttcatngccaggctttgaagagaagnatntagaatgctttctgggccaggcagaggaaggtgggagcaatgagtttaggtttgcnctgccaagttcctccttcctcatgggtccttttctctgc

SEQ ID NO: 3796 - DNA, 483 bp, Mus musculus
  misc_feature (314)..(314): n is a, c, g, or t
aagtttcagatagtctttcttcaaattattagcaatttctcatggctagaaacatttcttatggtttcggatggaagcatggaaatgtgaaatggtaggcaggaccatgcatgggtgtttggaacttctccgtccttccctcggcccacaagaccttacaccctgacacatgccacagtaggatgtacatgtcccttcagtgaagcaggcttcagatccacaaccggaagtcttcaccaaggtcccacagaagtagaattactgtactacctcccattcgatttgtaagaatgtaagtaggggcctagattggnctctaggaaactggctatggcagaggagtccaagaagagaaattgcagagagtaaaaactatagcctgggcatggttagaatgatctgatcacagagcagatgagggtgtggttgtgggtgtctctacagtagctatgactctaccagggatgtgataagcagcttttt

SEQ ID NO: 3797 - DNA, 402 bp, Mus musculus
  misc_feature (31)..(31): n is a, c, g, or t
  misc_feature (85)..(85): n is a, c, g, or t
  misc_feature (295)..(295): n is a, c, g, or t
  misc_feature (364)..(364): n is a, c, g, or t
  misc_feature (376)..(376): n is a, c, g, or t
actatgcgttgctctggctttaacagttgcntacagcaacgctggtcgagaggtagagtttatgtgccctgtccctccactctcncctgcaccatgcatctcccttgggtacacatggctttggcattcattggttaagcttcatccccacccaacccctcagcttggcgtagacggcaggatgtttatggttcaaaacgtatggcttcaagttcctggctggtgatacaggactttcaacagtaccgataagcaggctgaatctcacgggacagagcggtgtgttgccctcccntagggacgctgcatgactctcttgctatgtgcccgactggctgtcacgtgcgtgtgatagccttgcttntccatgtctttntgcccactgtccgtgagttctgagca

SEQ ID NO: 3798 - DNA, 413 bp, Mus musculus
  misc_feature (43)..(43): n is a, c, g, or t
  misc_feature (57)..(57): n is a, c, g, or t
  misc_feature (61)..(61): n is a, c, g, or t
  misc_feature (66)..(66): n is a, c, g, or t
  misc_feature (76)..(76): n is a, c, g, or t
  misc_feature (78)..(79): n is a, c, g, or t
  misc_feature (92)..(92): n is a, c, g, or t
  misc_feature (95)..(95): n is a, c, g, or t
  misc_feature (117)..(117): n is a, c, g, or t
  misc_feature (127)..(127): n is a, c, g, or t
  misc_feature (169)..(169): n is a, c, g, or t
ttaacttacatctcagacatcaggtttcatgttgcatgatgtnagaggagaattacnagcnagtgntcactgtctngnntctccgggccccntgntccattttatactgtgtgaagncctttcatgnacaaggagccagcactctgatgaaccccttccacagaacttnagacagtgtcatggggtagtttccaaccatagcctctctcatcacatggtaatttctacagctgtctccatcacttacaaccaattgggtagcattactaaaatcacagctcacacccaaaacagagaaacacggggatgcaaaccaaactttacgtttacacccaatcttaaaggtaacaacccaattccaactactataaagaaaaaaagcattaccagctgacaaatctgcggcttggctt

SEQ ID NO: 3799 - DNA, 369 bp, Mus musculus
  misc_feature (106)..(106): n is a, c, g, or t
  misc_feature (108)..(108): n is a, c, g, or t
  misc_feature (146)..(146): n is a, c, g, or t
  misc_feature (157)..(157): n is a, c, g, or t
  misc_feature (178)..(179): n is a, c, g, or t
  misc_feature (228)..(228): n is a, c, g, or t
  misc_feature (295)..(295): n is a, c, g, or t
  misc_feature (301)..(301): n is a, c, g, or t
  misc_feature (306)..(306): n is a, c, g, or t
  misc_feature (311)..(311): n is a, c, g, or t
  misc_feature (324)..(324): n is a, c, g, or t
atttgtagccttctgtgggactctagtggtctgctagggttgccgaaccatcactccagcctcgatatcgtcccaggttagttaacactttagaaagcctgctttncnaagcagaagcaaatttgaagaagagtaagcctgggacncagccttccancaaaggcagcttttctctctnnttagttttcgcataccatcttttactagatggtacaacccacgcagctntggaagactccactgaacaccaaatggagaatgagagcagaaaagtcttgagtaatgtcatggtgangttttngtttnaggcntcccgagagtatnttaagaattcatgggcagccctggcccacacttgtataatcactt

SEQ ID NO: 3800 - DNA, 430 bp, Mus musculus
  misc_feature (54)..(55): n is a, c, g, or t
gggagagactgacaacctattgcagttgtccttgttgcagtaagtcctggcgtnncttaactaactagaataattaaaatgtgttttatccacctattgtcacattaattactgtaggctgctcacagctaacagataggaaccccattttctggggtggggtcctggctgcacctgcactttaagccccattaaattgatcagagcaggaagttttccgcctctcctcctcactgcttcatccccacatgcttggccacacaggaaagtgtgttttactgccttgtgtaaacctttatggttatttcattgcagtgtatttaaatataactaccatgtgttttataggctgatacttataatactatgtagtcaaagaatgaatgtataagatgtacatcagaattctgacggtatccaaggacagctt

SEQ ID NO: 3801 - DNA, 311 bp, Mus musculus
  misc_feature (282)..(282): n is a, c, g, or t
cacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggancctgagctgctggaacctattccctatga

SEQ ID NO: 3802 - DNA, 391 bp, Mus musculus
  misc_feature (58)..(58): n is a, c, g, or t
  misc_feature (63)..(63): n is a, c, g, or t
  misc_feature (111)..(111): n is a, c, g, or t
  misc_feature (151)..(151): n is a, c, g, or t
tttgctactgttatgtgccataatgtaaatatctgatatggatatagtcttaggcganccctntggaaaggtcattcacccctccaagggggtcgggaccacaggttgagnaacacagctctgcgtgatacgcagtgtgaacagcctgggngaatgctgtgtgcctgagatgttttacagttagggattacaaatctaagggagtacctttaaattttgtttgtttgtttgtttgtttttaagtgatggatgtcttttaaactaagtaatgttttgggaagcacccgtgtgtctactttccaggttaggcaggctgctgtcacacatttaggcatggatggatgctgaaaataactgtcatccagggaaccagagcccctgtgtgcttttc

SEQ ID NO: 3803 - DNA, 381 bp, Mus musculus
  misc_feature (115)..(116): n is a, c, g, or t
  misc_feature (279)..(281): n is a, c, g, or t
  misc_feature (285)..(285): n is a, c, g, or t
  misc_feature (287)..(287): n is a, c, g, or t
  misc_feature (290)..(290): n is a, c, g, or t
  misc_feature (293)..(293): n is a, c, g, or t
  misc_feature (352)..(352): n is a, c, g, or t
tcatataggctgtcccctaaatcaaaaagcatagaattgcttccattgacttcctctcttgcctccttgattaaagtagccgtccttgacaaacctcctgttgtaaagattgttnnattttcataatcttctgtcgtcacctgtccgtggatgtccgatgtaaatataagccttaaatttgcagtatctggcaaggtgccatctggcccattattttcatttccctggttttcttgggattcgtccccttctttgccctcttccttattatcttcctgnnntgtntntgntgntgaagcttgcccttcagcagcagaaacaacagaaggctgccctgtaagcaacgcaaagntaaccgccatcactacaaatatcttccat

SEQ ID NO: 3804 - DNA, 210 bp, Mus musculus
  misc_feature (63)..(63): n is a, c, g, or t
  misc_feature (70)..(70): n is a, c, g, or t
  misc_feature (135)..(135): n is a, c, g, or t
  misc_feature (143)..(143): n is a, c, g, or t
  misc_feature (182)..(182): n is a, c, g, or t
cctcttcttgcttagacttttctatttccagagggacagtgaagcagaagtgtggaagccagntgggccntggtgcagttcagtgggccttagttttccctgggatgtatctctttcacctgcatggtttccagntgggaaantagcttgcagtttgggcaggaagagatagcttcatcaanagacagtggcttcccattagataagatt

SEQ ID NO: 3805 - DNA, 337 bp, Mus musculus
  misc_feature (226)..(226): n is a, c, g, or t
gggctgcccatcaggtccgcgggctccgcgctgcgtgagcacggccgcagccgcccgagctccagctgcccggtgctgcgtgtgcgaaaggcgcggaagtcccaggcgcgcggcccgatctcaggatcctcagccgccgcctcctcggcctcctcctccagccgcccgggcgcctccggggagcgcgcgggccggggccgccgagtaggacgcggagccggagcgnccagctgctccttcctgaccatggtcaccgagatgcggtagacggtcttcctggggggcgtcccgcgcgacatcgcgtctgcgggcgaagacgcgggttcgccgctgctgt

SEQ ID NO: 3806 - DNA, 259 bp, Mus musculus
  misc_feature (27)..(27): n is a, c, g, or t
  misc_feature (34)..(34): n is a, c, g, or t
  misc_feature (68)..(68): n is a, c, g, or t
  misc_feature (77)..(77): n is a, c, g, or t
  misc_feature (115)..(115): n is a, c, g, or t
  misc_feature (182)..(182): n is a, c, g, or t
  misc_feature (203)..(203): n is a, c, g, or t
  misc_feature (216)..(216): n is a, c, g, or t
tgcttcccaacttaggatcaatcagantaggccnaaatatgttccacaaactaatcatgtaggagctntgcttaaanctaccgccttcatcttccaggtttcaaaggcttccaancgtacccttccctatttccattgtgcagtgttccagttcccaacctgctctcaacactttgccatancagagataacagagataacgntgcctccctaggnataacgaactgagaacacacagcaggctcctactctatcttgg

SEQ ID NO: 3807 - DNA, 186 bp, Mus musculus
  misc_feature (26)..(26): n is a, c, g, or t
  misc_feature (36)..(36): n is a, c, g, or t
  misc_feature (40)..(40): n is a, c, g, or t
  misc_feature (43)..(43): n is a, c, g, or t
  misc_feature (47)..(47): n is a, c, g, or t
  misc_feature (66)..(66): n is a, c, g, or t
  misc_feature (136)..(136): n is a, c, g, or t
gaggacaatgatgatggtctttcttnggatgaacantgcnatntgcnggctgggaactagatctanccataggaccttcccatgattatttaacacatgaagattttatgtaattccagctccaggagtgctcatntccgtccttccttttgctgagtcactgctattatactcattgtgttgtgg

SEQ ID NO: 3808 - DNA, 154 bp, Mus musculus
ttctgacttggcatcctctgattgtgactcaggctgtaccaggcctttcctggattcctggatgtccttttcttctcctgtaatgacaagttctgggtctgtttctgagtcctttacatcatttgttttgggctcttctacaaaaagatcgtca

SEQ ID NO: 3809 - DNA, 266 bp, Mus musculus
  misc_feature (94)..(94): n is a, c, g, or t
  misc_feature (214)..(214): n is a, c, g, or t
aatctaggtgtgatgctgttgcctggtaaagatgtgaccaccgaactgttcgtggggtaccctcaattctctcaccaagaggcatcagcgggantgatcaaaagacccgcttacatttatctttaattgtcagcaagtcattgcctttttaaccataaacattagcatgtgcctggagcggttagaatattccatgagtaaagattccgtatanggggaaactaagagagaccagaaatgttcagccatttgtaaggaagtcccaa

SEQ ID NO: 3810 - DNA, 47 bp, Mus musculus
atgtgaacagcatgcaccacgcgttcccaatgtgtagacggacttat

SEQ ID NO: 3811 - DNA, 129 bp, Mus musculus
atcttgtcctgtcctgtgtcaaacacgatacctcctgctagctgggatatctctcttaagaatacctcagggacacaggcagctcaggtaaaatgccgtttatccaacaggcttaaccaatcttcaatt

SEQ ID NO: 3812 - DNA, 463 bp, Mus musculus
  misc_feature (55)..(55): n is a, c, g, or t
  misc_feature (272)..(272): n is a, c, g, or t
  misc_feature (304)..(304): n is a, c, g, or t
ctgtaactcttcctgtgggtgtgaggatcctatctctcaacccagcttgaatggnatttgtttctgcaactggaataatcttaaattatccattctgacaccagagactcagcactttcaggcaaggctccatgtgcatatattctgggctggggagatggaacccatttgagaagaaactatttcagcatcacagaaagcaaagacaatgatgattagcaacaccttttcctcctgactgaactgcgggcaagccatttcccaccctggcntgcccttcagagagaaaaccagccgaatacgntggggtgaatccgcagtcccagttattgaaagtctgaggcaggaggatcatgatttcatggccaacttgggctctaaaggaagagaagaaacccaagttggcacgtagcctacagagctggtctcagtggacgcatctcagttctatcttctagcctag

SEQ ID NO: 3813 - DNA, 523 bp, Mus musculus
  misc_feature (100)..(100): n is a, c, g, or t
  misc_feature (121)..(121): n is a, c, g, or t
  misc_feature (125)..(125): n is a, c, g, or t
gatcacttgaaaactttggcatttacaaacaaagctgctttaaacatctgtgtggatttgggtggaaatggttttcagttcctttgagtgaatgtggaangaacacacttgtttgtatggnaagnagtatttttagtgttgtgagaaatatccagactggcttccaaagtatggggcccattcttgagccatgctgaaatggtgttttgttgttgtttcatttttgtttttgtcattgaaatctatctgttcatttttaattatgcagaaaacaactggcttttgcatattagccttgaattttgtaactcttccacggacatttaatagcttcatgaggttttcttttgatgaatttttaaacttctctgaacttttgtttttattttagccagtctgctggtgattcctaaatgattagatgctcactgtcaggatcttaatttaactattaaaacaggtttgctactaaacagatgcctgtgtggtttgaatgtgaatgctccctatacaggactgtcca

SEQ ID NO: 3814 - DNA, 306 bp, Mus musculus
  misc_feature (182)..(182): n is a, c, g, or t
  misc_feature (224)..(225): n is a, c, g, or t
gggaatgcgatagcctccccggtgtctgcggttccagtgacctgacacctggaaatagaaagtggaagactccagaaacaaaccgcgcatggctttgaatttgtgtgttttgagtagctcagtagtggagactcacccagcgtgcttgagtcccatgttcagaccccagaactgttcttccnggccctaagatagtagcacgatgaagttttacctcttcctgnnttacacataggtcatcgtcttgcttggcgtatccctctgtatacgctaccccctcattagtcacgtaggacagctgcctgt

SEQ ID NO: 3815 - DNA, 531 bp, Mus musculus
  misc_feature (130)..(130): n is a, c, g, or t
  misc_feature (152)..(152): n is a, c, g, or t
  misc_feature (162)..(162): n is a, c, g, or t
  misc_feature (184)..(184): n is a, c, g, or t
gattaaccaggctgttttctctctctcctctggaaaatagtagtcaccacctctcctggctccgccccaaaactaagtttaaaagtttactcagggtgctgaggttaaacggctttatcttggttcacanttggtggagaagctaaactttngccaaggcancagtatcttttattttgtgttngtttttcttttgagacaaagtctcaccttgtagccaatactggccttgaatttactgtgtaacccaacctggccttgagtttggatacttttcctgactgaagccttcagagtgctggaattatatgcatatgccaccatacccaactttcaagtcagaaacctaaaattttagtttcgcccccaccccatcccccaaacaaaagtgggtatagatgcaggtgtataaatacttggctaccagcttgtttgcatttgtatatacattataattctgtactaggattttatataacttgagtactggataatattctcactagttcctgtcacttatgaactgtttag

SEQ ID NO: 3816 - DNA, 411 bp, Mus musculus
ggcattggctttggtatcacagggaactggatttattccacttcttcagattcatctctgtttgctcaattggaaacaggaagctgtaattacttactacacaagtgccaaattggtatgctaatttggcttattccttaaaatatactgctaatcacaatccttgtgtcttcacaggtatgggaggagctgccatcgccccaccgacgtctcttgtagagaaagacaaagagtgtatgtgcctcgctttcttttattacctattctcacacaggtatttgtggacagtgaagatcctaagcttgactctcttgtgtcctgagtttagagcagaatagcctggttttcatccctgaagtcacagtggccttgcttcctgctatacctgggatgctttgacagggctacaca

SEQ ID NO: 3817 - DNA, 548 bp, Mus musculus
  misc_feature (50)..(52): n is a, c, g, or t
  misc_feature (54)..(54): n is a, c, g, or t
  misc_feature (63)..(64): n is a, c, g, or t
  misc_feature (67)..(67): n is a, c, g, or t
  misc_feature (81)..(81): n is a, c, g, or t
  misc_feature (89)..(89): n is a, c, g, or t
  misc_feature (92)..(92): n is a, c, g, or t
  misc_feature (95)..(95): n is a, c, g, or t
  misc_feature (100)..(100): n is a, c, g, or t
  misc_feature (133)..(133): n is a, c, g, or t
  misc_feature (139)..(139): n is a, c, g, or t
  misc_feature (245)..(245): n is a, c, g, or t
  misc_feature (247)..(248): n is a, c, g, or t
  misc_feature (337)..(337): n is a, c, g, or t
catgtcatgtttctcatcttagaactatcacatgccttttattctcttgnnntnggtaatacnntcnactcctcttcattnccatatgncangantactnccataatgaactcaatcattagcagtgatcatngaaagnaaggcctctgcgcaatggtaacacataatctagtagatgagactggtattaaaaataaataatataacatatatcagaataaaagattaactattaaagtggggcnannaaaagggaggagggtatatggtgatgtttcatgatggaggtcaagaaaggtcttgaagagcatttgatatttaactagatgtgtgggtnaaagcctcacaaaatgatccataagagaaggcagttctacatagaagaggaaagtgcaaagaattgttgaatttttaaaagtcaagttgttttcctagctgaagtagaatgagcaagaggaaagcagaagctgacatgagaaagggacagaattcagcacagatgcctgggctgcatcgtactcatgacagaataaccaggacaggtgcct

SEQ ID NO: 3818 - DNA, 517 bp, Mus musculus
  misc_feature (305)..(305): n is a, c, g, or t
  misc_feature (324)..(324): n is a, c, g, or t
  misc_feature (327)..(327): n is a, c, g, or t
  misc_feature (380)..(380): n is a, c, g, or t
taattctttgcaatcccatgtatagactatagaatatatgtatagactatagaatacatgtatagactatagaatatatgtatagactatagaatatatatagatatgtatatatagaatatatatatagaacatatatatagattatatatatctcagttaaattactatgacagatatctcattaaaataaaacaaagactagatcatcacacatcaaaagattacatatctaagaagaaaatagaataagaacccgcatgcccatgttaagtactactagctcaaattatggtttctatatnacatgttctatggtccatnaanacaagtagaccagtaagacccaccattacatactgctttcctattccacagtnatattcatctacaataaaatgtcagttgcctaccgggggagatatgtgtttaggttgtgcttgtcatgctttccacaatgaactaagaaagagtttgctgttgttgtatgttgtctcactagtgtctggataaccta

SEQ ID NO: 3819 - DNA, 495 bp, Mus musculus
  misc_feature (183)..(183): n is a, c, g, or t
  misc_feature (199)..(199): n is a, c, g, or t
  misc_feature (202)..(202): n is a, c, g, or t
  misc_feature (215)..(215): n is a, c, g, or t
  misc_feature (265)..(265): n is a, c, g, or t
  misc_feature (320)..(320): n is a, c, g, or t
atgcttgtaccatggcacttgtgcacccactcctgtacacacacatatacacactcacatacacacacacacacacacacacacatatacacacacatacacacacacacacacacacacacaaagaaatgaataaatgtactaaaggtgtttaaatgtcttttcctggaccctctatttttntcactaaggttctgtnatngaacaactttgtnggtcattcaagcaaataaaatcttcattttgtgctcagctatttggctanactcacaggcagattttgatatgaattgtcctgtacatttgtgatttctctcttntgttttttatccaagaaaaggtacattttttgtacatttactgaaatattcaaaaataaatttgtgctcagctttgtctttcacaaaaccaaaccctaacaccacaaattgatcccaccttttctggtctctgtgggttattcaaatagccttcttctaaggctttgtttgggca

SEQ ID NO: 3820 - DNA, 418 bp, Mus musculus
tctgtgtctgtgtacgggcatgcaagtacaggtgacaatggaggccagaagagggggcattaaacccccttgagcttgagttgcaattggggaggcccccgacttaggctctgtgcattaaacttaggtgctctgcaagagcagcacgcgctcttaaccatggacccatctccccatcccctgtgtgatgttttgttttgtattttaaagacagggtttcacagcctgcttgcctccacttccagataagtcctggatctataagtgcccccacacccagctccagtttcagatttaatttgcttaaagtaaatgtttcagataatgtcattgacaagaaaacgagccagtctcgggactctttttcactgcggttagccagctcttggcttagaaaccttacaatcgctgggcagtg

SEQ ID NO: 3821 - DNA, 474 bp, Mus musculus
tctaccaagctgcacatatctctgtccctggaacggctaagtgtccagctggcctcctcctttccccaaccttttgatgcatcccgtctggaagaatggctcagtgatgtggtccgggctgcctacatgcagaggctcaacgagcacctggaggttggaattcccctgcctaagattctcaatgtcaactttgccaattcagtggtcgatatcattgagaatgcagttgtgctcacagtggctccgtgaggcggtatggctgctgctctccctgttcactacagagtcctatctgtctgcccactctgcctcagtttccctcccagtcttaagcctgcattggtgacagtataagtgccccttgcccacccgggcccaccttgccctctgttcctgtgatcatgcctgttttggggtggggatggctggatagccactgatctgcttcagaaagcacatagcaccttggttcaa

SEQ ID NO: 3822 - DNA, 515 bp, Mus musculus
  misc_feature (279)..(279): n is a, c, g, or t
  misc_feature (284)..(284): n is a, c, g, or t
  misc_feature (305)..(305): n is a, c, g, or t
  misc_feature (403)..(403): n is a, c, g, or t
  misc_feature (439)..(439): n is a, c, g, or t
gtttgattttcatagcctcagtgtttatgagaggaattatccaagaagaaaactaaattttaccatgggcttattttcaggcttttgagttttacttacaattgagctgggtttgtatgttatatgaattgtgcctgctttctccatgtgtctagaggaagagccatctacttaaaggccacaggggcaagctggctgtgcgctggctgtgctcaggctgtacatttgaaattctgaaaacaaagcatttttcataattttctcccagttcactggtgnaactnacccttctgtgatttggattnagcttgactagaggagaaatcattattccaacggtgaagtactcccgtggcatctaaacccagaagagaattaggaaaatggctttaattacatgctngtctgtttgacaggcagtaaggaaaggggagttctncctttgaaaagtgaaagagggtctgtttggaggaggggactgtcaatacaattccatgcatccctattgagagtta

SEQ ID NO: 3823 - DNA, 531 bp, Mus musculus
  misc_feature (117)..(117): n is a, c, g, or t
  misc_feature (120)..(120): n is a, c, g, or t
  misc_feature (124)..(124): n is a, c, g, or t
  misc_feature (143)..(143): n is a, c, g, or t
  misc_feature (150)..(151): n is a, c, g, or t
  misc_feature (184)..(184): n is a, c, g, or t
  misc_feature (188)..(188): n is a, c, g, or t
aatgtgtggcctattctatgacgcagaggtagaagagtgggggataaagatttattaaagggaataaaggctgtaatggccaaaataaatttatacaacaggtcactggttaagatngcngccnttggatatctgaggcagcnaaagaanncaataaatgtgagtgttgtgtgaattgctaggntagnctatttatgacaagaagctactttctgtaattctttacaattgacctggggcctaaggcatgcactttcacccatagcgagtaaagtgttgcccctgcacctccttaaaattccccatcccttaagaccttccagccctcactgtccagctcagctctgttacctatgctatatgatatgggtcactctttctctggaaagggaggcttggttaacctgtgacccacatacatggtacggttacttgtctacctgaagtcagctggccatttagggtctagcaatctgaaaaatctatctctgggaagcaaggcttccctgttatgccaggtggtcccacaaa

SEQ ID NO: 3824 - DNA, 437 bp, Mus musculus
  misc_feature (183)..(183): n is a, c, g, or t
  misc_feature (191)..(192): n is a, c, g, or t
  misc_feature (216)..(216): n is a, c, g, or t
  misc_feature (226)..(226): n is a, c, g, or t
  misc_feature (234)..(234): n is a, c, g, or t
  misc_feature (243)..(243): n is a, c, g, or t
  misc_feature (251)..(251): n is a, c, g, or t
tttgagcagagcttggtggtgtacacctttaatcccagcattctggaggctgaggctgatctgagtttcagaacagctagggctgtgtctgaaaaaaaaatcacacatttggtttggttatgtgaaaaggagactagcaagtatttgttttgagactgggtctcattgtatattccaggctancctagaanncacagtgtagttgaggctagcccnaatttgatgncaatcttnaggccttancctctggnaggactgcgattacagtgtgagccactagactggctggttattaagtttagagatttcatgctgaagaaaggtctgttggtgcatacctccaacatgtgtgtcatatggaaggccagtgaggaagtgacacttgcccatctattaaaatttaaattgtcttgtgggtcctcattatcttttggttt

SEQ ID NO: 3825 - DNA, 545 bp, Mus musculus
  misc_feature (144)..(144): n is a, c, g, or t
  misc_feature (164)..(164): n is a, c, g, or t
  misc_feature (213)..(213): n is a, c, g, or t
  misc_feature (238)..(238): n is a, c, g, or t
  misc_feature (279)..(279): n is a, c, g, or t
  misc_feature (347)..(347): n is a, c, g, or t
  misc_feature (368)..(369): n is a, c, g, or t
  misc_feature (457)..(457): n is a, c, g, or t
acagtgagcgcacggaaatcctcccctaacctctcttcctcactgagctgagtactgagcctagacgctgacctccttgttcactagcacaggtagagctggtcttagggagggtgtgaaactgaatctgtgggtggatttagnattagagtcggggaaacttngggcccatgtaccacatgtgcatggttatggattttggtaagtaaatgntttagtggaatatcgtcatgctcantcatttatattttagttttttgagaccaactctcatgtagncccaggctggtctcaaactcatgctgtacccaaggctggcctttgcctcctgactctcctgtctttgnttctcagctgttaggattatnngcatgcggcaccatgccagcctacatgttatgtatggctgccctttcactgctgtggtggagttaagtaggcctgatagcctgtgtgntctgcagaggctgaagtatttacagacaagtttgccagtcctctagcggtgtccctgatctatgtaagatcgcttggattggcaatga

SEQ ID NO: 3826 - DNA, 502 bp, Mus musculus
  misc_feature (112)..(112): n is a, c, g, or t
  misc_feature (120)..(120): n is a, c, g, or t
  misc_feature (140)..(140): n is a, c, g, or t
  misc_feature (323)..(323): n is a, c, g, or t
  misc_feature (386)..(386): n is a, c, g, or t
  misc_feature (391)..(391): n is a, c, g, or t
  misc_feature (407)..(407): n is a, c, g, or t
  misc_feature (449)..(449): n is a, c, g, or t
  misc_feature (463)..(463): n is a, c, g, or t
gatggctgcaaaagaccaacctagaggaagtgattctggggaggacatgccatccaacagtcaaagcagagtcactggactgctggtcgtcacataaacttgtgactctgcnattgcccnagtgcaattatccttacggnatcctgacccaagaggctcacccttgaaagcctgggggtgggggttagaacccggggtctgaatgccaggaaagctccccatggttctgacatcttgttgctttagatggggactttcagataattctcttagcttgatgctgagtaggatgaggctatgctgatggtctctgtcaggagcgnaaaagagaaatggaggaaccgaggcaggtatcttaaggagtctgggtccaaggagctgagganccttnacctggaaggggtacntctctcaggtttgtttctttgttattaagtttcccgggctgnccttgaacttgtcntcctgctacagcatcctgagcgccgggattacaaatgtg

SEQ ID NO: 3827 - DNA, 538 bp, Mus musculus
  misc_feature (138)..(138): n is a, c, g, or t
  misc_feature (154)..(154): n is a, c, g, or t
  misc_feature (172)..(172): n is a, c, g, or t
  misc_feature (176)..(176): n is a, c, g, or t
  misc_feature (182)..(182): n is a, c, g, or t
  misc_feature (189)..(189): n is a, c, g, or t
  misc_feature (222)..(222): n is a, c, g, or t
tgcaactcaccacgtgtaacctggattcaagtccctgtaacttagaaagccctagacacagaaaacaaaatgcccagtgtttggccctgggccactacaaatctcagagtgttaataaaccaatattggggccacacngatgagaaagcattgnattcagtaaatacttcanggancataantgtgttnaaatccaaggaatctgccacgaaggtctgatangacctctagtctgctaatgtcaacagagtcccttggttacttcctgcctgtaatgagctcagctccgtgataaaatgagtccatcctgtcccgggacatgaagtccccacgagaggccagcatctcacagactaaatgtggatggtctccacctttctttttcaaacaaacatccaagttagataggtgtggatacaacagaagaaattacccttgggtgtggagcctctgaatagcaaagtaaagtaacagaggaaggaattctatggcttctactcaaggaatctgtgagaaaggctagaatccctcttggctt

SEQ ID NO: 3828 - DNA, 334 bp, Mus musculus
cattcttggtagcaatttctaactataacaattttagggagttgttattttgaagcttttacctatttagtattccatgcatccttgtaaaatgtcatatttgataatgtttacaagatggctgtaatggcatacaactaaagaaacttatgaattaaaaaacaagcactgtttctactctaaaaactttcagtggaaaagctgcctgctgctgtaaccaacagaggctcagtggttcaggactagcactgaaccacaatgctcttagctttagaaactaaaatgtaagtcaaaagttgtcaacacccaaatgagacccacagttgattgtatg

SEQ ID NO: 3829 - DNA, 485 bp, Mus musculus
  misc_feature (43)..(43): n is a, c, g, or t
  misc_feature (60)..(60): n is a, c, g, or t
  misc_feature (101)..(101): n is a, c, g, or t
  misc_feature (103)..(104): n is a, c, g, or t
  misc_feature (111)..(111): n is a, c, g, or t
  misc_feature (114)..(114): n is a, c, g, or t
  misc_feature (122)..(122): n is a, c, g, or t
  misc_feature (129)..(129): n is a, c, g, or t
  misc_feature (131)..(131): n is a, c, g, or t
  misc_feature (165)..(165): n is a, c, g, or t
  misc_feature (169)..(169): n is a, c, g, or t
  misc_feature (172)..(172): n is a, c, g, or t
  misc_feature (232)..(232): n is a, c, g, or t
  misc_feature (261)..(261): n is a, c, g, or t
  misc_feature (272)..(272): n is a, c, g, or t
  misc_feature (275)..(275): n is a, c, g, or t
  misc_feature (277)..(277): n is a, c, g, or t
  misc_feature (293)..(293): n is a, c, g, or t
  misc_feature (368)..(368): n is a, c, g, or t
  misc_feature (382)..(382): n is a, c, g, or t
  misc_feature (393)..(393): n is a, c, g, or t
  misc_feature (435)..(435): n is a, c, g, or t
  misc_feature (438)..(438): n is a, c, g, or t
  misc_feature (445)..(445): n is a, c, g, or t
gacctcgggagttgtagctgctgttcagatgtctaaaggaggncttagagagcagcctgngaataagacttaacttggtggtgactgcaagtgtgcaggangnngaggcanaangaacacancttttangncagcctgggctatgagagcttggccctacagttncccnagngtgtagtacatacatatgtgcatattacatgcttttaattaggaaatgttttaatattcnagataatacacatataaatacaaagaatnaaatataaaanaanantaaactaaatctaaanagaagggtgggaaggcaggctcgttggttttgagtatgcactgctctagcagaaggtttgagtttggttcttagnatctacactgggtncctcacagctncctgcttgtaactccacttgcaagggatcagacaccctttantgnactcagntccccgaactcacattccacatacccctatagacagacag

SEQ ID NO: 3830 - DNA, 331 bp, Mus musculus
  misc_feature (115)..(115): n is a, c, g, or t
  misc_feature (130)..(130): n is a, c, g, or t
  misc_feature (279)..(279): n is a, c, g, or t
ttagaacccactcttgcatgggctcttctgaggatgactgtcccctcagtgtctcctattgtgaactactctaatacaggagtagtcacttgtgagaatcccaattcatggctgngacctcccttttcanaagctggctgtttgagtgtgtcctccacctacattttacctctctaaatccaaagagaatttggcagaaacaagggccacaatttgcgaaaaccaaaaggctgtggagtgtccctgatctggctgaatctcttggctgggtaggtggancgaggagcagaacaaatagtgaaaaaaactgtgcaaccaagttctcatatat

SEQ ID NO: 3831 - DNA, 529 bp, Mus musculus
  misc_feature (31)..(31): n is a, c, g, or t
  misc_feature (144)..(144): n is a, c, g, or t
  misc_feature (155)..(155): n is a, c, g, or t
  misc_feature (158)..(158): n is a, c, g, or t
  misc_feature (163)..(163): n is a, c, g, or t
  misc_feature (173)..(173): n is a, c, g, or t
  misc_feature (202)..(203): n is a, c, g, or t
  misc_feature (217)..(217): n is a, c, g, or t
  misc_feature (242)..(242): n is a, c, g, or t
  misc_feature (443)..(443): n is a, c, g, or t
  misc_feature (452)..(452): n is a, c, g, or t
  misc_feature (462)..(462): n is a, c, g, or t
  misc_feature (465)..(465): n is a, c, g, or t
catgcccattctgaaggaccttttacagcanacagccaactggaacaagatgaatgtggaacagtaccctgcctctctggagtgctataatgagttgggacatgtctctgtagaaagatttgcccaactttgtcaggaactcanggatacactanggncaatnaggcagcccnagagcctctcttttgctacacgtatatgnncacaaatgtggtgnagtgctgtgtctatggcaagagagnccagactttgtttttgctggcggtgaacatggattcagaacttctgcatgtgaataaatgacagtcttgagacacatctctcatctggggtgctcagagactgacttcaggcaatgtacagatacttggaaaggaaaggatgtgcaataattgggatcttggaggctaagcttgacatggggagcagacttgtggactgancaaaggcanacttggatgnttnttgaattgactctgccaggacagattaactagatcctttgtcatggacttgtaaactttttgtt

SEQ ID NO: 3832 - DNA, 494 bp, Mus musculus
agtcgtaggctctgcttcagtggaagaaaggccagggaaagctgagcgtggtcttctcattgttgttttctcaggtatcaagatgctgggacacatcctgagctccacttaggggtatgtgaaggcagtgctcagtcttctacagacacagtgtgaaaggaataaacactcgtgtttgtaacacatgcaatgggatattagcattcttaaaggaaagcgacattctggacagatacctctgtgggtaaaatgcttgccaagcaagcgtgtagacttgtctttgtatgtccagcactcatacaatagcatgtgtggatacagtatgcttggaactcccattgctcagggggcagagacaagcaaattactggtacttgtgggtcagccaatcaggccagtgtggcctagtttcagtgagagaccttgtttcaatgtatagacaggagaaaacacccagcatttacctctcgcctgcatccgtttagctatgagtg

SEQ ID NO: 3833 - DNA, 477 bp, Mus musculus
  misc_feature (147)..(148): n is a, c, g, or t
  misc_feature (153)..(153): n is a, c, g, or t
  misc_feature (295)..(295): n is a, c, g, or t
  misc_feature (300)..(300): n is a, c, g, or t
  misc_feature (308)..(308): n is a, c, g, or t
  misc_feature (317)..(317): n is a, c, g, or t
  misc_feature (320)..(321): n is a, c, g, or t
  misc_feature (330)..(330): n is a, c, g, or t
  misc_feature (349)..(349): n is a, c, g, or t
  misc_feature (355)..(355): n is a, c, g, or t
  misc_feature (357)..(357): n is a, c, g, or t
  misc_feature (360)..(360): n is a, c, g, or t
  misc_feature (369)..(369): n is a, c, g, or t
  misc_feature (379)..(379): n is a, c, g, or t
  misc_feature (394)..(394): n is a, c, g, or t
  misc_feature (403)..(403): n is a, c, g, or t
  misc_feature (414)..(414): n is a, c, g, or t
  misc_feature (416)..(416): n is a, c, g, or t
  misc_feature (430)..(430): n is a, c, g, or t
gagtaagtagctttctgctctgatccaaggaacgatgctatctgctcccagtcagtgtgcttggtaatattccttcctatgcacttgtgtgaatctagaaagcaaccttttctatttgatctatggtaaagataacaaatgtgttgnncttancaagtgaaggaatagggctgatgagatggctcagcgggtaagagcactgactgctcttctaaaggtcctgagttcaaatcccagtaacaacatgatggctcacagctacccgtaatgagatctgacgccctcttctggtgtntctgnagacagcnacagtgtanttnngtataatanataaataaataaataaatntttaananacnaaaacaacnacaacaacanaaaacaagtgaaggnatagaggtntcttcagccantnacctggatttcatnacaaaaaacagtttaaataaaataggctgctccttcttaaagttttc

SEQ ID NO: 3834 - DNA, 563 bp, Mus musculus
  misc_feature (86)..(86): n is a, c, g, or t
  misc_feature (328)..(328): n is a, c, g, or t
  misc_feature (347)..(347): n is a, c, g, or t
  misc_feature (353)..(353): n is a, c, g, or t
  misc_feature (361)..(361): n is a, c, g, or t
  misc_feature (378)..(378): n is a, c, g, or t
  misc_feature (403)..(403): n is a, c, g, or t
  misc_feature (411)..(411): n is a, c, g, or t
  misc_feature (419)..(419): n is a, c, g, or t
agtagcttgttagaggcagtcctgttatattgtatgtgggccttgttctgctcctacctttatactgctgccttctcccaagtgangaagccttgcttcttatgtttagtgttgttttgttttcttcttagtgaaaaatttcacatctagctatttctaaaaaagtgtatttcttttgtttaagcttcactaaattataacacattgtatgtccctgtgagacgtttttgtttaacaatacattactaagattcatccttactgcagtgtgaagtaactcacagcttcaaatgctacaacaataatagaccagttaatggacacgacntaagttttcaaagactttnctgatntgatcgtnggtattgtaatgttgtncagtctctccttgtccatgcatacntttctctnggctatanatctaggagtaagaagtgtagatagtagtgtacgtcagtgttctctgcttcaggacatgagtcctaattccagtctattcacttctctgcactgtactagtagcatgtaagagacccgtgtgcaggcatcgtttctaacactgt

SEQ ID NO: 3835 - DNA, 563 bp, Mus musculus
  misc_feature (344)..(344): n is a, c, g, or t
  misc_feature (356)..(356): n is a, c, g, or t
  misc_feature (365)..(365): n is a, c, g, or t
  misc_feature (378)..(378): n is a, c, g, or t
  misc_feature (401)..(401): n is a, c, g, or t
  misc_feature (405)..(405): n is a, c, g, or t
  misc_feature (409)..(409): n is a, c, g, or t
  misc_feature (432)..(432): n is a, c, g, or t
  misc_feature (441)..(441): n is a, c, g, or t
  misc_feature (450)..(450): n is a, c, g, or t
  misc_feature (484)..(484): n is a, c, g, or t
  misc_feature (513)..(513): n is a, c, g, or t
tagtcctagctcctggaaaggtgaagcaaaaggctcaaatgtgtgggccatagagggagttcaggactggcctgaacaatttagtgagatgctgtctgaaaataaaaagtgaaagaacactaaggttgtggcttaacagtggagtgcttgcacgggtctgaggccctaggtgtaatcccctttactacatgtaggaagacaggcaatcacgtcataggcggttaaggagaagctcttcatgtgctggtctttgacagcttgtctatctcccagtgcttgacagttgtggtagcaaccatgcagccggcaggcattcaagcatgcagacacagtgttccatccantccttgttcagncctcagatntcaagacccttanctcagagtgttagagttcttgtntaantcantattccatagcatttgatactanccagtgttncagcttttntcttagggtgtctgataatgttgattttaatganttcatggtttccaggagctcttctagcgnacagagcccgtagttcctcctatctgtctccttattagtcttttatccct

SEQ ID NO: 3836 - DNA, 376 bp, Mus musculus
  misc_feature (195)..(195): n is a, c, g, or t
  misc_feature (199)..(199): n is a, c, g, or t
  misc_feature (204)..(204): n is a, c, g, or t
  misc_feature (218)..(218): n is a, c, g, or t
  misc_feature (220)..(220): n is a, c, g, or t
  misc_feature (222)..(222): n is a, c, g, or t
  misc_feature (238)..(238): n is a, c, g, or t
  misc_feature (250)..(250): n is a, c, g, or t
  misc_feature (252)..(252): n is a, c, g, or t
  misc_feature (257)..(257): n is a, c, g, or t
  misc_feature (295)..(296): n is a, c, g, or t
  misc_feature (317)..(317): n is a, c, g, or t
  misc_feature (347)..(347): n is a, c, g, or t
tgaaatgaaccctgtatggactagtgtttgtggcgctggaaggcactctatatgctacaaatggggaaggtaaaggccaaaccaagtacgaaccctttgatctatcatgatggctttctagcaagattaagattttgagttgttcaatcaccctgccctgttatagaaaacaacttatccaaagccactcaccanctanttggnagctcagtcaggangnanctgagaatccttttgntacttcaattantnttctngatatactacctcagttttattaagtgtggaaaggtgnnaatgagtaattaaacttttantcccatccaaataaatgcgtttgactacancagcatgttcacaatgtggcagcttcaca

SEQ ID NO: 3837 - DNA, 546 bp, Mus musculus
  misc_feature (333)..(333): n is a, c, g, or t
  misc_feature (354)..(354): n is a, c, g, or t
  misc_feature (360)..(360): n is a, c, g, or t
  misc_feature (366)..(366): n is a, c, g, or t
  misc_feature (371)..(371): n is a, c, g, or t
  misc_feature (377)..(377): n is a, c, g, or t
tttgcccgatgaacttaccttacactccttcagtcgaatacactgagccccactctggctttctagggaaggttgctgggagtggaagtgagaggtaaagaagtgtagctaccattgaacacttcctccgactcgagaacctgcccttttggatgaggctctcactgtgtagcctgactggcctgacgtggacttgtgtctgccctgcttctttctgcctgccagctgttgggattacacgtgttttactatcacgtttgactttacatatgggctttaaaaccaagttttcatgggcagaaagaagaaatgaaagcatagtgacagggaaancacagagttttgggtgtcatntagctntgaaanggtgnccactntactgtgtatagggttccataaatgctaggccccacaggatagtgtggaggcagagctttaccagacagcatttgtaaagggactctgaactatctggcttctgttcctttctgtgcattgcttttctgatactaggagaaaaagacttcactttgatgcttgtgtagt

SEQ ID NO: 3838 - DNA, 479 bp, Mus musculus
  misc_feature (156)..(156): n is a, c, g, or t
  misc_feature (257)..(257): n is a, c, g, or t
  misc_feature (454)..(454): n is a, c, g, or t
ggtcaaaattcactacttgctgagcacctattataagcctggttctattgtagatgcaaaaggtccattgatgtggaccttagcaagttacctgccccaaacacaggtatatggggagctactaacgaagtcatctccatgttagttgctctcccnccactacccttgggccagagagaccaaagccattgcacccagctgtgccagctggtgacaacggagaaagagcaagcggtagtactccgtgtgggcaaaanatgcagacgccctgagcaggtgggccaggctcagccctggtgggtgttgctggagagggggctaggtacggtgaggactctgcctgcgggggcggagggcgcggatgtgggaaagcagactctgcccgcagttgcctgggccgccgcgcctgaccgccgagctgcgctcgcctgctccccgccctctgggaccgtgntgaagctctgttccccatactgagc

SEQ ID NO: 3839 - DNA, 364 bp, Mus musculus
  misc_feature (26)..(26): n is a, c, g, or t
  misc_feature (57)..(57): n is a, c, g, or t
  misc_feature (66)..(66): n is a, c, g, or t
  misc_feature (76)..(77): n is a, c, g, or t
cttgttggctggctggcattccctcnaaaagaagggtgaccactgccatctagtggntgatcacanaaacagcggnnaaggtctgtacaacctgatctttgaggtccacctttgagaagtcacctgtcctgtaggcagaactggggtgagggggccgtgtctttccctgaactgcaagcagtcccaagcttgctttttgaaaggagaattgacacttggttggactgctttgcacagtccttttcagagcccaatcttaggtctgcagagatcctcttcctctgtgcacaccccagcacttccctttttaaaagtcaccagtggcttcttgcttggaaaatcagaggaggccttacggtctagt

SEQ ID NO: 3840 - DNA, 403 bp, Mus musculus
  misc_feature (356)..(356): n is a, c, g, or t
tacaccaaccggatgagcctcaacgaggaggagataaaagatgcaggcccagccaataacaaagattggcatcggaaatctaaggaggcagacaggcagtatgacatccccccacagcacagattgcccaagcagcccaaagatggcttcctggtggagcaggtgttcagccctcatccttaccccacctccctcaagggccacatgaagagcaaccccctgtatacagacatgcggctgactgaactagctgaggtgaagcggggccagccttcttggaccatagaggatatgctcggaactccggtgacaaaggcaagctgacagctctggacctgcagcacgtgggataagcntgtttatgggagccaagctatggattatgtttccatacggagccacc

SEQ ID NO: 3841 - DNA, 85 bp, Mus musculus
gggactaggatcacttactgcctaatgctaccaagaacggtcaaagtgccaacctggtgtgatggtcttctttacttcaagatag

SEQ ID NO: 3842 - DNA, 483 bp, Mus musculus
  misc_feature (291)..(291): n is a, c, g, or t
  misc_feature (367)..(367): n is a, c, g, or t
  misc_feature (387)..(387): n is a, c, g, or t
  misc_feature (417)..(417): n is a, c, g, or t
  misc_feature (435)..(436): n is a, c, g, or t
  misc_feature (447)..(447): n is a, c, g, or t
atgggtttttacatctctttctccggcatcgtgagttccgtaatgctgaacaactcagagatgcggcgcgttatgtgccactggatcgcatcctggtggaaacggattcaccttaccttgcacccgtaccgcaccgtggtaaggaaaaccaaccggcaatgacgcgcgatgtagcggaatacatggcggtactgaaaggtgtttcacttgaggagttagccgttgcgacgactaaaaacttcgccacgttgttccatattcctgactcccgcctgcaatccgcctgataantctaacttattttaaagctcgtaattaataatcgaagcgagtaaagtgcaccgccacaaaacaggcggtgtacgcnatttttgtaacatacagaancgcattttgtaaatttatgaaagtttttcntatggctattagagaaanntgatagccgtnaaacaaactttcgtcgatttattttactctgcgtaa

SEQ ID NO: 3843 - DNA, 406 bp, Mus musculus
  misc_feature (37)..(37): n is a, c, g, or t
  misc_feature (40)..(40): n is a, c, g, or t
  misc_feature (58)..(58): n is a, c, g, or t
gcacacagtagggatactattcctctgctccctccanggnccatgaccaggtctcagnatgggcagctcccgactacacagatgcagagctcacacctgtattcactcaggtcaacacaacagctagacaagggtacaggtacacacccacacccacacatcccccacacccacacacatgcacacccacacacccgcaaacacaggcacgcacgcgcacacgggtgcacacacacacacacacacacacacacttccacagactcagaatacagatgcttgtttagacacataaagacacaaggacagaggcactcatttgcacatgggcatacagacagcaacagctataaaagatgagtcttgcaggttggctcatacttttcttttcagctgtgtgggaagt

SEQ ID NO: 3844 - DNA, 461 bp, Mus musculus
  misc_feature (193)..(198): n is a, c, g, or t
  misc_feature (222)..(222): n is a, c, g, or t
  misc_feature (225)..(225): n is a, c, g, or t
  misc_feature (275)..(275): n is a, c, g, or t
  misc_feature (280)..(280): n is a, c, g, or t
  misc_feature (331)..(331): n is a, c, g, or t
  misc_feature (335)..(335): n is a, c, g, or t
atacttcagtgcgtgtgtgtccatgtcctgggtagttctttctgtctgtgaaggccttagagttcccagttggctgctgtgcctgctctatgtgattcagacttccagccagaccccaccccacaggataaaggcctcccagtcttgaggtctcccttccttgcctcctccttccctcctgtctctgtttctnnnnnnccatccctttcattctctcccatnccntcccttctcctttccttctgtccccataccaactgctaaataccgtgttnaaggnccagtgagatggctcagggaggcaaagggacttacacaggcctggcagttngagntttaatctccagaactatgtaaaggaaggaaccaacttcgtgaacttttcaactgatatatatgtatatcatgcacacatgcatatttttttttcaaatcagaaattgtgttaaagccaggcgtgg

SEQ ID NO: 3845 - DNA, 284 bp, Mus musculus
  misc_feature (43)..(43): n is a, c, g, or t
  misc_feature (52)..(52): n is a, c, g, or t
  misc_feature (61)..(61): n is a, c, g, or t
  misc_feature (84)..(84): n is a, c, g, or t
  misc_feature (86)..(86): n is a, c, g, or t
  misc_feature (91)..(91): n is a, c, g, or t
gagggtaggtatcttatctcacaccagagctttcagagcaggntttccccantcggcctgntgacatgagagcacagggatgcntntgtgncacgtggggagtccttgatgagctcctgcacatgcaggcagtgcctcctacagtatggtttcctgcactggcagggcagcgcctccgacagtgtggcttctcagttgtgcaggacgatgggctattcccttacttgagtgatggatcatggtctgtctgttccatagatagacatagagtaagccaggcagtg

SEQ ID NO: 3846 - DNA, 525 bp, Mus musculus
ttccctcgtttttcaatgctagtgtctaaacctaggaccttactatatcctagacaagcactccatcactgagctatacctccagctctaacataattaattttgtaggtgaagggagaaagcaattaagtgatttatgaaataaaataacaggtaagaggctgattgttcagtgggtacaagtgcttggctctgcaagcacaagggcctgagttcaaatcccaaacacccctatggaaatgcaggcatgtctgtgtgtgcacttggcagtaatgagaggcagatgctgaaagttcagtggccagccagcctagccaaaatggtgaacttacggttctatgagagactgagcctttggttccatgagaaaccccatctcaaggtgtgtaagtcagagaatgatagaggtagctctccctttcactctcctgctctggacacacgcacacaaaaacatacccgtgaagatttttttgttgtggttcataagcatgatgattgagtatttgcatcgcatgtgcttcc

SEQ ID NO: 3847 - DNA, 484 bp, Mus musculus
  misc_feature (213)..(214): n is a, c, g, or t
  misc_feature (231)..(231): n is a, c, g, or t
  misc_feature (245)..(245): n is a, c, g, or t
  misc_feature (269)..(269): n is a, c, g, or t
  misc_feature (279)..(279): n is a, c, g, or t
  misc_feature (283)..(283): n is a, c, g, or t
  misc_feature (297)..(297): n is a, c, g, or t
  misc_feature (316)..(316): n is a, c, g, or t
  misc_feature (332)..(332): n is a, c, g, or t
tatatgcaatgcactcactctcagcatacgtctcaggacggacagatgccaccctccaggactaaaacactcacgtctttctgtgctggatgctggaacagagaactaactatgagtagaaggagcagagaaagcggtgacacctgagactggaggctaacagaggcaggcaaacgggctttaacagcttggagagttcaccacgttcctcgnnggcaacctttaccggantttattggactccntttcacaacggctttgaatcatancagcattacntggnatactgagtctgtncccaacactcaatggaggnaaactttcaaatgccnaactccatgcacatggtgagttttcagataggatcatgggtggcagaagaggcagtgtcaggcatacaagcagccacacatacaagcatatatgactaacctacatatttgtgataggcatatgtcagaccagccagcattctcagatagta

SEQ ID NO: 3848 - DNA, 526 bp, Mus musculus
aaaggtgctgtcagagttgtatctctggatgtgctcggggttgtttggcctctttataatgcacgtgaagttgtgatcaacaatgtacaacgtgttatctacgactcaaaggcaaaaatgctcctaatgttttcagcaactttatgattttgtattattttttaagggcagtcctttaaaggaagcatcattttagtgctaggcagattgtaaagatgaagagaccttctctgctagcagaaataaagagctgcaccattgggcaaaatattgagttgataagctgttggtattttacagtttagttttttttcctgaaagcaactctgatgtagattttcaaagttaaacttttaaaacacctggaaccagtggttttgaagtcattaatccctttctgttctgtgcttttgaaggtaaatcttttccctacttcatgggtaccttaccctgagctgtgcttgtgtgttcagtgagtgatggcaggcagtacatgtcacccccttttcagggagcatctttaaat

SEQ ID NO: 3849 - DNA, 533 bp, Mus musculus
  misc_feature (150)..(150): n is a, c, g, or t
  misc_feature (167)..(167): n is a, c, g, or t
  misc_feature (169)..(169): n is a, c, g, or t
  misc_feature (175)..(175): n is a, c, g, or t
  misc_feature (195)..(195): n is a, c, g, or t
  misc_feature (200)..(200): n is a, c, g, or t
  misc_feature (226)..(227): n is a, c, g, or t
  misc_feature (244)..(244): n is a, c, g, or t
  misc_feature (265)..(265): n is a, c, g, or t
aaactgagatttggtctcacccaaaatttaaagagactgtagatccttgctcagattatttttcatggataggcacaaactctcagttactcagtcaagtttctcatccctcccagctgacaaccttgtaagatttgtactgacaatttnctttgcagttcatacangncttttnaactcttgagattgatgccntgccntgctgtactaagagggcaatattttnnaatcttatttaccaccnaaaatgtgcattctacatacnaagataacattaacctctttatccacaacccgcatgcatatggctgttctcttgccctacagtttaatcaggagatggagtaacctgagcattttgtcttctcatacgaaatagcacaggtatttcttcatcggaacgtaaattccttaattcagctataagcatgtgtgggaattggatgctctgcataaaattggtttatgtaaagctatcagtgagcaatattcactcaatacatattctatgcatcatgtcagctttcttcttg

SEQ ID NO: 3850 - DNA, 417 bp, Mus musculus
ttgaacagagcttgtaaacctcactccgcccttttctggattggtgaactttagtttctcaagtctctctctcagcctctgcttaaaggagagtgaaaaatccctctctacttcaccagataacttttctgagtggggagcattgttagagtgagttgtaaataagaatgtggctcaaatgtggggtgctgttctgatgccccacaggcttctgcttatctgctagaggctgggataaggatgccctaggaagtttattattgatgcagaagttatattccccatctctggaaacttaacccatcagaggacagaaagtgatagtgaaaaaagaggggaggggtgggagagggagctctgctttgatttgccctaaggaaaaacatgtagtaaatcaggatatgctcaggctgggca

SEQ ID NO: 3851 - DNA, 541 bp, Mus musculus
  misc_feature (30)..(30): n is a, c, g, or t
  misc_feature (35)..(35): n is a, c, g, or t
  misc_feature (43)..(43): n is a, c, g, or t
  misc_feature (54)..(54): n is a, c, g, or t
  misc_feature (74)..(74): n is a, c, g, or t
  misc_feature (76)..(76): n is a, c, g, or t
  misc_feature (80)..(80): n is a, c, g, or t
  misc_feature (90)..(90): n is a, c, g, or t
  misc_feature (120)..(120): n is a, c, g, or t
  misc_feature (124)..(124): n is a, c, g, or t
  misc_feature (129)..(129): n is a, c, g, or t
  misc_feature (150)..(150): n is a, c, g, or t
  misc_feature (158)..(158): n is a, c, g, or t
  misc_feature (179)..(179): n is a, c, g, or t
  misc_feature (187)..(187): n is a, c, g, or t
  misc_feature (208)..(208): n is a, c, g, or t
  misc_feature (214)..(214): n is a, c, g, or t
tgttaatctccacgatcatttccttctccngtgcntgacctcnattcaatgacngacttcagacctagattttngngcangtattttctncaagccacccacgtgatttcaggttcccanttcntttangacattcagatttacatctgnaggacccnagaacctgccatacatatccntctattanctgacatctccgtttgtcagnatcttnggcacctcagatctaatctgcccaatgcaaatcttttgccccttccctgtccccagctccctacatcaacctttccatggagcactgacacgtaagaaaaattcaaccatatgatctagaaatatccaagtcaaactcagtcttttcctcacccactgtcttagttacgtttttatgactatgaaaagatgctatgtacaaagaaacttctggaagaaataatttattgggggctcacagtttcagagaatgaatccatgagcgtcttttttatttttaactttttattgattctttaagaatttcaaatcatacaacccaatccca

SEQ ID NO: 3852 - DNA, 519 bp, Mus musculus
  misc_feature (135)..(135): n is a, c, g, or t
  misc_feature (138)..(138): n is a, c, g, or t
  misc_feature (155)..(155): n is a, c, g, or t
  misc_feature (164)..(165): n is a, c, g, or t
  misc_feature (174)..(175): n is a, c, g, or t
  misc_feature (184)..(184): n is a, c, g, or t
  misc_feature (197)..(197): n is a, c, g, or t
  misc_feature (214)..(214): n is a, c, g, or t
  misc_feature (217)..(217): n is a, c, g, or t
  misc_feature (251)..(251): n is a, c, g, or t
  misc_feature (361)..(361): n is a, c, g, or t
gccagcgagatgactcggcttgtaaagttacttgccaccaaacctgacaacctgagcttgatgctaggaatccacatggtgtaaatggaggacagattcctgaccaattgtcttcctgggtgccatggcatctcngtncaacatataaacaatcnaataaatgnnagaagaaannttcaaattnttctctggagagntaaaaaataccttgagnaanctatgactgaaaatatctgatccagatctggtgnagggtggcgcatgccttttgttccagcacttgggagacagaggcaggcagatgtctgaattacaggccagcctggtctacagagtggattcctggacagccagagctacntagacgaaaccctgtcttgaaaaaccaaaagaaaagacaagacaagaaaatatccaaattagagtttaggatcctcccaattattaatgcatgtattattaatgcatgtttttatttcttatgctcacctggaatatgctgttgtatgcctttaggac

SEQ ID NO: 3853 - DNA, 499 bp, Mus musculus
  misc_feature (41)..(41): n is a, c, g, or t
  misc_feature (52)..(52): n is a, c, g, or t
  misc_feature (66)..(66): n is a, c, g, or t
  misc_feature (75)..(75): n is a, c, g, or t
  misc_feature (84)..(84): n is a, c, g, or t
  misc_feature (95)..(95): n is a, c, g, or t
  misc_feature (103)..(103): n is a, c, g, or t
  misc_feature (175)..(175): n is a, c, g, or t
  misc_feature (214)..(214): n is a, c, g, or t
  misc_feature (360)..(360): n is a, c, g, or t
atgtcgagtctacagagagctaccagaggggctttgtggtngtctgtcttgncatgctggagatgnaacctaggncctcagatnttctaggaagngttccacnaccaagctgcatcccaccccagtaacatattgtttggttggttgttttgagtcagagtctccttatgtaacnctggctgtcttagaactctctgtgtagaccaacctagtntcgaacccacagagatccttctgagtgttggaagtacatgtttcttgatttctaaagctgtacagtgatcccctcctgtattccagagaagatgttattagtcagttggcctttaccgtaacaaatacctgggccaacaggttaantcatcagataaaggtgcctgctggcaagcctaaggacctaagtttgattcccagaacccacacaatagaaagagagaatagaccccaagcaagtgtcctctggcctccacatacaaggtaaccgcctgatacacaaaat

SEQ ID NO: 3854 - DNA, 378 bp, Mus musculus
  misc_feature (36)..(36): n is a, c, g, or t
  misc_feature (58)..(58): n is a, c, g, or t
actgtattgcgttctaccgactagtctcataacgtnccaagcagttgttccttaagcnaagggcagaaaagtctggagagcttcctctgcagatgttgatgtgctggcgatactctaaaacagcatctggcatggtggtgcatgtctggttccagccctggggaagctaaggcagaggatcagaagtgtaaagccagcctgagctgcatgcgatcctataagaagcacactaacgtactgttaggctaggagtgtggctcatatcagatagagcacttctctagtatttgtgaagtcctgggttcaagggcaggtatgatggcgcatgcctttaatttcagcactcagattcaaggtcagtctagactactacaggat

SEQ ID NO: 3855 - DNA, 439 bp, Mus musculus
  misc_feature (37)..(37): n is a, c, g, or t
  misc_feature (80)..(80): n is a, c, g, or t
  misc_feature (102)..(102): n is a, c, g, or t
  misc_feature (257)..(257): n is a, c, g, or t
gacagagctttccatacacagtagagcacccaagtgncacattatggaagggatatggaacaatatcactgcaggtcccnaaggaatgggcagccttggatnagggatgaaatcacttggaagtgagctgaaatctcatgcccttttaagagctaacttaagcgataaatctgccctggtatctcctgtttccaggaaggtacatgttacggtcaagatgccattttttagaaaaggttgagggcaggtaggtaccnctagccgcgactgcccacccctctgtcagaggaggcctccaagcttggctggtagctcaaagcacaccgtgctcgcagcccttcagcactcatggcctcctcctttgagtgtgttttctatctgaccttccaaagccatttgtcttcttcagcatccactacccctctcatgatttagggat

SEQ ID NO: 3856 - DNA, 351 bp, Mus musculus
  misc_feature (120)..(120): n is a, c, g, or t
ttctggtcatctcttgagtttctctctgcttgtcccttaccaactgcgggccttctggggctcggagttcatgctgcctgtggagaggagccgttcctgcctgctaatgagagcaaatgnacacttcctactgagacctgctgcttataaagttagattcatgtacactttgaacacacacacacacacacacacacacacacacacacacccttaccgtagagtagtaacaaaactgtcctgcccagctcattacacaggtgtaggtacctccccctgccctagctttcccctgcgccccagctgtggatctgaattctaggctagctttcacaaccatcttacatgacg

SEQ ID NO: 3857 - DNA, 138 bp, Mus musculus
gctctttgaggaaccatgccagccacattctttttgggccagaattgttctccggtagctttgccaaagtgatcagctcacgacagaggaccagctgctgggtgctgttctgcagacacgtgacttctgtttcctgtg

SEQ ID NO: 3858 - DNA, 442 bp, Mus musculus
  misc_feature (161)..(161): n is a, c, g, or t
  misc_feature (181)..(181): n is a, c, g, or t
  misc_feature (183)..(183): n is a, c, g, or t
  misc_feature (189)..(189): n is a, c, g, or t
  misc_feature (211)..(211): n is a, c, g, or t
  misc_feature (226)..(226): n is a, c, g, or t
  misc_feature (236)..(236): n is a, c, g, or t
  misc_feature (239)..(240): n is a, c, g, or t
  misc_feature (244)..(244): n is a, c, g, or t
  misc_feature (248)..(248): n is a, c, g, or t
  misc_feature (287)..(287): n is a, c, g, or t
aagacagtcagtccctgcaaatcagtatcccagagagtttatgcccttgacttacaagaagccagttctaactcatcctttgtctaagccatagtaggtgaagacctctaattaaatggactgcataataatcgaaacatagaaagcatgcaagactatanttttcagaatttcaaagggnanagatanttggccatcccagcttcatcanccatgaatgtttgcncaaatcatgntgnncttntatntgggaacatttacctttgatagtgacctgtgatattganaattaatcattcttggtagaataaaaagtgcagaaatggatttaagagtagttatttcaagttggatttgttttaagcttaactagaataaacattaaaaagttttctaatcattctttgttctgtaattaggagagtaagctttatacactaat

SEQ ID NO: 3859 - DNA, 371 bp, Mus musculus
  misc_feature (209)..(209): n is a, c, g, or t
  misc_feature (213)..(213): n is a, c, g, or t
  misc_feature (295)..(295): n is a, c, g, or t
gggttttgtccgctctatccattgacttgcattctcttgttttctattggaaatacagatggtgcttgcatccttgatgctcagggtaaatggaggaagagtgtagttaaggcctctgctctggatcataggagtcaccttccctgcagcagcctcgactcactcagctctgtagtttctcagtgtttggtacatagatttccgtgganagtnccttctcggaacttcctggctttttctgtaaggggcccaatagtaaaaagtattgccaatgaaattctgaaaagtatttagnggatacatgagagaagcaatctccacagatttcttatcgatagagtttataaatcaaactcagtgtctgcagatga

SEQ ID NO: 3860 - DNA, 488 bp, Mus musculus
  misc_feature (190)..(190): n is a, c, g, or t
  misc_feature (225)..(225): n is a, c, g, or t
  misc_feature (255)..(255): n is a, c, g, or t
  misc_feature (267)..(267): n is a, c, g, or t
  misc_feature (286)..(286): n is a, c, g, or t
gtatggctactctctaagaccttgtctttgagggctcagctccggattattgttgttcagcatgcttctcctttgttctctaccctctcagcctagacggaactgaagaaaagtctaggtgagctaagagtgagtttctggggtcaatgcctggtgagcctttgactgtgattcactgtttccttgtttnacacacttccactagctggtgcagatgaatgaccnaaggcagtggggaccaaggaattgtagagnagccaatttgcnaaggatgctggggaagccnagaccctcagatactgaatcagagtcaggtagagttcagaaaccaagtagtgtgaaagatgtgtgcaggtatgtcaagaaagcccaggtgtcaataggcactgacaaacaatctgttgctgcgagttcactaagaatgggtggttggcatggccacttcctagggaggtcatctgaggttctttgaaccttgcctgcagaaa

SEQ ID NO: 3861 - DNA, 492 bp, Mus musculus
ctttatcttaagcagccagggcatagagggaaactgtttattggcttgctgctcctggctcaccctgcttgctttatagaacccaagaccactcactctcccaggaatggcactacccacagagggtttggctcttccacatcaatcactaattaagaaaataccctacaggcttgcctgctcacagtccactcttatggagacattatgtcaattaaggtttcctcctcagatgactgttaacttgtatcaagttgacataaaatttgctaacacgtccattaaatttaaattagatactaagggaaggaaagagtattgggtgcaggctccaggtctgtatgtcactctcacctaaatacaggtgccaatcccattctatgctgaccatattctacggcagaagccccgtgacacttctctgggctttcagaggaacctttgcctctgtgtccgccttgctgcacactctgcagggctctttttctaaat

SEQ ID NO: 3862 - DNA, 537 bp, Mus musculus
tgagccatccagtggtgccatcagcaggaggcagggccagctcttgtgctctcataccctgcagtcagctcagctgcacctatgcctccagagccagctcggctgcctagttaatgcacaggtcccactgtcccaagcctgtgaggggctgggcctgctctcccacgtgctatagctagtgagaggccagggatagctctctcccttaggccagctctcctgaccactgcaggagattggggggggggtgagagggcatcacccctgtacccatgccacctcatggcaaacgagtagtgggcctgctctcctatgccttttgggaaggctcaccctgtgccccctccaccagggccagctctgctgtgctgcccaggtgaggtgcagggcctgctttcccaagtgctgcagcaggcaagtaacaagggccagctctttgcctttcaggaccccacggcctgttttcccaactgccaccaattggggggctcccccccccaaaattatgttgagtaaaagctagtaccttctccttgt

SEQ ID NO: 3863 - DNA, 501 bp, Mus musculus
  misc_feature (52)..(52): n is a, c, g, or t
  misc_feature (195)..(195): n is a, c, g, or t
ggagaacccgtataccggcaagctttgagaaccattacagatggctccttanctttatggctgttcagacttgaactattgtgtgtgggtgtgcctttgggactcagggactaggattttgttcttattgaaaagctaatcccattctggcctctgagctcagttggatcaatctctccactcactacagttccntggcccctgactcggtgcctggcaggcagtgtatggtcttggctaagggtgccggggggttctaggttctgaccattctgggttagactatggctctactacatctgagagtgtagatactcagcgttcacacctaaacctataaaatggaggcaactgatcaatgaactcacagactcactgggaaaatgagcaaggccgcatgagaagtgtgtccaattctgtctcataatgaacaggtctttgtgagctgtatgatagtaaacttacagagacaaccagctctgaagtgaatggttgccctgt

SEQ ID NO: 3864 - DNA, 507 bp, Mus musculus
  misc_feature (92)..(92): n is a, c, g, or t
  misc_feature (97)..(97): n is a, c, g, or t
  misc_feature (111)..(111): n is a, c, g, or t
taagatccaacacctttttgcccctagtgttggggctcaaacttttggacttacctgccaggcatacatcctacagctgtgccacattatanccctntgggggtcactatntaaactattaaatcctacaggaggagggaatgacatgggaggggggagagaaagagacagacagacacagacacagagacagacagagagttgaacattccaagcacctggcgcagggccagctgcctgtgccactcactgctaagacgaataagagcttgaactgggattaattcacatgagttgcagagcatactaatttatatgccccgcctcggtttgccatctgtgggaacccacgcgctgagagtggaaaaagactgacccctcttacgtgttggacagtgtctttagaaagagaggatgctgtgatgaggatggagagctggccagcaggaggctggtgggcttcactcacttcttgcaaagcctttctgatctgctctcattctgaat

SEQ ID NO: 3865 - DNA, 356 bp, Mus musculus
tattggatgctgttgcttactgacagtgtgaagtttgacagaccctttagcccaagaacacgaagtgtcagggtcaaagccagctctctacagcatccagacgggctctcagctctgtgaaaaaggtgtttccactcttgaagcaaagtgttgatgcgcctcactaaaggattcaagatcgttcctagcatgtggggacagatagtgacaccagagagggagatacctccgcctgggtgtctaagatgagatttgatcttgcccaggaaaatggtggctctcttaatatgagcaaaatgaaatggtggcgccccctagtggtagtgaatggtaggtcggcccaccttgagaaaaat

SEQ ID NO: 3866 - DNA, 531 bp, Mus musculus
gcgtctgttactggccctgggattacaggtggttgtgagcccctatgtgggtgctggaactgaatccaggctctctgcaagagcagtgggtgcttttaactattaagccatctccccaaccaccactcaaaattatttatttctattttatgtgtaaaaagtgttttaactgcatgtatgtctgtgtatcacgtgtgcttggtgcctaaagagacagaagtggtaatgaatcccccggaacaggagttacaagcagttttgaaccaccatatgtgtgctcagaagcaagccagacctgcaagagcaacaaatgcttttagctactgagacatctcttgaacccctgaagagtccatgtttttgtttttgacctgaaactcactatgtagaccaggctggccttgaactcctagggacccacctgcctctgcttcctctgtgctgggaggagaggtggttccgtgttttgaaggactcaggatgcatcagcagaacctgtgcatattgttctgtgtgtgctctatgtgtaca

SEQ ID NO: 3867 - DNA, 367 bp, Mus musculus
  misc_feature (104)..(104): n is a, c, g, or t
agtctctgctccttcaagttccactgtgcactctggtcagtattgggaacttctttccctcttccctctctcctgcaaccctggggtgctagcaaggtagctcntgggggatcccaggtcgggggctgccccttcaccccctgcagcgtgggtcagaggcttatgctcacgcggggccgtgtggaaagcgtcccagaagccccccaacgcctgcgtccgcctggctgaacattaggccccttttccttcccgacttttccccagggtctccccaggacccccctttattttgttcccaacacttgctttaagtcttgtactcacgcagcactctaaattcaagcccaccctgatctataacaggttt

SEQ ID NO: 3868 - DNA, 467 bp, Mus musculus
ggctccctctgtagactaagttctggaggttttccacaccttgtagtagaactgtgatgacagggtcaagatcccaggtcctagagtcagcctgctggttatatcacaagcaccattacctacttgtattgtgacagtaggcgtgttttgaagcctcctgggtttgcttccttctctatgggtcggcacagagaagctgtgagggttaggcataggtacatggtacgtgcataggtactatggtcattattttgtattatgtcagtatccataggaaaagtgcctggaacaaagtgggtagcctcacagatccaatgtagtgttgctatcatcggggccctgtacttggtgtggctcataacataagaaacaccatgatgtgttttgacctgcatccttgaatgagaagagctttgtattatgaaaacatttctggccccatggaatggcgtgtgcctttgatccca

SEQ ID NO: 3869 - DNA, 283 bp, Mus musculus
gatgtccgagtcaagttgtcctgattagttccacatgcatccctatgtccaataactgatacagtataaatgaagttttcagtactgaagatgaaattgggccttgtgagaactgtattcacaaggtattcacccaacccaatgccatttgagattctatgacctgtggcccgattgctctgtaggaagtcgcaatgtgaaggaagggggcacatggctagagttgtggtaacgccatttagaaaggagatttgcttctttctcccaacttttgacattaagg

SEQ ID NO: 3870 - DNA, 565 bp, Mus musculus
  misc_feature (229)..(229): n is a, c, g, or t
  misc_feature (232)..(232): n is a, c, g, or t
  misc_feature (266)..(266): n is a, c, g, or t
  misc_feature (276)..(276): n is a, c, g, or t
  misc_feature (302)..(302): n is a, c, g, or t
  misc_feature (519)..(519): n is a, c, g, or t
tttatccatcgaagcatctcaccagcctctctcttactggcctggagaggaaagcgaggctggctggccagggagccccagaatcccaccttccaagcatgtggagctcaacattcagcttttttttttttttttaaacataggattaaactcaagtccctgtacttggaactttactaataagttctctctccagccccctgtcttatttctcaaggacttgtcattnggnacatcatgctctggtgggctaagtcctacttccntgcagtaacnactgccttgggacttaccaagattgnactaattcaccccaagattcaggttaaggcccatccttgcaataatgaagctgagttacttccccggtacacagggctactataaatagctcaagagtggaaagcctgcttggcataaatcatatcttttataatattcaaatttgtatcattaatacaatttcatatttgcatctgtgtgacgtgggtaagccatgaccagagtcatgctgccganacgcatatcagtccactccactgactggtgccagctgtacttctct

SEQ ID NO: 3871 - DNA, 463 bp, Mus musculus
  misc_feature (249)..(249): n is a, c, g, or t
  misc_feature (261)..(262): n is a, c, g, or t
  misc_feature (266)..(266): n is a, c, g, or t
  misc_feature (337)..(337): n is a, c, g, or t
  misc_feature (339)..(339): n is a, c, g, or t
  misc_feature (369)..(369): n is a, c, g, or t
gaggtggactctatgtttcctttcagaggcatagaaattggggcttttggattttaatcatccattggcaggtctctattgactgtaaggatctctcttcaggactttgggcttttatttctggccaacctttcctgtagacaaactgagccagaagtctgacaaggagagtgggcctttccaatgacctcaaagtgaagctgtggcataacacaggactggtgttggctgtgcaggctatcctttatncaagggcaccannttgnaaagtgagtctccaacctccccgagatgcatcttggcctggcatgcagttgcatgaccacagacaggggantntctttctattgccctcaaggcccctttgancgaacacccaccctggaatttctgccgtgtagactggttctctaggatgctcttgcgttcacctttcctcttccagcccatcaacatttatttt

SEQ ID NO: 3872 - DNA, 556 bp, Mus musculus
  misc_feature (125)..(125): n is a, c, g, or t
  misc_feature (127)..(127): n is a, c, g, or t
  misc_feature (129)..(129): n is a, c, g, or t
  misc_feature (131)..(131): n is a, c, g, or t
  misc_feature (133)..(136): n is a, c, g, or t
  misc_feature (140)..(142): n is a, c, g, or t
  misc_feature (144)..(144): n is a, c, g, or t
  misc_feature (146)..(152): n is a, c, g, or t
  misc_feature (160)..(160): n is a, c, g, or t
  misc_feature (171)..(171): n is a, c, g, or t
  misc_feature (174)..(174): n is a, c, g, or t
  misc_feature (176)..(176): n is a, c, g, or t
  misc_feature (180)..(180): n is a, c, g, or t
  misc_feature (183)..(183): n is a, c, g, or t
  misc_feature (192)..(192): n is a, c, g, or t
  misc_feature (198)..(199): n is a, c, g, or t
  misc_feature (214)..(214): n is a, c, g, or t
  misc_feature (216)..(216): n is a, c, g, or t
  misc_feature (222)..(222): n is a, c, g, or t
  misc_feature (226)..(226): n is a, c, g, or t
  misc_feature (232)..(232): n is a, c, g, or t
  misc_feature (248)..(248): n is a, c, g, or t
  misc_feature (253)..(253): n is a, c, g, or t
  misc_feature (268)..(268): n is a, c, g, or t
  misc_feature (313)..(313): n is a, c, g, or t
  misc_feature (431)..(431): n is a, c, g, or t
  misc_feature (450)..(450): n is a, c, g, or t
  misc_feature (452)..(452): n is a, c, g, or t
  misc_feature (460)..(460): n is a, c, g, or t
  misc_feature (514)..(514): n is a, c, g, or t
actccgtctgaacctaggctgctgctgtgtagacagtatctaccattgttcctaggctgctgctgtgtagacagtatctaccattgttcctaggctgctgctatgtagacagtatctaccattgncncnangnnnntgcnnngnannnnnnntcaggacnctctggaaganacngnacangtnctctgaccntctgannccatctctccagccntncagagnaacncttatnaaggcaaacatttcantgggnccgacttgcagttanggaaatttagtccattatcatggtgagaagcatgctgcatgaagntagactccatgctggaggagctgagaattctacatcttgatcagaaggcagcaaggaagagattggatgtgtttcacactgggcctagcttgagcatttaagacctcaaagccccacntccacagtgacacacttcntntaagaagnccacacctcctccaataaggccacacttcctatggcctcttcaaaccaccacanggggatctgagaccttggggattcacattactcagagagaca

SEQ ID NO: 3873 - DNA, 461 bp, Mus musculus
ggcaacggtcagtccagcaagtgtattaaagccatgcaatatttaggatattccaaaattaggaacatgcattatatgtgaccggattgtcaaataaaatgtaatataaaaagaagcttgagaaatcagcatggaaataaataaaaagaaccacaaaagggaggttcttgtatagattagatccactacactgccctggtcacccagctgtgcttattagaagacctagcacaaggtctttatcaaatgcttctgatcatagaattctaatgacatcaccctggaggaaaggcagggcatattttcctgctaaaattgcattgaaaatcagccttccaagcaagttctggggtccacagtacagcaaaggagtattgttaaactctactgaggacctgacaatagctaagataccagatatgaagaatttccctgcacacgtgtacactcagatcattaat

SEQ ID NO: 3874 - DNA, 444 bp, Mus musculus
  misc_feature (297)..(297): n is a, c, g, or t
  misc_feature (316)..(316): n is a, c, g, or t
  misc_feature (328)..(328): n is a, c, g, or t
  misc_feature (331)..(331): n is a, c, g, or t
  misc_feature (338)..(338): n is a, c, g, or t
  misc_feature (347)..(347): n is a, c, g, or t
tgcaatgtgtctttacaagggtctcagtggggcttcccacccttgcctctgcaggagacagctcatctgtttaatccttatgttttagtcaacctttcttattatgcagacagggctctgaggctctgctggattttgactctgggaatgaattgatggggctctttgatcttagctgtgtattgcatccgttttatctttcttcttaatgcagccttccaaaccccaattctagctggcattcctcaaacatatccataattacacaaacaaacaaacaaaaccttgcctctgacnactcagattaaaaacctcnttctttgccctntgnggcatantgagctttnttaggaaagaggggaaaaagtaatctaattcactactctggacaagactagaagatctgagaggatttaggtaccaactggcatgtatgtatctcaa

SEQ ID NO: 3875 - DNA, 513 bp, Mus musculus
  misc_feature (240)..(240): n is a, c, g, or t
gggcaccaacaacttcagtcatgtaatggacatctgtgtgggacatcgagaattaatcccagcacctgggaggcagcaggcagacctgagagatgatgagaggaaaggcagaaggcacagatgctcaatttgagagcagcagggagagctgaagggcttgtcacacgtcaaggactaatgggaacaaagagctgcaaggagacatgaagggattcactgctctggcctctttgtacatgnactcccaagatggagtgacccatgggtactgtttgagacaggacttatccatcaaatatccatctaggcggggacttgagccttaataggataagtcggaggaaactaaagtaagagaaggctcaggtcaacacggggcaggagaaaagagccagcagaagaaaacgattgtaaaaaataatcctttaattttagaatgtgagctgccattgttgacatgacactgaaacagctgaagagccctgtgagcttacaaaggctatttgaccccgt

SEQ ID NO: 3876 - DNA, 477 bp, Mus musculus
gaatacacttcctatacttctgtaagctttttaataactatgaaagcctgtaattcttgtgaacagagcgtattataagtatgctatctcaaacacacagacgcagcttgaaaatatacttcagcagcactgcatttttttgcatgtgcttttgaagcagcaaattctcaatctcccagcaggagactgtttaactgcactgcttgtcaatctaagccagttttcttagacaaggaaagaatgctttctctttagctaacgtgtgcaatgtgacaccagtgtcttgtgtttggcattttccatggacaccaaatggcaggatgctcctcaatgttctaatcggctttcttgtcagcccttcagcttcttttatcctcttccaagttcttttctctagagtctgaagcagacctacaggtcaggtgggactttagtgtgacagctgggcattcttcctaggacagacccagcatggat

SEQ ID NO: 3877 - DNA, 506 bp, Mus musculus
gagagatcagagacgcctgcactgcttgcagagccctgcttcaacacttagttatcttctgtaaattcctggtgaagacctggagtcaactggaggtcgggaggcgggttctttggggcagctgagtcactgcaggttctttgtgttaggcttggggacagtccccaggggctggttctctccttccattctgggtcccagagaccagctcagctcagcccaggccaccagcgttggcagccaagcacctttaccctttgagacatctcaccagccctcattttggcttttttggttggcttttgttttgttttgactgggcctcactgtagctgagactcatgatacagaccgggatcacctgatatgtgtgtggcacgtgcctgactccttagtttgctttgaattgagattcttattccgatgtagttgatcctcgtctttgctggttctgtatttgcaaatttgatctgtaactaacattgcttttgtggttgttctcatac

SEQ ID NO: 3878 - DNA, 426 bp, Mus musculus
  misc_feature (127)..(127): n is a, c, g, or t
  misc_feature (155)..(155): n is a, c, g, or t
  misc_feature (158)..(158): n is a, c, g, or t
  misc_feature (172)..(172): n is a, c, g, or t
  misc_feature (175)..(175): n is a, c, g, or t
  misc_feature (180)..(180): n is a, c, g, or t
  misc_feature (182)..(182): n is a, c, g, or t
  misc_feature (188)..(188): n is a, c, g, or t
  misc_feature (205)..(205): n is a, c, g, or t
  misc_feature (207)..(207): n is a, c, g, or t
  misc_feature (211)..(211): n is a, c, g, or t
  misc_feature (213)..(213): n is a, c, g, or t
  misc_feature (225)..(225): n is a, c, g, or t
  misc_feature (229)..(229): n is a, c, g, or t
  misc_feature (233)..(233): n is a, c, g, or t
aggcatttgtaagcagcttgacatgagtgctgggtcttactggtcctgttagcgctgatagctcttagcctcagagcagtttctctaaccccctttattctttatagttaactcttttaaataaatnaaaagatggctgagccagttttagaagntgnaccatcacttaatnggnaattncncaaaantatcaatggctaatcangntggngnaaaaacaaacgnaacnaacnaaacaactcaaaaccttaattattaccaatgaacttgaaatgatcaattaaacaaaatcacagttttctaagtctagaaatatgttgagacatctttgaaaacatttataccagtgtgtttatacaggtattttatcatagaaagaaatgggtaagatgtagagatgttcccagagatggaacacgatgttgt

SEQ ID NO: 3879 - DNA, 546 bp, Mus musculus
  misc_feature (70)..(71): n is a, c, g, or t
catctgatttcctaccaatgtctttgacttaattcattaatgcaaaaatttggtgtgtggcaagacactnnacggtgtccaagagggcaaggctgtgccctgtagagaacccttaaataggctttccactcagctcttccctttctctcggaggagcatggagtaacacagcttatcagtcttctcatatttggcatctttatattagttttcttttctttactcttgattcagtgatatttgtaatgataatttaatggaaaaatacatgtggatatatgagaatgttagggtgacattatttaataggaagcgaggaacagctaagtgaagaagagccactctcataattctacgctgctgtgctgagatgaaattagagccaccccattgtatgctgctgagccctttgccatcatgtctcagtggcagcaaagatgcagtatcctctcctggaacgacttggagatgcaagtctcaccttcaaggtggcttttccttcgttttaacgccgtgatcttctgtgacaatactttcctagggaat

SEQ ID NO: 3880 - DNA, 546 bp, Mus musculus
gagcagccagttttgacatccatagaaacagtggtgccataaggttggctccagagctgaggaactgcgcagtctttcaagtggcagaggcaaatccaccagagcagtgacagtggtgaagccatggtcactcaagtggcagcaatcaatacaacagcaatgacagtggcagaaacagcaacttccagagacagggccttagacacccaagcttgggagccagtaccattgagtgctgtcaagaataggcaaatctctggaccctagacctgggagctataccacgagagctgttattaggtaccagggatgccccagtgccctaggcctggaagctactatgctagcataagctgggtcattctgacacccaggaccacataagtgctgtaacaattttgttaagggtcccttataccagtggcctgcaatggagtggtaacatctgtcattgtaaggctaagcgtcctggtacctcgggcctacaccaggagctacaatactggtgtcatcggtcattccatcctgtttatggccactgtgcta

SEQ ID NO: 3881 - DNA, 381 bp, Mus musculus
gccactaccttctgactacaaatttttatacttaatggtgattttaatttgtcctaaaggtttctgcaactctgctttatttttatttttgttccttagactagataatcccaatatacctaccttcatgttggctactttttttctgcttttttgaatctcctaggaaacacctctaatgaatgttttataatccccactttgcccttcctcttgtgttaggaagaggatctagagccctagtcattggagacaagaactctcgctgagtcataaatctagcctcatccccactcctatccttgtgtgtttgtgtgtgtgtgtgtttgttttgagaccgtgtttcacatgtagccttgctgtcccagaactctttatata

SEQ ID NO: 3882 - DNA, 487 bp, Mus musculus
  misc_feature (33)..(33): n is a, c, g, or t
ggagctaatcctgatctcatgggattttatatnttaataaatagtgtgctggccaatgagcacaaggtatatgctccatatttaccaacaatctttcttatcagagtccacacttacatccttctctaaaacctgagaacctttacttctacacatctcaaggcccctgtcacccccagcctataactcagcattattacatccttctttcatctctgggccattcccaatttttggatgaggtagtgtgtgcgttggtccatgataactattggcagaggcgtttgatgctgaataaattccagccataaataataatattatctctcacatggagaagccacaaaacctcacaaaatccctgtgccgaataaaactttgctgatttattgtaggaaatataccaaatatgaaattcagttttaactgggagaaataaaaaatgaaaatactgagttggatggtgccttgatccaactatttgaag

SEQ ID NO: 3883 - DNA, 545 bp, Mus musculus
  misc_feature (296)..(296): n is a, c, g, or t
  misc_feature (302)..(302): n is a, c, g, or t
  misc_feature (307)..(307): n is a, c, g, or t
  misc_feature (336)..(336): n is a, c, g, or t
  misc_feature (376)..(376): n is a, c, g, or t
  misc_feature (400)..(400): n is a, c, g, or t
  misc_feature (476)..(476): n is a, c, g, or t
tacagtgccctgaaacctttattaagtacgatatttggaggccttttattaacgtcataccattgacatctagagttaagccagtgagctggttcaggggtaaaggcacttgtcacacgaggctgacagccgagtctgctttgcatccgcatgagggctgaaggagagaacccgccccttggagttgtcctctgacctgcacacgtgctgaggagtgagcctcccccacacctcacatacacattaataatcatgtttttagtaaaaaatcctgtagaattgtagtcagggtgtgnttgctngtgtnggaggctgaaacaggagggttgccacaantttgaggctagcctgggcagcatggttagttccaagccancctaggtttcagtgggagaccctntctcacagaagctgggacagttgagggaaaacttctcattgttttcatgtttaagcaatatcatgcttctaagtgnccaaattacaaaaagaatgcagactcgtctcagctggggatgggtggagctcagtggtgtagtacatgc

SEQ ID NO: 3884 - DNA, 518 bp, Mus musculus
  misc_feature (310)..(310): n is a, c, g, or t
  misc_feature (321)..(321): n is a, c, g, or t
  misc_feature (324)..(324): n is a, c, g, or t
  misc_feature (338)..(338): n is a, c, g, or t
  misc_feature (364)..(364): n is a, c, g, or t
  misc_feature (400)..(400): n is a, c, g, or t
  misc_feature (432)..(432): n is a, c, g, or t
  misc_feature (477)..(477): n is a, c, g, or t
gctacagaagcaccgtttgtgttttgtgtgataaactgctaatagtttacccctgggattcctaagtggggaattccttggactgactgtatgcttggtaaaccttgatatttaacatatagcattgaggtataaaagaatatgaacttgtgactttctggggagggtaatctccaccaggtttaatgatttctgggtatgggtgttttgcctgtgtgtatatctgtgtaccacaagggtactgtgctctccggggccagaggagggtttcagatcctctggaactagagatacagggggtagagagccnacatatgggtngangaatggaatttagnttcttaacccttgaaccatctttccngcctaaggaggtcattttcaattataaagtcatctntactgtaaacatctccaaagaaccagtttttnccctgcttttccatgttagctattttaataagactttcaattttntcttttaacataaatatattccagtcacttcctcgaagcaa

SEQ ID NO: 3885 - DNA, 213 bp, Mus musculus
  misc_feature (162)..(162): n is a, c, g, or t
agatagtgtctttacttggctttgctttgacatagcatcatcagtgcatgctggggttgtattgcttcataggtcaaaattcattccacatgccctcaaggaggttttaggaccttgatgtaatgtcacccaaaagcaaaactacaagagaactatagcctntgagttgcactggactttagaagtaggcatttcactcatcaaattgggtca

SEQ ID NO: 3886 - DNA, 550 bp, Mus musculus
  misc_feature (304)..(304): n is a, c, g, or t
  misc_feature (332)..(333): n is a, c, g, or t
  misc_feature (336)..(336): n is a, c, g, or t
  misc_feature (349)..(349): n is a, c, g, or t
  misc_feature (363)..(363): n is a, c, g, or t
ggcccagctgtctggattggtagactttaacccctaactaggtcacctgagagttggaactggttagggtgctgtttgggtaggatggggacatgatttttagaaatgttgaaagctcatcagtatgttaattacctatgtcaagaaggagtagcaataaactacatgtccccatagattttagtgaggttgacagactttttctaaaataccaaggcagtatttcccaggtcattgtggaatgttttacaagcttatgtacaaataagtttctgaatgattttgtgatattaataggattggnttcaattaaaccttttactaccttctgnnctntctttaattcctntgatagccctccanaaatggcttgtataaaattaagatacccactgagggtgaattctgagttggactaatgcttccagttgtgaattagaagaacctgttcttccacaagacaagtaggttgacttacaagttatctgcatagctgcacagctgtatagctgatacttctgtgtatatacctatgatattttctgggcac

SEQ ID NO: 3887 - DNA, 429 bp, Mus musculus
  misc_feature (326)..(326): n is a, c, g, or t
  misc_feature (356)..(356): n is a, c, g, or t
  misc_feature (367)..(367): n is a, c, g, or t
  misc_feature (376)..(376): n is a, c, g, or t
agttgctgacagagcctctcagaggacagccatcttgtctgtaagcacatcttgttatttttgtatggagctttagtttcttctgcttgtagtttcttcagggtttttagcatgaagatgttgccttttctgtatctcttatgaccatgtaacttctatccttgagtctgtttatgtgctatattacatttattgatttgtatatgttataccattcttgcatgcctggaaggaaaccaagatgacagtggtatctctttttggtgggggttatggggatgaagacaggatcttaatgtgtatccctggttgtcctggaactcatnatgtagaccagactggactcacagagatcnacctgcctctncctcccaantgctgggattaaaagtgtgtaccactatgctcagtttacagtggcatctttta

SEQ ID NO: 3888 - DNA, 461 bp, Mus musculus
  misc_feature (157)..(157): n is a, c, g, or t
agttactattgatggctgtgagctaccatgtgagtgctgggaaccgaacccatgtaatactaactttatgactaagctctgcaacagcttctactcagtgaatctattggagatgtacctgcttctgcctccctagagtcaggattaaagctgtgcnccaccatgtctggcttcctgtcatgtacaaattaatatccaaattactttccctcttaggcttttgttaaccaagtgattattatttagcagcagtacttctaaaaaagttcagcagggaggtttggaattattgtaaaaatttgactgtggggctggttaggagcacgactactcttccagaggacccaagtttggttctcaactcccacatgatggctggtggctcacaggtatctgtagtttcaattccaggaggtctagagcactcacctgggctgtacaagtactacccgcacctgtta

SEQ ID NO: 3889 - DNA, 522 bp, Mus musculus
  misc_feature (283)..(283): n is a, c, g, or t
  misc_feature (288)..(289): n is a, c, g, or t
  misc_feature (295)..(296): n is a, c, g, or t
  misc_feature (308)..(308): n is a, c, g, or t
  misc_feature (329)..(329): n is a, c, g, or t
  misc_feature (340)..(340): n is a, c, g, or t
  misc_feature (396)..(396): n is a, c, g, or t
  misc_feature (403)..(403): n is a, c, g, or t
  misc_feature (412)..(412): n is a, c, g, or t
cttctccctacaacggacatggttgtttggagtgactcctaccattggtatgaccatgtgagccttttcagtaatggatgtgtgagatagcagttgaccaaagggtattctgagtggaaatgtttggagcctctgacagactttcagggatgtaaactgtgtgggtgcccttaaatcctcaagggagaagaatttgttttgcagcaacccattatctagcaaaaagcgctgtcctaggaaacaggagtactactttctggagttattccttccaccagcttgngcatnntccctnnttctccccattngtggataggaattaagtttgncacagaatttnaaatagtcgagggaagttacagcactttgaagaagtagaacacagcacattgtgtntcccatntgaggacancctgagaccctgtgtcaaaaacaaagaacaaaaccaaaccaaaccaaacaacaacaacaaaaaaaaccactgtagggtctgaagagtaaatttctctgcatcagtgacca

SEQ ID NO: 3890 - DNA, 508 bp, Mus musculus
ctctgccatgtcaacctttactaaaaagtgtgtgattgaataaagaaaacccatttcgcttgctttaatccccaaatgtgcccttgtcttcacccttggcagaagattttttgccttctcagtaactgaatttatagagcctcaagtgaataacttcagttttgcttttaaaatgtgtctgtttcggtctcactaggggcgaagttggtgtccatgttgtctttctcatcttgacattatcactgacaaacctccttcgactgtattttcatcagccctcatctctcagcctctcacgtcacctctctgtgttccctcgaaaggttcatgtcttgaatccttggccctgggcgtgtcatatggacaggagacctttatgaggtagaacctactgggaagtaattaagttattagagatgccctcttcacaggagataaggtatgttcagaatggtgtggccatatgcaggatgctatctgtaaaagggctttctgcatttcttatggg

SEQ ID NO: 3891 - DNA, 497 bp, Mus musculus
  misc_feature (393)..(393): n is a, c, g, or t
  misc_feature (432)..(432): n is a, c, g, or t
ggacaaaggtctccaacaattttgagaaaaggaattaaagtgtgctgttagtgtatgagagctgtttttgtagttggacagacagggcttggtggattactaaatttgtcttagtagctagatgggttatataatataaatgataagatcagtcacataaacttagactgtgtgagttctcagaataacctaaggaagttacagttaggttgaacttgatactgaataatctgttagtttatagtaaagtgagtacagacagtgacattaattcatttgtcatcagtttaatcaaagcaaatttatttttatctttctctagttggaagatgctggctcaagtagtttagataatctactgagtagatatatctcaggcagtcatctaccccntcagcctacaagtaccatgaatccttccccaggaccctntgcgttatcacctggatcttcaggtaaaacaagcagggatattgcttcattgcttttaacccttt

SEQ ID NO: 3892 - DNA, 521 bp, Mus musculus
  misc_feature (40)..(40): n is a, c, g, or t
  misc_feature (43)..(43): n is a, c, g, or t
  misc_feature (82)..(83): n is a, c, g, or t
  misc_feature (190)..(190): n is a, c, g, or t
gtttgtcaaaggtggcatagcttttgtgggggtgttgttnggnaggtattttccttttttgttttgtttttgttattgtttnnagggaagggtgttgttttggtttgtttgggattttgtgagtttttggtttgttgtcttcccccccagacagttccctctatctagctctggctgtcctggaactcangaagaccaggctgtcctcacactcacagatctgtcagcctccagctctgattaaaggagtgtgcagtgacacctggcttacggtggcgtaccttttagtgtccacatgctgtgtctgcctaaaacctgtaggaagcacttgctctcacctcttccttgactggggctgaagagagaactcagtggttcaaagcatttattgctcttgtagaagacctgagttcagttcccagcatccacatgatggctcacaactcccataacctcatcccataattccagttctaagggatggtccacctcttctgacctcttgcgggtactaggcacga

SEQ ID NO: 3893 - DNA, 432 bp, Mus musculus
  misc_feature (234)..(234): n is a, c, g, or t
  misc_feature (272)..(272): n is a, c, g, or t
  misc_feature (371)..(371): n is a, c, g, or t
gtcccgggtcactgttgaaactaagttaaataatggcaaaccttcacggaacagagggacagataaagtcaccaaagaaacatggattcactcttccatgctctgggtgacagaatatgcgtatgtgacatgaaagccaaagcatccctaaaccagagcgatctgtgttctctgcaggtgaagctttactgggcaatttactgaggctgcgcctcaaaatgaacagaaactganctacatcttaatgacagatcacttgcttaacatgatgntcttgggtttcatccctagtctgaaaaaatacccatcctggaactctctagcatcccaaatagaccaagacagcctcatttttatgtcttcatcctgancacgttgagtacctgccacagcttgtgaggctcttggtatgagccctgaggtcatggcctg

SEQ ID NO: 3894 - DNA, 355 bp, Mus musculus
aatttctgagtaatcctgtgcctgcttcagccctttcaaacagcagcgtgactgcctttttaagaatgcagcgacacatctcagctttgctcgccttactttctgctctatctcctgatgcaattatctccacatggtctcaaatcttccaagatcatgcccgtatgggagacaaaagaaggcagatcctgtgttgataaagggcacttggagttccccaaacacccagtttccaggcatgtggaggattcagtattctgtcattgctttttctcggatgcccactgagagccagaggaagcctcgctgacaccctgaggtgtgtggaggtgtaatttactggtgcccagggcct

SEQ ID NO: 3895 - DNA, 420 bp, Mus musculus
  misc_feature (49)..(49): n is a, c, g, or t
gtttggatcttcctttgatagcagtttttcttgaagctcaaattttttnctccttatcattttgctcatttcaggttactaacagtgactttaagcttttcctgtcagtggttgctaggttagtgggactcacctgtaaagtgttcttttcaatttcgagggcaagcaggtatgtaactttgcacatgttgtgggaggaatatgatttttcccagccgtacactcacaaacaagacaaggaagtctctatcgatggaagagaggttttccctatacgacaggagcaggagggaaccacggtggggttttgaggcttttgaggaagcgcattgctctgcagaaatgcaccatctgccatcccaggatggagaagcacccgctgtgtggggagctaagatgcttctattaacctttgtcctg

SEQ ID NO: 3896 - DNA, 564 bp, Mus musculus
  misc_feature (203)..(203): n is a, c, g, or t
  misc_feature (224)..(224): n is a, c, g, or t
aatggtgccatgtgaagcccttgttcttggttctaacctagtaaggattattagacacagaaatattctttttagtagtataaaaaaaatagaaagaatctgtaagttacatgtgtagaatgctggtagctgcctgtacaaaagcttgaccatagggaaagagccagggctgagaagtatagaatatactaggaagcaacagntgtactggggcaggaaggagnaaggcacaggaaagccaacaagtgggttctctgcactccacaatgctagagctgattatgaagcacagtctcccaaaaggcaggaggcaaatacttgctaaagcacattgtatctcaggaccacagtagattgtgctctggttatcaccctgtggtcaaaggaagcagtagactgcagtttcggaaaaagaaaaatagcagggtactatatgaaatgtgtgtgtgtgtgtgtgtgtgtgtgtgtgtgtgtgttaatgtttcttcaaaacatcatgagagctcaactcctcaaagattgaattagttccaaggtcattgggctacttgtttaattgctcag

SEQ ID NO: 3897 - DNA, 522 bp, Mus musculus
  misc_feature (185)..(185): n is a, c, g, or t
  misc_feature (190)..(190): n is a, c, g, or t
tactcttgagtaccccaaatttgtggaatgacagttctctctccttctcaaggccattcatttatctccactcatttctgttcttctgtaagttcatgccctcctgccctgctccctccccagcccgaccaagctctacactcctgctgtcgggcctcatccatcccattattcattcatctcantcatnatctctccctctccccccgcccccaatcccaggtgaatagccacctggtccacctggcttcacgctcttggccacagggagaggctctgctgcagtgagctggggaaataaatgcccgtgaagctgtaggttagagacaggctcaaactcagagaagaggcagtgtgaagtgcacccgttagaatcaaccaaagaccaaaaaagagccagaaatacaccaatcaggctgaagacatggctcatcagcgggaggtactttccaccagtcgcagtgacatgagtttgatgacgggactcacatagtggggaactaaggatccactcaggcaagt

SEQ ID NO: 3898 - DNA, 554 bp, Mus musculus
aaggtcctgagatctagctccagtgttggaagtggaagagaaaaggacaaaggcatggccagggagtggaggagaagagcaagctgcagcataacacagcatcaatcctttaaaacaataacatgcatacacaccaatctaacataggcagctataacgaaaattacatgcaaagactgttaaggcctgacacctcacaccatttagttccatgcccaccatcgttgctgtgataggtctgccagtcatggacactgaaacataacttgactcagagcagggtcatgctgagcacataccctgttttgttctctatgttctgaggtttgctaatcttaagaaattccacaaagctttatgtaggacccctcaaattaaaggtcaacatgaagtgttatgtctaagatgacttgaatcagagccaacacctgggcaacttgtcctgcacctgcgtatgatctcactgtggcttttatggttttgtttttcctttatacgccagccatgagaaatgtttgctaacatagcctcatctatgaccctgaccaatcagt

SEQ ID NO: 3899 - DNA, 474 bp, Mus musculus
agcatttaactactctttgtgatgaagaaagggcccagcagattgcggctgtgtgtatctctaatcccagcacttggggtggggtggggcaataaatatcgaggccctggtttaaacaggaaagattttgtaatctcaagttatcagtgtattccagtcttcagtgtgcttgggtgcagtggtgatttagaaatacatcagcatggtgggatagagttcaggtttgagaatatggcagatgtaaaattcaggctctgcttgtttctagccccatggttatgaaccagttaatttccttgtgaatgcttatttcttttttgtttgttttgttttgttttgtttttcaagacaggttttctctgtgtagccatagctgtcctggaacttactctgtagaccacagaaatctgacatgagaatgcttatttttgtcatatactttcagtattgagttttgtgtcatacctagtctag

SEQ ID NO: 3900 - DNA, 490 bp, Mus musculus
  misc_feature (254)..(254): n is a, c, g, or t
aagtgtacctctcaggatatccccaggcacacgaagatggaatggaaagccagtgggtatctcccacccacttagatgctgatggcctgggactataaacagggacagttgggtctcctaaggaatagcttccaggtccaggatgctggcatctcccagagagaactccatcccctgaccaccaaggcctttgtagaagcaggaatctcttcctcctgtcccacagcccccaggtcagagccaagcgcatcatntgcagcacacatgtctgtctccacaggcaagcaaccttgccaaggcaggccagacaggacagcccagcttcccactccagacatgttgttcttacatctctgacccagtgatctttctaggggtctgtcacatgtcccaacaggtggacagctctccaagtcaccaacctgaggaaaatatccctccttgtaaaaaggctttctctttgtaaatgattctgttgcctttttctaaa

SEQ ID NO: 3901 - DNA, 496 bp, Mus musculus
  misc_feature (313)..(313): n is a, c, g, or t
  misc_feature (319)..(319): n is a, c, g, or t
  misc_feature (351)..(351): n is a, c, g, or t
  misc_feature (369)..(369): n is a, c, g, or t
  misc_feature (381)..(381): n is a, c, g, or t
gtctttgtaacaagtgcctccgatgcaaaagtcgggtccggttcttcctcccagccccatgctctcagaaataagactcagactcaaaaaatattacagatacctcagccttgtgccagccctcaggactagtctcagacgagatcaaaacttagataacccatgtgctttaacctacatcctgacacgtggctggttacctgggctcaggtaccatgtgcccatctcctcacgtcttcccgggccgatctccagtgcctcattctatcccagaatcctttgtgcctcctggatgtcccatctctatttcctncctaanccataggccataggctttttaattgacatacnatacacagatattctctntccattccaganccttcatctcaagtttcagaggagagcatctccttaactgtgaatagcttcagttgtctgcaggaatgtaacttctcacagtcaaacttaggtacaaacacaataactccttata

SEQ ID NO: 3902 - DNA, 558 bp, Mus musculus
  misc_feature (44)..(44): n is a, c, g, or t
  misc_feature (46)..(46): n is a, c, g, or t
  misc_feature (61)..(61): n is a, c, g, or t
  misc_feature (74)..(74): n is a, c, g, or t
  misc_feature (98)..(98): n is a, c, g, or t
  misc_feature (101)..(101): n is a, c, g, or t
  misc_feature (105)..(106): n is a, c, g, or t
  misc_feature (112)..(112): n is a, c, g, or t
  misc_feature (146)..(146): n is a, c, g, or t
  misc_feature (149)..(149): n is a, c, g, or t
  misc_feature (192)..(192): n is a, c, g, or t
  misc_feature (197)..(197): n is a, c, g, or t
  misc_feature (360)..(360): n is a, c, g, or t
  misc_feature (371)..(371): n is a, c, g, or t
  misc_feature (403)..(403): n is a, c, g, or t
  misc_feature (527)..(527): n is a, c, g, or t
tgaaagtcggttcctagcctggttacatactgatgctggctccngnccaggccaagacttnttttttggagtcncaagtttccccctcagtaaatccnccncctnntctgtntgcattgtaagacaaaagggtagcattagggagnccnctccaattggaaaaaggagatggggtgagtccttccactcaanagacnctagctgctgtttgtgagttctctattgacccttgtgtgtgtccccggctgtgtgtctcagtgcaggctgggaaatatgtctacaggccatacctgccttctcaggaaccatcatttttaccctgggttctcttacttgggaggtgggaacagcagggaaccnctagagtgatntgtgggacttggcaggcacagataatgccatntagagagggacataagtatccagagatggggctggtggggttagcagcccgctactgtgatctcaggaagggtgagtcttgccagatgatgactgggctttcagctctaagaagggtccttacnctcccagcgtccttcccagttaacattttct

SEQ ID NO: 3903 - DNA, 480 bp, Mus musculus
  misc_feature (32)..(32): n is a, c, g, or t
  misc_feature (42)..(42): n is a, c, g, or t
  misc_feature (52)..(52): n is a, c, g, or t
  misc_feature (77)..(77): n is a, c, g, or t
  misc_feature (94)..(94): n is a, c, g, or t
  misc_feature (119)..(119): n is a, c, g, or t
  misc_feature (126)..(126): n is a, c, g, or t
  misc_feature (135)..(135): n is a, c, g, or t
  misc_feature (156)..(156): n is a, c, g, or t
  misc_feature (161)..(161): n is a, c, g, or t
  misc_feature (203)..(203): n is a, c, g, or t
tacacgtggctctagggcctggagagatgggnattagaagcnaatgctgaanttgtatcaggccagatcacagagcnttctggggaacccaggncctgggccttagaccgagagtgccntccttcnagataaacnatgtgtaaatgaatcattttnaaggnaaattctcctgcctttctccccacatcccatagtagtcactnaaagcactttaaattgttgtttgtttctactgaccagctttagattcactatgtagttccggaagggattgaacgtggagcctcctgtctccatctttggaggcctggaattacgggtgtgtgttaccactgccaggacaaatagtgctggagattcagtgttgagagaccacatcttcttatgtgtaggactgtgggtctagtatgtagcaatgcaagcatgcacacacacacacacacacacagagtcaatttaagattgtctggtggcacaccc

SEQ ID NO: 3904 - DNA, 379 bp, Mus musculus
actgctctgctgtttccagtctgtatgtccgtagagtccactgtgtgctgctgtgtctgtgagtgaggcaacccaaccttttttcatgactgcctataacgttctcagtctctcatgaagttgctttcctggacacttgcactgggcagtggtagccaaccatggggcctgggcatgatttaccttggcttttacatgcactagacatgaaaatgggagcttcatgctcattatagagttgaaaaaaatgtcaattgataaaacaatttatgctgaaaggtaggaaagaccacatttaccccctcttaaaatcatctaaagatttggtacataattagattatttttctagtgtgtacagttacagtgttctttactta

SEQ ID NO: 3905 - DNA, 527 bp, Mus musculus
tttgccaattacaaaccctgcactttggctagagaggcagatcatactatgtgcaggaaaactaaagcttgcttcttacccaaaaaaaagactagaaagagcagaagtaaccagggagagagggtagggagcactgagtgtggccttactatggaagtagaaatgttatgggtcaaaattttatgcttttgatgtcaagggtttttttttaatgcatcaaaaacaaacaaacaaataaacaaacaaaatctattgtcaagggctctcttatggtcttagtggatacctgaggtcctgagactgcagcaaagtctaaacttccatgtagttataaagttccaggtatactaaatcagcataagggtgacatgtttagctcactaactgagcagctaccatggcttagcatcatagtgaatgtacagtactggctgtttcctcccttgctcacacagctgactgacctgtagccccctgctgctactcagaatcttaggacagttgactataacatgccattagcctgg

SEQ ID NO: 3906 - DNA, 495 bp, Mus musculus
  misc_feature (293)..(293): n is a, c, g, or t
  misc_feature (309)..(309): n is a, c, g, or t
  misc_feature (346)..(346): n is a, c, g, or t
  misc_feature (355)..(355): n is a, c, g, or t
  misc_feature (388)..(388): n is a, c, g, or t
  misc_feature (428)..(428): n is a, c, g, or t
  misc_feature (438)..(438): n is a, c, g, or t
ggaaagttaagagccactgtcctaaccttccccaaaagttccacaaacaggggacaaagtattcaaatatatgatcctgtgggggccattctaattcaaactgccaaagctccttatttctttcacactatagcctgatttcctagaacttctgcgtactcccttgtcagctcctgctttctgtacaggccccaaatgcagtcacgtgaacttccttccattgctccagtattcatgctccttattttttttcttttttcctttttttttttttttaagtgaggtttgagcanggcgagtccactaganactgaaaagatcacaaacagaacactcactgactggncccaacttncccttggcccagctctgtagcagggcacaatgntaccttggctctttcttgagtaactctaggacttactggncattccctgntcctagccactacaaccagagatgatgagatagcatggtgttatcccaaggaataat

SEQ ID NO: 3907 - DNA, 399 bp, Mus musculus
  misc_feature (102)..(102): n is a, c, g, or t
  misc_feature (139)..(139): n is a, c, g, or t
gtaaccaactgccttgcggaacttcagtaccacaatctgactccttcatccatgaaatgaagacaaatgccaactcccacaaatactatgaggaatgaactnaggacatattttaaacatattgggtacagcctatatnagaactatcctaaaagtgtgctaatttacaatgttactacggttgccttactgtttacacagatgcaaaatttgttcacaagcacctaccgaatgccatatagactacaaaaatcaagatttcaaggaagacttaagttctgaatctgtacatatttcaaaccttgctcataaacagattattaaaaatatttcatagattcattttctgagagcagatttgagttcctcagagagtacgttcttaccttattttctctg

SEQ ID NO: 3908 - DNA, 438 bp, Mus musculus
aaatccagggccttacataccaggggactgactgctctagggcagatctacatccccagcctgactgtctctttgaagcttttcttctcccttgaaaggaggctcttggaaggccaagccacagtctttaatttgcctggctgtttgcttgggtagccctgctctttcaggttcttccctgtaccttccatgcctggcactgagctgtgaggcatgtgggttaggcagacatgtgaattagggactatgaggaccccatggaggtttggacagacagagatgtctctctatatatcatgccctgaactcactacttcagagcagccaagagttgctgctgttcactctggatgtacagataggatgcctggacaaggtttctcattctatcacttgggcaaatggctaacctcagtttcctgatctgtaccagaccag

SEQ ID NO: 3909 - DNA, 511 bp, Mus musculus
  misc_feature (145)..(145): n is a, c, g, or t
  misc_feature (302)..(302): n is a, c, g, or t
gagttccttccaaaatcgaaaacagatttcctgaatgttgttctttccttgggacatatgcaaaaacatttcctcccttttagggtagtttatctttaaaaccaaagccagggcccattagaaacatgttgaaaatcctgtgttntatgagttgatgctgactaagccatccactgtcatcgtccttcctgccttcctgccactgcctagatttggccctgatttccacattgaaaggggtgtgcttagtgctaacacatgtgtggctctgggagaggccgacacagcccgctgctcttctntgagccaagttaaacagctgagggcaagtttcacagacatgattggttaatggttctaatttttttttcaagtgatagaaacacagcattcttgtacagtatatagattaccactctcctggacaacatcagtaacctctttacaacattacgaagccatttgtaaaaacacataaattgtattgtttagccatcttcctgatgtgtca

SEQ ID NO: 3910 - DNA, 473 bp, Mus musculus
tagagctacatgttgctgcaccctgctttttacatggatgctggaaatctgaactcaggccttcatgcttgcatggcaagtactgtacccctcagccccaataaatattcattttacatacaacacggcttcaaccttgccaatcccctctcaacagatctgtgctgaggatcagtgttttgagttagtatgggctccgtatttgtgaaaatacaggaattcgcccttttcggtggcacttcctaggcatctggctgcatcaagatgaagttaaaggtctccttcccaaccaccagccgtctgaaactcaatgctgtagatgatgacctcagacttgatactttctattggaagtacataaccacagatgtagctgctgatgctgggtaaagattgagagcttgtgtggtcttctcagtgacagggcaaacaaggttttcccatgaagtaaggtgtcttgacccatggcggag

SEQ ID NO: 3911 - DNA, 427 bp, Mus musculus
  misc_feature (304)..(304): n is a, c, g, or t
  misc_feature (312)..(312): n is a, c, g, or t
  misc_feature (361)..(361): n is a, c, g, or t
tggccaatgtcaccaccatggtaaagccatgatgatgtccctggtctggactgttgcctggggccatgttcacatctgagggctgtgcagggctggcgaggcccctcactgttctgagggcatgaacaagggagagttggctcacccaacatgggctgcagcaccacatggacccagtgcccacagaggccagaagaaggcttcagatcctctgaaactggacttaaagatgattgttagtgctggggaccgaaccctggttctttggaagatcaacactgagccatcttcatatctttctgancaagcatnatatataatatagtataattatagtctaatatagtaaggcacaactatntcaactgaatttattctgaatccacagaaattctcacctggtaagcacatgtgtaccagtcatggg

SEQ ID NO: 3912 - DNA, 558 bp, Mus musculus
  misc_feature (486)..(486): n is a, c, g, or t
ttagactgcttcctgctaatttaggaatgtcgcattcctaggtgcaagtccagtctctccaaacagcaatccagcaaaacagcagcagcagaccaacaattcagcaaatgtgacagcagggaccagtggcagtagctgcctcaggccctctcaaggttctcaatttataccctctccagagtccccagaattaaaccatctgcagctggcagaaatcatgccctcttagagcacgagacaatcatagttaacgactttagacaaactaaagcagctccatatcccacacctgggattacaacaaaaacattgacacaacataattaggttttcaaagaaaccaaaagtttcactacaatgatttctctcaacctgattctgcagaacatttgtaatgttaattaatatttgatagcagaaatattgattcatctttgataataaataatttcattgaagaggtgtctgtgtgctgtatctctagtncaaagtctctttagaaattaatctaaaaatagcgaggggtatagcttagctgagagcacattcttaacgtaa

SEQ ID NO: 3913 - DNA, 408 bp, Mus musculus
ttagcattgcccacatgtgcatggtgttcagctctctactggaggatgggaaatctaccagtagccacaccctaaaagaggaatgattctcccttacctgctccagcagctatcagctgccagtagctccccaatacagatgggggctgtgaagcacctttcttgaccttgctgaaatttcaactggcttgcccttgtacaggtcttgtgtaggtcatatcagctgctttgagctcattagtgtggtagccgcattctgactggaagacagcatttcacagctctcttcctcagcttcaggcttttcccacctcctcttccacagagaaagaacttaggttgaacttattgctggactcagaaccatggtgcaccgttcactggggacacatttatctgactatctat

SEQ ID NO: 3914 - DNA, 524 bp, Mus musculus
  misc_feature (336)..(336): n is a, c, g, or t
  misc_feature (356)..(356): n is a, c, g, or t
  misc_feature (373)..(373): n is a, c, g, or t
  misc_feature (419)..(419): n is a, c, g, or t
  misc_feature (496)..(496): n is a, c, g, or t
taaactgacgagctcccggaaatttgtagttcaagatgacccaaatacttctgattttactgatactatatcaggtatcccaaagggtaaggcctggccaggcacttcatctctgactgcatggaaacctgatccctagcctggctctcagaggtgaaactaaagtcgagcagcagtccctctggccacagtgactttgctctcctgtggtttttaagtctgagtacattcctgcccacgacatggctcctgagacagccactcagacaatctaatctgtattgggttctgctggcagatgctgagagcctgctgaatatcagaggattctgaggntcaccctctcaatatcaaangacaaaagctcgcagangacaaatacctgttaccaaatatttttatctgggaggctatctcanccccttcttagcttcatctgcagatgtaatgtggaaaggatatgcagggtgacaagttgtccaaatgccacaagtgncaaagggtggcatagtacttgtctgtaa

SEQ ID NO: 3915 - DNA, 470 bp, Mus musculus
  misc_feature (303)..(303): n is a, c, g, or t
  misc_feature (308)..(308): n is a, c, g, or t
  misc_feature (344)..(344): n is a, c, g, or t
  misc_feature (383)..(383): n is a, c, g, or t
  misc_feature (406)..(406): n is a, c, g, or t
  misc_feature (421)..(421): n is a, c, g, or t
ttgttttgcttgaaccagggcctcactatctagctgggtaagcccacgcaggcctgtaatttaaggtcttcctgtgtaagcctccccaatacctggcctcgtgcatggtagggcatttggtgtcatccttggcttctacctatctgaggccacttgcagacccaactgaccaatcaacccttcaagccttgctttctcccacttcttcacaacctcaggtttaaatttgcctcgactgatggtctccagcaacctgtcaaaaataacacgggctacattctagatttatgaatgcctaaattngactnagggacagagttggtttttgtttttaagatgaggtntcatatagctcaggctggtcagaacttttatacagccanagacaatcctgaacaccattctngtccacctgccgctntcctaccaagagctggggtggcaagcacataccagctcacagatcaaat

SEQ ID NO: 3916 - DNA, 471 bp, Mus musculus
  misc_feature (30)..(31): n is a, c, g, or t
  misc_feature (37)..(38): n is a, c, g, or t
  misc_feature (42)..(42): n is a, c, g, or t
  misc_feature (53)..(53): n is a, c, g, or t
  misc_feature (62)..(62): n is a, c, g, or t
  misc_feature (66)..(66): n is a, c, g, or t
  misc_feature (72)..(72): n is a, c, g, or t
  misc_feature (75)..(75): n is a, c, g, or t
  misc_feature (82)..(82): n is a, c, g, or t
  misc_feature (94)..(94): n is a, c, g, or t
  misc_feature (96)..(96): n is a, c, g, or t
  misc_feature (108)..(108): n is a, c, g, or t
  misc_feature (117)..(117): n is a, c, g, or t
  misc_feature (180)..(180): n is a, c, g, or t
ttttcgttgctatcttatacctgtaatttnngctgcnnttangaatagtaatntgaatatcngtgntcttcnganggtcttnggcaacctccangnaaggcccccccnaaaggtcangacctacaggttgagaactgctgtgttagaatgggcagcagtaagcctctgggtcctgagtcnagagtaaacctggcctcagccttccagcctcagccctgagctttagggaactgtggttggtgctgggaaaacttagggagacaaaacctcccaacacacagtgacattagacatcaccaggtctagatgtagcttagcttacaaatattggatgaacttttcattttatttccacaagaaacttctgggatttttttcttttccttttggcttttcctttaggccctatgtttgtggaccagtagaaatgtatttctctctacacacaaacatcacccgatctgatcaaaa

SEQ ID NO: 3917 - DNA, 560 bp, Mus musculus
  misc_feature (321)..(321): n is a, c, g, or t
  misc_feature (331)..(331): n is a, c, g, or t
  misc_feature (333)..(333): n is a, c, g, or t
  misc_feature (342)..(342): n is a, c, g, or t
  misc_feature (381)..(381): n is a, c, g, or t
  misc_feature (383)..(383): n is a, c, g, or t
  misc_feature (394)..(394): n is a, c, g, or t
  misc_feature (409)..(409): n is a, c, g, or t
  misc_feature (411)..(411): n is a, c, g, or t
  misc_feature (424)..(424): n is a, c, g, or t
  misc_feature (509)..(509): n is a, c, g, or t
gcggtttggcacttgtgttcaacatgtgtgggctgttttcatcttcaatggccctttcattggattgtcgatggtgcaccgtttcagcaagaggcgtgactctctcctgcctgtcattatggcaaacatctatctgctagttcctcctgtgctcaaccccattgtttatggagtaaagacaaaggagatccggcagcgcattcttcgtcttttcctcgtgaccacacacacttcagatcactaggaaatcatgatgaaaccttcctccattcaaagttctgtaactcacactttagtatgatatcttggaagacagtattnagaaaataantnttaataaanatatagctcagatctttcaaggatgaaacttgctgtggnanttctacgtggnatggaagaacacctncnatctccattttcnaatattacattcattcttttgtttttttctctagataattattaagatcaagacttgtgttttgaaagttatttctcacaatttnatcactacttccaaatttcaattcatttcactgatgatcgttcacagcatt

SEQ ID NO: 3918 - DNA, 516 bp, Mus musculus
  misc_feature (201)..(201): n is a, c, g, or t
  misc_feature (232)..(232): n is a, c, g, or t
  misc_feature (238)..(238): n is a, c, g, or t
  misc_feature (282)..(282): n is a, c, g, or t
aaggataatgcacttcctcaccttttcaagtttctaggcacacgtacggtcttggctggtaagtttctactacatattttgactcatggtccctttcctaaagccaaacacagctgtgtaatttttcttccattgcttcactctgacactgagtctctttctatttcctgtttctgctgtgaagggcccttgtgattacgnttagggcccacctgcatcattcaggataagnctattntgaagatcagctgactggcaggcataatttcatctgcaaagctntaatgcctcttgagcacagaatataacatattactagctctccagattaggatgtgagcttattacggaacattattttgcatgccacatgtgctgtgattgctaaaataaagtcctctaactaaacaaaaacattgaggaagaaacacaaggagatacctgataaggctagaatatcaacagtgaaatcctgagaggaaatgaaaggagaaaactaccacacagatacagaag

SEQ ID NO: 3919 - DNA, 513 bp, Mus musculus
  misc_feature (333)..(333): n is a, c, g, or t
aagtttatcttctgtgtcttgccacaattaggaaaagtaatgctactgttgaatttatttcctctaaatataacctgtcacattgaccatttcttacttgttcgggactacagatcagtgcgtggttaagactacatactatgcagttggtcccatttagcacagtgactaacagctattcacaggggaggcttaattgtggtctacagaattgccttatgatcctacttcaagtaatgattttgtggaaacgaaggcaaaccaaagaggtaacagaaagcaaacagaagcagctgaggtgtaacttaagcggacactcctgctcctctttantgcgtcttcataggtggtagaatcaagttgcccaggattagctcacttctctgccaggtcactgtgttacttgatgtgcaatcagttagtgtttttccttagattcttctgctgtacatgctggtctcaaagaaatgctaggtcttgtaacctctctcactatctcttttctgtacagac

SEQ ID NO: 3920 - DNA, 377 bp, Mus musculus
ggctattctgaacttgggtgcctcaggtttggattttcctgtgaccagctgacattcagctttattcatgggttcatctcataccacaggccttcggttagctcaccttccgtggcctgtctcgggaagagcaggcttctttttaagcagcaaaatggagatgtgtaaacagtaggacatttcgataactatgtcaggtcagttcttagttcagtacttttcattaaaatttgatatacgaatttcctctagaagaagatccctgtgtaggtttcagactttattgtcctttgaggacagtgtcctcattgtcctttttgattgaaaacaatcaacttttctgccttcattttaagtgcccatgtctctcatagaat

SEQ ID NO: 3921 - DNA, 349 bp, Mus musculus
  misc_feature (189)..(194): n is a, c, g, or t
  misc_feature (196)..(198): n is a, c, g, or t
  misc_feature (200)..(206): n is a, c, g, or t
  misc_feature (208)..(210): n is a, c, g, or t
aaaattttgatcttgccatatgcctttaataaatcatggtgatagtataatctgctatagtgaacacttagtactttattgtgagctgttataataagagattgtcagggggaaaaaggagagatgcagggtgaccactttgtgatattgaaataatcttagctatatatatatatatatatatataannnnnntnnncnnnnnnntnnngcagtaagccagccataagctagtgacaaaaagtatattgataatgtcagtgtattagctgcctttgacagtgataaggtaggacttgaaaactggcaacatggctgttacttgatggctttgccataacagttaagta

SEQ ID NO: 3922 - DNA, 496 bp, Mus musculus
ttgacagcccagtacgcctaaagactctcttctcatacccccacttctccacctacatggctgccttcccatgcctgcctggctgccacaaatattgttcaggttgtcagctgttggcatctggtaaatctaattcttactggcccagagaatgtgctaattacgtcctgcagctaattagaaagcagcctctttgctagagaagagtttatttagttcatcaatgaataagacttggtttgaatcttgatttaaaaatcaaaaggaaatggaaatgggatgagctagaccaaaaaatggcctttaaagaaagggacacatgctatttaattttaaaaaaatatagatttttcagtaagagccagaaggaggtgaattttcactaaaactaaaaagttttgagtacatttacatttcaagaatgaacaaatgatgctgatacattattgtcagacttcagatagctgaagtcgctgtggccagaacccaatttgaa

SEQ ID NO: 3923 - DNA, 535 bp, Mus musculus
  misc_feature (84)..(84): n is a, c, g, or t
  misc_feature (87)..(87): n is a, c, g, or t
  misc_feature (131)..(131): n is a, c, g, or t
  misc_feature (177)..(177): n is a, c, g, or t
  misc_feature (219)..(219): n is a, c, g, or t
  misc_feature (239)..(239): n is a, c, g, or t
  misc_feature (252)..(252): n is a, c, g, or t
  misc_feature (370)..(370): n is a, c, g, or t
gtcaggttcaggtttctccctgtgctgatggtgatgctgatgctgatgctgatgctgatgctgatgctgatgctgggcctattncantaggcatgggctctttctgaaactcctgactgataagagggagnacagaggcagtatatgctagaaagggagaattaacgcaagaatcanactctcttgctgtagttctcatccttattacctgctaagtanacaatattgaacaaatcagncagtctcactgantttgggctttgtctgtcggaatgattatacctatcgtgcagagtcgcttcacaaaatctaacaaggccaagtttattcttgttatactgggcagaaaaggctccagaaattagagctntttacaagactgaagaaatagcttagtcagtaaagtgtttgctgtacaagcttgaagattttactttaaactccagaacctatgtgaaaatgccaggtatggcatatccattaatcccagttatggggaggcagaaaccaaaagcttcctggagttcattagcca

SEQ ID NO: 3924 - DNA, 487 bp, Mus musculus
  misc_feature (182)..(182): n is a, c, g, or t
  misc_feature (369)..(369): n is a, c, g, or t
  misc_feature (386)..(386): n is a, c, g, or t
gaattgtatataggacctctgctcgctccggtcaacccactccctcagtctctgactgctccagcccaaagatttatttattatttttattaagtacctgtagctgtcttcagacacaccagaagagggcgtcagatctcattacagggggttgtgagccaccatgtggttgctgggatttnaactcagtaccttcggaagagcagtcagtgctcttaatcgctgagccatctctccagcctgagaggccagtatctaaatgcagattagattaagtctctggagtgaataattccagtgctcgggatgggctctccagtactgagccctgctgctagctcactaaataacttggattggagtatctgnaatcaggggctcaccantagctttgagctctcggcttttgttttcctgggataatctgttcacccataagattctgtggctgttgtcattggaagagggccacatgcagccactgaat

SEQ ID NO: 3925 - DNA, 456 bp, Mus musculus
  misc_feature (26)..(26): n is a, c, g, or t
ggattaacatcatatttcaacgcaancagccatgttcctatgcatcttccttataatttccttggaacggcttatatttaagcatattttgctcggtgcctttgatttcaatgcaaagtgtatgcacatatctcagttctgccatccaggctggcaaatcagaacagtcttcctagtggtataatgaagatgtctacatttcccctcattagctgcattcttctataatgaggataaaacagaggcacaggagagtaacatatttaattctgagcattcttccataataaaatgaaaaatggggactgtaaaaatcagagcacttatcagaatgtgttaaacattttccctactttataaagttttaccagtagtgactgtaaggctgataagaagataataaacatagaatatgctcatttagtaaatatataaaacctttcctagctgcagagt

SEQ ID NO: 3926 - DNA, 548 bp, Mus musculus
  misc_feature (183)..(183): n is a, c, g, or t
  misc_feature (376)..(376): n is a, c, g, or t
atttggatctctcagcacatgaactgaggttgacatggaagggaagccctaagagcttcagcgattgtccgtggtattcacaccatccttccgtctccgggatgtcccttgttcctaggttgcaggcttttcttcctggacccttttctgcttggccccatttgctggggtagttaccactgnatgctcagtactggcttgaaaactcccgatggagggaaaacgtactctccttgctagccccatctttcagaacacgctttaccactcttttatggtcacctgcctgcttatctgtggccctccctgctggatataagtcacttcctgtcttgttggcctttcctcgcctgaacaggtcctggcaagagtctgnttgagtgaattggaaaggaatacaacaccccctcgtatcgacgagcaccgaggcctcggaggggagatggtagccctcatgaccaagctcaccaaggggacagcgggaatggaattcaggtcttggaggcttctctatcttatactgtctcctacatggctttgctactgta

SEQ ID NO: 3927 - DNA, 442 bp, Mus musculus
  misc_feature (128)..(128): n is a, c, g, or t
  misc_feature (244)..(244): n is a, c, g, or t
  misc_feature (332)..(332): n is a, c, g, or t
  misc_feature (351)..(351): n is a, c, g, or t
aatggagacttgtcttcactgacagagagaacagtggaaccgcccctgccctacccatcgtctgtgttcatgctgaacccaggtcccctgcccagggcgagttcaaattaaaagtgaggccaaaatcnagtttgctttcataagccacagatcctcctggtggttcctgagtgtgcatagttaaatcctgtgtttttagagcacctgcaagccagggagggagagcatggggcagacagtggtncgagctgttcaagcatgatgacccgagttcaatccccactcctcacagaataggctgagtgtagggcagacagcatgatagctccctngctaaggtacttgttgccnagcctgacagcataagtttactccctagaacccacacagaagaagggtagactaactcttacaagttgttctcaaacccacaacatgcaca

SEQ ID NO: 3928 - DNA, 538 bp, Mus musculus
  misc_feature (282)..(282): n is a, c, g, or t
cagtggtagttcttgggtggtcaacaaccgagaacctttagaatatgtggaatctattgttctatgatctggtaaacatagtttaagttgtacaggagtccttaatgaaccatttaagtgataactagttatatatccattcttctaagactctgcaagtgaatggatagaactagagtgattaacaaaggctaggaatcagaatttgccttttgtacaactaagtgtgttctaacacttcagaaataatgaataaggaggtaggtacaaatccacatggtnaaacagaatgtcactaatgaggtctacacattccttcaggaaaataaaatataatgtaggactttgaaattatttattaataagtaaaaagagcgattacaaatgttaggaccttaaggccttggtcaaactgaagactttacaatggcagggaaagtaatgataacaatgctgtctatgtaagcacacctgacagtaccttggaaagagtataaaagtcttaccctgtaagctatgctttctttcagtaactgga

SEQ ID NO: 3929 - DNA, 485 bp, Mus musculus
  misc_feature (256)..(256): n is a, c, g, or t
tcgcttgaccaactggcagggaatcaagcccagtacggccttctgggttcaatgacatgatctctctgtgtgtgtgtgtctttggcttccacatctactatgtgtagctagcaggtagatttctgtgttttcccgaaaactgttgggttaagatggatcccactggacaatttttcttctctctttatcatagccctggcatctgggcttaatacagttgttggaaactaccctagcgaattcacttgtcaatcantctgatatcctagtgcctggtgggggtgtggggagggggatacatgaccttcagccttcatctacaggagccaagggaagacattgggtgtgagctgttggtactgatgtaacatgaatctgctcagagtccagcatgcttttctcactgccaaaacataaacaaaacaaaataacaacagcaaaaactttcctgtgggggaatgactgatacctagacctggatggcc

SEQ ID NO: 3930 - DNA, 482 bp, Mus musculus
gttaactctgctctgacactatacagcgggcgagctcacacatgtgcttgcacatacacatcgccttcttccttcttacccagcactaattttggggctagggagacatccctctctagctggtgattggccaggctcagaaggacctgccttcttaaagtcccattccttcagccttgagaatcccctgaggcagcttgggcttaggcataggcgctcactcccagtgtctcaaacctcacacgggctatgagcccatccccaggattacttaagtagaatacaaagcagcaacctagatttgggtgactctctctggcagccttcctaaacttcatatgacacacaaaagttcaaagtccacaaaaacatcattttatcccttaatgaaaactggggactttcaggatagcaccttgtctccccactgtctcttggcctctgggatggcgatgtgtggtctctccacagggacgagtagt

SEQ ID NO: 3931 - DNA, 530 bp, Mus musculus
  misc_feature (176)..(176): n is a, c, g, or t
  misc_feature (179)..(179): n is a, c, g, or t
  misc_feature (335)..(335): n is a, c, g, or t
ggtcgagggcatgctgattcaccagctgtggcctctggaggtctactctttacggaacttcactggggggcacacctgggggcttccagtagctcccaccctctctccccatttccccttctcacttatactctgaagcttgccacagccccaggggaagaacccaggaactatcnccncagagaatgccttcctttatacgtggtaggagtggctgtcagaggagggggatgtggctggaagcatccacatggtcgcttctcgcccttatcttcaagctgctgaacaaagttcaaaacctagtccaacctctcatcatatctgtcccaagggcncttgctgaaatgccctggaaagcatgtgatacagagggactaagggagatgtgagtatatgtccctgtatgttaaaggaccagtggtcataggagaccattgaggaaaatggacttggattcatgggccctggaaaatgtacagcctctgtacctgaaggaaaggaacccaggttcccggactctatgacagggc

SEQ ID NO: 3932 - DNA, 527 bp, Mus musculus
  misc_feature (86)..(86): n is a, c, g, or t
  misc_feature (90)..(90): n is a, c, g, or t
  misc_feature (92)..(92): n is a, c, g, or t
  misc_feature (107)..(108): n is a, c, g, or t
  misc_feature (136)..(136): n is a, c, g, or t
  misc_feature (210)..(210): n is a, c, g, or t
  misc_feature (450)..(450): n is a, c, g, or t
  misc_feature (458)..(458): n is a, c, g, or t
cctttcttctcagctctgaatttgtctctgtaactccttccatgggtattttgttcctccttttaagaaggagcgaagtatccccncttngntcttccttcttcttnngtttcatgtgttttgcaaattgtatctnggatacgtcttcaaagacaaggcctgagtactgaggccctacagcagatggaaatgatcctcaggagatgcccnccacaggagcttgtagtataagtagctctgcagcagagctctggcctagcactgacatgccgacgccctctctcagtgcccagcactgaccatggaaggggggttagtggtgaacctagaaccaaagttcaatgacagaactaaatgagaatggggaaggggttggcactggagagctggctgggtggctaagagcacttgctctaagatgtgtggactaaaggtaaagtgttggacacnctgtgacncactacagcttccacagtgagagatttttttttcttttggggaggaaagtttgcaaggtcagagagctg

SEQ ID NO: 3933 - DNA, 510 bp, Mus musculus
ggcactaattctgggaaccggcacagagctaatcattatagaagtagctcggattcccccgagggtccagtctccggggaaagtgttgctggtctagagaagccgtgagcccgtaggaacatcccaaaagaagttctcgacttggtgtctgggtttcaaataccaatctgctcttggcaagccttggcttcactccgtctttgtttttataaatgcaggctagctcattctaactctgaacacttctgccagtaaaacaatacatccaaatacaataacactggtcacgatctcagtccagagattcaaggataatcagaatatttatttctgtcagcctcccttacccacacctctgtctgacctttacatttagcagggaaattcagaggcgaggcgggggaaatatattgaaagcaatagagggtggaatttgaagccatggatgtcactcttgtcttcctgaaatggttttctgcatgtccaggcagatagcatacccctgtaatc

SEQ ID NO: 3934 - DNA, 434 bp, Mus musculus
  misc_feature (281)..(281): n is a, c, g, or t
  misc_feature (318)..(318): n is a, c, g, or t
  misc_feature (344)..(344): n is a, c, g, or t
  misc_feature (369)..(369): n is a, c, g, or t
  misc_feature (376)..(376): n is a, c, g, or t
  misc_feature (406)..(406): n is a, c, g, or t
catattttgcccagtcattggactttcttctcaccctattccccattctcctctctatttttgttccagtagttctctgagacaggaacaaccccagatcagaatttctgactgtaggataattcttgagaaaaaaaaatatgtgatggatgaggaaatggctaaggaagtgaggtagttgccatgcctatttaattttggtttttggtcagatcctccagaaccatggaaatacgtgtcctgtaatttcagcatccccatgagtagaaaaagggaggaanaagagacatcttgaacttttggtgtatgcagtggtanatgcagtggtgaataagagaacctanatcaaacagtcaatacctgaagctntcctctntcctctgtgtgtacaccgtggcatgtgttngggtgccaacttgtttctttctgtgtac

SEQ ID NO: 3935 - DNA, 499 bp, Mus musculus
  misc_feature (302)..(302): n is a, c, g, or t
  misc_feature (311)..(311): n is a, c, g, or t
  misc_feature (378)..(378): n is a, c, g, or t
  misc_feature (403)..(403): n is a, c, g, or t
  misc_feature (422)..(422): n is a, c, g, or t
  misc_feature (435)..(435): n is a, c, g, or t
gagctgaatctagtccttgggtttttagcattcttcccattttgacttgtttgcagctgtgggggtaagaaaagctacttctatggagataagagtttaaatttgaatgccctgtctcggggttctggttctgcctaaccctgcagtctgcaaggactatttgctgccccagttgaggaaatgtttagttgataagcacatctttataaaccttatttctgtgcatctggcatttaaaagcacttaaatagataaactagtgggttagcctcagacataatcaccactccctttttgtgttntggataacnaaaaaaaaaactaattgtacttgaactatttattcttgatttgcagaaaaataattttactagagcnatggtaaacccaaggcatgtgattnaaacattttgacacatttnaaattgctgcgtntgctacaggtggtggaagggctttgttaacacagcacttgggcatctgaggctgttgatcctaa

SEQ ID NO: 3936 - DNA, 465 bp, Mus musculus
  misc_feature (324)..(324): n is a, c, g, or t
  misc_feature (344)..(344): n is a, c, g, or t
  misc_feature (364)..(364): n is a, c, g, or t
  misc_feature (367)..(367): n is a, c, g, or t
  misc_feature (392)..(392): n is a, c, g, or t
  misc_feature (416)..(416): n is a, c, g, or t
  misc_feature (433)..(433): n is a, c, g, or t
agaaccaaacctagatgctgaacagggatgagagatccaccaacattagaggccctgaccccaaggcctggagcaagaggatgccattgtgtcaggcagctttaccaagtccttccttctgcctactgccttcagacaatgacacttacaaaagcggaagcaggggtgcacagatctcagatgagggctgccctgggctaaggcatgcatgcttcaggcttctcagttctgagaacacatgttcacagcccacagagtctgtgtcatgcattccacactccaaggctgcccccacctcctcagccatgcatccacagcatgctncatactcttgaatccggaantaaggacaatgcctcctagnagntcagggaaccttacaagagcatctncctcagtgtgagattaggacgcancatgcagtaagaatctncatgggactctcttactgggtacctgtaatgt

SEQ ID NO: 3937 - DNA, 554 bp, Mus musculus
tcattgagtcatacggtggcagaacatgcttttaattctggcacccaggaggcagaggtacacagatctcttaatttgaggtcagcctgctctacagagcaagttccttggtagccagagctccacagagaaacccttatcttgggagggagagctgaaatgattagtatgtgagtggagataaaactcagcatgcttaacaatagaaatattggttcctccatatctttgatgtttaatactgaccaagtacatagcaagtgtctggtgaatatgtgttgatatactttaacagtatgttttgaggatcgcagggctgatagccttagctagagtatttttgttaagattaaagagaaatgaaaatcatctttgtcttcctggttgttttaggggctcccggcttgggcaccagctctggtgcttagctttcatttaatcaagaatgagtaaataatcatgctgatgaatgaaagtggctgaagcacttgtggctaagcttaattgctacctgactgggaaacagataataggtctgggcaaggaaccaaaca

SEQ ID NO: 3938 - DNA, 521 bp, Mus musculus
tcctcctcttaagtgctggctacatcaccttaggccagtggttctcagccttcctaatgctgggaccctttaatactgcagcctcacgctgtgctgacccccaaccataacattattctcgttgctacttcatagctgtaattttgctactgttacgaatcataatgaaatcatttgacttggcagaggttgggtcccccagattgagaaacactgccctagacaaaagtcttgactctgagtttcagttctgtcatctgtcctgaggaccagagaaggagcaccttccaattccttcagaagaagttagagcagatgtgctgtgtgcccaaaactcttaagaaatccttctacgttagtccccttctttggatctcaaattcctgtgaccttctaacctcctccctcccgggaccgagccggaaatctagaaagttcttgacaggcaagagtgtgtgtgggggggagtcattattattttgactgattacttatgtgtgactcttagctttcccaacctt

SEQ ID NO: 3939 - DNA, 416 bp, Mus musculus
  misc_feature (191)..(191): n is a, c, g, or t
  misc_feature (193)..(193): n is a, c, g, or t
  misc_feature (197)..(197): n is a, c, g, or t
  misc_feature (229)..(229): n is a, c, g, or t
  misc_feature (306)..(306): n is a, c, g, or t
  misc_feature (375)..(375): n is a, c, g, or t
ttcagaagcgaagccttgagcaaggatgtgaactccttgtggcacaggaccgtgatgttacataacggtggccgagtgcccaaaacccatcactacacttggctgccatttgttccctgtgcacttactgaagctgggcacatccaagagcccagtaagcttttgaggtcacagcctgtccatcagaagancngggntcaagatcaagtgcttggtccacacagacatntccgctactgatttttagtcattgtgggctactcaaaacaatgaatttttaaattttccaagctgaaggacttaaancaaaaaccctcttacaatatcaatatgaaatcagtatataaacttgtgttctaattacatggtattttnccaagacattaaaaaagttacctccctctaatttacaagtg

SEQ ID NO: 3940 - DNA, 483 bp, Mus musculus
  misc_feature (282)..(282): n is a, c, g, or t
  misc_feature (301)..(301): n is a, c, g, or t
  misc_feature (320)..(320): n is a, c, g, or t
  misc_feature (351)..(351): n is a, c, g, or t
gcctgtgacagggtcctattatgttatacaggctaacctttgactcatagtcctccagcctcagcctcccaggtgctgggatgaaaacgtggtgtgcttgactatcccatctagacaacagtaacttttcggggtgtggcaacaaagtgtaatcttcatacatggtggatgggtgaatctggcaaaagccagccttggcttcacagcagatttgaggttggcttggattacataacatagtatctcaaaatggaaataaggaaagagaaatgtgtaaaagantcagaggaaatgaggactnttagtttgaaatagggtcnttctgagcagtgcaggcaggcctccttagcntcctggtgctgggatgatgggcttcctggactgtgtccagctgctgaagtgggaatagaaaggctgagggaaagagaagagagagattggaggtttcttttgagttcttagggttgaaccttggcctcctgc

SEQ ID NO: 3941 - DNA, 539 bp, Mus musculus
gattggaaactctctaaccgtaaagtgtcaatatttgaactttatttttcggattagaatcaatcttgtctttgctatctgtgctcagtgttagatcccagaatttgtcatttagtttgaaggcatgggaacacaggtaaaattcctgctcctgtttcaagaaggaataaatccacaaagatgcactcaaaggcttctaaaattaaagctaggggcaatgtaaaaaaatagagagagcgaatgtggggagggggaatgggcttctgtgggcataaagggcaaacataaaagtgaaacaatgtgtaaaacatcaatacaggctaagcagaggttccttcctctgagacttgaactccattttctccacactgctcctgttagggaactatatgataaagcctttgtagatctgtcttagaattttctattatagtcatattggctggaatacctgttaagcctggccccgccttgggtttccttagctggttgaataaatcatttcacgttttggagactcaatcttcccacttgttaga

SEQ ID NO: 3942 - DNA, 493 bp, Mus musculus
taattaggttggcaaatccccgccggtcttggtctgccagtgttgagttgcatgtgcaggcttccccatccactgcctgcacctgttcccttcctccgagccattccaaggggtctgaataacccagtcagggctctgatcctcctctgcctgccttcctgctgggagaatagttagcacttgcctaaagctggaacctggttcagtctttctccctcacccatgccaactctcaaaatcattctttttcctaattatcttgaaccagttaatcatttccacactgactgttcagtaacaaggatgtagggagaggcagccatgcatcttgtctgcccggggcccacatttaccccaggggtcaatgctggatgctggacagtaggctttcctcaaaagaagcttgcttcaaactgtactcctttgcggctgagaaaaacacgccctacaaaaactgacaagctctcaaatagcaacccaggctgaactgcag

SEQ ID NO: 3943 - DNA, 497 bp, Mus musculus
atcctgcttgcataactattctgaggaaactatgtttggccaacagagacttaaatgtggaagctgtgtcagattgatagagacttaaaacgatggttttcggaaggatggtttcaaaagtcggcaggtgcctatcaggaaagattccttggtacaatgaacatgtctctgtctgcaacttacaaagtattatgacagagggttcctatttgacgagtggacgtatgcccacacatggttaatgtgtctttcatcttgcacagccatataacttcatttgctgccagctgagcatgtgctcatgttcacaggacatgcctggctggacatttacttttggtttgttgaaattgtgctttgtagtacaaaataggattgggggtgattaacccagtgggaaagagaaggaggaagggaaactactggggacttttacaataatcccgatgttacgacttcttgaaatgaaataaccaatgatggcagtgctcgggcga

SEQ ID NO: 3944 - DNA, 501 bp, Mus musculus
gtattgactccttattcagctacaggattccatggtgggtgttctgcttactgtccttgagaatatttcatttaataatgtcttccagtcccacccgaggtgttgaaagtgactgtattttatctttttatggctccataatagtccattgtgtacccacaccaccatttattttttcactcacctgttgctaggcactgaagtagatcccacatccccaggttttgtgaatactgctgcagtaaatatgagtacaggttcctcctggtgagcttttgtatggaagacacaccttttcatagactgacagcgtcttaaggacacgctctcattgttctgcatttcttttattttgtggcaaggtggggaaggatggttgcccatattcaacatctcacctatttcccaaggctgcttaagacatttcccacacacattgagacccgtgcctcaagttggatacttctggcgtcaactgtccaagccccatgtagtgcaaac

SEQ ID NO: 3945 - DNA, 554 bp, Mus musculus
  misc_feature (263)..(263): n is a, c, g, or t
  misc_feature (338)..(338): n is a, c, g, or t
  misc_feature (432)..(432): n is a, c, g, or t
  misc_feature (503)..(503): n is a, c, g, or t
gggtgccattccttaaagtggatctgtacaaggccatctgctccttttatttcaaaataaaaactttatttcatttaaaacttgtatttgctgtaggagtttggggatgaccgagttgttacatgcttttcttgcacgtgtgaggaccctagttcaattcccagaacccatgttgggggttcatgcttgtaaccccagcactggtgaggtagagtcaggtggctcttctgggctgaccagccagcttagcctaatcacaagtntcatgccaaagagagaccctgtctccaaggaggtggacagctgtcctgagaatggtacttgaagttattgcctgnttttaaacatgtgcacacatgtaccctccctgcaagtgcaacacccccccacctgcacatgtgtacacacgtacacatgaacatacatatatgntgcatagcaaaaccgctatttgtgtcctttgtgtgataactttaagaggggaggaacttactcctgtgggnctgtcatctgaccaacacacacatgcagtggcacttgtccacgtacatgct

SEQ ID NO: 3946 - DNA, 505 bp, Mus musculus
  misc_feature (87)..(87): n is a, c, g, or t
  misc_feature (93)..(93): n is a, c, g, or t
  misc_feature (95)..(95): n is a, c, g, or t
  misc_feature (100)..(100): n is a, c, g, or t
  misc_feature (108)..(108): n is a, c, g, or t
  misc_feature (110)..(110): n is a, c, g, or t
  misc_feature (114)..(114): n is a, c, g, or t
  misc_feature (121)..(121): n is a, c, g, or t
  misc_feature (126)..(126): n is a, c, g, or t
  misc_feature (132)..(132): n is a, c, g, or t
  misc_feature (150)..(150): n is a, c, g, or t
  misc_feature (154)..(154): n is a, c, g, or t
  misc_feature (157)..(157): n is a, c, g, or t
  misc_feature (167)..(167): n is a, c, g, or t
  misc_feature (169)..(169): n is a, c, g, or t
  misc_feature (191)..(191): n is a, c, g, or t
  misc_feature (198)..(198): n is a, c, g, or t
  misc_feature (212)..(212): n is a, c, g, or t
  misc_feature (224)..(224): n is a, c, g, or t
  misc_feature (469)..(469): n is a, c, g, or t
cataggtgatagacagacaggtgcctggggtcattaagaagttttgtgcagttttgttcataaagctatctgtggatctgaatgatnggctcnanacctnggagtccntngcgnttcaggnaagcntgaggncaggaggatgaagagttnccanccngtctggaatncntagactctgtatcaaaaaaaanaaaaaancaattaaagtaatnaaagcagtaatnatgctactttggaaatcaattctctcttccccagagtatcttggagcaagagatatttattagtcactagaggtttttttggcctttccctggacatattcggggaggaaaaaataataataactgagagagacaaaggagctttgtttctgctgtttctaaataacacaaaattctgtcattcatttcttatattttcccacctcagacttcaagcttataattatagattaaatacctgagcnttgcatcagctaaagttctcttctgaagctcaagag

SEQ ID NO: 3947 - DNA, 491 bp, Mus musculus
  misc_feature (316)..(316): n is a, c, g, or t
  misc_feature (325)..(325): n is a, c, g, or t
  misc_feature (354)..(354): n is a, c, g, or t
  misc_feature (362)..(362): n is a, c, g, or t
  misc_feature (394)..(394): n is a, c, g, or t
  misc_feature (400)..(400): n is a, c, g, or t
taaatgttcctgtaatgtaccctggtaatttgcagtgtccgcccacaaaaagtgggtaagttttaaaaaacattgttatgttgtccaattccccggatgttaaaggtgacttcaaggaaaatagtgaaaaaacccaaatttggctgcataatatggaccaagtgctcagattatatctaacccactgactccatatattatatctaacctactgactccatatattaccaatgagagaggcaacattggcactccattttgttaatgggaaactgagatgcagactaaggccccacttagttaagatccaaaaccnggcattgangtcagaacactgaaattgaacttcctttntctcactncagcacattaggaatgatgatggatgggtgtntagtanatattctcttaaagcctagctgtctccctttatgttacagaccttgtctcttttcagagtgctcctatctacctggtagctgagactaact

SEQ ID NO: 3948 - DNA, 485 bp, Mus musculus
  misc_feature (212)..(212): n is a, c, g, or t
  misc_feature (251)..(251): n is a, c, g, or t
  misc_feature (266)..(266): n is a, c, g, or t
  misc_feature (275)..(275): n is a, c, g, or t
  misc_feature (289)..(289): n is a, c, g, or t
  misc_feature (309)..(309): n is a, c, g, or t
  misc_feature (366)..(366): n is a, c, g, or t
  misc_feature (431)..(431): n is a, c, g, or t
gtggagcaccacgtcatattgaagggagtggccaagtcatctcccattggcatggcaaaacattcctgctgtctcaggcctaccactgcaccacattacgctccaggaccatgctcaccgggactggtgttttcgtttctcttgggtagacgcctacatggacgctgtcctgtggtgcgcttgtgaagttcctgtttacgattttatagccntccaaactatcttccaaagagcctgccgtccatcatggntgtgcctgtgtgagnttcgctttntctccactgtcacnaacggttggtgttgtccggntaatgtcgtcattcccccggaagtgcagtgctaccctgagaggtttgacttggattnccctaacagtgactgctgtgggaccgctttctatttgctctgttgccatctacgtatcattttcnaggaaatgtctactctgaatctttttccagttcaaactgtctttccatagaggt

SEQ ID NO: 3949 - DNA, 446 bp, Mus musculus
atagatttgtcttccagagcacatggtatatagctgtgtgatgggaatgttagatgcaaatatcaggagcaattcgttatttaaactagtaaatgtaagtgaattaggacatagctaatagtagtaacatgcacagccattgctgtgacacttaggtcgtgtttgttaccgagtcatctgaagatgaatgttttcaactacattttacagagaagttggatagcctgacccgctgagccactcccaggcagttctcccggcagttgtgtgccgtttctgtccataaatactgtgccaggctgtggcctcaccctcggctgtgtttcctggactctaggtggtagtgatcccactgtgtctgaagtgtgtctcactgtcaccttcactcacatggccctaaaagcaaatgctgttgagtgtcctcgtcggcttgtcaggtcatgtgg

SEQ ID NO: 3950 - DNA, 507 bp, Mus musculus
  misc_feature (332)..(332): n is a, c, g, or t
  misc_feature (337)..(337): n is a, c, g, or t
  misc_feature (344)..(344): n is a, c, g, or t
  misc_feature (356)..(361): n is a, c, g, or t
  misc_feature (364)..(365): n is a, c, g, or t
catagccctggttaaggccctaaaggtgaaccagatcttggagaacttagacctacagagcaattccatcagtgacatgggagtgacggtgctgatgcgagccctctgcagtaaccagacactctccagtctcaacctgcgagaaaactccatcagcccagagggagcccaggccctcactcaagctctctgcaggaacaacactctgaagcacttggacctgacagctaatctcctccatgaccgaggtgcccaggccattgcagtagctgtgggagaaaaccactccctcacacaccttcacctgcagtggaacttcatccaagctggtncggcnagggccntgggacaagcannnnnnctnnccagctgaacagaaccctgacaaccttagacttacaggagaatgccataggggatgaaggagcttcctcagtggctggcgcactgaaggtgaacacaaccctcattgctctctacctacaggtggcctccattggtagccaa

SEQ ID NO: 3951 - DNA, 514 bp, Mus musculus
  misc_feature (244)..(244): n is a, c, g, or t
tgaatggacacggaagcccctctcttcacagccccagcgcgcacactagcatctttcttcgtcagatggctgttggagcttgagaccaaggataccctctggaaatctgaattccattcacttttggcaaagagcagcttcctgcttagagaaggtgtgtgcatatgtgtactcccaaccacagaaactggtagaggggagagacacgtgggtggatggctgtttgaaaagatagtaggatggnctctagtgtctccaggcactggatggcacttgcaaagcttgtctctaggattaggcaaatatctccagggaatgaattagaaacgtgcagtctgtgttgcctttgaaataagctctggcttaaaaccatcacagggaaacatgcctttgaattggaaagccagaactttttttgcaaaataattcaaaaagtttgttgaaccttaaacctttcctgatgactctttccttctgaacttcactcgttaaaagttgctatgatcccagcccc

SEQ ID NO: 3952 - DNA, 477 bp, Mus musculus
  misc_feature (263)..(263): n is a, c, g, or t
  misc_feature (275)..(275): n is a, c, g, or t
  misc_feature (289)..(289): n is a, c, g, or t
  misc_feature (294)..(294): n is a, c, g, or t
  misc_feature (302)..(302): n is a, c, g, or t
  misc_feature (365)..(365): n is a, c, g, or t
gagtgatggcactacatattctatagcaagatccagaaccccaggttcgaaacaagctacccatatcatactgcattccagaaaaagttaagtcctgcttctgttcatgtgacccgtgcactgctgggaagtctgtttttctgccattttcacagatgttgttaagaaattcatggatcttttgcatcgatgtgtgcaggcaggctgtaggttgctggccttgctctgtgttaatacccttggagagtaaatatagtgattanctattgctaccnaaattaagtgattntagcnggctcttnatataggatcagtacaagtgggtaggatctgatcattacttaaatgaagtcacatgtgagacnatcatttttaagagctttaattgacaatcagtatgggctacatttgaaacctctaaatggggttggcaaagggacttgctccaacctgacaaccagatcctatccatggtgg

SEQ ID NO: 3953 - DNA, 458 bp, Mus musculus
  misc_feature (41)..(41): n is a, c, g, or t
  misc_feature (75)..(75): n is a, c, g, or t
  misc_feature (80)..(80): n is a, c, g, or t
  misc_feature (82)..(82): n is a, c, g, or t
  misc_feature (94)..(94): n is a, c, g, or t
  misc_feature (103)..(103): n is a, c, g, or t
  misc_feature (135)..(135): n is a, c, g, or t
  misc_feature (247)..(247): n is a, c, g, or t
  misc_feature (372)..(372): n is a, c, g, or t
agaacagccactacatccagaaatgggtggtccagagaggnagctgagatgaccaacggcagagtgaaggttggnagctngnagcttgaggagnacagtgtgnatgagaggtgacacacagcctcgtgtgtgtgntccagtcccactgctttccctgatgagctcagacccgctcatctggtgcctgggcagtcttctggtctgcactgtcatgaccatgctcacattggatgtcaggccattgcgnttcacacacgatgcccaaggctacagcagaactagaaggggcgacttccctaactctcaaagccctttaaattttaaataaagctctgtgctgaggaggtggtcagcagtctagtacactggtantcttacagagtttgggtttccagctcctgcgtggtggctcacaaccatctataattccagttctatgggaaatctggtgtcctctt

SEQ ID NO: 3954 - DNA, 529 bp, Mus musculus
  misc_feature (57)..(57): n is a, c, g, or t
  misc_feature (221)..(221): n is a, c, g, or t
gtaagcataccaaactgtgagccaaattaaccctgcttttccttccttggttctgtnagatatttgtcacagtaccattcatgttctgttgtaactttaaggaccaatgacctaacgtccttcctggtttcaagtcttcatggaggctctgtgtcaaggggcagtggtgaggtgggagtgtgtatcttacttatttgtcaactactgttatggtttggatnttaaatgtcattcaaaggccacattacaggccgggtcccagtctatagtgctatctagaggcaaaggcacttttaggaggtggggcctaatggaaggaattgggaggtgtttccttgaggggatatggggactccagccttttactctctttgattcctagatgtgtgaagtgagtggctttatgccctgaccactcccacagggatgctcctacttggcacagccccaaaacaactgaccatctgactgtacatagaaacctctgacccagaataaagctttcttccctttatattctctttctcaa

SEQ ID NO: 3955 - DNA, 491 bp, Mus musculus
gaaatctctccttgatgcttaccatgcacaggagctccttgatggcacatctctaaccaaccacagaaggagagaaacgaaaagaagatgaaaaggtggccaaggaggtagtggatgttcacagcactttgatagcattctcttcaaaatgacataccctgactgtgcagtaagttccccatagagctgagctctaggctatgccttgccctgaaatttaaaagtaccctgagaggactaaggctctcatctaagccagagattctcaaccttcctgatgctgagaccctttaatggacttcctcatgttgtggcaactcctaaccaaaagattattttcattgctactttatagctgtaaatttgctatgcttgtgaataataatgtaaatacctgtgttttctgatagtcttagttgtcccttgtgaaatgatcctttgaccctcaacaaggttgccactcacaggttgtggaccattgatctaagctc

SEQ ID NO: 3956 - DNA, 419 bp, Mus musculus
  misc_feature (60)..(60): n is a, c, g, or t
  misc_feature (191)..(191): n is a, c, g, or t
  misc_feature (232)..(232): n is a, c, g, or t
  misc_feature (258)..(258): n is a, c, g, or t
  misc_feature (346)..(346): n is a, c, g, or t
  misc_feature (352)..(352): n is a, c, g, or t
  misc_feature (370)..(370): n is a, c, g, or t
  misc_feature (392)..(392): n is a, c, g, or t
atgccggtacccttctttaactgctcctgcatgcgctccagccgctccacatcgtgttcntgggggagatcagaagtatggttaccacctcgatggccactgtgaatagcagctctgccacttcatatgcttggcctgacatcctgtcctagctgtgtgtcatagtcagtgaggaccaccatccttgcttntacaaggcccaaagctctgcttgcccacctgagcggcatgncggttcacacagcctgcctgccacgnttgttctctggatctttgtgagtgctgggaccagagatgtgtgtcgtcacagctggtttatgtagcaacactagaagtgaatccacancctgcncatgctagtcatacgttntaccatgaacctgtgtgcctanccctaagcggaccatttgtgaagcgat

SEQ ID NO: 3957 - DNA, 456 bp, Mus musculus
  misc_feature (35)..(35): n is a, c, g, or t
  misc_feature (54)..(54): n is a, c, g, or t
  misc_feature (184)..(184): n is a, c, g, or t
  misc_feature (223)..(223): n is a, c, g, or t
  misc_feature (287)..(287): n is a, c, g, or t
  misc_feature (358)..(358): n is a, c, g, or t
cttagagatttatttatgtcatgtatgtaggtacncggtcgctgtcttcagacnccccagaagggggcatcatatgcgccttacagatggttgtgagctaccatgtggttgctaggaattgaactcaggacctctggaaaggcagtcagtgctcttagccaatgagccatctctctagcctgtntgctatggtcttttctctctgtgcacatgttaactatcncagtaagagatcaatcataattttaaacttactaatttacttatttctgtacctttgctaaccnccaggcaactaaaaatgaggaaagaaaaattgaggacagggggccttagtatatcttgtttcaaccatgtntgatatattatagtttttttttttcaacaacttttagtgttagaccctataggtttgagcctataaaaaaaggttgtcgcctggcaatgttggcacac

SEQ ID NO: 3958 - DNA, 466 bp, Mus musculus
agggctccatcagctgtggtatatggaaaaaaacggtgcttccacaagaaggctttgcttctattaaatgagatttctaagatagtgaagtttctgttgcgaagaagatgctgcagatagagcagatgctggtttgtcttttaaattgttaagcacatgtattataaggtagttactattgaatggttaatttttcacttctactaattaaaatactttcagttaattatttaaattagcatagggattaaaagctgttcagtattttttattgtattggtgttacttaatattttttaaattaaataaatattttatgagagtttcacctgcataggtcagaagagggtatcaagaccccctggaactgaagttacaggcagttgtgagctattgtgtaggtgctgggaattgaatatggctcagtggttaagagcacttgaagaccttccttgaaggtcctgag

SEQ ID NO: 3959 - DNA, 461 bp, Mus musculus
ggaagctagctgtgtagaccatgctggcttcaaattcagagtgatttgcctccctctgtctcccaagtgctagttctcccaagtaccaccacatctggcttgaattaacttcaactaagatctttgtctatacttgaatgatactggctccaagtggcttctgttcatagtgaactgtaccatacctgggtaatatatacaaattgtgaaaaaatggctgggcctccagccagtcaggcccaaaccgccaaaactatgtaaggtaaaggctgacttcagccagtcatattgttcttgtcttttcattggctacaaatttaactttgagctgtattgtgttcataaggaacttgttggcccacctttgcttggctgtaaaacttcctgtgttttgagataaacttaactccttttgggtgtttaataattggaatgcagcatccttgagtctatgtagtata

SEQ ID NO: 3960 - DNA, 473 bp, Mus musculus
  misc_feature (187)..(187): n is a, c, g, or t
  misc_feature (197)..(197): n is a, c, g, or t
  misc_feature (207)..(207): n is a, c, g, or t
  misc_feature (220)..(220): n is a, c, g, or t
  misc_feature (234)..(234): n is a, c, g, or t
  misc_feature (262)..(262): n is a, c, g, or t
tgctaagatcaaaggtatgctctaccacacctggcttcaatgttcagttttttttttaaaacgtgtattagtgttttgcctgaatagtgtgtctgtgtgagggtgtcggcccctggaactggagttacaggcacttgtgagctgccacatggatactgggaattgaaccccagtcctctgaaagagncagccagtgntcttaacccntaagccatttctntagacctcaatgtncaatttttaaaaaatacttagttttgtnctttcagaattttatacataggtataacgtatacttttattgccctaagctttggttttactttgagtagggtttttgttttgttttgggtttttttttttttgcttgttttttggttatttgaggtagcatctcatgtagtttaggctagcctcaaattccctatgtagtcctagattgccttaaactcttgatctttctgcctccatct

SEQ ID NO: 3961 - DNA, 495 bp, Mus musculus
  misc_feature (37)..(37): n is a, c, g, or t
  misc_feature (66)..(66): n is a, c, g, or t
  misc_feature (110)..(110): n is a, c, g, or t
  misc_feature (242)..(242): n is a, c, g, or t
agtgtacttttcttgctgtcacatttttttatgctgntgctgtacgccagagttcaaaagtagaancaggttataaacagaatacccactcttcctaaaaactggatacncaatattcattattgacacaacttaattgatgtaaacactctaggaagcaaacattgatttttctcaggaattaattggaaatgatcaattactctatcagaatagtggcaccacctcattaatcagacgcncattgtcctggtaggctaaggatgcccttttgacttaggaatatgctagccctaagggaaagagctgaaatcattacagtgatggccgtctccagctgtctctgggagcgtcattgttcttaatactgaggttggggtttgacttaaaaggagctcaccatgtctgaaagtcctattgtggctctatccttttacacagggagtgatatgaaacccaacctgagataagttccatacacaatgactgtcatgt

SEQ ID NO: 3962 - DNA, 449 bp, Mus musculus
  misc_feature (332)..(332): n is a, c, g, or t
gaacctttacagtagcgactcagataaatagagacaaaagggcacttcgcttcctatggacccctgcctgtgctgagtgaaaaggacacctccagaagccacaccatggtcctcagccttgccccgtacacctcagcactctgcccaagctctgctcactagtaaaaaaccatgctgaccaaagatgactttttgtgggcaggccctggtacagaactggtgttttctgcaccaaaagtcttggttcttcatggttgaaaaggcgccttttggacctcaccactattttctgaaagtgcctctcccccactctggctggaaaagtgttcttntgaagtccccaccacaaccagactaggtgaaaagcaagggtcactgaaaaacttcacttaactgcaaaactttaagaacacttctcaataatgtttctgctgttcttttaagtgtgc

SEQ ID NO: 3963 - DNA, 272 bp, Mus musculus
  misc_feature (69)..(69): n is a, c, g, or t
tcagtgcggcctgcaaaaggccctagccccatgactttgcaagaaacagaacccagggcaagctccccntacgtcactcccaacactttcagaaagcctgtagctggcagccgctgcctgcacgcagggttgttgacccggaagcaattcaggaagtgggtggtgttggctgtcagttccggtgcatcagtgcatcgcagttgcattcatttgctgcttgccagtcgtctctttcggatttgggcatttggagctggtgtcgcagatcctga

SEQ ID NO: 3964 - DNA, 507 bp, Mus musculus
ttctaaccagcctcttcataaaatttgatgctcgtgaactgtcagtgtggtctgcctcacatagtttatacgtactgtaaggtagaacctgcattttgttgattttattagtccaactgaactttaggttattttctttgtttgagacaggatgtctctgtgttttctctttgctgtcttgaaactcactctgaagaccaggctgaccttgaactcagagatctgcctgcctctgcctcccaagggctgggactaagcgtgtgccccacaatacccagctctaggttattgtattaagaggaaatgctgaatatatttgaattatagtatgattatataatttagattcctgtatagttaaaaataagaatgccaatggaattagtttttaaatgtcattccaaaaaagaaggaagtagtataatttagtagagaatatagaaaaattaaaaataagaactgtagggtatggtgactcctacctgtaattccagcatccagaaggat

SEQ ID NO: 3965 - DNA, 463 bp, Mus musculus
  misc_feature (50)..(50): n is a, c, g, or t
  misc_feature (152)..(152): n is a, c, g, or t
  misc_feature (157)..(157): n is a, c, g, or t
  misc_feature (165)..(165): n is a, c, g, or t
tctgcgagagcagcccatctatcaactgctgactggtctctctagcctcntacaggagtctttaactttgatgacaagtccccaactctctctttggctttttagcgctaagaaaatctggctgaacccaaggtcacagatgtttgctcctncctgngccccccncgcccgagacagggtttttctgtgtagctctgtctgtcctagaactcactttgtagaccaggctggcgtcgaactcacaaagatccacctgcctctgcccctcgagtgatgggattaaagcggtgcaccaccatatcagctacagaaagcctgctttttctgtttcctcgaaagagtcttatagcttcaagccagaagtgatggcatgtggctctattcctactcagcagtcagaaacctgagctctatacatttgagaacaacctggtctatatcctggtctgtatggtgacttcca

SEQ ID NO: 3966 - DNA, 473 bp, Mus musculus
  misc_feature (58)..(58): n is a, c, g, or t
  misc_feature (61)..(61): n is a, c, g, or t
  misc_feature (205)..(205): n is a, c, g, or t
  misc_feature (217)..(217): n is a, c, g, or t
  misc_feature (256)..(256): n is a, c, g, or t
  misc_feature (320)..(320): n is a, c, g, or t
gcgggtgtctttgtggatcaccatttcgtaactggaccagaggggaaagggatgggantgngccagtttgcatgagaagcagtcccagagatatgggggaatcttcagaaaggacagtcaacgttgtacccaacattgcacttcctcctgtaggcctggctccttcctttctgccttctgcaggtcccagacaacacagtcagcnttagatcatagnccagaggtcaggaaatgtgcccagatgggtttgggtgantgagagcccaggatgtggcaatagagagctcccttcacctgggcatggccctggtctctctcancctgctctctgcccttattgtgccagaaggaggcaggtggcagcagagattacctctggtcctgcctgggacatgaactgtgatgggcgagtcaggtccaggcccctcagtaggcaatgccctccagctggtgtggtagaggttcactgcccc

SEQ ID NO: 3967 - DNA, 397 bp, Mus musculus
  misc_feature (27)..(27): n is a, c, g, or t
  misc_feature (33)..(33): n is a, c, g, or t
  misc_feature (42)..(42): n is a, c, g, or t
  misc_feature (66)..(66): n is a, c, g, or t
  misc_feature (73)..(73): n is a, c, g, or t
  misc_feature (176)..(176): n is a, c, g, or t
  misc_feature (191)..(191): n is a, c, g, or t
taaatcttatcctcatacccacagatngatatngctacctcntctcctcaaagaagtttctctttngagcaantgaagaccattacagaaaaccatcactggacccacccaatacacagatcatggggagtcaagtccagtggatatatccatatctaaggtcttgcctctgcagnttcagggtgggcatnacaactgaaggaaccagaataccacgatgcttgtgaatcagtctctcacagaaatggatgcataatcaagatctgaacaatagcaatatcaatagacatactagctagaaaaggggggagtcttatgggatcacattccttaataaggcactacagctaactgacaactgctgagaatgggagagtcagtctctctcagagatgaa

SEQ ID NO: 3968 - DNA, 546 bp, Mus musculus
  misc_feature (502)..(502): n is a, c, g, or t
gttagtcttcctgtagaaatcctatcccttcctgaaccttcaattcttccaccacctctaccataagattcctggagctttgtccagtatttctctgtgagttttagcatctgtttctgtcatctactgggtggagcctctcagaggacaggtcagttcctatctgcaagcatagcaatatcactaatagtgtcaagggattgtttcttgagatgggatggtctcaagttgggacagttattggttggtcattccctcagtctctgctccatctttgtccctgcattttttgaacaaaggacaaaatttgggtcaaaagttttgtgggtaggttggtgttgtatcccttatccctctacttgtggtcctgcttgataataggaggttagaaggggggacatctgaaagatccataagagatgggaacagagttggcagggatgtttagctgaagagttgtggatgaaactagaccatttgatttataattaagttataattnatttgtctttcattattctggcaattgttatgtgattactctaa

SEQ ID NO: 3969 - DNA, 421 bp, Mus musculus
  misc_feature (29)..(29): n is a, c, g, or t
  misc_feature (59)..(59): n is a, c, g, or t
  misc_feature (178)..(178): n is a, c, g, or t
  misc_feature (181)..(181): n is a, c, g, or t
  misc_feature (198)..(198): n is a, c, g, or t
  misc_feature (214)..(214): n is a, c, g, or t
  misc_feature (231)..(231): n is a, c, g, or t
  misc_feature (270)..(270): n is a, c, g, or t
  misc_feature (358)..(358): n is a, c, g, or t
  misc_feature (373)..(373): n is a, c, g, or t
gttgttctttgcaggacgtccttcctttntttcagcatcaggtttttctgtgactggcnccggcacggttgtctttaggcacacttgtgtgatccgtgaccatctcagcctggctctgtcatgacgtgttgacttttcccttgacccaccccatgcctccgtgcgtagagggacaagntgntccggaggcactccgcntgcgtcgtgcgtagtnccgaggaggaagagagntgcccgtcagccaggcgacaccggatcactgtggatttntccctcctcacagtcccacctctgccagaggaaactttgcatgttgcacccgtgttcttcccgcaagaagtactgagttctctgatcncctcttgactcagtntgagggcttcctagttggcccctagccttttaccactaatgactccta

SEQ ID NO: 3970 - DNA, 496 bp, Mus musculus
  misc_feature (301)..(301): n is a, c, g, or t
  misc_feature (308)..(308): n is a, c, g, or t
  misc_feature (367)..(367): n is a, c, g, or t
  misc_feature (403)..(403): n is a, c, g, or t
tgcctgcttttgtgcacctaacactgcatgacagcaggcactcggtgcatggtactaacctggtccccactgaggcagcatctgaccacactccactgctctggtccctgtgcaggcagcacctcgcccagtccccatgtatctagtccccaccaattttgtccccagtgtcgtagcaactcactacattccactgatgtgcagcgccttgtcatgtcccacctacctggtgggatacattgtaccagtcataatcaaaggaatggacgttcttgatctgagaaaatgacaagatgaacangttgtancaggcccgagaggcgtagagcaagatgacggtgacaccaatggcagttacctgacacantgatgagccctggaagacaaagccaacaggaatggnccattgctgatgtacccactgcaggcacactagctgcctccctccttgtgtatgtctgtctgtctgtctgtacctggagcttgctgatcctct

SEQ ID NO: 3971 - DNA, 436 bp, Mus musculus
  misc_feature (73)..(73): n is a, c, g, or t
  misc_feature (76)..(76): n is a, c, g, or t
tgactgtagttgagccaccaatggaggccgcgtccctgtccctctgtgttactctgccataacctccctccgnacngggacatctccttttgcttgttcccagcactgcagaacctctgcctaagatcagttacaacgtcgtggatggaccgacggaccgtcgcagcttccatggagtctacgtggtcgagtatgggttcccgttgtgagtatgctgaacctcagctagcatcagcaatggggcgcatttctctctgagagagctgacttctctttctggcaaaagcaaacgagaaaaggaaactcggtgtgtgctgttccctcagagtctgcttgctcagagcctttccctggaaggtccctggatccaccacagcagtgtcccaagtacatgggtctgttggaacctgggggcttcaacttatggtcggaaact

SEQ ID NO: 3972 - DNA, 495 bp, Mus musculus
aggcaaccttctcttttatgtccagagtgaattccttagattcgtgctaattaaaaatgtgtctaagtatctgagagtctttgattcagtgacaagagaagtgtaaccctctctgagaaattgtgctctagtctcaaaaaggtggagtgactgtagggtctccaggcccgacctctgaggtaatgtctcagaattgagtcttcagtacaatagataaaatgtctttattcaggccgtcaagctgaggcacatccatgctcttgctctgctgggtggctatttgctgtctagggctgcccacttctgtgagtgctcaggcagctagctgtaagggcgtgcagcctgccccaagggaaaaggacagttggtgcagcctgttctggcaccatcctggtagaggctctgccctcctgtccctgccctcaagaaattcatcagctccccagagactgtaaggcattatctcactcagccctctggctccaagtaggaatt

SEQ ID NO: 3973 - DNA, 486 bp, Mus musculus
  misc_feature (38)..(38): n is a, c, g, or t
  misc_feature (54)..(54): n is a, c, g, or t
  misc_feature (59)..(59): n is a, c, g, or t
  misc_feature (63)..(63): n is a, c, g, or t
  misc_feature (70)..(70): n is a, c, g, or t
  misc_feature (86)..(86): n is a, c, g, or t
  misc_feature (89)..(89): n is a, c, g, or t
  misc_feature (97)..(97): n is a, c, g, or t
  misc_feature (102)..(102): n is a, c, g, or t
  misc_feature (132)..(132): n is a, c, g, or t
  misc_feature (148)..(148): n is a, c, g, or t
ggtcaggtggccacatgtagttctgaccagtagctganaggtgtacaatctgancttcnggtnggcagcnggcagagggagagacnggnactgatangggcntgtgaaatctcataccccacccttggtggncacacttcctccaacnaggtcacatttacttcaagaggctacacctcctaatcatttaaatccttttaacaatttcactccctggtgacttaatattgaaatctgagcctctggaggccattctcattcaacctaccacgcccacctttcttttatctccaccagagaatgtaaaacatgttttgatttgtgaatttcttcattctgttataaaactttcattaactgcttcctggttagatcactggatttgaagtaacccatgttctttgctccaacaccatgttcattagtaatacatggcttgagaactatttattatttccatttaggtaaaggcatccctgggcctaa

SEQ ID NO: 3974 - DNA, 503 bp, Mus musculus
tcagacccacggcaggcagatgtttccctcagctgcctctccctttacctgtgtctccaggacagttcccaaacctgtatcagaacaagactgattctggtttgttcccaacaggggcaggtagtacctccatcaggacagtcccatgggcagtgtagttctgttatcactgatgttgttaatttaatttttttgcatgtcctattaaattatttattgggtgtggtgaggcacatgctctatagtgtatgggtagaggtcaggggcaacccaagggagttgtttctctccttttggggattgaactcagatgatcaaacttgacagcaagaacctttccctgggggtaggagagatggctcagctgttaagagcactggctgctcttccagaagtccggagttcaattcccagcaatcacatggtgactcataaccatctataatgggatctgatgcccccttctgacatgcaggtatacatgcagatgtacttgtatacct

SEQ ID NO: 3975 - DNA, 470 bp, Mus musculus
  misc_feature (46)..(46): n is a, c, g, or t
  misc_feature (48)..(48): n is a, c, g, or t
  misc_feature (69)..(69): n is a, c, g, or t
  misc_feature (76)..(76): n is a, c, g, or t
  misc_feature (246)..(246): n is a, c, g, or t
  misc_feature (394)..(394): n is a, c, g, or t
cgcctcggattctctttaatacagtatgctttatgcctgtcaatananacttccctgtcccaaactaantttaacnggatagccttttctactccacagagaacagaaaagaggaagaataagctcgtcctttcctctccaaatctatgcattaccatgtgaatcctgactatttacatccttatttctgtagagcaggaggtctatagctgggcatggctgctcacccctgtaaccccagaaatncagaatcacaaggattaccctgagtatgaggctaacctaagctgcacggtgagttcctcagcttcatagtgagctctaggccgtcaggggcttggccatatgagaccccatttctaaaaagcgtgggcaaagtgccaagatgggtcangcaggtataggagcttgctactaagtccaacgacctgagcttgactcccatgatggccatgttgagtcttttacgt

SEQ ID NO: 3976 - DNA, 264 bp, Mus musculus
gcttttaccataagatggcctccttttaattaatagcagaagcaatcccaggaggtggttcactacctcatctctgtatctaccctccacctaaggtgtatgtgccatgtcttctactttctcttcctttcttaaggatgccttatacttgttctttactaagcccaatgtcttcacttgtctcaactattctcaagaatttcatcaattgtaactgttattttaaatatatgactcttgcttgctgtcagtgtaatgcctata

SEQ ID NO: 3977 - DNA, 329 bp, Mus musculus
  misc_feature (33)..(33): n is a, c, g, or t
  misc_feature (39)..(39): n is a, c, g, or t
  misc_feature (42)..(42): n is a, c, g, or t
  misc_feature (77)..(77): n is a, c, g, or t
  misc_feature (103)..(103): n is a, c, g, or t
gtgagagctatggtcttctaccgcccattgtgnagactnagnaagatgtgtggagatagctgggcaaagcttagagntgataatgttacaaaacatttctttnagctacccacagaagctagaaaggtattctgtcctggtgttcctatgcaccacaggccatttgttgatatgaataccctctaaaaggctccttgacccacattaaattgggctcaggggtgcatgaaggtgaggaatagcctactggaagatttccaaggtttgctctctgtcttacagtctcccagccaggtatatagcagccatttggaaaagctcctgaaaaa

SEQ ID NO: 3978 - DNA, 493 bp, Mus musculus
  misc_feature (44)..(44): n is a, c, g, or t
  misc_feature (122)..(122): n is a, c, g, or t
gtgaaaccttaccatatgccagtataacattcaaaagtcggttncctctttccacgggaggcactacttgtatcagttcttcccggaagctgccaggaattaagagcataatctctgtgtgnttagtcagctttgcactgctataacagaataccacagaccagagcatctattaaaaaaatagaactgtactccctcacagttctagcaactgggaaatccaagatcaagaggctggccaagggcaagggccttctgctgcatcttccatgactgaaaagagcaagagaggatgagaggatgatgaggtaggaaagaaagcagacagagggaagggagagagaggagggaggaagtgaagctttctgaagagaaacgcctcctaacactgttatagtgggattgagtctccagtatgtttcttaaggatccactcaaaacataacattgtgcaaaccagcttagcccagtcctggctcctagtcaggattgt

SEQ ID NO: 3979 - DNA, 438 bp, Mus musculus
aagggcttcatgtgcgagaccgccatgcgcaggatggtcagcttgtctggcttcctagccagtgcactgcaggtgggaaccatgtcggagagttccgtaatatattgagtcatcttgttccgcctgcgccgctcaatctcactgtggttctctcttcccagaaagcaagaggtcagggggagggaaaaagagaaggatcagaccaggggtcggtcagcagacattgggataaaagaatacactgttaacatcagatagccaaagtcctggacctaactcataatggctcagtgttttgagtagttgtggactgaatccctgacacatctgtaactcgggtctttgtgtgggaagcatggacctctctctgtgcctccttctctaaatatgtataggctcttccggaattacacacatacctatggacttttgaccagg

SEQ ID NO: 3980 - DNA, 447 bp, Mus musculus
tttcgaattttctcttcagcactctcttcaccgctgcgcacattggtacttccacatacttgtaaaaaacaacagcgctcaccaatacaaaaaacaatgaaacaaagtaaataacgaccagagaaataccatcaaggtagcctctgctataggcgaagcggaatattccgtatacaaatggatgaatcagatagagcgagtaggatgaatcaccaatcaaggtaaacaacttgatatttcgcacctttccaattgtatccataccggcaagagcgaacaccaggatcgccgcagggataccggcacaaataacccggccgaacttttcatagtaaccaagcataacgatgaacatcactatggcgatcaataccagtactgaatgcgcgaacatgccaaggttgatttttttttgcgtatacaaatgcgcaatcaatactcccacga

SEQ ID NO: 3981 - DNA, 406 bp, Mus musculus
  misc_feature (102)..(102): n is a, c, g, or t
  misc_feature (105)..(105): n is a, c, g, or t
  misc_feature (107)..(107): n is a, c, g, or t
  misc_feature (110)..(110): n is a, c, g, or t
  misc_feature (113)..(113): n is a, c, g, or t
  misc_feature (125)..(125): n is a, c, g, or t
aatttcatttcatgctgcattgtagaaagagtttacataaatagcttccattaatcatttaaaacaaaggttaaatgtaaattagcatccaacatttttttnccngntgntanttagggttttcngtaaagttttattttcatgagagcatatgaattaatgtgttttaaaataaaatatgtttaatcaaagactgacaacatacaaaaataaattgccttggaaagaatcctataacatctccagcagcatctgaggttaaagcatacgttgctctccaccacagttttaattatgtcattatttagtttggaaatctctttccttaggacgcttacttgctcaggtttagtagctatttgtaaagcaggtctgtagacagcgttttctctgatggctgaagttt

SEQ ID NO: 3982 - DNA, 489 bp, Mus musculus
  misc_feature (87)..(87): n is a, c, g, or t
  misc_feature (90)..(90): n is a, c, g, or t
  misc_feature (92)..(92): n is a, c, g, or t
  misc_feature (125)..(125): n is a, c, g, or t
  misc_feature (145)..(145): n is a, c, g, or t
  misc_feature (158)..(158): n is a, c, g, or t
gaaatagccatgtgtgcctccagttttggacagtgtggttctaggagaaaaaatgcaaacaccagtgtatttcagtgctgtcgaggnacngnactatgtattctaatgtcgattccactcccttnaacaaatgaccaagtctagncatttattgaagncagtgctgttgtacgtattgatagctgtatggccatttttcctttatgccatgctgtcctgtttgtccttgcccacatgaggtgtttcccttctctctggcatgcataagagctgttcttcagagtgcaaggatgtctgccggtgattagccctgtgcctagatctcctcccaaaggccatcaatcattgccattatgtgtggggcagatgggtaattcaggagcaacctgtgtcctcagccacttggctgctggctgggtgtttaattatgtctctgcaaacatcagagcaagcactggttgataagctcagttcattaaggaccgggtt

SEQ ID NO: 3983 - DNA, 387 bp, Mus musculus
  misc_feature (27)..(27): n is a, c, g, or t
  misc_feature (158)..(158): n is a, c, g, or t
  misc_feature (215)..(215): n is a, c, g, or t
  misc_feature (240)..(240): n is a, c, g, or t
aaacgtgttgttattctagggactgtnttgagctggaggtaacaggcacagcttaagcaggagcccagggcatgtgctgtaagagcagtggctgcatgtagcttctggagtggtcaagtccacacatgtgtgcaaattatttcaccagggttaacttnatgttaacccttagtgtactggatgatggaaagggcttcgggaacatttgacctccnttttaaaggagttaccattggcttntttctggaaggattaaccaaagccacgagcagacaaagcaaccccttattcctaacaagattttcactctgacttctgatctcagaaatgccaccctcactgcccatgcctctcctgtcccttctctctacccttggtatcattcaa

SEQ ID NO: 3984 - DNA, 504 bp, Mus musculus
  misc_feature (30)..(30): n is a, c, g, or t
  misc_feature (104)..(104): n is a, c, g, or t
  misc_feature (129)..(129): n is a, c, g, or t
  misc_feature (152)..(153): n is a, c, g, or t
  misc_feature (163)..(163): n is a, c, g, or t
  misc_feature (171)..(171): n is a, c, g, or t
  misc_feature (230)..(230): n is a, c, g, or t
aggacacgtgatccatttccagtggcggcnaggacacgcgggtgccgcggcgacacagcaatagaacggggaaacccaaggttcataagcagtcatccaacccnagggtgcagacaccactaacaacanggaagccatccttaaatatgaanncagtatcaanggataatnagatatctactacagggatcactaccgtagcatcttgcttataaatacctgagaatagnagcagactgtcaacaagcctagtaataaatcattgccacttgcaaataactattttcatgcctctggaataatatatagcttgtattactcacaaggaaaggacacaagttaaccttatgttcttttgaatattaaatatcagagtacattagactatttcatttaagaagtatatgtgattaaaatgatggctattcataattactaccagagggaacagtttctgtctaaaagtatttcctgaactaaatcaacctgtgtttatcagcagtg

SEQ ID NO: 3985 - DNA, 449 bp, Mus musculus
  misc_feature (44)..(44): n is a, c, g, or t
  misc_feature (47)..(47): n is a, c, g, or t
  misc_feature (66)..(66): n is a, c, g, or t
  misc_feature (68)..(68): n is a, c, g, or t
  misc_feature (75)..(75): n is a, c, g, or t
  misc_feature (79)..(79): n is a, c, g, or t
  misc_feature (81)..(81): n is a, c, g, or t
  misc_feature (98)..(98): n is a, c, g, or t
  misc_feature (103)..(103): n is a, c, g, or t
  misc_feature (107)..(107): n is a, c, g, or t
  misc_feature (155)..(155): n is a, c, g, or t
  misc_feature (203)..(203): n is a, c, g, or t
  misc_feature (220)..(220): n is a, c, g, or t
  misc_feature (244)..(244): n is a, c, g, or t
  misc_feature (253)..(253): n is a, c, g, or t
  misc_feature (342)..(342): n is a, c, g, or t
  misc_feature (385)..(385): n is a, c, g, or t
  misc_feature (403)..(403): n is a, c, g, or t
accccggtgttcatgctctgtaaggtatgtactctttaacctcnggnaacttgtgctctcaatttngncatcaangccngnattcctacagaccgggnatcangggnatcctgtggtgggtgcacagtggggggtgcttatgttctggtctgtgntaaattctaatttctctacaacctttgcgactttatctcaaaactatnaagggattttttaaaancagattagtgttggcatcagtaancaaattaancatctttaaaatagcttcattggttttcagaattggcccagctgcaatcaaaccccatgcgtacagctgatggagcagatggatgaccncagtgggtctgtggcgtccacctgctcctgcctcagccccggnctgttgtattctgctgcntgaatccagtccatttctggtgaacatgcaaaatgtccggcctggg

SEQ ID NO: 3986 - DNA, 382 bp, Mus musculus
  misc_feature (181)..(181): n is a, c, g, or t
agtgcatctttatctcttccatttctccagcttctctccctgagctaccagaaagatttcacctacaatgtccttcaagttctgaaacaaactttagttccaacgtttgctttaagtatatgcggggatagagcctagaggattggtctttggctctttagatttgagcaggaactcttgntttatgcttatcagtactcatgtcatttgatgtacttgtgccatctctcttgggccttcatccctccaccttggttttgaagtctttttcacatgtactggccttaatcgtattttcgttcttctttgaatatgtctttcctcccctttatctctgaagtctccctttagctacaatgataagtatatgcctacagtgcca

SEQ ID NO: 3987 - DNA, 433 bp, Mus musculus
ctttgcattttgtcccaatggatcaaagggaaattacataacagtgctgctattttggaatggtcacttgctactttgtgcagaatgatttagaagcatctaaaggaatccagctagaaaacaagacagtagtccatagatagtgttgaagttggaagaaggggtggtagattcagaaattctgcagagaagactgactgcaggacagaagggggtggctgtgagaacaagagcagaggggtcatcagcactgaggttccgggtctcagacagctgaacagatgtcagcatctgtccttgttaattatattgaaggccacattcttgcagttgggtgcattcttaacgaatgccaagtactgctgtggtagtataggagcaaacagactgcgcagagtctctgtcctcactgagcctgctctcggtgaaagac

SEQ ID NO: 3988 - DNA, 329 bp, Mus musculus
  misc_feature (57)..(57): n is a, c, g, or t
gacagataaatgttagcctagggcaatgttccttttgaactgttaatttttggtttntgagacagggtccctcactggcccaagcctcacctgttcagctagactggtgagccagtgagtcccagggtctgtctctgcctctctagccctgggattacaggcctagtaccaaagctttgcttttctatctgagttctgtctgggagatcacactcagatcctgcacattttgtagacctgctcttgtgaggcagaggcaggcagaccgctgtgagttcaatgccagcctggtctacaaagtgaattccaggctaatcagagttacccag

SEQ ID NO: 3989 - DNA, 487 bp, Mus musculus
  misc_feature (260)..(261): n is a, c, g, or t
  misc_feature (266)..(266): n is a, c, g, or t
attcctagcttcagtatagttctctaagcttgtttaccaaatgcagttgagaactgttaggcttggggaaggggaattgtgatcaggacatgtttcatggaaaaaagttttatttaaacaaaacaaaacagcagggcagtggtggtgcacgcctttaatcccagcactcgggaggcagaggcaggtgaatttctgaattcgaggccagcctggtctacgaagtgagttccaggacagccagggctacacagagaaacccnntgccnccaaaaaaccaaaaaaacaaaacaaaacaaaaaacccaatcattgggcctttgagatggctcagcaggtacatgattgttttacagtcttgagttgaaacgcatgacccacattgtagaagtaacaaaccaactcctgaaagtgggccatggcacagctacctgtatatatacatactaaacagagatcaagcagggcatggtgcctgagacctgcagaaa

SEQ ID NO: 3990 - DNA, 305 bp, Mus musculus
ataatcttaggtttcaattgagtaggtttgtttagagacagattgaaacagttgtcaaattcagtgccccacactcaaccacacgtgccgcgggatgctgtgccaagcaagccctgcctggctcccaccagctcccttgagccagtgcagagatggcagaagtgacacagagggaaggtctgaggtttctgtgctgagcaggctctctgcactccagctaacagacatgtatgacatctttccaaactcaggtcacaaatgtgcactcacgctcctctcacaaaggcactggagttctgactttc

SEQ ID NO: 3991 - DNA, 474 bp, Mus musculus
  misc_feature (26)..(26): n is a, c, g, or t
  misc_feature (32)..(32): n is a, c, g, or t
  misc_feature (49)..(49): n is a, c, g, or t
  misc_feature (83)..(83): n is a, c, g, or t
  misc_feature (113)..(113): n is a, c, g, or t
  misc_feature (315)..(316): n is a, c, g, or t
  misc_feature (328)..(328): n is a, c, g, or t
  misc_feature (337)..(338): n is a, c, g, or t
  misc_feature (340)..(340): n is a, c, g, or t
  misc_feature (342)..(342): n is a, c, g, or t
  misc_feature (347)..(347): n is a, c, g, or t
  misc_feature (350)..(350): n is a, c, g, or t
  misc_feature (352)..(352): n is a, c, g, or t
  misc_feature (405)..(405): n is a, c, g, or t
ttggaacctcattggttaacacatgngcgttntcagagggatgggaaanttaaatcaacccaaaatttcaaggcccatctccntcagtgaaattcttaggaagtccagtggtntggggccatgcagagaatatccttctaggtgaagataagttatgcacctgcccctcctacaaccaagaaagaagcacaacgtttagtgggtctatttggattctggagacaacacatccctcacttgggtgtgttacttaagcctatttaccaagtgactcggaaagctgctagctttgtgtggggcctggaacaggagaanncccttcaacagntccaggctnntntncaggntgntntaccacttggaccatatgacccagcagacccgatggtacttgaggtatgctcnagtgcatgatcgatgtacacagtggaacttcatcagggctgaataatcccaaatacaggtgaacactat

SEQ ID NO: 3992 - DNA, 320 bp, Mus musculus
gtccttctcagcttttacgaggtgtccagttgtgtctgggatgccttagactgagaacctgttatctctggcctctgtgaggcccagagacctcagactgccccttgtccacctccccctccgagggctggggtctgtggcttctcacagccagacacccaccggggcttcgtggaaagtgttttgcagtcctccgtttgcctgcccagagcacaggaactctgacgggaggcgggttttctcccaaaccctttattctcccacacctgttgcctgactggtcttaaaagagaaagtgagtaaatctaccaaagaaatct

SEQ ID NO: 3993 - DNA, 336 bp, Mus musculus
ttttgtttatgcctgtgtcccaggttttaattggattacatggattgttggtgtttaacttcttgagttctttaaccctctgtcagatatagggtggtggagattctttcccaatgtgtaggctgccattttgtcctattgacagtatcttttgccttacagaagctttacagttacatgaggtcccatttatcaattggtgatcctagtgactgagtcattagtgttctgttaaggaaattatcttttgtaccaatgcattcaagggtatttcccactttctcttctatgagatttaggatacatggttttctgttgagatccttgattcacttg

SEQ ID NO: 3994 - DNA, 221 bp, Mus musculus
accacctgaggtaaagaagtcacatacccaactcctaagataacaatggcaacagtgggatctttgggttgttgctttgtttcttagacaggatcttatgatgttcaggctggccttgaactcactatgtagttgaggatgagaattcctgcctgctggttatactgccacttccaaatactgggattatagacatgtgccactacgctctgtttataaaa

SEQ ID NO: 3995 - DNA, 494 bp, Mus musculus
  misc_feature (26)..(26): n is a, c, g, or t
  misc_feature (103)..(103): n is a, c, g, or t
  misc_feature (137)..(137): n is a, c, g, or t
  misc_feature (140)..(140): n is a, c, g, or t
  misc_feature (153)..(153): n is a, c, g, or t
  misc_feature (166)..(166): n is a, c, g, or t
  misc_feature (176)..(176): n is a, c, g, or t
  misc_feature (189)..(189): n is a, c, g, or t
  misc_feature (208)..(208): n is a, c, g, or t
  misc_feature (240)..(240): n is a, c, g, or t
  misc_feature (248)..(248): n is a, c, g, or t
  misc_feature (359)..(359): n is a, c, g, or t
aggatgctagtctatgttcatggtgnggatgctagatttatgctttgtctgagctctggtgtgcaccaagtgctgctgctctgtgagcactttcaggagggangactctttccttcctctacagacagactctaatnaangagacatccttcngccttctgtccangttcctttcnaactataaaactnagagaaatacatagtgctnaagagtcataatcctagtgaattactattctnactttaanctcacaaactttcattattttatcaagtttgattttttaattatgcaattgctttacatacttgttttttaacatcaaagtgataggtttcataatcaaattatcctacanacttgcttttaaaatatccatactaatattcaagtcctttttattctaacaagaagttaaacaacatattaagagtctttaaaaaaaaatgacaggactggggtaaacctcagtggtaaagtacaggcctagcgt

SEQ ID NO: 3996 - DNA, 462 bp, Mus musculus
  misc_feature (29)..(29): n is a, c, g, or t
  misc_feature (268)..(268): n is a, c, g, or t
  misc_feature (337)..(337): n is a, c, g, or t
  misc_feature (340)..(340): n is a, c, g, or t
tcatctatgctgtccagccggatggcttntaaacagttgcagaggtcctggacattgtgtgggttaagcagttgataccattgccagtcccatgctgtcccctcatcccctgaaagcttgtttagagtatcgacacaatgaagtctgatattgcacctaagttccatatcacatgacctcagtagggttctctcaaatcaccatttcctgcttttactctcaatgaaaagaaacagtttccactggaagaaacataggccaggctttnggagtctaggttagtaatagcatttgggggctgtaactatgtggccactcagggtctccagtgaccagngangaagtacaagcaagatgttgctcttcaggagtcatatgatgactgtcttggttgtcaacttgactacatctggaaataactaaaacccaaaaatggaggtacacatatgtcagctcggtcta

SEQ ID NO: 3997 - DNA, 480 bp, Mus musculus
  misc_feature (43)..(43): n is a, c, g, or t
  misc_feature (71)..(71): n is a, c, g, or t
  misc_feature (122)..(122): n is a, c, g, or t
  misc_feature (127)..(127): n is a, c, g, or t
  misc_feature (140)..(140): n is a, c, g, or t
  misc_feature (192)..(193): n is a, c, g, or t
gaattcttagtgttcacgttcccactgtgaaaaaattgggggnaacacaggttccaaagggggggtccacnttcccatgaggccaatgggcttggaatctgtcacactggctcccaagagtntggtnaagtcacttcccntatctgccttttattgttcccattggtaaagtcccctttaagcccattggcnnctttgcatgttgatgttcatctggagcggagggtcttactggctcccggtaaatccattgtacagagtagaggggaaagacgggaaaaggcttatgcctactcctcctgagccccttaccctacctggtcctggcagagcatctgaagagcaaggtctctcccatcctctgatcctccttgcaaaccccccccccccctgttttcaattcctttcctcgtgatcctgccaagtaaagtcactgtgaccacacacagagggcggggacagcccagacatttcaacttc

SEQ ID NO: 3998 - DNA, 294 bp, Mus musculus
  misc_feature (31)..(31): n is a, c, g, or t
  misc_feature (41)..(46): n is a, c, g, or t
  misc_feature (49)..(49): n is a, c, g, or t
  misc_feature (51)..(55): n is a, c, g, or t
  misc_feature (57)..(61): n is a, c, g, or t
  misc_feature (63)..(64): n is a, c, g, or t
  misc_feature (66)..(73): n is a, c, g, or t
  misc_feature (79)..(79): n is a, c, g, or t
  misc_feature (87)..(87): n is a, c, g, or t
  misc_feature (89)..(89): n is a, c, g, or t
  misc_feature (92)..(92): n is a, c, g, or t
  misc_feature (106)..(106): n is a, c, g, or t
  misc_feature (108)..(108): n is a, c, g, or t
  misc_feature (121)..(121): n is a, c, g, or t
  misc_feature (129)..(129): n is a, c, g, or t
  misc_feature (136)..(136): n is a, c, g, or t
  misc_feature (140)..(140): n is a, c, g, or t
  misc_feature (146)..(146): n is a, c, g, or t
  misc_feature (155)..(155): n is a, c, g, or t
  misc_feature (161)..(161): n is a, c, g, or t
  misc_feature (163)..(163): n is a, c, g, or t
  misc_feature (182)..(182): n is a, c, g, or t
ttgtttttaactggaacagttctctaactcnggctcccacnnnnnnggngnnnnntnnnnncnngnnnnnnnncccttntacttagnangtntggcccctcctctntngcctcttctccanccattgancattgcncatnggattncgaagtgtncagtangncagtgaaatctgtggcagncagagtttgtaccataaaaagaccccatacatcacaccagtaaaataggacattcagagtgctcacattctttcctttctcatatgtgtgataggtagactcttagtgttaa

SEQ ID NO: 3999 - DNA, 258 bp, Mus musculus
  misc_feature (55)..(55): n is a, c, g, or t
  misc_feature (71)..(71): n is a, c, g, or t
  misc_feature (222)..(225): n is a, c, g, or t
ttagcctctctgatttcagctcactagagtgtgagaatcgaaactctttacacancaacaaatatcttctntggacatagtgtccctcaaatcagaaaaatgtctcatttgcaaagcttaaagaaacttgcatttatgaacatggtaatacctgggatacatatacatctatctatatgcactcacacacacacacacacacacacacacacacacacacannnngccaaagacaataaatacatagtcctgacaaac

SEQ ID NO: 4000 - DNA, 443 bp, Mus musculus
  misc_feature (98)..(98): n is a, c, g, or t
  misc_feature (306)..(306): n is a, c, g, or t
  misc_feature (311)..(311): n is a, c, g, or t
  misc_feature (319)..(319): n is a, c, g, or t
  misc_feature (329)..(329): n is a, c, g, or t
  misc_feature (338)..(338): n is a, c, g, or t
  misc_feature (354)..(354): n is a, c, g, or t
  misc_feature (389)..(389): n is a, c, g, or t
taaagctataatcggcctgcacacttataggtcactgctgttgtagcactcggttgaaaaaaactgctcaggctgtgtcttaagatgatgtacccccnccccccttccttctggcctctatactcccctggaaggttttgaggaagtgtcattttgagaactttgctgagatggtcgctctgcctcccgctgcttccttttcttgggcaacgcaaagttcctggtttgtagatttctagttggatgtgatttaatacccggaggtgaacaagtccagcctgtttcatgtctgtggctttgctcctnggctnggagagantggtgggtanagacacacnttgaattctttctccnaaacatcttgagagatgaattactcttgtactttncaaggcttaaggtagaagcgtattctgtagaggttgatcttgactttgtgagct

SEQ ID NO: 4001 - DNA, 379 bp, Mus musculus
  misc_feature (26)..(26): n is a, c, g, or t
  misc_feature (44)..(44): n is a, c, g, or t
  misc_feature (49)..(49): n is a, c, g, or t
aatcaacagagcctcctgtctcctgncctctggatggattgggntctgntggagaacttgacccaggagaaaggagaaggcttatcattagctggcagatgacagttagtggaagtcttctgtggcagtgaaggtaacagaacctctgtgagatctaggatggtttgctgatatctgctgaagaagctgtagtccaaagcccatcatgacttctgggacttgagaggaacaaaaggataatcgtgctgttggacagtaccagcacagctttatagccacaccttctcttcctcctccccactttctctttgtcctcctcctcctcctcctcctcctcatcttcctcctcgctagtctgatagtactcctactcctattt

SEQ ID NO: 4002 - DNA, 462 bp, Mus musculus
  misc_feature (248)..(248): n is a, c, g, or t
  misc_feature (258)..(258): n is a, c, g, or t
  misc_feature (274)..(274): n is a, c, g, or t
  misc_feature (325)..(325): n is a, c, g, or t
  misc_feature (378)..(378): n is a, c, g, or t
  misc_feature (390)..(390): n is a, c, g, or t
  misc_feature (394)..(394): n is a, c, g, or t
  misc_feature (408)..(408): n is a, c, g, or t
  misc_feature (413)..(413): n is a, c, g, or t
atctttgcggaaacagcgtcctcctgttcgattagcccctgccccccacttacatgtcctgaaggcaagtctgggagttcccccaaagggtaagagactctcaaagttaaccctattcttttcctcctcgtagaaagtctgctgacctctgccccagagaaagtacatatgtatgtcttagaactgtttctccaagacattatcaaaatgccccaattttatttgaattccagtgtattggtttttanctgaagtacnatgaaaatcgataggncaaagtacttatttttacaaatgccatccttagactcaatattttcttttnttcttgaaacctaatggagtgagtttaatctggataattttaaaccatggtantctctatcaatntggnatatacatcatatnatacnctgggtggcatttaattgttaaaaacacattgatccattttgtttaaat

SEQ ID NO: 4003 - DNA, 426 bp, Mus musculus
  misc_feature (97)..(97): n is a, c, g, or t
tagtagctattacaaggactgtgtctaaactctatattcttttggggggggtaattctataatcattaagaaatttaatgttttaagaaacctattnccataagaaatgtctagatccatatatcttcaccagagaattctattaattgttcacactaaaaggtgaaaacaaaattatattcccagaaaatatgagaaggaaacaccttccaataccctgtattcttaaatgagtattataggcataatgcctatataagagtaacaatattagtttcaaattttctatcaatgtagtaaatttatactaatgtaaaattacaacttcactttgtatcaaatataacgttttctaccaatgtaaaggtgtggctatataatgctttgcttaagaatacatttagtaatccattccatctgtttcct

SEQ ID NO: 4004 - DNA, 268 bp, Mus musculus
ccacctctaagtgagtacatacagtgtgcatccttttggcactggttacctcactaaggaatatgctctcaagttccctacatttgcctgcaaatttcatgtctgtttttaatagctgaatagtattccattgtgtatatgcaccggtttctttatccattcttcagtttatggacatctagtttgtttctagtttctggctattacaagtaaatcttttctaaacatagataactgtttttgtggcacgaagtgtctcttgggtata

SEQ ID NO: 4005 - DNA, 464 bp, Mus musculus
aatctgagccagtgttcctcttgacccggtccacccacacccaggacctggtgatccctcccagaggtcagaatctccctgagagcttgttagcccccggggcgccaggcccgccctgctgggctccagttcatcttctgaggcaagctgaaaatttgcatttgtaatgagatccttagcgatgctgcttgcctggggaccgcaatttgaaagctacacccttgtccttaaagaccttccttctctctggcctgggtgcccacctggtggaagagctgagctgtttccttcatcttcagctcccaagagaaagccacagcccatctccggggcatcacacctgtcttcttgaagggcaaagactaggacccatgtgagcaagcacagagctacagggaggcccttgttgtgatgtgctctaacacctgtctgtctgtctgtctacctagcatgtatctatcatc

SEQ ID NO: 4006 - DNA, 85 bp, Mus musculus
tggggtagggttcagagctcaggcttgtgggctcagaaaacttgtgccctaaattatactatcccgggatatcccaacactggga

SEQ ID NO: 4007 - DNA, 272 bp, Mus musculus
  misc_feature (244)..(244): n is a, c, g, or t
  misc_feature (246)..(246): n is a, c, g, or t
gggatggaagccagtcctcctgagtatctgcccttgagtcacatttctgggtctttccttgtcgcttagatgcaaacttaatctttcagcattctaaaagttattttcccttttagttaaaaaatattagccgggctatggtgcatacccctttaatcccagcactcaggaggcagaggtagtcggatctctgtgagttcgaggacagagcgagttctaggactgccagggctgcacaaagaancnctgacttagccgagcgtggtgttgca

SEQ ID NO: 4008 - DNA, 340 bp, Mus musculus
  misc_feature (148)..(148): n is a, c, g, or t
acagacatgtctgcactcactttctctcttccgatctccaaaggctctatgctcaagtgtattgactgacacacagacattcattctctctcttaaaataattgtcaaaatatattaaaaatctctttaggatcaagaaaataaggcnccggcaaagaattaaggagaggcaaggaattgatctccactctgtggaaaagttagtttgccaaaactctccctttgtaaatagctcttttgtggctcccatgctggctcagcaggtaaaggtccttggcgccaagcctgaagaccagagttcaattcctgggagccacagagtggacacagacaacctcct

SEQ ID NO: 4009 - DNA, 316 bp, Mus musculus
  misc_feature (33)..(33): n is a, c, g, or t
  misc_feature (48)..(48): n is a, c, g, or t
ttttttctgtaccacaactttatagtataactnaaaccctaaatattnaaaagatattgcctctgaatcttttctggagcaacagctactccacagaactttaaagctcattgtgtgagagcaaagatttgaaataaacttcccttgagaggcattagctaataaaatacttccacttaggaaacaatatacactgaaagattcaaactcttagcttcttgtattgaagcagagacaataaaatttttcttacataatgtaaagctatattagccatacctagaggcaaaattttccagtgattaccagttcacta

SEQ ID NO: 4010 - DNA, 422 bp, Mus musculus
  misc_feature (397)..(397): n is a, c, g, or t
tcagcagttggttctggtatatggtaaagaaagccttaattagaaagttttaaaatggttaaaatttatgcattgaagatttataaaaaatcaggcattagatgttaaataataattaaacatatggggttggagagttagcacggcggttaagagcaatgaccatagagatttattaacctgctcttggaaatatgccactagccttggatgtctgccctactgaatacatccttttcgaattgttataatttgatgatttatactaataatgatattacctgttctgcttgtgattcactgaatacatagtttcagagttgtaatatttggatgatttttgtgctttactctgccaaatgatttttgttggtatttgtgattgttttgctggatncagtttttaagagttgtaatgtttg

SEQ ID NO: 4011 - DNA, 348 bp, Mus musculus
  misc_feature (51)..(51): n is a, c, g, or t
  misc_feature (283)..(283): n is a, c, g, or t
  misc_feature (303)..(303): n is a, c, g, or t
  misc_feature (308)..(308): n is a, c, g, or t
ttgttgctgtatatgggtccaggaagcctcctattaactgagaacaagacncagccagtagagcatcagagttttgattaatgttgaaaatcggatgatgggctgtgctcctgagcctttcattgctcaggttgctgcttgtttcctagagaactacattttagagtgtacttttctgcttgaacgctctctttgaatctcaaaactgtaccagattatagatgaaattggtttgagtctattgaagtcttgttgataccagaagacttattaaaggtacccnttaattaaaatcaagaaacnaaacncataagtgctaagatactgcaagccctattgttgactaaa

SEQ ID NO: 4012 - DNA, 337 bp, Mus musculus
  misc_feature (54)..(54): n is a, c, g, or t
  misc_feature (57)..(65): n is a, c, g, or t
  misc_feature (67)..(67): n is a, c, g, or t
  misc_feature (74)..(74): n is a, c, g, or t
  misc_feature (125)..(125): n is a, c, g, or t
  misc_feature (132)..(132): n is a, c, g, or t
gaaagtagccccacatgtgtagagttgttaaaaacatgttccgttgggccactnggnnnnnnnnncnacacatnagatgtctaataaacaataagctttctctctcatagccttggagattaggnaattcanggtcaagatgtcagtagatttggtgtttcatgagtcgactttctagtttacagatagctttctgtctcatattcttccttggtagaaagtgcacaggagctttctgtggtcccttttctaaaagcagtgacctcattcttgaaggtcacgtgcttatgacctcatcaacatgctctccccatctctctgggcactaggatctaaa

SEQ ID NO: 4013 - DNA, 368 bp, Mus musculus
  misc_feature (79)..(79): n is a, c, g, or t
ggctgtgctttgtagttggcgattcagtcccctagcacatgctgtgtgataaagtatgccagtgtcatggaccctgcanggtgacagagggacatcaccctcctgagcctgcttcactgcataggccagaaggtgggggcgaggcctgttctttccttccttctgcagcctacttatttcaacatggctcactgccaagctatgggcactaagattaggtaggactttaggtgggttgggggacaggttctgcctggtctggcagaggggggccaccttattaactcactaactgtgccctaagaatttgatgtcatgaatgctgagatacctgtgaccttcctgttcccctctaaccaaagccatta

SEQ ID NO: 4014 - DNA, 379 bp, Mus musculus
  misc_feature (209)..(209): n is a, c, g, or t
  misc_feature (228)..(228): n is a, c, g, or t
  misc_feature (241)..(241): n is a, c, g, or t
  misc_feature (262)..(262): n is a, c, g, or t
  misc_feature (285)..(285): n is a, c, g, or t
gcacgattctaaccacggtctcagtgttggccatgagttagatcatttggagttatctttcaaatgtcctatataagccctgcctcatggattctgattttgtttgtctggtgtgggaatcaagtacattattccttagtagcatgctaagttgactgtaatatgcagcttgggctacaaatccttgctctgcatgagaaaattcactnccttcacaccttagaggantatgattttgtgnccataaggctgtagctgagtntcaattctaaccacagagaaggnccttttgttaccacctcagtagaggtgaagggatgaggcagcttgggtgactcaaaacctgtgagggacagctcccaggttgtcatctgtatga

SEQ ID NO: 4015 - DNA, 169 bp, Mus musculus
  misc_feature (103)..(103): n is a, c, g, or t
gaatcttgggttcccttgcccccatcttttttttgggtaagggctaccctttgggtctctgagggtgctgttcccagcttttcttgataggcctagtacaatnttgggaacagggtttctgtgtggtgaaggtttgccagtagcttttagtcttgcctatcttagggag

SEQ ID NO: 4016 - DNA, 390 bp, Mus musculus
  misc_feature (114)..(114): n is a, c, g, or t
  misc_feature (207)..(207): n is a, c, g, or t
  misc_feature (210)..(210): n is a, c, g, or t
  misc_feature (229)..(229): n is a, c, g, or t
caccaaacccagactctatggaagatgccaacaagattttgctgacaggaccctgatatatctgtctcctgtggggctatgccagtgcctggctaatacagaagtagatgatcncagtcatctattgaatggaacacagagtccccaatgaaggagttagagaaagtacccaaggagctgaaggggtctgcaaccttataggaggancancaatatgaactaaacagtnctcccccccccccaagagctcatgtctctagctgcatatatagcagaggatggcctagtaggccatcaatgggaggagaagcccttggtcttgccaagattatatgctccagtataggggaatgccagggccaagaagagggagtgagtgggttgagaagc

SEQ ID NO: 4017 - DNA, 414 bp, Mus musculus
  misc_feature (67)..(67): n is a, c, g, or t
gaatgaattgctcatcagctgctcccaaacaggcaagcttagaactatgaaggagaggtagaacctntgggctctatacagggaccaggccattacaggctgatggccctaatgtgtttgaaagtgtatttgaattttaagttctgcatttctgaggtgatgacaaccttccagaagtcagaaacgagcatcttaaagattagtagcttgttcaggtatagctagatgttgagctcatttgtggtggtgtggatggaagaaaataaagcaggtaacaagcgtaattgaaggggaccaatgccatgtaagcctggatctccaactccaggagagtgggagcgagcagaagaggaaattagtcctgacagtgggctgtccttcagcttcctggcatggaaccttagctcagaatct

SEQ ID NO: 4018 - DNA, 409 bp, Mus musculus
  misc_feature (55)..(55): n is a, c, g, or t
  misc_feature (67)..(67): n is a, c, g, or t
  misc_feature (84)..(84): n is a, c, g, or t
  misc_feature (89)..(89): n is a, c, g, or t
  misc_feature (92)..(92): n is a, c, g, or t
  misc_feature (94)..(94): n is a, c, g, or t
  misc_feature (97)..(97): n is a, c, g, or t
  misc_feature (150)..(150): n is a, c, g, or t
  misc_feature (187)..(187): n is a, c, g, or t
  misc_feature (239)..(239): n is a, c, g, or t
ggattccttccaaattgatatgacagagggagtttccctgaagatctaggctctnccactaaagcangaaagatatcaggaagnccaancanancangtaacatgaattgctgctctgttatataagaactcctatgaaactgactgagncataaaaacatttttaaaaatatatagcatgtaaaantagccagaatttcaactatgcatagacaatcaatattcttggataccaaaancatcaagacttatcatgacatcatttcaaatgatatacatagaaaatcaaattacggtttggttaatgcaatccaaactgacttgtaaagaaagaaagctgccttagctgctcagaggacaaagaatcatctttagctaaaatgtgcacctgcagattccatgcatgtgt

SEQ ID NO: 4019 - DNA, 396 bp, Mus musculus
  misc_feature (47)..(47): n is a, c, g, or t
  misc_feature (62)..(62): n is a, c, g, or t
agaccataaatgtccccagttcacatatggcccttagcagctttctntaggaccccagcctnaagggtttcgaggtaggctgcctgcatcctaatgagatgtattacttctcagtcatgagctgggtgactcatgaccctcccatgcctcagtttcttcatccacataacaggaatccgagtagtagagtagccttgtagagtgttaggactaattttacaatcctggggtcagggcctgaagcccagttaagcactctgagtttggtaaccgaggctgtatgtgcacactcccatgacagctaccaccacactcataactcatgccattctggccacagaagtcctttctcctcaaagctcaacacccaaaatgcatagtgctgaccgagactca

SEQ ID NO: 4020 - DNA, 323 bp, Mus musculus
atagaagtgcctgagacctttcccttgaagttgaagctttgaccctattcaagaatagtagtttgaggcaaccagataaaagttgagtgacaggtgtcagaaaggcgtggatgtgagggtgaggagctggttgtgatttagtctgagaatgctcacccctgcagacaagggagaaaggtatggatgagccctgcctgctgatagatgcatgttcttcaggcagcttggaggtgaagctaagtcagttaggaaacaacccagacttcacttttcccaaagggaatatgaaacttgcctctttagaaagtccagctgggccgggc

SEQ ID NO: 4021 - DNA, 339 bp, Mus musculus
tgggtctggtctgtgcactggcacaagcctgccaactgcacacctgcctgatatagcgttgtgtatcaaagtgggcagagggagaggtttcccattcctcctaggagtcttagagattcctgccttactttgttgtgtagtttgttggctttttggggttttcttgttttttgtatttttgttcttgtttttgttttttagctttggtgcaatgtgagtgtcaaaaggttttattttgacattttaaacaagaccaaatcaggcccaaactgcctccatagaaggtgctggggtctttcagaatgcctccttccaatggataaagacgtgggcagcccc

SEQ ID NO: 4022 - DNA, 269 bp, Mus musculus
aaaagtcagcttgactcccacttgatttgtctaaaacatttctgctaacagttagtttcatctaggaatcattggatgtctcaaggaggtttccatagaaatacaatgggttggaaaaaaaatctgtattgtgtaaaatcagtgatttctccaaaatccaaaagataagtaaaaatgtttgggattttaaccattgaggctactcaatgaggaaagagtgaaaaggccacgggtttcagtgcattgctcctttatctcttttccagagt

SEQ ID NO: 4023 - DNA, 417 bp, Mus musculus
  misc_feature (52)..(52): n is a, c, g, or t
  misc_feature (64)..(64): n is a, c, g, or t
  misc_feature (96)..(96): n is a, c, g, or t
  misc_feature (155)..(155): n is a, c, g, or t
  misc_feature (189)..(189): n is a, c, g, or t
  misc_feature (229)..(229): n is a, c, g, or t
tggagatcacaccacttcatacctggcatggtttaaaactggaggacgactnccgggcatggtngtgcacagctgtagtctgagggctgaaaggtngaagcctttagaaagatcatgagttagagaccagttctggcaagacccggtctcacagntttaaaaaacaaaactacaggaactccttcatancaaagaaattagcatgaagatgagactgtagtgagcattntttatggcacctaatggcagccagaaggtgtcactcagagaagtcacacctgagcccaggctgacccccaacagctttaactgctcactgtgagcatgcacaagcaggcacacagctctagccaggagcatctcaagtggggacagtgatgggacagggctggatttcttccctcaactcaagagtct

SEQ ID NO: 4024 - DNA, 366 bp, Mus musculus
gagagtactgtccatttatttaaaaaatttcagcacacacaaaacagtttatacccaggcatggtggtaggtgtctataactcctggttgtagcaggaagagtccaagttgatggtcaagctgggccacctggcaggacactaacaacaaaaattttgctaagtgaggggctgaagagatagctcaggctaagagtgcatgcagctgctgcagagatccaggctcagttctcagcatccactcaaggctgctcacaatcacctggaaccccagctctcggggattcagtggcctcttggtctccacatgcaaccggactcacatgcacaaacccccacacagatacagatgcatacccgttttata

SEQ ID NO: 4025 - DNA, 421 bp, Mus musculus
  misc_feature (100)..(100): n is a, c, g, or t
  misc_feature (102)..(102): n is a, c, g, or t
  misc_feature (107)..(107): n is a, c, g, or t
  misc_feature (116)..(116): n is a, c, g, or t
  misc_feature (140)..(140): n is a, c, g, or t
  misc_feature (149)..(149): n is a, c, g, or t
  misc_feature (174)..(174): n is a, c, g, or t
  misc_feature (238)..(238): n is a, c, g, or t
  misc_feature (251)..(251): n is a, c, g, or t
  misc_feature (272)..(272): n is a, c, g, or t
  misc_feature (328)..(328): n is a, c, g, or t
tacacagtgtagcagttcccagggctgctttaattctggaggatttagtgcctgccttagaacagggatagcgccccatcctaaagtggtccttccaggnancctgngtaagaccngcattgagctagactgcagcatcnaacagcccnagtgtcagtttcagctttccaaatnaagcattactgtttatatcatagccacactcgttaccagtggcattaaggaatgcaagggcccngttcaagggtcangatgtaatcttcaaaacaggnacttaccagttacaatcctgaaatcactgcactcatggctccatcctggggtgacngctgagcatggagtggaaacctctacaggagggcgtcacacccctggctctggtggccaatactcaccacattttgccttctggagtcccatt

SEQ ID NO: 4026 - DNA, 244 bp, Mus musculus
gattcccccccatggcccaggaaggcataactgctggaggtgtaatggacgtcaaccctgcttttcaaaaggtgctgaagaccgccctcatccccgatggcctagcacgtggcatacgcgaaactgccaaaaccttagacaagcgcccagcccatctgtgtgtgctcgcatcccactgtgatgagcccatgtatgtcaaactggtggaggccctttgttttgagcccccaatcaacctgataaa

SEQ ID NO: 4027 - DNA, 338 bp, Mus musculus
cgtgctctttatcactttgctcagccccacataataacatcttcatctgagattgccgtggcacaggggagccgcatttgttgatcaaatttggctggctaacactgtgatctcctatcctgaagtgcagagatgtgcctggaatatgtaagtgcaaagccagcctcctgattgattgattctgcctgtcacagaacaagataaccggatcagtaaataccctgtgcactcaccatcgtccccacaatcaaaagtgagggcatcacggggctggaaaacactggggcatgatgggatgcacacatttccaaaggataggcaggaacacatccacagac

SEQ ID NO: 4028 - DNA, 381 bp, Mus musculus
  misc_feature (179)..(179): n is a, c, g, or t
  misc_feature (189)..(189): n is a, c, g, or t
  misc_feature (243)..(243): n is a, c, g, or t
  misc_feature (310)..(310): n is a, c, g, or t
  misc_feature (325)..(325): n is a, c, g, or t
  misc_feature (327)..(327): n is a, c, g, or t
  misc_feature (331)..(331): n is a, c, g, or t
  misc_feature (334)..(334): n is a, c, g, or t
  misc_feature (355)..(355): n is a, c, g, or t
cagattaagttcctctctccaatccctggtggtggagcaatcacctacggccacaaagctcaacgttgccactgaccaattctgaaaggtctggcctgtggtagcagcaggcaaagactacccaaggaaacccaaaccctgtgccacaagcaattattgaaaggcatcgtgggcgctcnaaaacctaancacggatctaaacacgtggttaaaatgatgagttcttccgacccaggctcaggntaaaggaagagaaaggtacagagcatgccagctcacccaagacccgtcctgaatacccttaaatacncctagtgtagatggntntctnccntccttactggtttagtctaanccagttcatgtaaaacccacgaaaca

SEQ ID NO: 4029 - DNA, 378 bp, Mus musculus
ttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccagggcagcatctcggttctgcgcca

SEQ ID NO: 4030 - DNA, 412 bp, Mus musculus
  misc_feature (165)..(166): n is a, c, g, or t
  misc_feature (183)..(183): n is a, c, g, or t
  misc_feature (195)..(195): n is a, c, g, or t
  misc_feature (231)..(231): n is a, c, g, or t
  misc_feature (247)..(247): n is a, c, g, or t
  misc_feature (261)..(261): n is a, c, g, or t
  misc_feature (282)..(282): n is a, c, g, or t
  misc_feature (317)..(317): n is a, c, g, or t
  misc_feature (368)..(368): n is a, c, g, or t
gtgggtcagtgtcctctccgtcctgcctccctgcccagtgtggcccttcgctcactctttgggctcccaccgatatgggttgggcgttggtgccaaagctgagggcactgtctccggggcctccagcttgtctcttccttcaaagccaaaggcccctggctcctnncccctttgctgctgcgnggtccggtacancctcgacctcaccaccctgttgcacgtggaggaaanaggtggtgttagttgnccctttagtttgtntgcaacctcagtggttcagcncctcatcacaggaggcagacagggacctgtttgtnatcagagctctgtttttgcttttgtttgagactgtctccacagcccagacnggctttgtacttgaaatcctcctgtctcggccctggcgctgaat

SEQ ID NO: 4031 - DNA, 363 bp, Mus musculus
  misc_feature (84)..(84): n is a, c, g, or t
  misc_feature (130)..(130): n is a, c, g, or t
  misc_feature (205)..(205): n is a, c, g, or t
  misc_feature (211)..(211): n is a, c, g, or t
  misc_feature (214)..(214): n is a, c, g, or t
  misc_feature (221)..(221): n is a, c, g, or t
  misc_feature (286)..(286): n is a, c, g, or t
gaaagatgtttcaggctgccagccatcagaagtggcaacgtgctagattagagtccaccattttcttatgtttggaagtgtgangcttttatttgtttgtttgtctgcctggttctttcttgcacacgcngaagacagctgtgctgctctcttaatggtgggattttaccttgaaaggaccaagtgttccacacagggacttcanagctgntcnggtccantgtgctctagagccagggttgtcaaccttcctgatgctgtgaccctgtaatacagttcatcgtgntgtgacgaccccaccccacacaccataaaattgttttgttactgcttcataactgtaactttcctaccgttatggat

SEQ ID NO: 4032 - DNA, 374 bp, Mus musculus
ggcattcagctgtatcttaggcatgcaatgagttttctttctttctaattaaaaatgtcagtaacatgcttcacttatttcctccattgctgagattctgttccttacattgtaaacttgaagaggaaaccaaacctgataatgtggtccagtgagcacacccatgcctgtgaattctacctccagcacaaccaagcctgatacctcacacaagcaaaaacaagagaaggaagaccagaggggtcttcagaggccacagtttttccattgttttctgtgttttaaaacagatgctgtatctaaccaaagctgtgaaagaaatgttctctttggtcaagtgacatggtccccattccttggattctgttctactt

SEQ ID NO: 4033 - DNA, 350 bp, Mus musculus
aatggatcgtgtagaccctgagtgaggcagaggagcacatatggatacccatgcagcattaaggcttctcattccactaactctcctctttccaagtgttgctgctacaactagccaaggcttccagcaaatccttagggaagctacatcccacttccagattagcaaaaatgctaggaaaatagcaggcattgctattagaactacattcttgctttgatttcatttttctttgctagaagaagtgaatcggggctggccataatttacaccagtaattacagcccttagaagagggagacctgaggatcaagaattcaacatcaaggcagctacatcgtaacttcaag

SEQ ID NO: 4034 - DNA, 364 bp, Mus musculus
ctgtatatggctggtcccacttcatacactgggtcccaactgtgtataaaaataaggaagcctagttgatcagaagcaggcagaccccaagggtccagtttatcctctgctcttgactatggatatgatgtgactagtgcttaagttcctgcctcgacttctccacaataagggactgtgacctgtgttgttggttgttgttgttgttgttgttgttgttgttgtatttggggggtggggtcagggtgccttcccagggcatcagagtaaaactggaacaatgacacatgtctgtgatcccagcacttgggggactaaggcaaggggcctgaggattcaaggacagtttggactttgttgtgaa

SEQ ID NO: 4035 - DNA, 380 bp, Mus musculus
  misc_feature (145)..(145): n is a, c, g, or t
  misc_feature (150)..(150): n is a, c, g, or t
  misc_feature (159)..(159): n is a, c, g, or t
gtttatgttactgatcttatttgggaaagcaaactaaatactcttctatagatgaaacatctttataaattcttgttcataagatagcattttctatgctgttttgctaaaaattaaagataatacttggtcccagaagcacacntgctncagcgatcntaatttgctctaaagctgagccaccccgccatggccactgctgctctgcagtggtgtcactaggtgactgtagtgacagagggctgccttctaccctactcactttcttcattgtctgtagaagggaggagagaattccggtctgtaactttttggacaaactttttaagagtttatacttgtttaattgggtaataagtgacccctcctgttaatcctag

SEQ ID NO: 4036 - DNA, 295 bp, Mus musculus
  misc_feature (156)..(156): n is a, c, g, or t
  misc_feature (163)..(163): n is a, c, g, or t
  misc_feature (185)..(185): n is a, c, g, or t
  misc_feature (191)..(191): n is a, c, g, or t
  misc_feature (220)..(220): n is a, c, g, or t
  misc_feature (244)..(244): n is a, c, g, or t
  misc_feature (246)..(246): n is a, c, g, or t
  misc_feature (270)..(270): n is a, c, g, or t
ctaatgggctctggtatgtcttttagactaacaaacttctgttttctatcttttctttcataagccccttgtaggcctgcagaatggacataccatcttatttggctcgttctaggctggccatccctttacatattgatcatgatgatgcatctngaggatntctgaaggctttctttctacanccctcntactattgtatggctctgaattcagaaanccactcaggtgggctaagaaaacnanagctacataattcctaaacacttnatctgttcttctcaaagggagtaag

SEQ ID NO: 4037 - DNA, 296 bp, Mus musculus
  misc_feature (59)..(59): n is a, c, g, or t
  misc_feature (128)..(128): n is a, c, g, or t
  misc_feature (186)..(186): n is a, c, g, or t
  misc_feature (238)..(238): n is a, c, g, or t
  misc_feature (246)..(246): n is a, c, g, or t
  misc_feature (248)..(248): n is a, c, g, or t
  misc_feature (253)..(253): n is a, c, g, or t
aaaacctgtcctgtgtggatgaagcccttagtgaacatgtgctattgacactagcacanccatgtcaaggaccccaaggcggacccccctccccaagtgaggctcagagggatggcaaggcctttctnaggggtctgagtgtgaatgttggcagtgtgtgcagaaaatgtccaccatagcctcttntaccacccaaacatttacagcctgaaaactgctcccctacaaagactgcccntactgagntnagctntacctgtccccttgatctgtatactgtatccaataacccgcct

SEQ ID NO: 4038 - DNA, 360 bp, Mus musculus
  misc_feature (147)..(147): n is a, c, g, or t
  misc_feature (172)..(172): n is a, c, g, or t
  misc_feature (174)..(174): n is a, c, g, or t
  misc_feature (181)..(181): n is a, c, g, or t
  misc_feature (193)..(193): n is a, c, g, or t
  misc_feature (207)..(208): n is a, c, g, or t
  misc_feature (212)..(212): n is a, c, g, or t
  misc_feature (220)..(220): n is a, c, g, or t
  misc_feature (224)..(224): n is a, c, g, or t
  misc_feature (228)..(228): n is a, c, g, or t
  misc_feature (234)..(234): n is a, c, g, or t
  misc_feature (244)..(244): n is a, c, g, or t
  misc_feature (275)..(275): n is a, c, g, or t
  misc_feature (282)..(282): n is a, c, g, or t
  misc_feature (284)..(284): n is a, c, g, or t
  misc_feature (299)..(299): n is a, c, g, or t
  misc_feature (306)..(306): n is a, c, g, or t
aatgcatcaaattctcaaggagggcttggtgttctctctgcagctctgatctctgggagtctgtcctacaaactgtagacgccttggtcttcctggactctcagctctatctcttcaactcattgaactcagtgggctcttcccaantcttccctctgcactgaatcctctntnaaggtantgagtggggacnaacccattttactnntctntcttcatnactnaatntcagtnacttgaatantcttcagtattttaacttttataactgggcnaaccaantnggttacacctcttgnccagatntcaaggccatgtgaccatctacccagtattaatttaccctgttctcccaaatag

SEQ ID NO: 4039 - DNA, 210 bp, Mus musculus
  misc_feature (29)..(29): n is a, c, g, or t
ctctctggcccaagatgtaaactatcacnccgggtaaccattccaataccacactctactctcaaccagatattcttattttgaatcatcaagtatattttagggttttgctttttgtgttttggtgtgtgtgtgtggtgggggtgtgggaggagtgggtcactctctagcccttgctatcctggaactcgatgatctgtagcccaggct

SEQ ID NO: 4040 - DNA, 283 bp, Mus musculus
gtgtgtggcggtaccttcagagtccagaggaaggtatcagatcctgtgcagctggaggtacaagtagccatgtacagctcagcacaggagctgggaatggaacttggctcctctacaaaagcagtgtacattcttcaccatggaaacattctgacaagcttcctggagagccttaaaaaatggtcaccctgtttctaatgaaaactttgaataaacgatgacttatatagggagatataagaatgaaaacacaaataaattgtcataatagagcactggtttt

SEQ ID NO: 4041 - DNA, 324 bp, Mus musculus
  misc_feature (176)..(176): n is a, c, g, or t
  misc_feature (265)..(265): n is a, c, g, or t
  misc_feature (283)..(283): n is a, c, g, or t
  misc_feature (287)..(287): n is a, c, g, or t
  misc_feature (297)..(297): n is a, c, g, or t
atagagaaggacctccactgtcaacctctgacgttcgttcgcatgtgcaggcacaggcaggggtgtggacacaggcaacaacaaacagggctgagaatggcagtacactgtgctaatctccgtacctggaaggcagaggcaagcttgtctctgtgagttccaggccagccaggagntacgcagtgagaccccatccaagaagcaagaacacactgagatccctttgcctctcagcataaatagtccccattttacacatttgggncctgcttgattttttaantaantgtgagagtntaccatacaacatgtcccactgttggt

SEQ ID NO: 4042 - DNA, 259 bp, Mus musculus
  misc_feature (181)..(182): n is a, c, g, or t
gcttgtcttgattgctgcctagggagcctgaccaacgtgtgtgtaattaccgtttacaggttctgcctatttagccgctgactgtggttcccttatggttatatttatttcaggttttgttttgttttgttttgagatagtgactcactgtgctggcctggaactcattgcgtagcctaanntaggatgggcttaaactcgaaattcttttgcctcggcctacctattactggcattaagtgtgtgcatctcgctgggc

SEQ ID NO: 4043 - DNA, 272 bp, Mus musculus
aatactgctcacagtgtgtgactgttggtcgtgtcctgaaagtcttggagtcacattttatcccctgagagtttgactcaggttccaaaaccctaacagaagaacagctgactctgctcagccgccagggcctgttaagaagttggagttactcctacaaggacttatcatggagagagtccacaaatacatgtatgtagttacacacaggtttggtctacctaagggattgtcacctgggcctgtgaagtgactgggcctgcagctactgc

SEQ ID NO: 4044 - DNA, 234 bp, Mus musculus
tactggtagaccacactgggcttgctctctgcttctgtgtacaaatcttattccgtttctgttgttattcaccagcaaagatccttagtgcttatcatctgagagtcttcttctcattcttcctgcacacgtagcagacacacacaggagataaggagcattgtgagcttcagagaccttagcacagggtgttgttaccacagccattcaaagctctgttgacctcatttttaa

SEQ ID NO: 4045 - DNA, 333 bp, Mus musculus
cattcctgcccgtgctgaggatggggtaggaggggtgatagtggtcacagtcctcactgcaccctgccttttgctttgccaggagcatcgatcaggcttcaaggccaaagcctgggaaagtacaggaaccccgctttctcaatcaacagaggcttggagagttgggtttttgtttgtttgtttgtttttgtttgtttttggggggttgtttgtgtttgtttgtttgtttgtttgttttttgtgcctgccctcattagtctctggcagaagtgggggtgaaaccttagaggtcatgtcctccttgtacccactaccccagcttgaaggaggcaa

SEQ ID NO: 4046 - DNA, 76 bp, Mus musculus
ctggccttactttagtctctgcttgctcatctgccaagggttagagagtcccagggttactagacatttgatgctc

SEQ ID NO: 4047 - DNA, 280 bp, Mus musculus
  misc_feature (174)..(174): n is a, c, g, or t
  misc_feature (197)..(197): n is a, c, g, or t
  misc_feature (217)..(217): n is a, c, g, or t
  misc_feature (228)..(228): n is a, c, g, or t
agatgaaacctacgctctctttaagagctccaggaggaaaaggaagtctttcctgtatggtttaggaaattgcttttgcatccaagagagagcaatgagaacacttccctgatacattgcagggctgggtgcgaaaggaaccagctcagagcagagtggatacagctaggaatnagcaccctgcctcccaggacctntgagggggcccagggtcctnttgggaacctntgatgtactaattacacccatgcatcccttcagaatcaaccgcaagctttta

SEQ ID NO: 4048 - DNA, 250 bp, Mus musculus
  misc_feature (52)..(52): n is a, c, g, or t
  misc_feature (207)..(207): n is a, c, g, or t
taacctgcaactaaatagcaacagccaaagcaaagcttagaatagagatcangtaaagttctgcacctggtttcagcaaggtggctgagggcagggctctggctctggctgcacacattctgaactcacctcctcccctgagcaggcctgaactaggtatttgcaccagctcatcacctgtgagccaggggtgtgacagtagctccnttacctaagtgctgagcttctactcctgacaactacaaggaaa

SEQ ID NO: 4049 - DNA, 254 bp, Mus musculus
  misc_feature (63)..(63): n is a, c, g, or t
actggcctgggcataaattctgtgatgagttgttttcctggaataatattaataacaacttgnttaattttacatctacatggttgaaaagtccgtgagggtgattctgtcccccttgccactcaaacggagcaaagatgtggattgaattgtttggtgagtgtagataatttagtaaatattagggtttcttacatagaagtgattcaaattatcacagaaaaagaaggataacacacttgagaaagattctg

SEQ ID NO: 4050 - DNA, 125 bp, Mus musculus
tgactatacacacaacaagacttctcgcccaatccccaacctccatcttccgaacaccatctcctgtagagtttcaaatcacacccatcagaccacttcaatcctaatctgaacaccggatggga

SEQ ID NO: 4051 - DNA, 198 bp, Mus musculus
  misc_feature (73)..(73): n is a, c, g, or t
  misc_feature (75)..(76): n is a, c, g, or t
cactcatggcttaagaattcagtaccacagctatcttgcaattctgctccacttcctgaggaaaggctttctntnntcttaaatacacccctggctcacaatgtttttcagtattaaagggcaccggttgttgatgcaaacccttcccaacctgcagtttctcaacttctgttttgggtcagattgcaatgaaccatt

SEQ ID NO: 4052 - DNA, 105 bp, Mus musculus
  misc_feature (73)..(73): n is a, c, g, or t
atttttcgccagtctttaggactgctttatcagaatttatattttagtctatcctcccttttgaattttactnatgacagacgaagtattgacccatgacttttt

SEQ ID NO: 4053 - DNA, 61 bp, Mus musculus
ttgccaccccgaacacactgatgtgaccccctctcgagcttgatcctgttttgaatttttt

SEQ ID NO: 4054 - DNA, 80 bp, Mus musculus
tttctccaaaccacttgacttcatcaatatttgaagccaagaaagtaggtctctatatcttccacttcggattcgaaagc

SEQ ID NO: 4055 - DNA, 229 bp, Mus musculus
  misc_feature (28)..(28): n is a, c, g, or t
  misc_feature (33)..(35): n is a, c, g, or t
  misc_feature (37)..(37): n is a, c, g, or t
  misc_feature (42)..(43): n is a, c, g, or t
  misc_feature (78)..(78): n is a, c, g, or t
  misc_feature (89)..(89): n is a, c, g, or t
  misc_feature (99)..(99): n is a, c, g, or t
  misc_feature (106)..(106): n is a, c, g, or t
  misc_feature (122)..(122): n is a, c, g, or t
  misc_feature (124)..(124): n is a, c, g, or t
  misc_feature (126)..(126): n is a, c, g, or t
  misc_feature (131)..(131): n is a, c, g, or t
tggcagtctacctgcgcatccccgacanttgannncnaaacnncttcccattcctaccacaaatactgcagagaccanacagaaccttntggcatgggnagacagnccactaaactgatttnanancctgntagtagtgttttcagaaatccctaagattaactgtgtgttttccctataaattatattcgaatttcctgcacagcagttgtactgacacagactggtg

SEQ ID NO: 4056 - DNA, 119 bp, Mus musculus
ccctgagacagttggcgcaggcccacctcgatccagtccgcccgagatgcctgcagaccttcatatttctcgaggtgccaccgctgaagacggtgctttaaggaagtcatgatgagtct

SEQ ID NO: 4057 - DNA, 94 bp, Mus musculus
catgggccttgggttaagcatacaatcctgacccctatggtcattccggagccctgttgagccttttcatatgaagaacttaggagctattgct

SEQ ID NO: 4058 - DNA, 202 bp, Mus musculus
tgtcatctccattgagtcctggtagtctacatccaaggactctgggacactctagaggttccccacccccactcccagtccccaccgctgtatattttgattcattctcctggccccctgggtttctttcttgtctctccccatacctaatcttgttccttccttcccctttctgagtccttttacactggctcttttcttt

SEQ ID NO: 4059 - DNA, 100 bp, Mus musculus
ttgttttctaccatatcttcccttgcttttggaacaggctcccccagcttcttctttccttatctgtggtctactgtgattctgtgatccatttccagca

SEQ ID NO: 4060 - DNA, 214 bp, Mus musculus
  misc_feature (40)..(40): n is a, c, g, or t
  misc_feature (42)..(45): n is a, c, g, or t
  misc_feature (47)..(48): n is a, c, g, or t
  misc_feature (51)..(51): n is a, c, g, or t
  misc_feature (58)..(58): n is a, c, g, or t
  misc_feature (60)..(60): n is a, c, g, or t
  misc_feature (63)..(63): n is a, c, g, or t
  misc_feature (69)..(69): n is a, c, g, or t
  misc_feature (74)..(75): n is a, c, g, or t
  misc_feature (77)..(77): n is a, c, g, or t
  misc_feature (88)..(88): n is a, c, g, or t
  misc_feature (91)..(91): n is a, c, g, or t
  misc_feature (93)..(93): n is a, c, g, or t
  misc_feature (125)..(125): n is a, c, g, or t
  misc_feature (130)..(130): n is a, c, g, or t
  misc_feature (136)..(136): n is a, c, g, or t
  misc_feature (141)..(141): n is a, c, g, or t
  misc_feature (145)..(145): n is a, c, g, or t
  misc_feature (149)..(149): n is a, c, g, or t
  misc_feature (159)..(159): n is a, c, g, or t
  misc_feature (189)..(189): n is a, c, g, or t
gcccattcagagcacttatcaaactccaattcccttaacngnnnncnnccnctccatncngangagaanccccnngntgatgggaagnagnanccttcctgctctccactaggaattcacctctnccctncaggtnccctncagntgancagctctcanctggtgcacaaggacatgggacaaaggagntcctccccaaggaatgtggtgctgt

SEQ ID NO: 4061 - DNA, 201 bp, Mus musculus
  misc_feature (116)..(116): n is a, c, g, or t
  misc_feature (129)..(129): n is a, c, g, or t
  misc_feature (165)..(165): n is a, c, g, or t
catgggactcaaggatctgcttttccactgtggagaggtcattccccctcacaacgtttgggggacaggaactgggagacgtgtgccctgtcccttcctctccccacacctccacncacagagacaatncccctgtaagggaaacaggactgttgacaagggagncaagaggacaccagccaaggaccagtgcctctgacc

SEQ ID NO: 4062 - DNA, 178 bp, Mus musculus
  misc_feature (46)..(46): n is a, c, g, or t
  misc_feature (70)..(71): n is a, c, g, or t
  misc_feature (94)..(94): n is a, c, g, or t
  misc_feature (125)..(125): n is a, c, g, or t
  misc_feature (134)..(134): n is a, c, g, or t
ctcagcaaactttcccaggcctggtcctcttgggtgaatggccacnagcttttcttttgttttgttcccnntgtttcctgggtgggggaggggnccacctcccttacctactctgagttcccttnagagagatncattttttctaggactctgtgcacctgttgtgtgtggtcccgtg

SEQ ID NO: 4063 - DNA, 165 bp, Mus musculus
  misc_feature (34)..(34): n is a, c, g, or t
  misc_feature (40)..(40): n is a, c, g, or t
  misc_feature (42)..(42): n is a, c, g, or t
  misc_feature (44)..(45): n is a, c, g, or t
  misc_feature (48)..(48): n is a, c, g, or t
  misc_feature (50)..(50): n is a, c, g, or t
  misc_feature (54)..(54): n is a, c, g, or t
  misc_feature (57)..(58): n is a, c, g, or t
  misc_feature (61)..(61): n is a, c, g, or t
  misc_feature (64)..(64): n is a, c, g, or t
  misc_feature (72)..(72): n is a, c, g, or t
  misc_feature (74)..(74): n is a, c, g, or t
  misc_feature (85)..(85): n is a, c, g, or t
  misc_feature (88)..(88): n is a, c, g, or t
  misc_feature (93)..(93): n is a, c, g, or t
  misc_feature (102)..(102): n is a, c, g, or t
gcttgaagacatccaatggaccccacaaactttnctcaanancnnagntngaanttnnctnctnctaagaancntctcagaactntanccccncatcatgangaaaagaaacttcctgaggaaagagggaagaaggaagaacagaccagactgaggcccattcct

SEQ ID NO: 4064 - DNA, 40 bp, Mus musculus
ggcactatggagattcccttgtggttctaggagcacagtt

SEQ ID NO: 4065 - DNA, 160 bp, Mus musculus
  misc_feature (75)..(75): n is a, c, g, or t
cccatgttctcctgtttacaacttaacttaagtcgggctttctgttatgggttttcctgttttgtatttaaattntaaaaaatcagcaagctgttccctgagtagtgttgctgcctgtgtgtccggtcccgcccccccggcacgcactttagtaagttat

SEQ ID NO: 4066 - DNA, 52 bp, Mus musculus
gggccgaagagtctcccagagtcatgtcttctctggtggcagcaacgagggt

SEQ ID NO: 4067 - DNA, 174 bp, Mus musculus
  misc_feature (140)..(141): n is a, c, g, or t
  misc_feature (143)..(143): n is a, c, g, or t
gagtgtaattatacccatttgtgtgaattaaaatatatgcagacaaggtgcaacgtggttgccaaataaaggggtgagcacacagcctctgtgcaaagctcctagttaccccatctgcacatagcttaccatcatgcttnnanggtatttacctcctgcttggtttatttgtta

SEQ ID NO: 4068 - DNA, 118 bp, Mus musculus
  misc_feature (88)..(88): n is a, c, g, or t
taccagaattctgccgcccatcccgaccctgaatttgattgtcccttcctccctcccttctcttttcttgaagctgggggaggggcancgggctcggacttggctagtttgtttattg

SEQ ID NO: 4069 - DNA, 160 bp, Mus musculus
  misc_feature (30)..(30): n is a, c, g, or t
  misc_feature (42)..(42): n is a, c, g, or t
  misc_feature (64)..(64): n is a, c, g, or t
  misc_feature (77)..(77): n is a, c, g, or t
  misc_feature (89)..(89): n is a, c, g, or t
  misc_feature (96)..(96): n is a, c, g, or t
  misc_feature (123)..(123): n is a, c, g, or t
acttcctgcccttctgcatagggtagctgntccctaccccantcagaaggtactccctctggcnggccccattccancttggctcctgntcccttncaactgagtggatccagtttcctcacnaattgaactgacaacacctacctttcagggtggtcag

SEQ ID NO: 4070 - DNA, 191 bp, Mus musculus
  misc_feature (81)..(81): n is a, c, g, or t
taaaaatcgcataatctcactttcacagagcattccatcattgcccctacaatggtggtccatgagaaacaagatgacttnggcaaaggtggaaatgaagaaagtacaaagactggaaatgctgggagccgcttggcctgtggagtgattgggattgcgcagtaaacattccctgtgtgttttgattttca

SEQ ID NO: 4071 - DNA, 110 bp, Mus musculus
  misc_feature (65)..(65): n is a, c, g, or t
  misc_feature (79)..(79): n is a, c, g, or t
ggatcctgcatctgaccttgtctatactatttttgaaaccattcctcccatagtcaatgatgatntccactagtcaagntcatttgtttttgagaactgtcattggtaaa

SEQ ID NO: 4072 - DNA, 113 bp, Mus musculus
  misc_feature (34)..(34): n is a, c, g, or t
  misc_feature (41)..(41): n is a, c, g, or t
  misc_feature (51)..(51): n is a, c, g, or t
  misc_feature (72)..(72): n is a, c, g, or t
  misc_feature (75)..(75): n is a, c, g, or t
cgcactaagagttgctttctctcgttttgcattntaaatcnatggcagatnccttaggtggtagtgttgctntanactgtccccctcccaacacgcttgatgtttgccctgat

SEQ ID NO: 4073 - DNA, 134 bp, Mus musculus
  misc_feature (67)..(67): n is a, c, g, or t
  misc_feature (86)..(86): n is a, c, g, or t
  misc_feature (88)..(88): n is a, c, g, or t
tcctaatgcgtatggccaggccttacagcttatggaatggctaaagcagaacttgttaacagatgtnatgtaaaccttgccaaagntntggtggcaatctccaatgtgttgtttgaactgtgcgcgctgtgcct

SEQ ID NO: 4074 - DNA, 87 bp, Mus musculus
  misc_feature (39)..(39): n is a, c, g, or t
atgtagtctacagatcccacaaagttcttgaaatccttnaggggagttttcctttttccggtgccactacttcaactttcttctgtt

SEQ ID NO: 4075 - DNA, 55 bp, Mus musculus
ggagccccccagcaactgaatcatttagataccactgttcccttgaggattaaca

SEQ ID NO: 4076 - DNA, 145 bp, Mus musculus
  misc_feature (71)..(71): n is a, c, g, or t
  misc_feature (73)..(74): n is a, c, g, or t
  misc_feature (95)..(95): n is a, c, g, or t
  misc_feature (103)..(103): n is a, c, g, or t
  misc_feature (105)..(105): n is a, c, g, or t
  misc_feature (115)..(115): n is a, c, g, or t
ggagccccccagcaactgaatcatttagataccactgttcccttgaggattaacagtgaggcaagcagggntnnttttcaccgcaggaggaagcnactgatgntntccatgcccntcctgacagcgtctttttgaccagagtgcc

SEQ ID NO: 4077 - DNA, 126 bp, Mus musculus
  misc_feature (38)..(38): n is a, c, g, or t
  misc_feature (40)..(40): n is a, c, g, or t
  misc_feature (42)..(42): n is a, c, g, or t
  misc_feature (45)..(45): n is a, c, g, or t
  misc_feature (48)..(48): n is a, c, g, or t
  misc_feature (52)..(52): n is a, c, g, or t
  misc_feature (58)..(58): n is a, c, g, or t
  misc_feature (63)..(63): n is a, c, g, or t
  misc_feature (65)..(65): n is a, c, g, or t
ggcagagcacagacgcccttgtgggggcttgggagtgntntntgngtnttantgatgnctgantntgcaagcctgttgatttgtaaacattcatggtaattttgctttgcctctgtgctttactta

SEQ ID NO: 4078 - DNA, 174 bp, Mus musculus
  misc_feature (26)..(26): n is a, c, g, or t
  misc_feature (30)..(30): n is a, c, g, or t
  misc_feature (34)..(34): n is a, c, g, or t
  misc_feature (36)..(36): n is a, c, g, or t
  misc_feature (59)..(59): n is a, c, g, or t
  misc_feature (69)..(69): n is a, c, g, or t
  misc_feature (105)..(105): n is a, c, g, or t
cccagcctcgcgcaatcccaggtttncctntggnanctcctgctcaggtttggacctcntggcacactncccatcaagagggcttttccaaatttcaggacagantcacgcagaggtgcctgttacgaaccacttcaactgtatatagacagcttagtgataataccctggtcc

SEQ ID NO: 4079 - DNA, 164 bp, Mus musculus
  misc_feature (72)..(72): n is a, c, g, or t
  misc_feature (75)..(75): n is a, c, g, or t
  misc_feature (81)..(81): n is a, c, g, or t
  misc_feature (83)..(83): n is a, c, g, or t
  misc_feature (88)..(88): n is a, c, g, or t
  misc_feature (102)..(102): n is a, c, g, or t
  misc_feature (104)..(104): n is a, c, g, or t
actatccaatttccaccccttaatggggtttttccaaggcttcgttgtggggcctgggtttttcattgtccnttntcagtncntgggngcagccctcttcantntcctcaggtaggctgtgccccttacccagctgttctgcttggatttcctacgcccccagg

SEQ ID NO: 4080 - DNA, 75 bp, Mus musculus
ggactccccttccttgggagtcatattgatccctgatcctatttccctctgccaatgactttgggcaacacgttt

SEQ ID NO: 4081 - DNA, 44 bp, Mus musculus
taagagagagatgttccgatgcactcattaaacgacgggaatac

SEQ ID NO: 4082 - DNA, 152 bp, Mus musculus
  misc_feature (34)..(36): n is a, c, g, or t
  misc_feature (38)..(39): n is a, c, g, or t
  misc_feature (42)..(42): n is a, c, g, or t
  misc_feature (45)..(45): n is a, c, g, or t
  misc_feature (47)..(47): n is a, c, g, or t
  misc_feature (52)..(52): n is a, c, g, or t
  misc_feature (54)..(54): n is a, c, g, or t
  misc_feature (56)..(56): n is a, c, g, or t
  misc_feature (59)..(59): n is a, c, g, or t
  misc_feature (62)..(62): n is a, c, g, or t
  misc_feature (84)..(84): n is a, c, g, or t
  misc_feature (90)..(90): n is a, c, g, or t
  misc_feature (92)..(92): n is a, c, g, or t
agtatcagatctgccgtggaattggtatcgtatnnnannggntcntnttttntnancangtnttcctcactagaaggaaatgcngttacntntaagctttttcaaatttacattaaaatacttgtatgaggactgtgacgttatgttaaaaa

SEQ ID NO: 4083 - DNA, 116 bp, Mus musculus
  misc_feature (27)..(27): n is a, c, g, or t
  misc_feature (31)..(31): n is a, c, g, or t
  misc_feature (80)..(80): n is a, c, g, or t
tttattcgtagaaatcagtagccaggnaaantcttgggaaccttccttctgatttgcctgcccatcccatccattccttntacatatataccttggattcccatacacttaggaaa

SEQ ID NO: 4084 - DNA, 152 bp, Mus musculus
  misc_feature (43)..(43): n is a, c, g, or t
  misc_feature (60)..(60): n is a, c, g, or t
  misc_feature (78)..(78): n is a, c, g, or t
  misc_feature (118)..(118): n is a, c, g, or t
  misc_feature (127)..(127): n is a, c, g, or t
tacttttcctacttatccccaggatctggattacccctggggntgatttttgacctgggntttgtcgagggctcagtnttttggatattcagacaggagctattgcccgagcctgggntaatggacntttgaaccctgtactgttacctgat

SEQ ID NO: 4085 - DNA, 100 bp, Mus musculus
  misc_feature (45)..(45): n is a, c, g, or t
  misc_feature (50)..(50): n is a, c, g, or t
tcttcactgacctatgggggtggaatacagatgcacagctccagntattntgtcccctctctctctctgatagatatggctgttggctgtaacattccac

SEQ ID NO: 4086 - DNA, 145 bp, Mus musculus
  misc_feature (44)..(45): n is a, c, g, or t
  misc_feature (48)..(48): n is a, c, g, or t
  misc_feature (50)..(52): n is a, c, g, or t
  misc_feature (54)..(54): n is a, c, g, or t
  misc_feature (57)..(57): n is a, c, g, or t
  misc_feature (59)..(59): n is a, c, g, or t
  misc_feature (66)..(66): n is a, c, g, or t
  misc_feature (111)..(111): n is a, c, g, or t
attaatgcttgcctggcccttttcctttttactttgggataagnnggntnnngnggntntattcantactttgggatacccccaaacctgttttgacgtcgtgagtgtcanatgtgtcccaatcctccctagaagttatgaacac

SEQ ID NO: 4087 - DNA, 36 bp, Mus musculus
tggattctttattcgcagactcctggatttctgacc

SEQ ID NO: 4088 - DNA, 73 bp, Mus musculus
tcctacctacttcagtttttatgttcccactcctcctgtgttaataacattgctttcatcttggatatttttt

SEQ ID NO: 4089 - DNA, 467 bp, Mus musculus
  misc_feature (211)..(211): n is a, c, g, or t
  misc_feature (281)..(281): n is a, c, g, or t
  misc_feature (293)..(293): n is a, c, g, or t
  misc_feature (364)..(364): n is a, c, g, or t
  misc_feature (417)..(420): n is a, c, g, or t
ggcctgcctggcagtggtatgcctagtgagctgcctcagctgatccccgtgtttcctggtgggaccccactcttgccacctgtggtgggtggctccatccccgtgtccagcccactgcctcctgcctcctttggccttgtcatggacccctccaggaagctggctgcttctgtgctggatgcccttgactctccagggcccacgctggacnccctggatctgttaccatactctgaggctcggctgggtgcccttgacagctttgggtcagcccgaggctncctggacaagcnggactccttcctagaagagaccagctcgcaggaccaccgacccccaagcagtactcagaagccagcccccntcgccggagccctcaatgcccaacaccaccctgctcatcaagaaccctctggnnnncacccacgagttcaagcaggcctgccagttgtgctaccccaaaacag

SEQ ID NO: 4090 - DNA, 523 bp, Mus musculus
  misc_feature (94)..(95): n is a, c, g, or t
accatctgtaggtggatctcgagagatatataaattttgaattttatataaaatttattatgaaattcacatttttgagtaaaaaaaaaaaaanngtccgcccctgttttgtgtatatgtattttcttccatattttcagaaacctagagaactgtgcttaaaggtgctttacaatctgtaagtatggggacaaataaaacacagattgatttagtggctggtaaactcttggatgctgctttgaggacagcctttttgccataaggtggagaggaataggcttccccagctggcaggacctccgagcatgggaggtctgccctctgcgtttgctagtgaggactcaaaggtacagccaggacagaatttgacttcatccacttagcagtcatgagctggtcttctcggaactcattgttggctgggaagccttcctgaactccgtgctatctttgctccaattctaaacctctggtttttttctgtttgttgttttatgaaccacagtccatgtcagtccat

SEQ ID NO: 4091 - DNA, 261 bp, Mus musculus
  misc_feature (159)..(159): n is a, c, g, or t
  misc_feature (167)..(167): n is a, c, g, or t
  misc_feature (179)..(179): n is a, c, g, or t
  misc_feature (185)..(185): n is a, c, g, or t
  misc_feature (190)..(190): n is a, c, g, or t
aatcctgtaaatttacctctgaaatgccagtcccctttctcttgtttcccataaaaaagatccgaagacctatccaatgtagagggcaaaattccttaggctgtgggtgatcccattccttggctgggatcatggactgtgtacatggagaaagcaagntgagcatnagcgttcaccantttttncttgntgatttcagaagaacatgactggctgctttagattcctgccacctcgacttcccgccctgatgaactgtac

SEQ ID NO: 4092 - DNA, 497 bp, Mus musculus
  misc_feature (388)..(388): n is a, c, g, or t
  misc_feature (393)..(393): n is a, c, g, or t
  misc_feature (430)..(430): n is a, c, g, or t
  misc_feature (446)..(446): n is a, c, g, or t
  misc_feature (455)..(455): n is a, c, g, or t
  misc_feature (459)..(460): n is a, c, g, or t
  misc_feature (464)..(464): n is a, c, g, or t
tgggatagacctgctggtccagcgagccccagggatcctgtctctgacctgccagtgctaggaccacagacatctgtccctgtgcttggcttgttacttgggttctggggaatccaaactcaggttgaggctgtagagcactttacttacttggcagtcagaggacagctgtggcgctggctctcctgccctcatgagggctccaggctgggaagacaagcaagcgcctttaccactgagctatcttgtcagtaccctctgccatttagtctcactgtaacccaggcagctggtactgaatttgtggcacccctctgcctcagcaccccaggtgttgggattataggcctgtgccaccacacctggctctggtaaagaccttcctggnaaacnaaaaccaagtggtttttttttgttttgttttttcganacgattttgctgtgtngaaccgcgntgtnntggnaaacccactcgtaaaaccggctggcctggaaat

SEQ ID NO: 4093 - DNA, 500 bp, Mus musculus
  misc_feature (77)..(77): n is a, c, g, or t
  misc_feature (132)..(132): n is a, c, g, or t
  misc_feature (202)..(202): n is a, c, g, or t
  misc_feature (337)..(337): n is a, c, g, or t
  misc_feature (345)..(345): n is a, c, g, or t
  misc_feature (348)..(348): n is a, c, g, or t
  misc_feature (352)..(352): n is a, c, g, or t
  misc_feature (359)..(359): n is a, c, g, or t
gagatgagccagaagtgaccctcctctggactctggtaggctgcgaacccagcagaatcccatgggcacgcctgggngctgtccttggtgctgccggatccttgggcgtcacagcgccttacctgctggaanctgcagtcgtcccccaacagttaagcagactggagtgccactttccacttttaacacaaatgactacccnggcctgtcttctttgtcccctttccggaggtttccggcgggccattcctcaaaaactctctcttttttttcttctgcataactctcagctcatctcttgctgctttaagacgaggagtggggggggggtgtgtgnataaagancancggnccctacngccaaaagtaaggaagaaagagactaagaggtagggggccagacgaaagtcaggaagccagagaagagctgctcagagggccgagagtggcgagacaaagaaagggcgctgggaaagggcacttgcgccaaagctgtgaac

SEQ ID NO: 4094 - DNA, 342 bp, Mus musculus
  misc_feature (276)..(276): n is a, c, g, or t
gttagaacccatggaactggtcttttacattgtgaaccatccaatgtggatggtttaagttgacctcaggtcttctctgcaagagtagaatgtgctcttaaccactgaatcacctctccatccctgtatagtttcttaaaactcatctatcataattgatccttgtagtgactctagagaaccctgactaatacaatccttttatcaacaaaggcagaaaataaaggtaagaaaacccagtgctgctctaagtcaggactgtgactccaagtgaanaaaagatcactctcacaaaagccacaaggagccaggtgtagtggtgcatacctttactcccaccag

SEQ ID NO: 4095 - DNA, 419 bp, Mus musculus
cagacaacagcatagcgtgggttctggggagagaccaggcacacatggcagagtcctgctcttccttagatgctggaggactgaaagagccatagaggtcaaagacaccacaagaaaccctacagaatcaactaaccttggcacatagaggctcacagagactaaaccaccaaccagagagcatgcataggacagacctagtctccctatacgtatgtaacagatgtatagcttggtcctcatgtgggacttctaacagcaggaggagaagatgtctctgactctgttgcctaccttcggatccctttcccctaactggatggccttgcctagctcaagaggagatgcacccagtcctactacaatttgatatgccaaggcagaggttgatatccatgggaggtctctcctctgaggaa

SEQ ID NO: 4096 - DNA, 368 bp, Mus musculus
gcagatgatgcatcacggcatcctcccggtctcggccgctgcgcaccgtgtcaatcacctgcagatccagacacgctccactgccgctctccctcctgtgggaggcagggataagtgtgctgaggactgggcaggacaggtgaggggaagggcacaggcaaggtgttgacacgtccctccccagagggatctggggagaagagcttgggggaagggaagagggagcggctcgtggactcacaacaggttggtgacagaggtctctgccacagaatttctgctaggcatagagggcagagtgagtcctgtggaggacaagacatggcctccctgtaggagtcaagacagaggtcagacaagggtcagat

SEQ ID NO: 4097 - DNA, 161 bp, Mus musculus
caaaagcgtgagagtagagatgttagcgcggagtcccgcctcagcacagtcctcaggccctgctgcacacctccacacggcacgaaatgcctgtgtgagctgagctcagctcctcaaaccaagccctgtttcatgcacagactatttcatgcctggcttcc

SEQ ID NO: 4098 - DNA, 260 bp, Mus musculus
ttcttacagatttctcaacacccggtgctctgtttttccagtacagcaaatgctaacggcaagaagagctgcaggactagtgctcagtcactgatgcttgcatacgcagagccctgggttctacattctatcccaacgtcaccacaaatacacaacaaaactaactgagggactggaacccctgcagcccatacggtagctagagatccagtcccaccaacatgtcctctacacacgtgccatggaacatgtgatgcccc

SEQ ID NO: 4099 - DNA, 206 bp, Mus musculus
aaagctgcagacatgaaacatccatggccagcttctgcttagtgttttgttcctgttcatcttaagccagggtcttagctggcctggaactcaatttgtagaccagctggcccttaattcttagagatccactgctgctgccttccaagtgctggaattaagggcatgtgccgccagcaccattcatccgtctagcatgtgtgcat

SEQ ID NO: 4100 - DNA, 204 bp, Mus musculus
gttccccgctgactgtgtgcacagaccctcttagactacacttacactatagcccattgagccgccaagttattatttaacctcgggcccttttcaaagacaaatttcattaagattcatccttttcacatggctgaatggaaacacgtgttatttcaacctaaaaccaatcccagctgtgaactgcatgaggcgtttcgcgaa

SEQ ID NO: 4101 - DNA, 218 bp, Mus musculus
aacatctccgcaaaccggaaatccaaaatacaaactctcagcttgtctgataaaccactgcccatgggcagtacctctgccatgcatccttatgccacttacgtgtacttttccatctcaaggatatcattagacagatctatgggcaccccagccccttgggttaaacttagaaccttttccggcttccctttcaacttattcttcactgttaggtt

SEQ ID NO: 4102 - DNA, 192 bp, Mus musculus
gaattacatctatttcaaggatcccctaaaaattccggcgtccgaagtagttcttattgccatgccgtcacggccatcctcccccaacacgtgggagcttaggcctgttcacccttacctattccccgcctggagtgccaagcccgggtagcaggcagtatatgctggggaagaatagttgttaagctctgc

SEQ ID NO: 4103 - DNA, 133 bp, Mus musculus
gccgggctatcctgggcaaagcaactgcacacaccttcccgctggaaaagcgcgtaccctcaggggtgctccccaggctggggggaggggaaactggctatggctcctccctcactcggtggctcgggtggga

SEQ ID NO: 4104 - DNA, 157 bp, Mus musculus
agcccccaagatcagttttcttcttaactgttgagccatctctccagcccctatttcatttttaattaaacaaaaatggaggaatgttggcaattcctctagactctgctcattagttacctagcaacggcttgcctctctgactaccaggttctag

SEQ ID NO: 4105 - DNA, 117 bp, Mus musculus
ttagaagaacagtcttcttttatgcctaattttttgctagaacctggtagtcagagaggcaagccgttgctaggtaactaatgagcagagtctagaggaattgccaacattcctcca

SEQ ID NO: 4106 - DNA, 193 bp, Mus musculus
gggcattgatatgtgccaataatctatgtccctgcctcacccaaatgcttacacgggcccatacacacatgtagctggatgtcaagagtagaatgttgactaggaactgcctggaattcagaacaaagaggacagtatgaatttgaatagctcccactagataagcaatttccacgagaacctaccaaaagct

SEQ ID NO: 4107 - DNA, 474 bp, Mus musculus
  misc_feature (275)..(275): n is a, c, g, or t
  misc_feature (280)..(280): n is a, c, g, or t
  misc_feature (284)..(284): n is a, c, g, or t
  misc_feature (287)..(287): n is a, c, g, or t
  misc_feature (289)..(291): n is a, c, g, or t
  misc_feature (294)..(294): n is a, c, g, or t
  misc_feature (296)..(296): n is a, c, g, or t
  misc_feature (299)..(299): n is a, c, g, or t
  misc_feature (303)..(303): n is a, c, g, or t
  misc_feature (324)..(325): n is a, c, g, or t
gtcatgacagtgtttgcctgcctcatggggaaagggatgaagagggtgtaagtcccagaggagtaagccagaaatcgacacagacaagcctgagggggtcagcacatggttgctcccaggatgcagaggaccattcaagccattgcaaagtcctgaaccttggagacattatttgaaattcacacatttcttcagccaagtagcttctgctataattagcaatacgtgcttctcttttgttgttgttttttcagaagatgtactcgcctacaaanttttntttnttntnnnttntntgnaaangtctaccaggaaaaaaaaaanngagttaaaaagttatttccagatgctcacccctcccctccccccatgctttcactggtagtcaaggatataaactacagtatgcttaagggtcacctgatctcttgagccagcttgatctagctgctcttggccttgttcagactgaag

SEQ ID NO: 4108 - DNA, 242 bp, Mus musculus
gcagtgggaatttatgccatgtaaatgcaatactggcccccaggggctgtgaactctgtccaatgtggccttctctctgtaagggagaatcttgcctggctctcttctcttgggcctctaagaaagcttttggggtccctagcccactccctgtgtttcctttctctctggaatggagggagatacctgacacagttccctcaccaaaagcacatccagccagtggcctgaactttgaaacc

SEQ ID NO: 4109 - DNA, 423 bp, Mus musculus
  misc_feature (69)..(69): n is a, c, g, or t
  misc_feature (76)..(76): n is a, c, g, or t
  misc_feature (87)..(88): n is a, c, g, or t
  misc_feature (287)..(287): n is a, c, g, or t
  misc_feature (289)..(289): n is a, c, g, or t
  misc_feature (295)..(295): n is a, c, g, or t
  misc_feature (300)..(300): n is a, c, g, or t
  misc_feature (305)..(305): n is a, c, g, or t
  misc_feature (312)..(312): n is a, c, g, or t
  misc_feature (316)..(316): n is a, c, g, or t
  misc_feature (318)..(318): n is a, c, g, or t
  misc_feature (320)..(320): n is a, c, g, or t
  misc_feature (330)..(330): n is a, c, g, or t
  misc_feature (332)..(332): n is a, c, g, or t
  misc_feature (339)..(339): n is a, c, g, or t
  misc_feature (350)..(350): n is a, c, g, or t
  misc_feature (364)..(364): n is a, c, g, or t
  misc_feature (378)..(378): n is a, c, g, or t
  misc_feature (385)..(385): n is a, c, g, or t
  misc_feature (387)..(387): n is a, c, g, or t
  misc_feature (389)..(389): n is a, c, g, or t
  misc_feature (392)..(395): n is a, c, g, or t
gagtggcagtccatctcagagatcgcctccacttgcaacacaattctggagtcactgtcccgggagggncaacccnatctcagaganngcggagaccccaaggaagctttaaagtgtgattctgagccagaacccgggagcctgtcagaaaaggtctctcacctagagtccatgctctggaagctccaggaggacctgcagagggagaaggcggacagggcagccttggaggaggaggttcggagcctcagacacaacaaccagaggctgctggcagagtccgagantnccgccnacccncctgnctcctgncctntnangcatctgggntncacccantactgacctgncctgagttccaatntgaatctggacctngcttggnantnccnnnncccctcagagcaactgggtcatactagt

SEQ ID NO: 4110 - DNA, 419 bp, Mus musculus
  misc_feature (296)..(296): n is a, c, g, or t
  misc_feature (311)..(311): n is a, c, g, or t
  misc_feature (315)..(315): n is a, c, g, or t
  misc_feature (321)..(322): n is a, c, g, or t
  misc_feature (339)..(339): n is a, c, g, or t
  misc_feature (350)..(350): n is a, c, g, or t
  misc_feature (373)..(373): n is a, c, g, or t
  misc_feature (388)..(388): n is a, c, g, or t
agctgctgtctaaggcctgtgtgcactgttcaaagggaaggacaggagctgaagtggaatgtcctagaatcaaatgtttggaggagggagcattgctaacagaagattttgaactcagagggccctctgtccagatggtgggcatgtctcaagctgccatggaatttgctgcctttggtgtttgacatgaattagtcggaaagacagtgactgacaagaagttactcccaaaatgaaattaaagcaaggaagtgagagagattgccaagataatgcattaggcttgtgtgcacatntacttggatagaagnagcngggtgnntcagggtgggatagctnagaatgatgantgaaggaaatttggccacaatgncctttccggaagaantcttaagatgctgaagacagtccacactcca

SEQ ID NO: 4111 - DNA, 513 bp, Mus musculus
  misc_feature (360)..(360): n is a, c, g, or t
  misc_feature (383)..(383): n is a, c, g, or t
  misc_feature (459)..(459): n is a, c, g, or t
gacattgatatccagaagaccatccagatggtacgagcacagcgctccggcatggtgcagaccgaggcccagtacaagtttatttacgtggccattgcccagttcatcgaaacgaccaagaagaaactggagatcatacaatcccagaagggccaggagtcggagtatgggaatatcacgtaccctcccgctgtgaggagtgcccacgccaaagcctcgcgtacttcctccaagcacaaggaggaggtgtacgaaaacgtgcatagcaagagccaagaaggaagagaaagtaaagaagcagcggtcggcagacaaggagaagaacaaaggttctctcaagaggaagtgatctgggcattngtctgcaggtggccatgcatcanccttgatccctgcagaggcttccacccgatagactgagacctgtggccctcaccagaccctaggaccacccccatnttcttgtaatttaagtgactgtggtcatctgaatctgtatatagcccggcaagt

SEQ ID NO: 4112 - DNA, 476 bp, Mus musculus
  misc_feature (289)..(289): n is a, c, g, or t
  misc_feature (300)..(300): n is a, c, g, or t
  misc_feature (303)..(304): n is a, c, g, or t
  misc_feature (313)..(313): n is a, c, g, or t
  misc_feature (353)..(353): n is a, c, g, or t
  misc_feature (361)..(361): n is a, c, g, or t
  misc_feature (371)..(371): n is a, c, g, or t
  misc_feature (395)..(395): n is a, c, g, or t
gagtcatcatctgcttttgtctgagagaaggagagcttctccgtttgttcaactttgtaacaagctgggttacatgctccacgcagctagagaagcctaggtgctctgcattccctggggaactgcaggaaagccttacctgctgactgttgctctggggaaaagcctgagggtccagagcagctacaagctacaggccataccttacaacctgaaaagctaaggaccacggtgaccttcccggctactgtgtgaaggtgctgggtggggcctgctcaacagacagggntcgacagagtngtnntgatacatncaaacagaatccttggagtgtgtgatacatgcaaacaganatcctggncccctgcttntccccctcagtcaaagcaggagtntcccttccgaagccaggacaacctgttcacaaggccccttgtcacatgtcaccttccacctgcctcaaggagtgctagtgt

SEQ ID NO: 4113 - DNA, 441 bp, Mus musculus
  misc_feature (296)..(297): n is a, c, g, or t
  misc_feature (300)..(300): n is a, c, g, or t
  misc_feature (302)..(302): n is a, c, g, or t
  misc_feature (346)..(346): n is a, c, g, or t
  misc_feature (385)..(385): n is a, c, g, or t
  misc_feature (391)..(391): n is a, c, g, or t
aggctttccgcatgtttccggatatctgtacctcacaccagagacccttttttagagaaaatcaacagatcaccgtctaagcctcagtccgggcaccccacctcgcctgagctcaagcttcaagagtctgtgactaagagaattccgaaaggatgtggagccctctgactggggtgggcgggtgtcctccaaggggcctccggaagcccacagagggatgcgctcctgctcaggcaggtgtcagaagcttgcaggggctgtggccgcaacctgtgattaaagcattcctttccctnncgncntttcccccttcaccactaatggctggcctttctgtgtgctgagntctttcgacagttcaaatcatctggtggcagcagactcncctttncccttctgcggccgagggcggagatttatgactttctctgcttggttgga

SEQ ID NO: 4114 - DNA, 363 bp, Mus musculus
  misc_feature (171)..(171): n is a, c, g, or t
  misc_feature (192)..(193): n is a, c, g, or t
  misc_feature (277)..(277): n is a, c, g, or t
aacacccttatctgctttgtggacaacatcttccctcctgtgatcaacatcacatggctcagaaatagcaagtcagtcacagacggcgtttatgagaccagcttccttgtcaaccgtgaccattccttccacaagctgtcttatctcaccttcatcccttctgacgatganatttatgactgcaaggtgganncactggggcctggaggagccggttctgaaacactgggaacctgagattccagcccccatgtcagagctgacagagactgtggtntgtgccctggggttgtctgtgggccttgtgggcatcgtggtgggcaccatcttcatcattcaaggcctgcgatcaggtggcacctc

SEQ ID NO: 4115 - DNA, 530 bp, Mus musculus
  misc_feature (261)..(261): n is a, c, g, or t
  misc_feature (278)..(278): n is a, c, g, or t
  misc_feature (305)..(305): n is a, c, g, or t
  misc_feature (311)..(311): n is a, c, g, or t
  misc_feature (334)..(334): n is a, c, g, or t
  misc_feature (343)..(343): n is a, c, g, or t
  misc_feature (384)..(384): n is a, c, g, or t
  misc_feature (423)..(423): n is a, c, g, or t
  misc_feature (495)..(495): n is a, c, g, or t
gtctgtagaatccatgtagaaccaatagatcttctagaaatgacagtttctttgatatcccaccctctttctttctgcttccaatgaaaacttagagctacctgttttttttttcttcttcttcttctttctttctctgctttgtgtttattttgattcagacatctcattatctacctgaagtcctggtatacttagcttgaatttgttattcctctttaatatttagattaaatgctagatctgaatggtaggtttacnacttctgttggtggttnaccatgaacaagaaagggagagggaancctcancctatttaattaagaccttgttncacttaaanacactatttaagatttcccagctacttgggagtttgaggcnatcacagaggagttaacactgggaaaacaaacaaaacancaaagaaagtagtgtgagcggttgctgggattgaattggcatctttttcgcttcttatcttgagacctcacntcttggctgcaggcatccaaacagatttcctccag

SEQ ID NO: 4116 - DNA, 339 bp, Mus musculus
  misc_feature (67)..(67): n is a, c, g, or t
  misc_feature (181)..(181): n is a, c, g, or t
  misc_feature (265)..(265): n is a, c, g, or t
gattccagctattcatgtaagcagagccaacctgcctatttctgtaggtgcgactgggatgttaggnagcacagcaaggacccagctctgtagggctggtgacctgatacttctcataatggcatctagaagttaggctgagttggcctcactggcccagcaaaccagaacttgtctttgnccgggccatgttcttgggctgtcttctaattccaaagggttggttggtaaagctccacccccttctcctctgcctaaagacatnacatgtgtatacacacacgggtgtatagatgagttaaaagaatgtcctcgctggcatcctaattttgtcttaag

SEQ ID NO: 4117 - DNA, 531 bp, Mus musculus
  misc_feature (144)..(144): n is a, c, g, or t
  misc_feature (160)..(160): n is a, c, g, or t
  misc_feature (169)..(170): n is a, c, g, or t
  misc_feature (238)..(238): n is a, c, g, or t
  misc_feature (243)..(243): n is a, c, g, or t
  misc_feature (285)..(285): n is a, c, g, or t
  misc_feature (404)..(404): n is a, c, g, or t
  misc_feature (436)..(436): n is a, c, g, or t
tggtgatgctggagacggttcctcagagtggagaggtttacacctgccaggtggagcatcccagcctgaccgaccctgtcacggtcgagtggaaagcacaagtccacatctgcacagaacaagatgttgagtggagttgggggncttcgtgctgggcctnctcttcctnnggagcggggctgttcatctacttcaggaaccagaaaggacagtctggacttcagccaacaggactccntgagnctgagatgaagtaacaaggctgaaggaaggagattccccccngtgtctccatgccatgaaaacatgtcctgcttggcccacatccctccagagacactgctcttccaggacctggctcctcctgattctccaccctggagatctgtgctcctgatggctgnttatccctgacccaggccttgcagctcccagnacagaggccccacctcttcacatctcctgtccccttttgtcccttgccttttgtctggcacttctgagccagtctgctgtcatatgcttttttac

SEQ ID NO: 4118 - DNA, 410 bp, Mus musculus
  misc_feature (26)..(26): n is a, c, g, or t
  misc_feature (42)..(42): n is a, c, g, or t
  misc_feature (177)..(177): n is a, c, g, or t
  misc_feature (206)..(206): n is a, c, g, or t
  misc_feature (211)..(211): n is a, c, g, or t
  misc_feature (225)..(225): n is a, c, g, or t
  misc_feature (307)..(307): n is a, c, g, or t
ctgtcatcagccatcactaatctatnttggtaaatgagaganctgacctggcaccttacaagcagaaaagcggcccacactaagaaaggactgcaaatcagtgagtctgtatagaacattttaccttcactgacttgggccgatgtgtttgtcatctctgtgtttttctagagcaanaatagtcacaaaagttcccctttcaatantcccntgagaagaataaangaaaaaactgtttgtaaatatttttttaaaactgttctgcaagtctttttgtaacatgcagtaccaacatgggacattgccnttaacttttgatgcactttcatggagactgactgccatgcattgctgtgagcactttctttgtcgttcagtttaatcttttccttcacctttattacagtatg

SEQ ID NO: 4119 - DNA, 551 bp, Mus musculus
tgtgaatgtggagccagtgtccccaactaccaaaatacctgagaccgtctttacaacagaaatgcatatgtccaacatgtctaatgtccatgagatgagtactaaacccatccccatagtctctgtcagcctgctgtttgcaggagtcattgctgctagaatcggtctttggtcctttgatttgacggtgacacagttgctgcaagaaaatgtaattgaatctgaaagaggcattatcaatggtgtgcagaactccatgaactaccttcttgaccttctgcatttcatcatggtcatcttggccccaaatcctgaagcttttggcttgctggtattgatttcagtctcctttgtggcaatgggacatcttatgtatttccgatttgcccagaagactctgggcaaccagatttttgtttgtggtcctgatgaaaaagaagttacagatgaaaatcaaccgaatacatctgttgtataaaaatagtttagctgtggcccctgttactagattgtggagagcatgtgtgcttattttgtactgcagaatccca

SEQ ID NO: 4120 - DNA, 333 bp, Mus musculus
atgcagccctgcagaacctggagcaactgctggatggtcccgaagcccagggcagctgggcagagctggcagagcgactggggttgagaagcctggtggacacatacaggaagaccccgtctcccagcggcagtctccttcgtagttacaagctggctggtggggacttggtgggtctattggaggccttgtctgacatgggtctccatgagggagtcaggctgctgaaaggtcctgagacccgcgacaagctgcccagcacagaggtgaaagaagacagtgcctatgggagccagtcagtggagcaggaggcagagaagctgtgtccacccc

SEQ ID NO: 4121 - DNA, 427 bp, Mus musculus
agagacactgtagcactggtggcttgagatccactgccagctgctggtgtggttatttctcagagtactagcctagcaaatgtgagcccttgagtttagccccaaatactacaaaaaagaggtccaagtttaaatgttagtctcctaacaactgtcaaatcaatttctagcctctaaatcttgctacttccactctacaaagtcacataagagagaagctgatggaaatttttgagtcccattcattagataattgacatactcagtttccttttgaacacagtccttggtaataggaatcatacagaaatcttttatttctggaaaatattccaatttctttgtcttattgattttgttccatccatccatccagaaaagattattcccatcctattgttagtcagtctggtagccttgaattaca

SEQ ID NO: 4122 - DNA, 566 bp, Mus musculus
  misc_feature (192)..(192): n is a, c, g, or t
  misc_feature (252)..(252): n is a, c, g, or t
  misc_feature (406)..(406): n is a, c, g, or t
  misc_feature (430)..(430): n is a, c, g, or t
  misc_feature (509)..(509): n is a, c, g, or t
aaggtcctcaccaaccaggagagtccataccagaaccacacgggtcgcttcatctgtgcagtgcccggcttctattacttcaacttccaagtgatctccaagtgggacctttgtctgtttatcaagtcttcctccgggggccagcccagggattccctgagtttctctaacaccaacaacaaggggctcttncaggtgttagcagggggcaccgtgcttcagctgcgacgaggggacgaggtgtggatcganaaggaccccgcaaagggtcgcatttaccagggcactgaagccgacagcatcttcagcggattcctcattttcccctcggcctgagctggggatctgcccctgcatcctgccatctcctgcgctccctgttgtggaccacgccccccccctccgncctgcacccctcccctccgcactntgcaaagtgaaggggctggggctttagcaccctgggggaggggctgtctcggagggagggcactgaggactgatgtttntgcacactgcccagtggtttctttaagcactttctggaataaacgatccccgtctgt

SEQ ID NO: 4123 - DNA, 467 bp, Mus musculus
  misc_feature (119)..(119): n is a, c, g, or t
  misc_feature (251)..(251): n is a, c, g, or t
atgactttggaaacctacagcttggacccccgatgtcttgagaggcaagaagagattcaagaaggtcttttggtgacccccccacccaaccccaagtctaggagaccttttgttctccngtttgtttccccttttgttttatcttttgttgttttgctttgttttgaagacagagtctcactgggtagcttgctactctggaactcactactagactaagctggccttaaactctaaaatccacctgccantgccttctgagagccaggcttaaggtgtgcgctgcccactcccagccttaacccactgtggcttttccttcctctttcttttattatctttttatctcccctcaccctcccgccatcaataggtacttaattttgtacttgaaatttttaagttgggccaggcatggtggagcagcgtgcctctaatcgcaggcaggaggatttccacgagcttga

SEQ ID NO: 4124 - DNA, 239 bp, Mus musculus
tccctatactgcgtttgagacctgtcttcaaatggaggcagtttgcagcccctaagcaaggatgctgagagaagcagcaaggctgctgatccctgagcccagagtttctctgaagctttccaaatacagactgtgtgacggggtgaggccagccatgaactttggcatcctgccgagaaggtcatgaccctaatctggtacgagagctccttctggaactgggcaagctctttgagacc

SEQ ID NO: 4125 - DNA, 501 bp, Mus musculus
gagatcattatccacatctactgtgtacacacaacattcttcaaacaatacacctgaaacctattatcaaagtaggcacccatatacaacagattgcaaatatatatgctatgaaccttgaaaatgattactgtctctagaaataccttcattaaaaccttatttatagtcaaatatgtcaacttttcaataccatgaacaatggactgatccagcctagactagtttgagtaaatgtacatccagacaaactatttctttaaagtgaacttttatgatggatattctgtttaccacctccttcctatgtatacttgtgtgtgtataatcaaagtaaagtgctctatggaaagggacatgcaggaggaagaaatgcctacctaatctatgctgatccaccgaaataaagactcacttgtattacatcccttcagcaaaacaacaactcctcttgaactccatgaaagaaacttcaaggaaaacctggagcctgtaaataca

SEQ ID NO: 4126 - DNA, 513 bp, Mus musculus
  misc_feature (454)..(454): n is a, c, g, or t
gaagatcacacctatgagggcttgaacattgaccagacagccacctatgaagacatagtgactcttcggacaggggaggtaaagtggtcggtaggagagcatccaggccaggaatgagggtcaccttcatcctgctcaactcttgggcctcactgcttccaaaccgcctggctcacaagcccattccctgcttcctggataccccggccagcgtctgaagctggaccatcaataccacctctcattctagcccctggtccccagctcttgctgaagggcctggggtggaaggacaatagggtggtgacatggagtaaggagttctctggggatagacttgacccaaggcttctgggagtgccatgtgggatctgtccccatgtttgggacaggaaagcagagacttgttggaatctgcaaatggactcagaacacactggcttcaagaggagtntaggaggaccatggttcacactgacacctgaagaagttgccagaatgccatttctctct

SEQ ID NO: 4127 - DNA, 259 bp, Mus musculus
  misc_feature (91)..(91): n is a, c, g, or t
agaacaacaccctttaggcccacaggtttatagcaggagaactgttactccctgagaaccagatgtaggacctcagagtcagactcatatnaagagcccatttatattttatatattaattaactttaaagttggaaatatgtccttactgttttatcaaaaaagagacctttcacattcatgtgtactcctctacattccaaagacatgaaattgtattctgtattttttaaaaacagaagcctctgtttatcccaca

SEQ ID NO: 4128 - DNA, 514 bp, Mus musculus
  misc_feature (228)..(228): n is a, c, g, or t
  misc_feature (253)..(253): n is a, c, g, or t
  misc_feature (261)..(261): n is a, c, g, or t
  misc_feature (287)..(287): n is a, c, g, or t
  misc_feature (319)..(319): n is a, c, g, or t
  misc_feature (323)..(323): n is a, c, g, or t
  misc_feature (442)..(442): n is a, c, g, or t
  misc_feature (466)..(466): n is a, c, g, or t
gaacaggcatttagtgacaacccacttcagatgcatgtggtaatagatctgttgtttaatgttaaactatcctagattgtcgaggaatgaaaaacctacatgtcaaatgtgaacttgtagctcgtactaacaagaggtttgcgagatggacttcagttattttgcacccttgtaaaacgcaggcttccaaaatagtctccagaaggttcctgggaagctggtgcaatnccatcatgaggtggtgcaaagcagntctccttnagagaaaagcttcctgggggaaacantcctactttgaaaggttgcttgtataagattnattntcttgcattaaaaccagtaacaattgaaagatcctcagcttaaaggtccaggctcttcagcagtatacaaatatattcctttgcactgtgaccctgatgatctatttttattattcatntctttcacacagacaaaataccancctcttgtatcagattctttaatgtttcctattcatctggtgtcattc

SEQ ID NO: 4129 - DNA, 450 bp, Mus musculus
aatgaggctcagcacagcaacgctgcttctcctcctggccagctgcctctctccaggccacggtattctggaagcccattacacaaacttaaaatgtaggtgttctggagtgatttcaactgttgtcggtctaaacatcatagatcggattcaagttacgccccctgggaatggctgccccaaaactgaagttgtgatctggaccaagatgaagaaagttatatgtgtgaatcctcgtgccaaatggttacaaagattattaagacatgtccaaagcaaaagtctgtcttcaactccccaagctccagtgagtaagagaagagctgcctgaagccactatcatctcaaaagacacacctgcacctttttttttatccctgctctgaattttagatatgttcttagttaaagaatttccaagaaaataactcccctctacaaacaaacatg

SEQ ID NO: 4130 - DNA, 372 bp, Mus musculus
  misc_feature (84)..(84): n is a, c, g, or t
  misc_feature (325)..(325): n is a, c, g, or t
gctcttcactatgttggacctgctgcccccagcaccaccacttgccagtgctgtggtgggtagcgggggtgcaggggccaccgnttgtggagtcttctggcccagagcccctatcactggactcttttgcagcgccgggccccggggatgttggtactgctagccttgtgggcagcaacatgtttcccaaccagtaccgagaggcagctttcgggggtggcctcctatctccagggcctgaagccacgtagcctctgaggtaacagaggaggcactgggtgaggtatgtggtatagcactccattccgaagccaaccttgatcangtcttccagcttcctcatcctgaatcggacatctgcagcgctggtgg

SEQ ID NO: 4131 - DNA, 101 bp, Mus musculus
caacgatggcatcgagtactggattgtccgaaattcatggggcgaaccctggggtgagaaaggctggatgaggatcgtgaccagcacctacaagggaggca

SEQ ID NO: 4132 - DNA, 593 bp, Mus musculus
tgttcatttacttagaccctcttggctgaaggaagcagccagctctgagagatgatcgtcttacttcacaaatatgctacagaacatctaggctgaaactcatacaaatgagaggagactatgttatttttagtaagaaaagatcaataggtataatgtgtccagtgcacactctgtaagtggggattgtgctaattactgggtagatgtgctgtactgatgttctatgtggcactgaggaaactaaggtatagatcttctcatgtctggatattagatcctgggagctgccgccaagactattctaatgtgttgtggatatatatgattttttttcttttcacacttaccttttgaaaggatatttgtttagctgtattcattatcaagtaagttaaaatctatgattttccattcacaataaataataataatgacaatgatacccataactgaaccttctgttatgttgtgaaatgtaaacaatagaatgtttctaggaactcatattgcttctagcagatagaaggtatcagatactgtatctgttaagttttttctaccctttgttgtgaccacaataaagtaccatt

SEQ ID NO: 4133 - DNA, 558 bp, Mus musculus
  misc_feature (304)..(305): n is a, c, g, or t
gtaattctgaggaccacactgcgctctctagagctttgtctcagctggcagaggttgaggagaagatagaccagttacatcaagagcaagcttttgctgacttttacatgttctcagaacttcttagtgactacattcgtctcattgctgcagtgaaaggtgtgtttgaccatcggatgaagtgctggcagaaatgggaagatgctcaaattaccttgctcaaaaaacgtgaaactgaggcaaaaattgatggttgctaacaagccagataaaattcaacaagctaaaaacgagataagagagnntgggaggcgaaagtacaacaaggagagagagattttgagcagatctctaaaacaattcgaaaagaagtgggaagatttgagaaagaacgagtgaaagattttaaagctgttatcatcaagtacttggagtcattagtacaaacacagcaacagctgataaagtactgggaggcattcctacctgaagccaaagccattgcctagccttacccctgtgaaggagacattggattccccagtgagatcatctaga

SEQ ID NO: 4134 - DNA, 415 bp, Mus musculus
  misc_feature (374)..(374): n is a, c, g, or t
tgccgcgggtaccatgaagatctctgcagctgccctcaccatcatcctcactgcagccgccctctgcacccccgcacctgcctcaccatatggctcggacaccactccctgctgctttgcctacctctccctcgcgctgcctcgtgcccacgtcaaggagtatttctacaccagcagcaagtgctccaatcttgcagtcgtgtttgtcactcgaaggaaccgccaagtgtgtgccaacccagagaagaagtgggttcaagaatacatcaactatttggagatgagctaggatagagggtttcttgattctgaccctgtatacgcttccctgtcattgcttgctctagtcctagccagcttggggatgccactcnagtaatcccctactcccactccggtcctgggaaaatgggca

SEQ ID NO: 4135 - DNA, 432 bp, Mus musculus
  misc_feature (79)..(80): n is a, c, g, or t
ttgggtaatgactacctgcacctgctcacagccaatgggaaccaagagctccgagttgacttacaagatttccaagggnnaaaggctcctatgccaagtacagctcattccaggtatctgaagaacaggagaaatacaagctgaccttggggcagtttctggagggcactgcaggagactccctgacaaagcacaacaacatgtcatttacaacccatgaccaagataatgatgcaaatagcatgaactgtgcagctttgttccatggagcctggtggtaccacaactgccaccagtccaacctcaacgggcgctacttgtctggctcccatgagagttatgcggatggcatcaactggggaactggccaaggtcaccactactcctacaaggttgccgagatgaaaatccgagcatcttaaggtgccccag

SEQ ID NO: 4136 - DNA, 492 bp, Mus musculus
gatggcaagaggatcctccctagaggatttagactatgaatgcccactaaatttgcaaggtcagaaactagccaaggtccttctcaggcatctatccttaacttggtctctccacaagctgcctctgatgctccgagccccttctgcctggcagctgggctccctgtgtgcttttacctatgacccttggtcagcagagtacaaggagcacctaagctgcctcgccacctcccactgactgcaaacaccacatacctcatgcggaaccgaatgtctctccagtaaacaccccagccagccattcataaaaacctgtctctgtgtgcgctgggacatgtcctccctgtaccccgggcctgctttgtgtgccagacagtgactccacagggatgccaggtctgtgattgcattgctccttgcagagggaagccctcggttgtccttctctgggaatgctgccacccagagcagcacacagtgattgccctgtta

SEQ ID NO: 4137 - DNA, 499 bp, Mus musculus
  misc_feature (225)..(225): n is a, c, g, or t
  misc_feature (232)..(232): n is a, c, g, or t
  misc_feature (306)..(306): n is a, c, g, or t
  misc_feature (319)..(319): n is a, c, g, or t
  misc_feature (400)..(400): n is a, c, g, or t
  misc_feature (449)..(449): n is a, c, g, or t
  misc_feature (453)..(453): n is a, c, g, or t
gaacctaggtactaagtcttcaacacatgaattctgaggggacacattcatactggagccgatggcagcctggtgaccaagaccatctcaggatgagtttctgaatggaatcttcattcgccataaaaccagagatgtgaccttccccacaaggaagccttgctaagtgcgacattgagctgaggacacacaagctgagaattccccctctgtcctcctagcctnggctaantactgaccatacaccgaatgtcacccattcacggcacttttgctgaggacctaaaagctacaaaggctgcatanccttccatctagntctagggacatgtacagatgggagcatctcaccttcacctctgagacactgggacattcacagccagggatggtacaggantccctgctggtggtgggctcaatgaacagagacgatggtgaaatgggtncctntctttagaccagtggttctcaaccttcctaatgctgagatctttca

SEQ ID NO: 4138 - DNA, 300 bp, Mus musculus
  misc_feature (91)..(91): n is a, c, g, or t
  misc_feature (192)..(192): n is a, c, g, or t
cctaccaattaccacaagctcaaaactctcatgtcacgaaggacctatctggaatggcccacagagaagaacaagcatggacttttttggngcaaacctaagagcatccattaatgttaagctggttaaccaggcagaaggaacgtgttacacacagcaataagaatatccacctcaatgatgttgctgctntggggagttctaataatagtaccattcatatcagcaagaacctaaaaatggttctgactttacaatgtgggaatttgtgctttttagcccaagtttaccgctagtgtt

SEQ ID NO: 4139 - DNA, 312 bp, Mus musculus
ctgtggcaggcctcgatgcaagccaggggccctggcccatgcacccagttggcatgcaataatgaggctacagatagtggctgccttggacctcctgggacagccacgtagactgatatagcaatgtggtggccccagcaggcctggctggctacagggttctgagtctcttggaagcagagtcggggtaacaagaacatagaagagaggcctgaggtttcatttcccctaaacattttctatttgagcaccaccttctggtgatttctctaatatgcctggctgggaagaaatgaagccagcagccccagt

SEQ ID NO: 4140 - DNA, 289 bp, Mus musculus
gggagaatatcccaccaggtgtgttagttaatcttacattgttatggccagatacttaccagaaacaggaacgatttattctggctcatgatttcagagacagactctggtccatcacaacaggggaggcatggaggagtggctatgtctatggcatcaggaacataaggttgaagctagatgttgaggtcaaccaatttcctgtgggtcatcatggagaaaagcatgactttggctctgtagtcatgctactgaaatgtgcagaaccccatggtgacagccatgtttt

SEQ ID NO: 4141 - DNA, 462 bp, Mus musculus
  misc_feature (370)..(370): n is a, c, g, or t
  misc_feature (399)..(399): n is a, c, g, or t
  misc_feature (431)..(431): n is a, c, g, or t
cagagtctctgaagaccccatccaacgctccaatggccagcaacaacaccgccagcatagcacaagccaggaagctggtagaacagctgaagatggaagccaacatcgacaggataaaggtgtccaaggcagctgctgacttgatggcctactgtgaggcacatgccaaggaagaccctctgctgaccccagtcccagcctcagaaaacccctttcgggagaagaagttcttctgcgccatcctttaagtctctgagaggaggctgaagagtgttggggctcctgggacatacatgtagagttcctagcaaagtgggcgcctttctcgtccacagcatttaaagagaggaaggagaaccatcctggacantccgggctgtgcatgtttaaagaaatgtnccccttatgagaatgaaagctgattccgtgtncccaactttagagatctgaccctgcagaccg

SEQ ID NO: 4142 - DNA, 525 bp, Mus musculus
  misc_feature (81)..(81): n is a, c, g, or t
  misc_feature (94)..(94): n is a, c, g, or t
  misc_feature (97)..(99): n is a, c, g, or t
  misc_feature (192)..(192): n is a, c, g, or t
  misc_feature (278)..(278): n is a, c, g, or t
  misc_feature (393)..(393): n is a, c, g, or t
  misc_feature (414)..(414): n is a, c, g, or t
ccagggtccttcgtgaagatccttaaggactttcccgaggacgaggacaccaccaactggctacgatgctacttctatgangacacaggcaaanccnnnaaggacattgcggtggaggaggacctcagcagcacgcccctgttcaaagacctgctagcgctcatgaggcgtgagttccagagagaagacatngcccttagctaccaggatgctgagggggacttggttaggctgctgtcagatgaggatgtgggactcatggtgaagcaagcccgagncctcccttcccagaagcgcctcttcccctggaagctgcatgtcacacagaaggacaactacagtgtctacaacactgtcccctgagtcacagggaccctgtggcaaggacggggngctcagcaaagggcctttacnttccaagaacacggagaccttcagggagactgatgtaagatgcaaacctcctggcccagagtgcctactggacaggattctattaagtttttgacactctaccttttggat

SEQ ID NO: 4143 - DNA, 207 bp, Mus musculus
  misc_feature (26)..(26): n is a, c, g, or t
  misc_feature (38)..(38): n is a, c, g, or t
  misc_feature (49)..(49): n is a, c, g, or t
  misc_feature (55)..(55): n is a, c, g, or t
  misc_feature (61)..(61): n is a, c, g, or t
  misc_feature (70)..(70): n is a, c, g, or t
  misc_feature (77)..(77): n is a, c, g, or t
  misc_feature (82)..(82): n is a, c, g, or t
  misc_feature (86)..(87): n is a, c, g, or t
  misc_feature (90)..(90): n is a, c, g, or t
  misc_feature (96)..(96): n is a, c, g, or t
  misc_feature (98)..(98): n is a, c, g, or t
aaagacctcttctaccctcagtatgnccaacctgatcnagggctacctnagtttnaaaccnactggaatngcaaatncactnatgnntcnacggcnanttaccagagctgaccccagcttcttgcctcgctagtgtctgtcagaaaagccaagctctagaatgtctccaaagcacttttcaggttccacactaagaaggcaaaaaca

SEQ ID NO: 4144 - DNA, 233 bp, Mus musculus
  misc_feature (61)..(61): n is a, c, g, or t
  misc_feature (78)..(78): n is a, c, g, or t
  misc_feature (112)..(112): n is a, c, g, or t
  misc_feature (124)..(124): n is a, c, g, or t
  misc_feature (135)..(135): n is a, c, g, or t
  misc_feature (141)..(141): n is a, c, g, or t
  misc_feature (147)..(147): n is a, c, g, or t
  misc_feature (156)..(156): n is a, c, g, or t
  misc_feature (163)..(163): n is a, c, g, or t
  misc_feature (168)..(168): n is a, c, g, or t
  misc_feature (172)..(173): n is a, c, g, or t
  misc_feature (176)..(176): n is a, c, g, or t
  misc_feature (182)..(182): n is a, c, g, or t
  misc_feature (184)..(184): n is a, c, g, or t
gggagatcataaaaatccggagaaagctgacctaccagttcagcgaggctgttctccaaanacttgctccagctaacnacctgggaaaagacctcttctaccctcagtatgnccaacctgatcnagggctacctnagtttnaaaccnactggaatngcaaatncactnatgnntcnacggcnanttaccagagctgaccccagcttcttgcctcgctagtgtctgtcagaaaa

SEQ ID NO: 4145 - DNA, 133 bp, Mus musculus
  misc_feature (34)..(35): n is a, c, g, or t
  misc_feature (65)..(65): n is a, c, g, or t
  misc_feature (78)..(78): n is a, c, g, or t
gggtgctgtctagattggctgaaataatttcaannatcctcaacgaacaggagagccttattcancgcttgcaaaacnggcttcaggactgtgccacccacacccaacctttctgggatgtgctgacccacag

SEQ ID NO: 4146 - DNA, 326 bp, Mus musculus
  misc_feature (97)..(97): n is a, c, g, or t
gggcttctatccagcggatgtgaccatcacatggatgaagaatgggcagcttgtcccttcccacagcaacaaggagaagacggctcagcccaatggngactggacataccagacagtctcctacctagccctaaccccttcctacggggacgtctacacctgcgtggttcagcacagcgggacctctgagcccatccgcggggactggacacctgggctgtcccccatccagacagtgaaggtctctgtgtctgcagccaccctgggcctgggcttcatcatcttctgtgttggcttcttcagatggcgcaagtctcattcctcca

SEQ ID NO: 4147 - DNA, 412 bp, Mus musculus
  misc_feature (62)..(64): n is a, c, g, or t
  misc_feature (70)..(70): n is a, c, g, or t
  misc_feature (74)..(74): n is a, c, g, or t
  misc_feature (80)..(80): n is a, c, g, or t
  misc_feature (119)..(119): n is a, c, g, or t
  misc_feature (130)..(130): n is a, c, g, or t
  misc_feature (134)..(134): n is a, c, g, or t
  misc_feature (144)..(144): n is a, c, g, or t
  misc_feature (148)..(155): n is a, c, g, or t
tgaggttcaggccaacatgggatacctgagactctgtagtaacaaacaaacaaacaaacaannnaacaancaancaaacntacatcatagatggatggatgcatgaacaggtatagatngatagataganaganagacagacanacannnnnnnntacagacagaaagaaatgaagaatgttgaaccttttgaattagttgatggcaaattaagaggaagtggttggagaccacgtttagtaatttacctgtaaacacagatctgagtcaggaatagttcactgtgtttaagaaggatacactgcagtttgctctcagggaaatcttgttttgttttcaccagtaaaaaatgccctaggaaggtatctttcacagactgaccatttgtataatagtgtctgatggtatcgta

SEQ ID NO: 4148 - DNA, 521 bp, Mus musculus
  misc_feature (326)..(326): n is a, c, g, or t
aagtgtggtatgtcctggtgttttcaattgttaattaagccagcaacaggctagcaggatatgtaaaggtttgtcatttcctgcccccaaaaagaaaggcaagctgccttggggaaggtgatcttcctccatgtagcccccaaagctgttggagaccataccgtgagaaagggagcttttcacagtctcccaccctgacaggccaaatggccttgtgctaaggagccggttgtcactcccttctccctgtttccttcctggcaccagagtctgtaaaagctgaattatagtcccctcttcctgactcccatgacatccaaggacangttatgcgctgagcccggcctgacacccaaggctgttaaggaggatctatgttccggagataagactcagagtgcccgccacctggcgcctgacttcagccctcatgtcccctgatgcccacttctttgttctttgttaattccccctcaacccctccctatacccctcaatgcgtgctttaaaactcggcgttt

SEQ ID NO: 4149 - DNA, 253 bp, Mus musculus
  misc_feature (220)..(220): n is a, c, g, or t
  misc_feature (228)..(228): n is a, c, g, or t
acaagtcacactggtacacaaagcacactgaagggcaggtctcatgcccagcggtacgtggccaacactaaatgaactcactggtattttcgaagtctgtgcttataatgcttgtctgttacttatatattatgatgacctgtcatgtgcttttagacgacttcagggaattcataatgtatatgtataaaaaaaaatcacagtactagacacctcacanatatacanttctatttaccaaggattcctgtat

SEQ ID NO: 4150 - DNA, 564 bp, Mus musculus
gggaaggtaccaagaaccgcatcatcacagcagaagggatcatcttgctgttctgtgcagtggtgccagggacgctgctgctattcaggaaacggtggcaaaatgagaagtttggggtggacatgccagatgactatgaagatgaaaatctctatgagggcctgaaccttgatgactgttctatgtatgaggacatctccaggggactccagggcacctaccaggatgtgggcaacctccacattggagatgcccagctggaaaagccatgactgacatgtcccacccttccctgcctgccatatgtctgactccagcatccctgcctccccactcttcccctggagtccccccttcccagtgcttgctccagccactcgagtggcctacccttgcctccaggctgccccaccctattctcccacctaatcttgtccttccccaagtccagctccctctctagtgggtaatgagcccttaatcgctgcctctaggggagctgattacagcagcctcgttagtgtcaccccccctcctcccagatctgtcatggccacttaagtg

SEQ ID NO: 4151 - DNA, 513 bp, Mus musculus
  misc_feature (58)..(59): n is a, c, g, or t
  misc_feature (67)..(67): n is a, c, g, or t
  misc_feature (263)..(263): n is a, c, g, or t
  misc_feature (386)..(386): n is a, c, g, or t
  misc_feature (388)..(388): n is a, c, g, or t
  misc_feature (465)..(465): n is a, c, g, or t
agattcttgcgcacacagtctctcaggctcactcactctctgtggcctgcctcagatnntctgccanggccccccgtgtgaccccactcctggccttcagcctgctggttctctggaccttcccagccccaactctggggggtgctaatgatgcggaagactgctgcctgtctgtgacccagcgccccatccctgggaacatcgtgaaagccttccgctaccttcttaatgaagatggctgcagggtgcctgctgttgtgttnaccacactaaggggctatcagctctgtgcacctccagaccagccctgggtggatcgcatcatccgaagactgaagaagtcttctgccaagaacaaaggcaacagcaccagaaggagccctgtntnttgagtaaagagatgtgaatcactctggcccaggaaaccaaggaccagaagagaggaccaggcctcctgatgctctntcccagacctaacccagccaagtctgtgcctagagagtcgatgtgagt

SEQ ID NO: 4152 - DNA, 316 bp, Mus musculus
  misc_feature (244)..(244): n is a, c, g, or t
acttggatgactttcacgtggaatccatagataccgccagaataatattcaaccaagtgatggaaaaagagtttgaagatggcatcattaactggggaaggattgtgactatatttgcctttgggggtgttctcctcaaaaaacttccacaagagcagattgccctggatgtaggtgcttacaaacaagtttccagttttgtggcagaattcataatgaataacacaggagaatggatacggcngaatggaggttgggaagatggcttcataaagaagtttgaacccaaatctggctggctgacttttctgcagat

SEQ ID NO: 4153 - DNA, 465 bp, Mus musculus
  misc_feature (339)..(339): n is a, c, g, or t
  misc_feature (414)..(414): n is a, c, g, or t
gaggcgagccaagaagaagcgtttctgaggagcggcgcgcagttctcccccacccacgggctggcgctgccacaggacggcgtctattacctctactgccacgtcgggtacaggggcaggacgccccctgccggccgaagccgtgctcgctcgctcacgctgcgcagcgccctgtaccgcgcggggggcgcctacgggcgaggttcccccgagttgctgctggagggcgcggagacagtcacacctgttgtggaccccatcgggtacgggtcgttatggtacacgagcgtggggttcggcggcctggcgcagctccggagcggcgagagggtctacgtnaacatcagtcaccccgacatggtggactacaggagagggaagaccttcttcggggcggtgatggtggggtgacanccatctgtattcattcctggaggatcgactgacggtgcgaatgtgtgaatc

SEQ ID NO: 4154 - DNA, 524 bp, Mus musculus
  misc_feature (292)..(292): n is a, c, g, or t
  misc_feature (295)..(295): n is a, c, g, or t
  misc_feature (303)..(303): n is a, c, g, or t
  misc_feature (305)..(305): n is a, c, g, or t
  misc_feature (310)..(310): n is a, c, g, or t
  misc_feature (314)..(314): n is a, c, g, or t
  misc_feature (316)..(317): n is a, c, g, or t
  misc_feature (319)..(319): n is a, c, g, or t
  misc_feature (322)..(322): n is a, c, g, or t
  misc_feature (327)..(327): n is a, c, g, or t
  misc_feature (331)..(331): n is a, c, g, or t
aaatacgacaggagtgtcccctgcccctttctctgcccgaactacagtcacgaacctggtgctgcttctgaccccatggttccatggagaacggagaatggactccagagagttttggacccagagggacttcatggctttctgcgaggtggaggggtcggggtggggagtccaggagagctgctctcttcccctgtccagtcagtaactttcaactgttggtctgacacctgtgttaatctctgacctgaaagtgaagatacacgcatttttacaacagccagccaaacanagnagactcangngactncggncnnantgngccancctncgaggagacaagagagggtgggtgcagaggaagggtttgaagggtgcacatttcaccaggcgaggtcactttgaaccggtgtgtacacacacgggtgtctcttttttatttcttcgggaggggggaggctatttattgtagagagtggtgtctggatgtatttcttctgttttgcatcactttctggaaataa

SEQ ID NO: 4155 - DNA, 372 bp, Mus musculus
  misc_feature (108)..(108): n is a, c, g, or t
  misc_feature (282)..(282): n is a, c, g, or t
aatgactccaccgtctttgataagctctttttctcccagctaagccggttggggccgcgggcgaagctgaggcagactgctgacatatgtgcactccctgcaaaagcncacatctaccgtgagggctgcgcgcagagcctccagaagtggctgcacaacaatatcatctccatagtgggaatctgtctgggagtcggtcttcttgagctcggcttcatgacgctctcaatattcctgtgtagaaatctggatcacgtctatgaccggctggcccggtaccgntaggccccagcccacccatcggcacccacgcacctccatgcagtcaggaaatgtttccttcctggttggtcacaggcttggagcccatgc

SEQ ID NO: 4156 - DNA, 237 bp, Mus musculus
tgccattcctcaccatgtgcattaaggagagcctacggctgcatcctcccgtcactgcaatctcccgatgctgcactcaggacattgtgctcccagatggtcgggtcatccctaaaggtgtcataagccgaataagtattttcgggacacatcacaatccagctgtgtggccagacccggaggtctatgaccccttccgctttgatgccgacaacgtcaagggcaggtcacccctgg

SEQ ID NO: 4157 - DNA, 509 bp, Mus musculus
  misc_feature (57)..(57): n is a, c, g, or t
  misc_feature (134)..(134): n is a, c, g, or t
  misc_feature (210)..(210): n is a, c, g, or t
  misc_feature (235)..(235): n is a, c, g, or t
  misc_feature (266)..(266): n is a, c, g, or t
  misc_feature (355)..(355): n is a, c, g, or t
  misc_feature (410)..(410): n is a, c, g, or t
  misc_feature (446)..(446): n is a, c, g, or t
tcaggttcaactctgtggtcaccaaccctcaggggcattacaacccaagcacagggnaagttcacctgtgaagtgccgggcctctactacttcgtctactacacatcgcatacggccaacctgtgcgtgcaccntgaacctcaaccttgccagggtggccagcttctgcgaccacatgttcaacagcaagcaggtcagctccggaggagncctcctgcggctccagaggggcgangaggtgtggctatcagtcaatgactacaatnggcatggtgggcatagagggctccaacagcgtcttctctggtttcctactgtttcccgactagaacggcaggctgcttccagcccccanccacccacctcgctccctctgctttccccatcctcactcagacctcttcctccangaagtccaccctggttcctgatccatcggccctgtntctcctcagagtttctctgggaaccacctaatggtattattcctgtggccatttatcaatacc

SEQ ID NO: 4158 - DNA, 416 bp, Mus musculus
aaaaatactgcacatctctgtcctccaaactggcagcattcaatgactctcctaagtattcctatcaagtttctctgcccagcggcttagaggagttgctagatcgttcgaagtcatattggatacaggagatgagcaagaagtggagctcatattgtgacatgatacaaatatataacaagaagtgggaaagaacaatttccaagtgtgcagagcttcacccctgcatttgtgagttggaggctttcaggtttcctgatgggatccatctgaactgaaacggacacttgaacaagaccttttgacctacatccttaacctacggcctgccaatttttaagactgctattcctccagcactccctcactctcgggcatgcccagctaagggatgacctgctgcttgcttgaaagct

SEQ ID NO: 4159 - DNA, 574 bp, Mus musculus
  misc_feature (399)..(399): n is a, c, g, or t
  misc_feature (416)..(416): n is a, c, g, or t
  misc_feature (420)..(420): n is a, c, g, or t
  misc_feature (425)..(427): n is a, c, g, or t
  misc_feature (430)..(430): n is a, c, g, or t
  misc_feature (504)..(504): n is a, c, g, or t
atatcttcccgcctgtgatcaatgtcacctggctgcgcaacagccagcccatcactaagggagtggcccagaccagcttctactctcagcctaaccacaggttccggaagttccactacctgaccttcgtgccctctgcggaggatgtgtacgactgcaaggtggaacactggggcctggatacaccgctcctccagcactgggagccccaagtgcttaccccaccaccggacaccatagagaccctgatctgtggcctgggcctggttctcggccttatgggctgcctcctgggcaccgtgctcatgatcacaggcacacgcaggcccagtatccgcaggtaacttctcttctgagaaacccttgagagatgattcctggcggacttctggaagcttntgcgtgctcagcggcancctngtgannncangtgttgacctcgagtggcatcaacctctgttcaccaaatcccaggagaacattgtgggcgcagtctcctgcccntggtaccccatttcactcacagctccagtgccatccacagctctggcagccgcactaaattctcttaaga

SEQ ID NO: 4160 - DNA, 511 bp, Mus musculus
agctcctgaagccatcaactttggttccttcaccatcaagtcagatgtctggtcctttggtatcctgctgatggaaattgtcacctatggccggatcccttacccaggtatgtcaaacccagaggtgattcgggcactagagcatgggtaccgtatgcctcgaccagataactgtccagaagagctctacaatatcatgatccgctgctggaagaaccgccccgaggaacggcccacctttgaatacatccagagtgtgctggatgacttctacacggccactgagagccagtatcagcagcagccttgacagcagtaaggacatgagcagagccagaagccccatcagtgccttgacacgcccaacttgctgggcccactctcagacaccacaccacacacactgcagctgttgagtgggtgggaggacttcacaatctctttctgactctagtcatctgcaatccgccactctcagggcctccaagttggtatgtctcatttgcctgga

SEQ ID NO: 4161 - DNA, 490 bp, Mus musculus
  misc_feature (110)..(114): n is a, c, g, or t
  misc_feature (116)..(121): n is a, c, g, or t
  misc_feature (124)..(126): n is a, c, g, or t
  misc_feature (129)..(130): n is a, c, g, or t
  misc_feature (132)..(132): n is a, c, g, or t
  misc_feature (282)..(282): n is a, c, g, or t
  misc_feature (366)..(366): n is a, c, g, or t
  misc_feature (451)..(451): n is a, c, g, or t
  misc_feature (463)..(463): n is a, c, g, or t
gcaaggattgcgaggcatgtgctcagcacacgccctgtatccctggctttggagttatggagatggccactgagaccactgataccgtctgtcatccctgcccagtcggnnnnntnnnnnntcnnncannanttttcgaaaagtgttatccctggacaaggtttaaagtcccggatgcgagccctgctggtcattcctgtcgtgatgggcatcctcatcaccattttcggggtgtttctctatatcaaaaaggtggtcaagaaaccaaaggataatgagatnttaccccctgcggctcgacggcaagatccccaggagatggaagattatcccggtcataacaccgctgctccagtgcaggagacnctgcacgggtgtcagcctgtcacacaggaggatggtaaagagagtcgcatctcagtgcaggagcggcaggtgacagacagcatanccttgaggcccntggtctgaaccctggaactgctttgga

SEQ ID NO: 4162 - DNA, 398 bp, Mus musculus
  misc_feature (97)..(98): n is a, c, g, or t
  misc_feature (118)..(118): n is a, c, g, or t
  misc_feature (165)..(165): n is a, c, g, or t
  misc_feature (207)..(207): n is a, c, g, or t
  misc_feature (226)..(226): n is a, c, g, or t
  misc_feature (238)..(238): n is a, c, g, or t
taccaagtgcagcagtgcaggacccagagttgtcttgctgcggcgttcactgtaaggagtcgtggctacaggagtccgtggcccgcagcttgtgctnntagagggcacctggttgccnatcagcagggtactggctaaataaatctgtaattatttatacaatgncatctcagaaactctagcaggtggggcagaaaacaggtagtngaatgatgggtagagaaanagcttttaaaancacattccaaggcaggtaagatggcttttgtgagtaaaggagcttgctgcccaaacccggttacctgattttgatccctgggacttcatggtaaaagggagagaaccaaatccagagggttgtcatttgacctccatgtgtgctctgtggtaatgtaccc

SEQ ID NO: 4163 - DNA, 465 bp, Mus musculus
ttgggaaagtcctacttcctctgtagacccactatctgtgagtgacagccactgtagctgttcacattaaccttccccatctccttttcctaggagaataattccacacactgcaccccatgatggccaccaaacatcaaagaagggaaaatctcctgcattgagttttagttttgagttttcccttctctttattagatctctctaggttccttgaagtcagtgttctgatgattattaatagttaatgataacacaacccactctcttggagctgatgttatgaagacaacaggtagaaaaattcctgggctcaggctggagtgacacccttttctttccctaacatcttctactcagatacctaaatttaagattcaggacagctgtccccaactcttaccatgtcttttataacttgctccttaacttgcccaacctgtaggctatctcattttctcgctt

SEQ ID NO: 4164 - DNA, 482 bp, Mus musculus
  misc_feature (365)..(365): n is a, c, g, or t
aggagtcccaggtcttgtaggcagaaagggagacactggaagccctgggctggcaggtcccaaaggagaacctggacgagtcggtcagaagggagacccggggatgaaagggtcttctggccagcaaggacaaaagggagaaaagggtcaaaaaggcgaatctttccaacgcgtccggatcatgggtggcaccaacagaggccgagctgaagtttactataacaatgagtgggggacaatttgtgatgatgattgggataataatgatgcgactgtcttctgtcgcatgctcggttactccagagggagagcacttagcagctatggaggtggctctgggaacatctggctggacaatgtgaatngtcggggcacagagaacagtttgtgggactgcagtaagaactcctggggcaatcacaattgcgtacataatgaagatgcgggtgtggaatgctcctgacttgggagcccgagaggtc

SEQ ID NO: 4165 - DNA, 96 bp, Mus musculus
tcctttcagtcaaaatgtcaggttctggcacccccatgaacccaatcttccagaagagcggtgtgtttcaatagtttactggaatccttcgaaatg

SEQ ID NO: 4166 - DNA, 410 bp, Mus musculus
  misc_feature (281)..(281): n is a, c, g, or t
gaagatttacctatgagtgcctgttattcattaatatctttaaagttcagacctaccaagaagccataacttcttggcctgtacatctgacagaggccgttcttttcctagccactattctttactcaaacagaatgagccctttctccttctgatggttagagttttgtcaacttgacacaaactagagtcacctggggagtaggatcttcagctaaggaattgcctctgtcagcttgaccagtcagcatgtctgggggcattttcttgattaatgattnttgtaagagggtccaggtggtaagcaaaggtgttaaacccatgaagagcaagccagggagcatcatccatccatctctgccctcaggtttctgccccagggtcttgccctggtttctttctatgaactg

SEQ ID NO: 4167 - DNA, 347 bp, Mus musculus
  misc_feature (128)..(128): n is a, c, g, or t
aaaaacaacctgtgtctggccagacctgaccggccttctctggctggtgatcctccctcacgcattgtgccacgtctgcttctccaaccccaggcacccaccaccatctgctccatcctgtgcctcantcactgcagctggatgtgttcctgttgtaatcgtcactaacacttcttcttctctgaccccttgatactctaccccgttcactaatcttactacccactttctggccctggggagaaatccccaggaaggacagaagtaaggaagcaagaggcactgtccccagttggcttttcttctacaaagatgttggaccttctgtggagatggtgccttccctc

SEQ ID NO: 4168 - DNA, 581 bp, Mus musculus
  misc_feature (103)..(103): n is a, c, g, or t
  misc_feature (284)..(284): n is a, c, g, or t
  misc_feature (322)..(322): n is a, c, g, or t
  misc_feature (329)..(329): n is a, c, g, or t
  misc_feature (384)..(384): n is a, c, g, or t
  misc_feature (503)..(503): n is a, c, g, or t
taggcacaggagagtcaccacccagcaccctcactgtctactacagtccagagaccatcggcaagcgggtcgccttgggactaggcttctgcctgactatctncatcctggccatctgggggatgaaaatccagaaaaaatggaagcaaaaccgcagccagcaggggcttcaggaaaattccagtggccagagcttttttgtgaggaacaaaaaggctaggaggacccctctctcagaaggcccccaatcccagggatgctacaatccggcaatggatgacacngttagttatgccatcttgcgctttccagagagtgacangcacaangctggagatgcagggaccccagcaacacaggctcctcctccaaacaacagcgacncggtcacttactcggtgatacagaagcggcctatgggggattatgagaatgtgaatccgagctgcccggaggatgagagcatccattactcagagctggttcagtttggggctggtaancggccccaggcaaaggaagacgtagactatgtgaccctcaagcactgaggtgggtagcagctgctgtttcaggttctt

SEQ ID NO: 4169 - DNA, 582 bp, Mus musculus
  misc_feature (371)..(371): n is a, c, g, or t
  misc_feature (382)..(382): n is a, c, g, or t
  misc_feature (385)..(385): n is a, c, g, or t
  misc_feature (401)..(401): n is a, c, g, or t
  misc_feature (488)..(488): n is a, c, g, or t
  misc_feature (514)..(514): n is a, c, g, or t
  misc_feature (518)..(518): n is a, c, g, or t
ggagcctttgcactgtagattctaaagaaacccaagaattggattccaggcctccatcctgaccgttgtttcaagggtcacatccccacagtctccagccttccccactaaaataacctggagctctcacgggagtctgagacacttcaggggactacatcttccccagggccactccagatgctcaggggacgactcaagcctacctagaagttcctgcacagagcagggtttttgtgggtctaggtcggacagagacctggacatgaaggagggacagacatgggagaggtggctgggaacaggggaaggttgactatttatggagagaaaagttaagttatttatttatagagaatagaaagaggggnaaaatagaaanccntcagatgacaactagntcccagacacaaaggtgtctcacctcagacaggacccatctaagagagagatggcgagagaattagatgtgggtgaccaaggggttntagaagaaagcacgaagctctaaaanccanccactgcttggctagacatccacagggaccccctgcaccatctgtgaaacccaataaacctctt

SEQ ID NO: 4170 - DNA, 523 bp, Mus musculus
agaactgtcagtgatcgccaacttcagtgaacctgaaataaaactggctcagaatgtaacaggaaattctggcataaatttgacctgcacgtctaagcaaggtcacccgaaacctaagaagatgtattttctgataactaattcaactaatgagtatggtgataacatgcagatatcacaagataatgtcacagaactgttcagtatctccaacagcctctctctttcattcccggatggtgtgtggcatatgaccgttgtgtgtgttctggaaacggagtcaatgaagatttcctccaaacctctcaatttcactcaagagtttccatctcctcaaacgtattggaaggagattacagcttcagttactgtggccctcctccttgtgatgctgctcatcattgtatgtcacaagaagccgaatcagcctagcaggcccagcaacacagcctctaagttagagcgggatagtaacgctgacagagagactatcaacctgaaggaacttgaaccccaaattgct

SEQ ID NO: 4171 - DNA, 525 bp, Mus musculus
  misc_feature (309)..(309): n is a, c, g, or t
tgatctgcccagtccattgaaaagtcaagaggtcagagatagaccagtgtgtgtctcaatggatgtagatatcagccacctcggtgctcaacaggtattttatgatctccttgtttcaaattcatctagatgtagaactagggagagagcagtcacattgatgaaaggctaggactctttcagctcatggcttgtgtggaaggagggaaagcagaaatcacaacactctgagactactgtagtctgcagatacctgagtgggtgtggcttggcctttcaaaggacaaagagcaactaatgctgaaagcncatagtgtatctatacggcatggaatagtcatcacccagacttaaagagaactttggcaggtctgagcagcaaaatattgttgtttccattttacataaagggccctggagggctatagactattccgctggcagggctcatgcttgtaatgtgtccatcttgattcaccctgtgcagactcttaagatctggccagttaccaacatgttctgtac

SEQ ID NO: 4172 - DNA, 59 bp, Mus musculus
agcctgctgtgttggtcaatggactctgtggatactttcattctgtccaaggagggatc

SEQ ID NO: 4173 - DNA, 320 bp, Mus musculus
gacatgccataactttgtaaatctaacatctactagtacaacaacactttaacatcctccattaattgtatgtacaaggggcaatgaattagcaaagatgttttgaaagcaaaatgaaacaaacaaacaagccagcacacaaaaaaagacctgttttgtcttttgcaaagattaaagaaaggcgttcacatttctttggggcttttgctaaataagtggatttagctgcttttgatcatgtacaaacacatgaattatgtatattatattactaatgataggaaccaatttttatctctgtgcatattcatcatataata

SEQ ID NO: 4174 - DNA, 535 bp, Mus musculus
  misc_feature (194)..(194): n is a, c, g, or t
tgtccatctctgcttttggatgtaaagcttcctgttgtaactccagcgaggttcttgtagtgctaccatcaaatcctgctgtgactgtgatggcaccccctgtgacgcttcaaccattgccaccatcagaacaccaagggaaaaatgttccagaaaatgtatataagaaccactcagaagaaatagtctaattntcttgtgtgtatgtgaatgtgtgtgtgtgtgtgtgtgtgtgtgtgtatgcatttccctgggaaattaacacttcattgccctggcttttggggggaatatcagacatgccataactttgtaaatctaacatctactagtacaacaacactttaacatcctccattaattgtatgtacaaggggcaatgaattagcaaagatgttttgaaagcaaaatgaaacaaacaaacaagccagcacacaaaaaaagacctgttttgtcttttgcaaagattaaagaaaggcgttcacatttctttggggcttttgctaaataagtggatttagctgcttttgatcat

SEQ ID NO: 4175 - DNA, 518 bp, Mus musculus
  misc_feature (393)..(393): n is a, c, g, or t
  misc_feature (399)..(399): n is a, c, g, or t
  misc_feature (403)..(403): n is a, c, g, or t
  misc_feature (441)..(441): n is a, c, g, or t
  misc_feature (453)..(453): n is a, c, g, or t
gccagagttgctcaataacaccaaaagctgcctcttgataattgaggggaacacttctaccaggattttgtttgtgaaagatcaaaaataaagaatgttttgcagcgaagctaagtgtcagggacgtgcaagtagaggagaatagtttgatagtctgcatctgtgaagagtattttgatggtttcaattacaaatggaacaaaggaagaattatatacacactgtgttgtgaaatatcatactgcttggcagtttacacctcatggttgttgctacacttctataagagcttacattaatcccttggctttcaatcaaaacaaggtgaccagaagtggtattcatgctttcaagagggacatgcttagaaatatgatcataaagtcacatctntcatantctncccaagtgcatgacctggtttcatctgtaataatatgnccacaagtttgncaagaagttgagtatctggctctaaagagattttcttgactctgagctctgtgacaatatttgca

SEQ ID NO: 4176 - DNA, 171 bp, Mus musculus
gaggctgacacatttctactcttccaacagccaagttacctttcccctccaagcaacagaaatcttagcttgagtttaaaagtaattggctgccattcatgcattgtttcttttcaactgaagcactgtgcctggagtattttaagttattgttcaggtcctaagagtgta

SEQ ID NO: 4177 - DNA, 447 bp, Mus musculus
  misc_feature (403)..(403): n is a, c, g, or t
agttaattctcaccaattggccctttgctagctgctggctttaggtacacataggataatatgtgtccacgtttctacttggaactggtaaaagttgtcactggctggaaaatggtatctctctcttgtatacaagatggtccattgacactggtactttatgaagcagttctttgtttgtttgattgagctctcttgaaccttgttcatcttttagtttttgcttagaatagaatggaactggtttgaagttaaaggaaatattcattttgaaacttgttcattttgaaaggaaatgcaagtttcaaaatgaaaaataaaatgaaaaaggaaataaattattgtcccagatggtcacttgagttttaaaaaatggctgcacacagtaaaactgctaaaaacnaaaacttacctcattattggtttgcatcttttttcagctactaa

SEQ ID NO: 4178 - DNA, 531 bp, Mus musculus
  misc_feature (87)..(90): n is a, c, g, or t
  misc_feature (164)..(164): n is a, c, g, or t
  misc_feature (389)..(389): n is a, c, g, or t
gtgcttaagccatcagcatgtcctgagctcagtcttcggatatatgaaggttttcattatctgacagccagcctcactttggatgcnnnntccaacagtgtcttccctccctttctcccttcctcttcctcctgtgcccctccctgaaagggctcaaccttgcntgcctgtcctgttctaactgtccccagtcacatatcccatgtgcaacactgaccacacagtgtctgtcaccacggccagcactgcagctcgccccagcacaagcccccctggctggcttggacctgagtgtttgctcccttcctgccactcctggaatctgcaatgtggcgccatcttgcttgtatgcagggcacccgtttttgtgcatttcgctttgttttccnggatattctttactcttgcacatgagcacctgtacttaggaacagtggagaacagtgacccgtctggcccgactcccagtctcagaagcaacccctccacacagctgtgggctccccaaaggcgtctgcacacaagcaagca

SEQ ID NO: 4179 - DNA, 269 bp, Mus musculus
tcccactggtgaattgttgttgttcttgttgttgttttttgttattggtgaaaattgtgaaattgttaaggtctctgtttttgttatttatctccctaaatcacatggctgctgcatacattgcaatgttgccctaccacatgtatgtttttgcaagttgcttcttcactcattgaagaagcctgcaccgtaagtgaaactcacttagtccttgctaattgctgctcactgtcacgtgaacgcagagaaggctgattttcctggaccca

SEQ ID NO: 4180 - DNA, 392 bp, Mus musculus
  misc_feature (176)..(176): n is a, c, g, or t
  misc_feature (183)..(183): n is a, c, g, or t
  misc_feature (191)..(193): n is a, c, g, or t
  misc_feature (198)..(199): n is a, c, g, or t
  misc_feature (202)..(202): n is a, c, g, or t
  misc_feature (204)..(205): n is a, c, g, or t
  misc_feature (207)..(207): n is a, c, g, or t
  misc_feature (209)..(209): n is a, c, g, or t
  misc_feature (211)..(211): n is a, c, g, or t
  misc_feature (216)..(216): n is a, c, g, or t
  misc_feature (220)..(221): n is a, c, g, or t
  misc_feature (227)..(227): n is a, c, g, or t
  misc_feature (230)..(230): n is a, c, g, or t
  misc_feature (233)..(234): n is a, c, g, or t
  misc_feature (239)..(240): n is a, c, g, or t
  misc_feature (242)..(242): n is a, c, g, or t
  misc_feature (246)..(246): n is a, c, g, or t
  misc_feature (251)..(251): n is a, c, g, or t
  misc_feature (253)..(253): n is a, c, g, or t
  misc_feature (255)..(255): n is a, c, g, or t
  misc_feature (269)..(270): n is a, c, g, or t
  misc_feature (276)..(276): n is a, c, g, or t
  misc_feature (278)..(278): n is a, c, g, or t
  misc_feature (284)..(284): n is a, c, g, or t
  misc_feature (286)..(286): n is a, c, g, or t
  misc_feature (291)..(292): n is a, c, g, or t
  misc_feature (304)..(304): n is a, c, g, or t
  misc_feature (306)..(306): n is a, c, g, or t
  misc_feature (310)..(310): n is a, c, g, or t
  misc_feature (316)..(316): n is a, c, g, or t
aagcaatgggaaggctgtgtgtctagaactcatggtctcaactgcagacaagcttagttgtggatcctggacagcacacccagatactaagtctagacagctgagctgttcgttagttctccctccagagcaaagcctggatacctgtgctcccaccggcctcagatgagggtctnctgtganactgtggnnnttggnnatnannancntnttganaatnnatgcanaantgnnattanntnattntgttntnantggagttgtttgtnnatggtnangtttgnanatggnntttgtgtgtgtntngagnattggntttttgggtggtagcgaggaagtagacttggaggttgagctcatgaacagttttgtgcttcagactgtcttttttg

SEQ ID NO: 4181 - DNA, 378 bp, Mus musculus
  misc_feature (45)..(45): n is a, c, g, or t
  misc_feature (81)..(81): n is a, c, g, or t
aagatcgtctcaatcatctgtcgtcatcatggtcatcgttgctantctggttctcctgggaggtgtgatcactattgttgntggtgtgcaagaggaggggtgcaggggaaagatgaatcagttatactcagactgccagcaggaacagtgattaagttctgatgcttctttcaccatttagaaagttggcatctcatggtgtgtctcctgtcagcacagtgtgacaaagtgagcagcccagggcatccctgaggactgagtctcctctccatacctgtgtctcctccttttctcacctgtaccacagggggatccaggacttcttcatcccttgtggaactttaggtttctatgggcagcttcttccctattgaaaaa

SEQ ID NO: 4182 - DNA, 389 bp, Mus musculus
aggcagatgacagctctgagcccctgccttccatacttgaggcggccccctcctccacagaggaagagatacattatgcgaccctcagctttcacgagatgaagcccatgaacctgtgggggcaacaggacactaccacggagtactcagagataaagtttccacaaaggaccgcatggccatgaccgtggctggagaaagcatggtggccccaggaggctggctctggagaaggaaagagtcacctaggttgacatgtgatacacagggcttcagagccattccttctgtgacacaggcgttctgtgctgcccatgcccctgtgctgccctgtccacacaactgctattgtgccctgggaatcataagcttgacctttttactcctct

SEQ ID NO: 4183 - DNA, 490 bp, Mus musculus
  misc_feature (79)..(79): n is a, c, g, or t
  misc_feature (189)..(189): n is a, c, g, or t
ctcgtggattctacgcaccaatggggaaggaagccaacttgcctggggaaagcaagatagcaaagtggtcctagcctcnagagaggggacacctagctaagagaatgacgacagaggttcctgtcttcattaggcagaggcaatataagaagccaacctgggcaggcaagtcctcaaaccccaggaagncagtaccctgcccctgggagggtaccactcacatggaaccagaggaagctgctccatgcatacataggggaagttagcaggcaattctgagctcggcttcctcccagccaccgatctgggggcgtgggggtaggaagcagagttgcctagtaccactcaagccaaccgtacaagctccctgggggatcccactggggaaaccaatgctatagcttcagagactgtatcctcattgcagaaccgtgaagacacctggggacccccttttctgctcccagcatccaacaaccagctgggaaga

SEQ ID NO: 4184 - DNA, 552 bp, Mus musculus
gggtatcagcatctgcaatccatggagtcttgttatgatgcttttattgtgtatgacactaaaaactcagctgtgacagaatgggttttgcaggagctggtggcaaaattggaagatccaagagaaaaacacttcaatttgtgtctagaagaaagagactggctaccaggacagccagttctagaaaacctttcccagagcatacagctcagcaaaaagacagtgtttgtgatgacacagaaatatgctaagactgagagttttaagatggcattttatttgtctcatcagaggctcctggatgaaaaagtggatgtgattatcttgatattcttggaaaagcctcttcagaagtctaagtttcttcagctcaggaagagactctgcaggagctctgtccttgagtggcctgcaaatccacaggctcacccatacttctggcagtgcctgaaaaatgccctgaccacagacaatcatgtggcttatagtcaaatgttcaaggaaacagtctagctctctgaagaatgtcaccacctaggacatgccttggta

SEQ ID NO: 4185 - DNA, 318 bp, Mus musculus
tgtgggtcaggcatgcttgtttagcggtgccagactgaagctccggccttccggtgtaccaagcaagtgttgtactcctgagtcaggttttcttcagttagatgctaactaagctctctgagagaccctcaaagtttttgaggtgtagctcagtcagtagagtgctgcatctgcaagagcaaatctctgggttcaaaggtcagtactacctaaaaccaggaatggcagtgccatcccctacctgtaatcccagcactcctgaggtacaagcaggaagatcaggaatgcaaagttactgtagctgtaagttcgaagcca

SEQ ID NO: 4186 - DNA, 588 bp, Mus musculus
  misc_feature (201)..(201): n is a, c, g, or t
  misc_feature (215)..(215): n is a, c, g, or t
  misc_feature (230)..(230): n is a, c, g, or t
  misc_feature (235)..(235): n is a, c, g, or t
  misc_feature (254)..(254): n is a, c, g, or t
  misc_feature (257)..(257): n is a, c, g, or t
  misc_feature (372)..(372): n is a, c, g, or t
  misc_feature (467)..(467): n is a, c, g, or t
gaacaaacgcctggatctcctggagacgagcagagctgctgtgaacatggtctgcaggcagaagtacaagctgggggcccccttcactgtggagagaaatgtgcctccagaggtgacagtgtatccagagaggaccccgttgctgcagcagcacaacctgctgctctgctctgtgacaggcttctaccccggggacataantgtcaagtggttcncggaatggacaggangagangtctggggtcatgtccacntgnccttgttaggaatggagactggaccttccagacaacagtaatgctggaaatgatcccagagcttggtgacatctacagctgcctcgtggagcaccccggcctcctgagacctgtntctgtggcatggatggctcagtctgaatattcctggaaaaagatactgagtggagctgcagtgttcctgcttgggctgattgtcttcctggtggnggttgttatccatctcaaggctcagaaagcatctgtggagactcagcctggcaatgagagtaggtcccggatgatggagcggctaaccaagttcaaggctggaccgggacatgtcacatga

SEQ ID NO: 4187 - DNA, 531 bp, Mus musculus
aaattctctgaagccggcccttgtgtgggataggaagatggggttgaatccagccctgagtcacccagaggaaggagaactgaggtctgagtacatcctggctctagccttcccatggcctggcatttagccacctaacatccagtgatgcaaatatgtccagccgctacattccatggtgtcccacaagggagagacagtgatgggactagcagactgtttggttgtaacccatccctgctcaccctgcacaaactgggaaacactgtctgcctctcttttaatcctgcctgctccaggctaacaggccagtaccctcaccttcgagtttctggcaacactacctgagtgcctgctcagggggttcagcttctgaccatatgtagacaccaccccagctctgagtttacacatcatcaccccttgcctaagacctgaaacccccctttaccttcgcccaggtgtgccatttccctgctccctcctggatccttgggacctgtgaacctactcaagtgctgctctcaataa

SEQ ID NO: 4188 - DNA, 230 bp, Mus musculus
  misc_feature (204)..(204): n is a, c, g, or t
atggcctggatttcacttatactctctctcctggctctcagctcaggggccatttcccaggctgttgtgactcaggaatctgcactcaccacatcacctggtgaaacagtcacactcacttgtcgctcaagtactggggctgttacaactagtaactatgccaactgggtccaagaaaaaccagatcatttattcactggtctnataggtggtaccaacaaccgagctcc

SEQ ID NO: 4189 - DNA, 306 bp, Mus musculus
ttactcctgcactgtgacacacgagattgaccgctacacggcaattgcctattgggtaccccagaacgccctgccttcggatctcctagagaatgccctgtgtggtgtggcctttggcctcggtgtgctaggcaccatcatgggcattgtcttcttcctctgctcccagagaccgtgctcaggtgactgattcttctcaaggagatcttggaacagcacaggccaggccagcggggatgtccaggcatctcgtgactacccaaggtctctcatcggagccgaagtcccagggatccctcagggtgt

SEQ ID NO: 4190 - DNA, 214 bp, Mus musculus
tgcggcggcttgaacagcccaatgtcgccatctccctgtccaggacagaggccctcaaccaccacaacactctggtctgcttcggtgacagatttctacccagccaagatcaaagtgcgctggttcaggaatggccaggaggagacagtgggggtctcatccacacagcttattaggaatggggactggaccttccaggtcctggtcatgctgg

SEQ ID NO: 4191 - DNA, 296 bp, Mus musculus
  misc_feature (30)..(31): n is a, c, g, or t
gtgcagacacaactacgaggagactggagnnccccacctccctgcggcggcttgaacagcccaatgtcgccatctccctgtccaggacagaggccctcaaccaccacaacactctggtctgcttcggtgacagatttctacccagccaagatcaaagtgcgctggttcaggaatggccaggaggagacagtgggggtctcatccacacagcttattaggaatggggactggaccttccaggtcctggtcatgctggagatgacccctcatcagggagaggtctacacctgccatgt

SEQ ID NO: 4192 - DNA, 452 bp, Mus musculus
  misc_feature (46)..(46): n is a, c, g, or t
  misc_feature (157)..(157): n is a, c, g, or t
  misc_feature (227)..(227): n is a, c, g, or t
  misc_feature (229)..(229): n is a, c, g, or t
  misc_feature (232)..(232): n is a, c, g, or t
  misc_feature (264)..(264): n is a, c, g, or t
  misc_feature (270)..(270): n is a, c, g, or t
  misc_feature (278)..(278): n is a, c, g, or t
  misc_feature (305)..(305): n is a, c, g, or t
  misc_feature (310)..(310): n is a, c, g, or t
  misc_feature (312)..(312): n is a, c, g, or t
  misc_feature (320)..(320): n is a, c, g, or t
  misc_feature (335)..(335): n is a, c, g, or t
  misc_feature (341)..(341): n is a, c, g, or t
  misc_feature (347)..(347): n is a, c, g, or t
  misc_feature (349)..(349): n is a, c, g, or t
  misc_feature (352)..(352): n is a, c, g, or t
  misc_feature (372)..(372): n is a, c, g, or t
  misc_feature (408)..(408): n is a, c, g, or t
  misc_feature (415)..(415): n is a, c, g, or t
aagagccccatcactgtggagtggagggcacagtctgagtctgccnggagcaagatgttgagcggcatcgggggctgcgtgcttggggtgatctttcctcgggcttggccttttcatccgtcacaggagtcagaaaggacctcgaggccctcctccngcagggctcctgcagtgactcagagtgttttgactcagttgactgtctcagactgtaagacctgaatgtntntgntccgaattcctgactgccagtccacctgccantccgantcagagtntagcatggtactattgtatccaccacntcagntnttgtgatntggagtcccccagtntctgtntgtagntntgntccttggtgattccagagantccatctgtgtacagccgcaccccaggctttctgtnttcgatntgtagtaaaccaatgtatgcttatccccacctagatt

SEQ ID NO: 4193 - DNA, 441 bp, Mus musculus
  misc_feature (297)..(297): n is a, c, g, or t
  misc_feature (350)..(350): n is a, c, g, or t
  misc_feature (360)..(360): n is a, c, g, or t
  misc_feature (413)..(413): n is a, c, g, or t
gaatttgtgcacctgagagttcctggtcttgagttatggagagcaagcactggtttctacttcataggattcacaatggagagggctaggaagatactggacaattttcagcagtgtgacactcaagtcctggtcccttggagagaaaggacgcggtgttcaagaagtaatctcatcaaaatcagagtcaatgagaccttacatacagaagacatgaggtcttagattattggagggaaagtggaacgagtagttgagatgctgagggaaggttgctaagagatctggcattgcttncaattcttcccttatcagaacgaaatatgtcctgtgttagagctagcatgatncgcaagccancaactccccttattttccagacacctcctagtcctattgtgagatattttgtntcccctgcccaatgtattgttcccaaat

SEQ ID NO: 4194 - DNA, 454 bp, Mus musculus
attgctcaaggcttacgtctctacaggcctcatctggcatcagagagggtatataccatcatgtacagctgctggcacgagaaagcagatgaacgtcctagtttcaaaattctcttgagtaacattctagatgtgatggatgaagaatcctgagctggctgctaagctccgtggatctcctcctctctcctacaaaacctaattccatgtttcctgaggagttccctggctgcagggctctagccttccatgcgcctactgaatgcatgaagagccctggacatctaggaatgcctttcttctctcgttccctggcatactgctctaagcaaaggtcaagggatttctgtgcctagtattacccataacttcaagactcctaacagactgaattggggatgggaacactttgggggagggaaaactgtaaatagctccactagttgtccaacag

SEQ ID NO: 4195 - DNA, 408 bp, Mus musculus
  misc_feature (317)..(317): n is a, c, g, or t
aatatgagctgcagccctagcaaccaatggtctcttcagggctcccagcctgagcctccttctggactctgactttgggttaatatgttcacacttagctcttcttccaggtaggttgcagaatcagggaagaatggtgtgcctgcttctcaagtgagggagccaggagacaaagatggcttcatggtgaggcatgagctctcaaggcacaacctcggtccacctttcactggctgtgtgcctttggccaagttactttgctgctctgtgtcgtctcttccttgaatgtaaaatgagcaaggattgtgttagaactnacctccagttgtgttcagaccccgatagtcccgaaatcagtctgaccagttagcgatggacaggatgtcaggctgtcataacccagagtgc

SEQ ID NO: 4196 - DNA, 550 bp, Mus musculus
  misc_feature (337)..(337): n is a, c, g, or t
  misc_feature (365)..(365): n is a, c, g, or t
  misc_feature (461)..(461): n is a, c, g, or t
  misc_feature (465)..(465): n is a, c, g, or t
  misc_feature (507)..(507): n is a, c, g, or t
  misc_feature (521)..(521): n is a, c, g, or t
tttctggatagtggccacaggtcctcacttctctgcccactctggcctctggccaacaagccaagagactcaagtagcaggttatatccatgtgacacagagcttctgtatcctggctgtcctgtggggcctggtgtctgtgagcttcctggttctgtcttgcatcccagccctgtctgctcccggccgtggccctctggtctcaactgtcatggctttttctgcagctctctccatattagtggctatggcagtgtacaccagtatgagatggagccagactccattttctcaagtccagacattcttctcctggtccttctacctaggctgggtntccttcatcctcttcctctttgcaggcngcctgagcctgggtgctcactgtagaacccgtcgggctgagtatgaaaccttgtgaacagcagccaaggacagcagggtcatcaggatgtttggancctntcctctcaggagctacaaaaggaatgcagaattctgtctctntccctcccaccttnccttatccttcattggtttcttcacacac

SEQ ID NO: 4197 - DNA, 448 bp, Mus musculus
agaacagatatactatgccggccctgtcaataaccctggacttgatgttccacagggagaatatcagctcttgctggaactgtacaatgaaaaccgtgctactgtggcttgtgccaatgccactgtcacctcctcctgagcatggtctgcaaggaaatgcacagtaaactcaatctcaggggaccccaaggtccctggactcacctagctgcaagaaccactgataaccaagagaggctttacaaagaaatttcttgtgggtcactcttccgatcttagctccagggacagatgttcccagacccaacagatgtaataaaccctcaaaaactatctatttctgaggaccctgagtagtcttgaagccctattgtagtacctctccttatgtaattacgtttcatcaaagctacttcccttgcctgctccttagcaacacttccttgaa

SEQ ID NO: 4198 - DNA, 490 bp, Mus musculus
  misc_feature (356)..(356): n is a, c, g, or t
  misc_feature (388)..(388): n is a, c, g, or t
  misc_feature (404)..(404): n is a, c, g, or t
  misc_feature (422)..(422): n is a, c, g, or t
  misc_feature (459)..(459): n is a, c, g, or t
gagaccatcactgtttttatccttgttgaaaagttgccacctagcaagttcttgtccaagatgtgttgagctagcctatgttgttcccacgatctacttcctacaacaggactgatagaaaggccctagctcctgctacagacatgcgctggttgtgggctgaggaataacaccagtgcatgcgcagacaggctcctgtgctcagcctgtctgggagacgaacctatttctagtctttaagatctgtggctttaaaagtctgctcactagaacccaaggggctgaaaatgcaagacgattctggaaccagggtagaagagaacagaggcatcaagaacatagggtgcagagaccancctcggcttcaaagaatcgtgagaatttttgntcagcttttcagcagntcatttgtgtaaattttntcctttactttctgtttgtaaagaatgagctcttttnccaatttcatctgttgtgttgggtcagcctg

SEQ ID NO: 4199 - DNA, 242 bp, Mus musculus
aaccaaattatctatgcccatatgcctgtataagctatatcaaagtatatactttgtgagcaatgtgctgaatcacaaaagagtcagaattggatttgacaccatatgaataaagacacccagaatcttacatcatttggaaaactagtcgtgacattaatatgcaattagctggaaagttataagatgcaccacaaacacatcttatatgcactataaattaccacacaaagatcatgctt

SEQ ID NO: 4200 - DNA, 532 bp, Mus musculus
  misc_feature (376)..(376): n is a, c, g, or t
gaatccaattctcattcaccttttccttggatgtgtgtctcagtagtggtaatggtttttccgcatttcctccatcagcagttacagcagagggaaaagacacatgactgttctgttcatctctgaactctctgactccttcttcatgtttggtggagtcccttttgcatgattgtcttaaagaatatgagagaaattgtttaatgagaattgttttaataatgagagaaaatgagacacctatatgcctgtggggaaggcacaaaatatggcatgttcttcaagcttctgtgtcccacttgggaagctgtgaaaggcctagtcctaagtctgtctctgtacaaaaagcatagcttacacataagcaagtttcatntcttaactttgcccatctccagtttcttggcttctggtcacatcgtttatgtatttgtattctttagtcaagagaaaaaagaatggtgagacagaaatgtaatgggttcccagatctcaaatcctaagcaacagctgtgctttgagattctttcca

SEQ ID NO: 4201 - DNA, 428 bp, Mus musculus
  misc_feature (238)..(238): n is a, c, g, or t
  misc_feature (265)..(265): n is a, c, g, or t
  misc_feature (272)..(272): n is a, c, g, or t
  misc_feature (289)..(289): n is a, c, g, or t
  misc_feature (327)..(327): n is a, c, g, or t
  misc_feature (334)..(334): n is a, c, g, or t
  misc_feature (401)..(401): n is a, c, g, or t
ttattgtcacagatgggcagtcctatgatgatgtccgaggccctgctgcagctgcccatgatgcaggtatcaccatcttctctgttggtgtggcttgggcaccgctggatgacctgagagatatggcctctaaacccaaagagtcacacgctttctttaccagagagttcacagggttagaaccaattgtctctgacgtcatcagaggcatttgtagagacttcttagaatcccagcnataaccgatactctgacaactcaaggnatacgtncaaggggatctaatgtncaaattatattctcaatgcctatgtaactttatagctnaccagtntcaaaaaatgcgtccacagctgtttaaagcaaatgaatattcatgtgatgctcacaatttagattgnccgagacttgataatcaggcccttaga

SEQ ID NO: 4202 - DNA, 435 bp, Mus musculus
  misc_feature (290)..(290): n is a, c, g, or t
  misc_feature (299)..(299): n is a, c, g, or t
  misc_feature (315)..(315): n is a, c, g, or t
  misc_feature (322)..(322): n is a, c, g, or t
  misc_feature (333)..(333): n is a, c, g, or t
  misc_feature (339)..(339): n is a, c, g, or t
  misc_feature (346)..(346): n is a, c, g, or t
  misc_feature (358)..(358): n is a, c, g, or t
  misc_feature (364)..(364): n is a, c, g, or t
  misc_feature (376)..(376): n is a, c, g, or t
  misc_feature (388)..(388): n is a, c, g, or t
  misc_feature (403)..(403): n is a, c, g, or t
  misc_feature (410)..(410): n is a, c, g, or t
taagaaactgcttaaccccatcccacttataactacctcaaccaaagctgtaaaagatatggctgagaagttaacactcaagccaagacagctatccccaaaacgacagccaaaagtgaaagtgagaggctgccacactttccggagtgagggatgtggggccagtgaacaccctggttgagtagtcttcggaggcctctgaatgaacctgcttctagcttagagagatgtcccggagattcaaggacagagcttatctccacacttagcaagcaagcaagagatgacantctctctanatgctcccacagagcnacccctncccctcccttntgcctntccaccncctttcctgagntccagnccacaccatcanccctgaaggcantcccagctggggctntggatgncaatgacaagtagttgggtctctat

SEQ ID NO: 4203 - DNA, 515 bp, Mus musculus
  misc_feature (132)..(137): n is a, c, g, or t
tacaaaatgcctgatcgttgccagtctaactctgaacactatcacctctgtgttggctgcaactgcaagcataatgggtgtagtcagtgtggctgtgggttcacagtttccgtttcggtataattatacaannnnnnagggtttggatgttttgatgttaattttcaatatgctagaattctgccttgctgtgtccgtctctgcatttggatgtgaagcttcctgttgtaactcccgtgaggttcttgtagtgctaccatcaaatcctgttgagacagtgatggcacccccaatgacacttcaaccattgctaccatcagaacaccaagggaccaatgttccaggaaatgtgtacaagaaccacccaggagaaatagtctaattttgatgtgtgtgtgtgtgtatttccctaggatattaacacttcattgcactggcttttgaggtgaatattagatttactgtaagtatgtaagtcaagcacttattaggtcaacaacacttcaacatattat

SEQ ID NO: 4204 - DNA, 345 bp, Mus musculus
  misc_feature (276)..(276): n is a, c, g, or t
  misc_feature (281)..(281): n is a, c, g, or t
gtggctttcactagaactatgtctctctgcttttccctccgaggatgacacagattgtggtttgtatgcttcttgtttgaggaatgatttcagccctaatctggtctgagacggagatgagtggttggaaagtaagccttaccacactagttggaatctgtaaccagcagtaactccatgcacagccaagaagctttacattataaacaggaaggtgacccatgtggcacagaagaggtgggactcagtagagagcagggacccccacgggcctgntccanccttgcctcagagcaggaaggaggccattccagacatgtgcaagtctacagatagatcccagca

SEQ ID NO: 4205 - DNA, 539 bp, Mus musculus
  misc_feature (32)..(32): n is a, c, g, or t
  misc_feature (299)..(299): n is a, c, g, or t
  misc_feature (307)..(307): n is a, c, g, or t
  misc_feature (310)..(310): n is a, c, g, or t
  misc_feature (347)..(347): n is a, c, g, or t
  misc_feature (350)..(350): n is a, c, g, or t
  misc_feature (367)..(367): n is a, c, g, or t
  misc_feature (370)..(370): n is a, c, g, or t
  misc_feature (372)..(372): n is a, c, g, or t
  misc_feature (398)..(398): n is a, c, g, or t
  misc_feature (416)..(416): n is a, c, g, or t
  misc_feature (445)..(445): n is a, c, g, or t
agagccagtgagtctgggccttgaagggcccntcccccccgcccaggcagcaaaggggatgtgccatgtccgaggccatggacaggacagagctttgtggttctgtcttagtcacatgtgttcaggtcaatgcccaggctactgtaatgtgtctcctggtcatacccactggtatacagtgctttgggggtgtgctgggatgggggtggacctgcaccatttgtttgagggcaacttgacgtgtttaagaatgaaagggggcctggagggcacaccagtctgtcatccacccctcttcntcaatganttntacattgggacaagcagcctgcccccgatggcctccntcntccagttcaggttctcngtntntgtgtggggaggatagagccacccantccaggtctggggcaatntcaactggtcctgtaaccccgcagcctcncccttcctgttctgaatcacggagatatgctgtggcagggagctgtggaccctaccatgtgatagtgcagctgcaagccatgcatggctgcata

SEQ ID NO: 4206 - DNA, 362 bp, Mus musculus
  misc_feature (316)..(316): n is a, c, g, or t
aggaatttgtgtgtactgtgactcacagggatctgccttcaccacagaagaaattcatctcaaaacccaatgaggtgcacaaacatccacctgctgtgtacctgctgccaccagctcgtgagcaactgaacctgagggagtcagccacagtcacctgcctggtgaagggcttctctcctgcagacatcagtgtgcagtggcttcagagagggcaactcttgccccaagagaagtatgtgaccagtgccccgatgccagagcctggggccccaggcttctactttacccacagcatcctgactgtgacagaggaggnaatggaactccggagagacctatacctgtgttgtaggccacgaggc

SEQ ID NO: 4207 - DNA, 455 bp, Mus musculus
gtggaaatgaccacggtcctctcaggccctgggaggggctgcaaggaaaagacagagtggacaccctcaccatctcctcgctcacagccagctgccctaaggcaggcactaaggcggctgaggagcgctctgccgcagaccacgctggtacagcagagctggtccaaccacagttcagtgctcacaaataaaacctgtcaggcttttcctctaagtacaagttaaagaattatcatgaacttttttaagactcaaaattaagttaggcatgattgatggcacatgcctgttaatgctcaggggcctgaggccgagggtcagtttgagaccagcctgggctccatgagaagacccagcaggcaaagcagcacgtgggagctgtgaggacgaccccagccccaatacccccttgtaaaggaactgaaatctagagagaaataacctttcattccaag

SEQ ID NO: 4208 - DNA, 216 bp, Mus musculus
cctctgcagcatcttttggttagttcttaggcagctcacctcagatgctaacgttgtaacctgtcagttacactgctgagggagaaacagcggctcatcactctccctacacagaggatgcgggggaggagacgggggagctcctcagagctcagtgtggactgaactctgttcactgtgctcagaacagcacctcgggatctgtacagccacaat

SEQ ID NO: 4209 - DNA, 523 bp, Mus musculus
  misc_feature (336)..(338): n is a, c, g, or t
  misc_feature (340)..(340): n is a, c, g, or t
  misc_feature (343)..(343): n is a, c, g, or t
  misc_feature (373)..(373): n is a, c, g, or t
  misc_feature (378)..(378): n is a, c, g, or t
  misc_feature (380)..(380): n is a, c, g, or t
  misc_feature (387)..(387): n is a, c, g, or t
  misc_feature (396)..(396): n is a, c, g, or t
  misc_feature (407)..(407): n is a, c, g, or t
  misc_feature (438)..(439): n is a, c, g, or t
  misc_feature (467)..(467): n is a, c, g, or t
  misc_feature (480)..(480): n is a, c, g, or t
  misc_feature (492)..(492): n is a, c, g, or t
aggagctgaagagcccataaccaggaaaggagaactccagaagaggcccaacccagctgctgccacccaggaagaaagcctatatgcttcagtggaggacatgcaaactgaggatggagtggagctgaacagctggacaccacctgaggaagatccccagggagagacttatgcccaggtgaaaccctccaggctcaggaaggcaggacatgtctcaccttctgtcatgtcaagggaacaactgaacacagaatatgaacaagcagaagagggccaaggagcaaacaatcaggctgccgaatctggggagtcccaggatgtgacctatgcccagcnnntncancaggacactcagacagggggcagctgcatntcctntntcccagncaggggaanccccagaggancccagtgtatatgctactctggcggctgctnntccagaggctgttcccaaggacatggancaatgaccccctncctgccaggatncctagcagagacctccaagggactctgggaa

SEQ ID NO: 4210 - DNA, 574 bp, Mus musculus
  misc_feature (372)..(372): n is a, c, g, or t
  misc_feature (471)..(471): n is a, c, g, or t
  misc_feature (474)..(474): n is a, c, g, or t
gtcagggtaatatccatgccctctgccttccatatttccctttgtcttgaagaaagttgacaaagtctattagccagtaactcatccttgttgtttaagacaatccataagaactgactccagaccacaactaatggatttttaacactatgtcgctcaggataccttacattcaacaagaagtcaaggaatagaaagtatgaacagcaacacataatctagagttgaggttatgactactatataaattcaaatgctgcctcttacaaactaataaattctaaggttcttaaactgaaaattgaagtgcatttgacttaagatggttgtatgaaactaggtatgtgtaaatataaaatacccatttaactntcttgtacataatacatgggcctatagtcctttgtactcaatgaaatattttgtggaatgtttggagtattataaatacctgttgtcttcaaatgctantcntcttccttgcaagtttgattccatatgtataatctcatgtggagcatgtctgatttgaaaaaaaaagggggactggtcttcactgttgttctaaactatt

SEQ ID NO: 4211 - DNA, 532 bp, Mus musculus
  misc_feature (121)..(121): n is a, c, g, or t
  misc_feature (130)..(130): n is a, c, g, or t
  misc_feature (137)..(137): n is a, c, g, or t
  misc_feature (139)..(139): n is a, c, g, or t
  misc_feature (141)..(141): n is a, c, g, or t
  misc_feature (143)..(143): n is a, c, g, or t
  misc_feature (146)..(146): n is a, c, g, or t
gaagcctatggctggttattgtcagactctctgtcatgatggtatcacgaaatcaggttcctgacctgaaatttgtgttattccctttccctgctgtctccattgtatctgcctcaacccnaaaagcctngggcccnancnangtngaggctctctcctaacttaggctctgcttatgtctgccttcatcctttcagtcatgatgggactgtgcaagtttacaggccaacccataaggactaagaaaggaacctggtgccctgggtctatctgcagcatctgaaatgcttggtgcccagatctgccttatgcttgccttcctctgggcagaattatcctcagcccctgcatagtctcctggccccacccagatctggcacaggtggagatctcagccctgcagctgcatggggcctgtgggtcagagcagctcctccccctgtagcactcctactcagaacagagtagtctttctcaatgtctcttgttgaccaactacgtaggactggtggacacctctgcattcatcaca

SEQ ID NO: 4212 - DNA, 349 bp, Mus musculus
  misc_feature (121)..(121): n is a, c, g, or t
  misc_feature (123)..(123): n is a, c, g, or t
  misc_feature (175)..(175): n is a, c, g, or t
  misc_feature (258)..(258): n is a, c, g, or t
  misc_feature (261)..(261): n is a, c, g, or t
actgtctccaacacggtaactcattgctgttctggttgtccttggagctgcaatagtcactggagctgtggtggcttttgtgatgagagatgagaaggagaaacacaggtggaaaaggagngnactatgctctggtctccaggctcccagacctctgatctgtctctcccagatngtaaagctgatggttcatgaccctcattctctagcggtgaagacagctgcctggagtggacttggtgacagacaatgtcttcncanatctcctgtgacatccagagccctcagttctctttagtcaagtgtctgatgttccctgtgagcctatgggactcaaatgtgaagaact

SEQ ID NO: 4213 - DNA, 442 bp, Mus musculus
  misc_feature (67)..(67): n is a, c, g, or t
  misc_feature (309)..(309): n is a, c, g, or t
tttcaggacagggacaacaatagctatggtagcatggcaggggaaagcccacaggacctcagccttnatacaaagaatcagaggcaactgaggagtgctgagttgaaggaattgtcttacccaggggagggcacattaattggttatctaatacaaaatgttcagccccaaaactgttaagataaaagcctatatgcatcttaggaagtatctaccttgatacacctttattggaatatcatccacatgtttattgtgtgttctgaagagggtctgttgaatttctaagggttgatcagtttaattgtnccattttatattcagggtgtttggctttgttgtagtgaataatgctatatttccctgtatgtgtcatctttgactgttattttttcctggcaatactttattcaacaagaacctagagccttggtttattact

SEQ ID NO: 4214 - DNA, 543 bp, Mus musculus
gtgaaagtgctattgcaactccaaaaatttcttatcttctctcacaagcaaaggggacatttgtaaatggagaatttgtagtatttaagaaaagtgagaggcatgagtgcatttgctatggaattggagatgatacaggaaaaatggcagtggtggtttatggacgactcaccaatgtcaggtgtgaaccaggcagtaaacttagacttgtctgctttgaattgacttccactaaagatgtgtgcctcctgaggtctgtaaggcacagttacatgcaggtcatcaatgaaggaaagccactcaacccagactcagtcaggagaaactctctggaaccatacttctgataacctggatgccaatgacactgtttgtggagataagattcaagtacagaaaataaatgtgcacaggcctgttgaaataccagtcttataaagaccagctcttaattctaagaaatggtgctttctcatattctttatacattctattatctaaatttcataggttgtctctataactcctttaactgttggtttg

SEQ ID NO: 4215 - DNA, 536 bp, Mus musculus
  misc_feature (243)..(243): n is a, c, g, or t
  misc_feature (260)..(260): n is a, c, g, or t
  misc_feature (282)..(282): n is a, c, g, or t
  misc_feature (319)..(319): n is a, c, g, or t
  misc_feature (359)..(359): n is a, c, g, or t
  misc_feature (411)..(411): n is a, c, g, or t
  misc_feature (451)..(451): n is a, c, g, or t
  misc_feature (473)..(473): n is a, c, g, or t
  misc_feature (507)..(507): n is a, c, g, or t
gcagcagctcagcatgtgaggacacacggagtaagtgagtcctttcaggtctcctctggactctattctaagccaaggataaacattgcacatatggactatgaagacgccatgtagaattatgtaaacagcaactatggagtgctacatacaagcccaaggcctgatgtggcctccaaggatactggggacagggatagcttgccagcccaatttccccacacactgcggttcattagatgngtccttcacctaccctntgtgaagctggagcaagtcctncagaaaccacccaggaaaaccaacttagacggagaanccagaagcatttgcatctggttgttgcccattcatgttgncacacgaacttttatttacaggaggaaaatggtgtgatgaaagcaactaagntcttacagcagagggacaatgcgactcagagagcacaaanccgagatcaatggctttgcggntctgctgtggagacagagccatgcttcctctgtncacataccctagagtacttctgagtcact

SEQ ID NO: 4216 - DNA, 346 bp, Mus musculus
aactgactcagacaacttctccattcctggaggaaactggagctgtttctgacagaagaacaaccggtgactgggacatacgaaggcagagctcttgcagcaatctatatagtcagcaaaatattctttgggaggacagtcgtcaccaaattgatttccaagccggtggacctcagtttcatctggcttacagctgcctgcccagtgcccttgatctgtgctggctcccatctataacagaatcaaattaaatagaccccgagtgaaaatattaagtgagcagaaaggtagctttgttcaaagatttttttgcattggggagcaactgtgtacatcagaggacatc

SEQ ID NO: 4217 - DNA, 431 bp, Mus musculus
  misc_feature (346)..(349): n is a, c, g, or t
tcaacctgggaaaacctatcgatttggggctactgtgactctggaatgtgaggatgggtataccttggagggaagtccccagagccagtgccaggatgacagccaatggaaccctcccttggctctttgcaaataccgtaggtggtcaactattcctcttatttgtggtatttctgtgggctcagcacttatcattttgatgagtgtcggcttctgtatgatattaaaacacagagaaagcaattattatacaaagacaagacccaaagaaggagctcttcatttagaaacacgagaagtatattctattgatccatataacccagcaagctgatgacatgacaannnnatcaagatgtagaactctcagctacctcttcagcaccatatctgcttacatgccaccaagctaccctccacgacaataatgg

SEQ ID NO: 4218 - DNA, 280 bp, Mus musculus
acaggcttcttacctgccgaaattgctgtggactggaccagcaatgggcgtacagagcaaaactacaagaacaccgcaacagtcctggactctgatggttcttacttcatgtacagcaagctcagagtacaaaagagcacttgggaaagaggaagtcttttcgcctgctcagtggtccacgagggtctgcacaatcaccttacgactaagaccatctcccggtctctgggtaaatgagctcagcacacacaatgctcctgggtcctaatggacactggca

SEQ ID NO: 4219 - DNA, 506 bp, Mus musculus
gaacctgaacagactccaagacgatctagtcaacatcaaatccctgggcttgaatgagaagcgcacagcctccgattctctagagaaactccaggaagaggtggcaaagctgtggatagagatactgatttcaaagggaactgcatgcaacatatgtcccaagaactggctccatttccaacagaagtgctactattttggcaagggctccaagcagtggatccaggccaggttcgcctgcagtgacctgcaagggcgactagtcagcatccacagccaaaaggaacaggacttcctgatgcaacacatcaacaagaaggattcctggattggcctccaggatctcaatatggagggagagtttgtatggtcggacgggagccctgtgggttatagcaactggaatccaggggagcccaataacgggggccagggtgaggactgtgtgatgatgcggggatccggccagtggaacgacgccttctgccgcagctacttggatgcat

SEQ ID NO: 4220 - DNA, 546 bp, Mus musculus
cagatttcactctcagtatcaacagtgtggagcctgaagatgttggagtgtattactgtcaaaatggtcacagctttccgctcacgttcggtgctgggaccaagctggaactgaaacgggctgatgctgcaccaactgtatccatcttcccaccatccagtaagcttgggcccggtgggggcggttcgggtggcgggggctcgggcgggggtggctcagagctcggcagatctgaggtgcagcttcaggagtcaggacctagcctcgtgaaaccttctcagactctgtccctcacctgttctgtcactggcgactccatcaccagtggttactggaactggatccggaaattcccagggaataaacttgactacatgggatacataaactacagtggtgacacttactacaatccatctctcaaaagtcgaatctccatcactgcagacacatccaagaaccaatattacctgcagttgaattctgtgactactgaggacgcagccacatattactgtggaggaggactgaggactatggactact

SEQ ID NO: 4221 - DNA, 239 bp, Mus musculus
gggctacttccctgagtcagtgactgtgacttggaactctggatccctgtccagcagtgtgcacaccttcccagctctcctgcagtctggactctacactatgagcagctcagtgactgtcccctccagcacctggccaagtcagaccgtcacctgcagcgttgctcacccagccagcagcaccacggtggacaaaaaacttgagagcgggcccatttcaacaatcaacccctgtcctc

SEQ ID NO: 4222 - DNA, 359 bp, Mus musculus
ctattactgtgcaagtctccggcccccgtttgcttattggggccaagggactctggtcactgtctctgcaggaggaggtggtagtggtggtggaggatccggaggaggtggttctgacatcgtgatgacccagtctccatcttccatatatgcatctctaggagagagagtcactatcacttgcaaggcgagtcaggatattaaaagctatttaggctggttccagcagaaaccagggaaatctcctaagaccctgatctatcgtgcaaacagattggtagatggggtcccatcaaggttcagtggcagtggatctgggcaagattattctctcaccatcagcagcctggagtatgaag

SEQ ID NO: 4223 - DNA, 330 bp, Mus musculus
atactgctctggttatatggagctgatgggaacattgtaatgacccaatctcccaaatccatgtccatgtcagtaggagagagggtcaccttgacctgcaaggccagtgagaatgtggttacttatgtttcctggtatcaacagaaaccagagcagtctcctaaactgctgatatacggggcatccaaccggtacactggggtccccgatcgcttcacaggcagtggatctgcaacagatttcactctgaccatcagcagtgtgcaggctgaagaccttgcagattatcactgtggacagggttacagctatccgtacacgttccgaggg

SEQ ID NO: 4224 - DNA, 234 bp, Mus musculus
gcagtgccagctcaattgtacgttatatgtattggttccagcagaagccaggatcctcccccagactcctgatttatgacacatccagcctgtcttccggagtccctgttcgcttcagtggcagtgggtctgggacctcctattctctcacaatcagccgaatggaggctgtagatgctgccacttatttctgccagcagtggagtagttacccactcacgttcggtggtggga

SEQ ID NO: 4225 - DNA, 226 bp, Mus musculus
gacttgcagggccagctcaagtttaagtttcatgcactggtaccagcagaagccaggatcctcccccaaaccctggatttatgccacatccaacctggcttctggagtccctgctcgcttcagtggcagtgggtctgggacctcttactctctcacaatcagcagagtggaggctgaagatgctgccacttatttctgccatcagtggagtagtaacccgctcacg

SEQ ID NO: 4226 - DNA, 95 bp, Mus musculus
ggcaatgtggacatgattgggtttcagggactcccagaatctcctgagagtgagtggtgggttgctggaatgttgtcttcacagtgatggttcat

SEQ ID NO: 4227 - DNA, 406 bp, Mus musculus
  misc_feature (276)..(276): n is a, c, g, or t
  misc_feature (317)..(317): n is a, c, g, or t
  misc_feature (341)..(341): n is a, c, g, or t
tgtaggctccagagcttaccaagcatgcaggccaagggccttgactgcaggccagcattagcagaacacataatggtttcacccttttgcagtctggcgttggagcaaggagaaaattgcactaagcgctccatgatctgcagagcatgttgcttttgtttttaaaaaagcaagtaaaaaatgcattcctgaacacagagcaggggatcgtgtactgtaggaatccttctgtgtgtcagcgggtgcatgaggggctattctttaggcttcagtggntaatctggtgcccatggatttcttgactaccaggtaaaccnaaactggaaaggccaagtactgtntctgtagtacttattgaggaccccatggagattttgaaaagtgttatttcttttgtccacaagca

SEQ ID NO: 4228 - DNA, 193 bp, Mus musculus
cacagtttcgtcaagatcaaggtcaccaaggctgggaaaaaaaaggaagcatcaactgtcctgtcaagcacaaaaaatgaagaagaaaataattacccaaaagatggaattaaggtagagatgccagactatcacgtctaaatgacagctttagtagtatatccaagcatttaataaccttcatacctgattt

SEQ ID NO: 4229 - DNA, 461 bp, Mus musculus
aatgcaaatgccagtcctaagatctgtgatattcaaaagggtacttctggagcagtgttctatggagtgtttacattacacaagaaaaaagtgaaaacacagaacacaagctatgaaataaaagatggttcaggaagtatagaagtggaggggagtggacaatggcacaacatcaactgtaaggaaggagataagctccacctcttctgctttcacctgaaaagagaaagaggacaaccaaagttagtgtgtggagaccacagtttcgtcaagatcaaggtcaccaaggctgggaaaaaaaaggaagcatcaactgtcctgtcaagcacaaaaaatgaagaagaaaataattacccaaaagatggaattaaggtagagatgccagactatcacgtctaaatgacagctttagtagtatatccaagcatttaataaccttcatacctgatttctgattttgt

SEQ ID NO: 4230 - DNA, 369 bp, Mus musculus
ggtgatgccactcggaaccaaatgtgtaacaaagccgtaccttgccctgtaaacggggagtgggaggcctggggaaaatggagtgactgcagccggctgagaatgtccatcaactgtgaaggaaccccaggccagcagtcacgttcaaggagctgtggcggccgcaaatttaatgggaagccatgtgctggaaaactccaggatattcgacactgctataacatccataactgtatcatgaaaggttcatggtcacagtggagtacctggagtctgtgcacaccaccatgtagtcccaacgccacccgtgtccgccagcgcctctgcacacctttgctccccaagtacccgcctacagtttcaatggtt

SEQ ID NO: 4231 - DNA, 211 bp, Mus musculus
agtcctaagatctgtgatattcaaaagggtacttctggaacagtgttctatggagtgtttacattacacaagaaaaaagtgaaaacacagaacacaagctatgaaataaaagatggttcaggaagcatagaagttgtggggagtggacaatggcacaacatcaactgtaaggaaggagataagctccacctcttctgctttcacctgaaaa

SEQ ID NO: 4232 - DNA, 563 bp, Mus musculus
  misc_feature (81)..(81): n is a, c, g, or t
ggcaaattaagtccctgcaggtgctttctttggaggaaagcccgctttcatagtgatctgtcaagctagaaagcactcccnccacccagatatctaagtgtgaatctttggacaactggtgacttctggccagcttttctggggccggcctctgtccaggtgtctgcccaggaccctgctcagtgcctgtctgtctcacaccagtgacttcctcacacccgcctgttcaggcccagtcttttccgttcaagtgctacaggccaagtaggctcaaactgtgggtttgtcttgggcatccacagcagaatcagaacccagagctttgaagcctgagtgaggggaggggggcactcaggcttccgtctctctgagaaacagacgatgaagaggcccttaaaactctttgcaaccccatgagcctccccaatgagcctgtgacacaccggaactcacctctgtgggtggccgggagggggaacagggtcatggaagatccagatgtccatgtggtcaaggctaaactgtactaaataaaattatttctcatcaccactatacatgca

SEQ ID NO: 4233 - DNA, 116 bp, Mus musculus
tcagtgatgtcaccaccttccaagaattaccaggagctgcatacatcacagatgcaacttgagaataaaatgcatgcaaggttttttgcatgagtctatatcacagtgctgggtgt

SEQ ID NO: 4234 - DNA, 208 bp, Mus musculus
aggctatcgtgtgaggtaaaggaccagcatgttgactatacttggtatgagagctcgggacctttccccaaaaagagtccaggatatgtgctcgatctcatcgtcacaccacagaacaagtctacattttacacctgccaagtcagcaatcctgtaagcagcaagaacgacacagtgtacttcactctaccttgtgatctagccagat

SEQ ID NO: 4235 - DNA, 345 bp, Mus musculus
  misc_feature (29)..(30): n is a, c, g, or t
  misc_feature (46)..(46): n is a, c, g, or t
  misc_feature (56)..(56): n is a, c, g, or t
  misc_feature (58)..(58): n is a, c, g, or t
  misc_feature (62)..(62): n is a, c, g, or t
ttattgctggcaaggtacacattttcctnngacgttcggtggaggnaccaagctgnanatcnaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagtggactgatcaggacagcaaagacaggcaccctacagacatgagcagcaccctcacgtggaaccaagggacgagtatgaacgacataacagctataccctgggagggcactcaccaa

SEQ ID NO: 4236 - DNA, 470 bp, Mus musculus
  misc_feature (154)..(155): n is a, c, g, or t
  misc_feature (171)..(171): n is a, c, g, or t
  misc_feature (181)..(181): n is a, c, g, or t
  misc_feature (183)..(183): n is a, c, g, or t
  misc_feature (187)..(187): n is a, c, g, or t
aagcgcctaatctatctggtgtctaaactggactctggagtccctgacaggttcactggcagtggatcagggacagatttcacactgaaaatcagcagagtggaggctgaggatttgggagtttattattgctggcaaggtacacattttcctnngacgttcggtggaggnaccaagctgnanatcnaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagtggactgatcaggacagcaaagacaggcaccctacagacatgagcagcaccctcacgtggaaccaagggacgagtatgaacgacataacagctataccctgggagggcactcaccaa

SEQ ID NO: 4237 - DNA, 454 bp, Mus musculus
gtctgcatcccttggagacacaattaccatcacttgccatgccagtcagaacattaatgtttggttaagctggtaccagcagaaaccaggaaaaattcctaaattattgatctataaggcttccaacttgcacacaggcgtcccatcaaggtttagtggcagtggatctggaacaggtttcacattaaccatcagcagcctgcagcctgaagacattgccacttactactgtcaacagggtcaaagttatcctctcacgttcggtgctgggaccaagctggagctgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaatggcgtctgaacagttg

SEQ ID NO: 4238 - DNA, 225 bp, Mus musculus
gcagtgccagctcaagtgtaagttctggtaactttcactggtaccagcagaagccaggcacttctcccaaactctggatttataggacatccaacctggcttctggagtccccgctcgcttcagtggcagtgggtctgggacctcttactctcttacaatcagcagcatggaggccgaagatgctgccacttattactgccagcagtggtgtggttacccattca

SEQ ID NO: 4239 - DNA, 252 bp, Mus musculus
tcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggtt

SEQ ID NO: 4240 - DNA, 542 bp, Mus musculus
  misc_feature (142)..(142): n is a, c, g, or t
  misc_feature (333)..(333): n is a, c, g, or t
  misc_feature (355)..(355): n is a, c, g, or t
  misc_feature (366)..(366): n is a, c, g, or t
  misc_feature (373)..(373): n is a, c, g, or t
  misc_feature (382)..(382): n is a, c, g, or t
  misc_feature (405)..(405): n is a, c, g, or t
  misc_feature (411)..(411): n is a, c, g, or t
  misc_feature (428)..(428): n is a, c, g, or t
  misc_feature (453)..(453): n is a, c, g, or t
  misc_feature (471)..(471): n is a, c, g, or t
  misc_feature (515)..(515): n is a, c, g, or t
gctttggctctgtgcttttctccagccatgtgcgcaaggtgaatcgcttccgcaagagccgggaccgggcccttctgctcacagatcggtatctgtacaagctggagcctggacgacagtaccgggtgatgcgggctgtgcntctggaggcggtgacagggctgagtgtgaccagtggaagagatcagctggtggtgttacatgcccaaggctatgatgatcttgtagtgtgtctacaccgttcccaaccaccactggacaatcgaattggggagctggtgggcatgctggctgcacactgccagggagagggacgaactctggaggtccgtntctctgactgcatcccactganccagcgtggtncccggcncctcatttnctgtggagcccaggccagagcancctganccagatttccaaagcanccgtagcacctttaccctcctctgnccaagccactgagcaagnccaaaccagtttaacctggtttccacgctgttctaaatacctgntcttgactgcactaaaggccaggactt

SEQ ID NO: 4241 - DNA, 537 bp, Mus musculus
  misc_feature (342)..(342): n is a, c, g, or t
  misc_feature (350)..(350): n is a, c, g, or t
  misc_feature (416)..(416): n is a, c, g, or t
  misc_feature (461)..(461): n is a, c, g, or t
  misc_feature (470)..(470): n is a, c, g, or t
  misc_feature (497)..(497): n is a, c, g, or t
  misc_feature (506)..(506): n is a, c, g, or t
aaaccgggttgcagctcagaggagccggaagaagcagacccagaaggctgacaagctccacgaggagcacgagagcctggagcaggagaactctgtgctgcgcagggagatttcgaagctgaaggaggagctgcgtcacctgagcgaggtgctgaaggagcacgagaagatgtgcccgctgctgctgtgtcctatgaactttgtgcagcttcggtcagaccccgtggccagctgtctaccacgatgacaccccagctcactcctcctttgtccggctcggaaccttggtttgcacactcaggagtttccctacacacctgtgtccaggggtacatgtggctntgcccttnccagggagctctggggccagcctgggctcagcatcgtgctctggggcatctgacttccggcccctnccttccggccccaggacagaggatccagaggccccagcaagaagnccctttgantcgttcctctctcactttggcagctanccggtgctntcctttggcaggatcttttcgtctagaactt

SEQ ID NO: 4242 - DNA, 323 bp, Mus musculus
gactccatggagtgactgagacagagtttgccttgctggtacagtgtgtgtcttgtgtcttcactgttcttcacttccataagagaggtacagcaaagaacttctcctggtattcctgctggtccttcctgctggccctagctgaggcctggctgtctctgctaggtcctatcacttctgttgctaacctgactctactgaactgaacaactgctatatccctgaggtgttttcaagtggatggagctgccactgctgacctgtgaattgaactgccaacgtccagacaactcacatgagagttgctcccaagtgtagtctcc

SEQ ID NO: 4243 - DNA, 543 bp, Mus musculus
  misc_feature (325)..(325): n is a, c, g, or t
  misc_feature (341)..(341): n is a, c, g, or t
  misc_feature (351)..(351): n is a, c, g, or t
  misc_feature (381)..(381): n is a, c, g, or t
  misc_feature (383)..(383): n is a, c, g, or t
  misc_feature (394)..(394): n is a, c, g, or t
  misc_feature (483)..(483): n is a, c, g, or t
  misc_feature (507)..(507): n is a, c, g, or t
tggtcacagacaagacagcctatgtaggcacctctaactggtcagaagactacttcagccacaccgctggtgtgggcctgattgtcagccagaagacccccagagcccagccaggcgcaaccaccgtgcaggagcagctgaggcaactctttgaacgagactggagttcccactatgctatggacctagacagacaagtcccgagccaggactgtgtctggtagggctgagggttgatccctttgattctggcctacagctctagatggacactgatgctccccagacttccatctgcccaagctcagaaaccaagcaagcaaanggatcaccactgaggncccgagattntcatcagacaaacagcttccggcagagctntnaacggcttttnaacgaagaagaggctaaagcagagggaggcaccacggtgacatgggaagacagcaactacatataagtgacccccagaaccctccctgntctacctatgatgagttgctaggnccattcccagatgtaatgttggtgctgtccagccac

SEQ ID NO: 4244 - DNA, 508 bp, Mus musculus
  misc_feature (51)..(51): n is a, c, g, or t
  misc_feature (316)..(316): n is a, c, g, or t
  misc_feature (336)..(336): n is a, c, g, or t
cagtaccagggtagagattcagtctcttacaacgtgtgcaaggagtggggnatgccaagacatcacaataatatgtgtgggtgcaatgtgaactgtattctggatgtgtttgtataaaataccaattagatattagttccaatatttacatttcagcaagacttttaaaagttcctttcattttaaagtgaaaattgttcgctgggcttcttgcaacacatcctttcaactgtgaagtcccactgtacatatctgtatttttgtaaatgttatatatatgcatatatccctcattttaaaagtatgttgtacagtnatagtatgtataggctacantctttgttaaatggttgaaatgtctcttttgtagaaagtgaaatcacagctattacagggcttttgtttggtttatttgtggatttgaaacagttttgaatattgcatggataattaatttcacatcttttgtatccacctctgtgtctggcttttggttgggaagtgcttt

SEQ ID NO: 4245 - DNA, 522 bp, Mus musculus
  misc_feature (83)..(84): n is a, c, g, or t
  misc_feature (305)..(305): n is a, c, g, or t
ccactttgcacagctttaccaggaattgagtccaattggagccaacagtggtcaacagaaatgctagagatgcaggcagtggnnggacagaggcaggagctggaggcgacatcttagtgatgatgctctcccgggcgagcagccttgtgctgcctctctcctccgggtagccacgttctgtcttgtccactcatgggtgaagagtatttggtgtgtctgccactatggggtcataaatgcacacgggaggtgctagctcccccactagccacggtgcctctgtagatccacgagacagctagggntccccctcccctttgtgtgcccagactcaaggttaagaagtggaaagttttctgcgaatatttttgtatttttgccagtctatattttttaaatcattatggtttattgtggagttttgtagtcctaattttgtaccatggtatgtgggaaacaaatctgacccattttctgcctttgatgctgttttccttgtgagtacctgtgtcgtttacgaga

SEQ ID NO: 4246 - DNA, 505 bp, Mus musculus
aaccccttctaacaatgcactggaagcttcagagacttactttcaaacactaggcaaacaaaccctctatgaacaatgtacctacaaaccaactgacaacctagaacgctcaagtgcatcaggcttcaggtatatgtttccaacatggacgtagattattcttttagcaattctttagtgatatatatcccagaacacaccttgatgctacaagagatagcctaatccagcctagacttgtttgagtgcataaatgagacaaactgtctcctatttgccattttatgcctatatattattgtatgtgctactgattaacattagatgacctatgcaataaacaaaatcctatggtacccaagttggtcagtcaacctcctacttctcttgaagtccataatgtcaacaccacagtaattgctatgcttccgtatcttcatttatgtggcctgttattctccttgacttcatatttcttcctaacctgcgatattccacggcttta

SEQ ID NO: 4247 - DNA, 531 bp, Mus musculus
  misc_feature (44)..(44): n is a, c, g, or t
  misc_feature (231)..(231): n is a, c, g, or t
  misc_feature (327)..(327): n is a, c, g, or t
  misc_feature (337)..(337): n is a, c, g, or t
  misc_feature (354)..(354): n is a, c, g, or t
  misc_feature (373)..(373): n is a, c, g, or t
  misc_feature (380)..(380): n is a, c, g, or t
  misc_feature (388)..(388): n is a, c, g, or t
  misc_feature (405)..(405): n is a, c, g, or t
  misc_feature (423)..(423): n is a, c, g, or t
  misc_feature (436)..(437): n is a, c, g, or t
gaaactgttctttggagcaaatcccatttgtgttatcaggagancagcagttcatttacaggaatcatcagttgcagcttgatccatttgcaaacacttcacgaactatcaatcggtagtgttgggatagcaaacatgaatcagcagtggaatgacctagcagagacatccaggtcttagatgaatcagcatgaatcagcaggaggaaccaggactaccagggacatcagnagaagttctttgccttgcctctctcaaagaaacaatgatcactgaagactggcgaccaagaagccttctttgcagagctagctatgcaagcaagcncccctcacantctgttgagtcctattnatactccctccaaacatcncgtgtcntccatggntcttacctcaccacgtntcttgcctcagcacgtgngtctgtatcaacnnccatcattctgccaattggctcgagtctgcagaagtggcaaaaagcatcaggcacaccacctttgatgtgtctatctctatggagtccctacaa

SEQ ID NO: 4248 - DNA, 348 bp, Mus musculus
agtgaactaagaaactctcctcccaccttaaactctcagttgacttctcacatacacataagcatatacacatgcacatgtgcacatcacagtcacatgcatgataacacaggcagacgtgcatgagtgcacatgcatacctactcagatgcacataaatttacagcagagccttaggtgacaggaatggggactgtggtcatttgaataagaaccccataggctcatatagttgaatgcttagtcaccagggagtggaactctttaacaggatcagaaagattcagaggcaagtccttgttgtaggaagtgtgtgtcactggagcacgggtaggctttcaggtttca

SEQ ID NO: 4249 - DNA, 153 bp, Mus musculus
  misc_feature (59)..(59): n is a, c, g, or t
  misc_feature (67)..(67): n is a, c, g, or t
aagctatatgtgcatctgctaaaagcaaaaacccaccaaaagtcaccagcccatttccngggcaccngtccatcccccagggcactagcccaacccctggggcgtttagcctatccctagggtgcatgagatttgtgggtgtagctaccagtc

SEQ ID NO: 4250 - DNA, 562 bp, Mus musculus
  misc_feature (82)..(82): n is a, c, g, or t
  misc_feature (347)..(347): n is a, c, g, or t
  misc_feature (359)..(360): n is a, c, g, or t
  misc_feature (501)..(501): n is a, c, g, or t
  misc_feature (503)..(503): n is a, c, g, or t
ggtacagagcccaagctagacctgagccagtcggacccggggccatctgtggctttgactccatggattctgcgcttgagtnggctcagacgggagctgcaggagatgcgggctcaggaccggcagctggcagggcagctgctcaggctgcgggcccggctgcacagactgaaagtggaccaagtctgtcacctgcaccaggagcttctggatgaggctgagctggagatggagttagagtctgggactggcttgcctctggccccaccgctgcggcatctgggactcacgcgcatgaacatcagtgccagacgcttcaccctctgctgacagcagacttgggtgtntcttgcagtatnntggggagaaagaaggaaggaagagggaccccggaggctctggctacctgctggggaaggtgggcacacttaggtttccaaaagctgaatttagagagcacaggatggaggggaggaggagaggaaactcgggccccaaatntnttaataaaaaatgcattgaatcccatcaaggtttctgtagactgtcacagagcctaaat

SEQ ID NO: 4251 - DNA, 167 bp, Mus musculus
gggtttcctgaaagtttacattgcagtagcattgtggggtgagggggatggctcccccaggctctatccccagccccacccactcatgactctaagtttgttgtattaatatttatttatttggagatgttatttattagatgatatttattgcagaatttctattc

SEQ ID NO: 4252 - DNA, 271 bp, Mus musculus
  misc_feature (58)..(58): n is a, c, g, or t
agttcaggaaacaaagtgaccagtcctaagaagagtgttacagtaaatggaggggggntagggtttatgctggaggtggcctagacaccacaagatgtaattctaaaagagaagggcagggacagaccagacccagcagtcaccaagacagttggtggcacagggtggaaaacaaaagccatgttgagcattagtaccttgctttgaattttcttgccagcatcttggtgcctcctctctgccccctttcccagggtatctgtggttgcct

SEQ ID NO: 4253 - DNA, 312 bp, Mus musculus
  misc_feature (231)..(231): n is a, c, g, or t
  misc_feature (263)..(263): n is a, c, g, or t
ttctcatccctgaaactggaagcttcacttatcatttacaaacaggttccaacattcctctttttgtgtctggtgccagaactggtttggaagctgttaacatggctgttttgcttgctgcacaattcggtttccatctgtgcttatttacagacaaaattcaatgttgggagatgcttctcaaggttcaatctcagaccttttactttcgttggtttggttttggtgccnccgaacggtgtcaggtgagcaccgtgagtccnctcttctccccttgtgttttcccctcgtctctgcggatactgtacagca

SEQ ID NO: 4254 - DNA, 578 bp, Mus musculus
  misc_feature (158)..(158): n is a, c, g, or t
  misc_feature (169)..(169): n is a, c, g, or t
  misc_feature (261)..(261): n is a, c, g, or t
  misc_feature (296)..(296): n is a, c, g, or t
  misc_feature (313)..(313): n is a, c, g, or t
  misc_feature (322)..(322): n is a, c, g, or t
  misc_feature (329)..(329): n is a, c, g, or t
  misc_feature (334)..(335): n is a, c, g, or t
  misc_feature (387)..(387): n is a, c, g, or t
  misc_feature (410)..(410): n is a, c, g, or t
  misc_feature (429)..(429): n is a, c, g, or t
  misc_feature (502)..(502): n is a, c, g, or t
  misc_feature (519)..(519): n is a, c, g, or t
  misc_feature (550)..(550): n is a, c, g, or t
  misc_feature (552)..(552): n is a, c, g, or t
attcatctgtatacaatgcctttgatgagtgttctatcacccacaattccagtgtcttggccctctctctgcctgatcgtcccagtcgtgtaggagttttcctggaccaggaagtttgcactctctcattttatgatgtttctaactctggagctctncatctataganttctatgacccttccttccctgttgaagtctatccatattttaatcctatggaatgttcagagccaatgacagtatgcggaccaccatcctnaaccctcacctatacctgtgcagtgcccccatgtntccgctgcatcattctnacttttttntcttggnccctnnattgtaatgaccttcacttctaatcccaaaccactgtggattcatttccttnatccagtagcttgtctgctcacnagatgattactgtcatttntcatttccaatatttccccccccccaaaaaaatagctgttccctcactaagtgaaatagagcccctgataatnccatctctgtaggaacncagtcaaaagaatgactcacagtgaacaatntnttagttacctgtgagagaggccccag

SEQ ID NO: 4255 - DNA, 437 bp, Mus musculus
  misc_feature (114)..(114): n is a, c, g, or t
  misc_feature (139)..(139): n is a, c, g, or t
  misc_feature (156)..(156): n is a, c, g, or t
  misc_feature (217)..(217): n is a, c, g, or t
  misc_feature (219)..(219): n is a, c, g, or t
  misc_feature (316)..(316): n is a, c, g, or t
  misc_feature (359)..(359): n is a, c, g, or t
  misc_feature (370)..(370): n is a, c, g, or t
ggttctcccgagttctcccaggtcactgcctggattagttaaggggttcctggatccttcctggaaaagcctgacagcccagtctggacccgaagttatgctgccttggaagtnccgcggggagtcaggcttcaagaanagaaaaacgaaagtgantctcagcacactgagcaggaagccagccagccatgccaattctgccctccactcctccacncntgccttgtgcggttccccagcgtggttagcattatgggtttcaggggcacttgctgggaatccagatctgcctggagtggagtgagaggcagggagncaaaggattaacactggagaacatgggaagggtgtgtccactntccccttcctnacctgaggatctattcccccagtggtctcattgtaacctttaggaagtgttctcaaactgcattggg

SEQ ID NO: 4256 - DNA, 301 bp, Mus musculus
gtcccaaactctcgtgtttcaatggaaagactgatttatgtctcaaaagacaagagtctcaaaggctgtgggtaagctgaaggcttgcctccctgacagatgcttagactacaggcttcttgggacaggtggccccttcctaagctcacaggagtggccaccactcttgaccttcactctgtctatagtcccgcctcatcctggatcttgtactgagcggcagctaaaagtgttctacccagtgccctgtcactctagactggaaggtatggggcctgatgcaaggctgaccacaccaaca

SEQ ID NO: 4257 - DNA, 545 bp, Mus musculus
taggatggttatcagcctccttggcttgtaaatgccttaactcattaaattctaccagcacagacatccttctcaccctgtgtgaaacccaactgtctaggagacactgctaaatgtttccatgggaatatagagaagagaaattacccccctccagttgaaattgcagtacaaaatccactttttttgtttttatttctctttaaattctgttctaggcaacagaaagaaattcctggtctagaatgcaaaatgactttgtcatggctaaagaaaacatagttatagggaaattctgggtataaccctgtatgcatttatttacactcgaacagttccattagtttaactaagtatcaaaccagcttgcaaaactatgcctgtatatgcatagtccagaaagagctggaattattgcggtggttgaatatagcgcaggtgaatagctcactttcatttgtcagcaaccttcgtggtaccaggctttaggtagacagacaagtccctcagcttcatgaccagatgaccgaggagagctcttacat

SEQ ID NO: 4258 - DNA, 551 bp, Mus musculus
  misc_feature (48)..(48): n is a, c, g, or t
  misc_feature (100)..(100): n is a, c, g, or t
  misc_feature (316)..(316): n is a, c, g, or t
  misc_feature (368)..(368): n is a, c, g, or t
  misc_feature (378)..(378): n is a, c, g, or t
  misc_feature (381)..(381): n is a, c, g, or t
  misc_feature (421)..(421): n is a, c, g, or t
  misc_feature (427)..(427): n is a, c, g, or t
  misc_feature (430)..(430): n is a, c, g, or t
  misc_feature (465)..(465): n is a, c, g, or t
cagcaggctgctgtgtacccagggagggcattcttgggagatgtttcncactcccccaagcacttgcacctcctctcctgcctaagcagccccccaccangggaaagttcctcaacaagacagcaagaaatggggctccctatgccctgtgccagcccaggctccaagaatgagcagcaagtggccaggctgccctcttcctctgtaggagctcgtgtatatgtaatctacacagtgggaagagaagtgcatggcggggagtgggggggagatgcctgtctcgggagggacacacacctgggagctggggtatcangcaaggcaaatggagcccctgctggaatttgagaactttctggtgagctgancccacaccanctncccccatttgggggttaagggaccctgaattcttcctctncctccnccnatgtgtgtgtgtgcacagagactgtctgactttgntccctttcccctctctggttctccacttcttccctgacaccaagatggcgggacatcattttctttcctgttgtaacactcaggag

SEQ ID NO: 4259 - DNA, 451 bp, Mus musculus
  misc_feature (388)..(388): n is a, c, g, or t
  misc_feature (411)..(411): n is a, c, g, or t
  misc_feature (418)..(418): n is a, c, g, or t
ctggttcatcgctgcagggtcagatgcaggccgcagcttgtactatgctgatgaagttggcttttcaaacagacatcaccacattcttatcagttacactttgggggagcttcctatcaccccctgttgccagggggtctttcaagtttgagtcagtccatccagagagggacgagtaagttcaggcactgtggggcattggtgaggtcatatggagaacgaacacctatagaactgttgaacaaccatgcaagtcttccctgtccttggctatcactggctacctttttaagtgtataccagagccgtacactccaatggttagtaagtcataacttctcttcagatttttttcccaatagtgtaactattgagggtcagggtcagntcttctgatggttacgaagctancctttcnatcctggggagcttgcaggaactccgaggctaa

SEQ ID NO: 4260 - DNA, 44 bp, Mus musculus
cacactggtgtgtctgatttccaacttttccccgagtggtgtga

SEQ ID NO: 4261 - DNA, 186 bp, Mus musculus
  misc_feature (83)..(83): n is a, c, g, or t
ggcaaatggtacacctatcacccagggtgtggacacttcaaatcccaccaaagagggcaacaagttcatggccagcagcttcntacatttgacatcggaccagtggagatctcacaacagttttacctgtcaagttacacatgaaggggacactgtggagaagagtctgtctcctgcagaatgtct

SEQ ID NO: 4262 - DNA, 529 bp, Mus musculus
agatgaagcgtctcacgggcccaggacttagcaaggggccagagccaagaatcagcgtgatgatttctgggggtccctggcccaataggctctccaagacgtgtttccactacctgggtgagtttggagaggaccagatctatgaagcctaccgccaaggccaagcgaatctggaggcgctgctctgtgggggcacccatgggccctgctcacaggagatcctggcccagagagaagagctttagtccaacctgctgcacttctggatcttctctaattttattattattaatggctgattagaggcaggctctcatcatgtaggccaggctggccttaaacttgtcatcctgctcagcctcgaaagtgctgcatttaagtcctgagcctttttgtgcttgaccctcctatataattttttcaactgtggtggtggggaggggacagggaagcctgactctagctgtcaatcttctccctccacctctcgatggggtactgggactgaggctgcctttctactttcaaa

SEQ ID NO: 4263 - DNA, 305 bp, Mus musculus
  misc_feature (32)..(32): n is a, c, g, or t
  misc_feature (38)..(38): n is a, c, g, or t
  misc_feature (45)..(45): n is a, c, g, or t
  misc_feature (50)..(50): n is a, c, g, or t
  misc_feature (53)..(53): n is a, c, g, or t
  misc_feature (58)..(58): n is a, c, g, or t
  misc_feature (68)..(68): n is a, c, g, or t
  misc_feature (94)..(94): n is a, c, g, or t
  misc_feature (104)..(104): n is a, c, g, or t
  misc_feature (133)..(133): n is a, c, g, or t
  misc_feature (144)..(144): n is a, c, g, or t
  misc_feature (168)..(168): n is a, c, g, or t
  misc_feature (170)..(170): n is a, c, g, or t
  misc_feature (185)..(185): n is a, c, g, or t
  misc_feature (188)..(188): n is a, c, g, or t
  misc_feature (213)..(213): n is a, c, g, or t
  misc_feature (218)..(218): n is a, c, g, or t
  misc_feature (227)..(227): n is a, c, g, or t
ttatcttatctgcactggccagaatactcagnctgtgncctcaancccantgngaccncctgtgtatngaggatgagcactgtagcaccccatncctggtactnccttcctgtgggttgacttgctatctaantctccattttntcctgtgtccaatagtagttgctncnaaacctacctcccanctnccttgtgtgtatgtaacaaatcatntcctnccctgggancaaagtgctgtgcactgcccagagttaggagacgtggacagttagacctttccactttctctcatcactgaggtaata

SEQ ID NO: 4264 - DNA, 435 bp, Mus musculus
  misc_feature (28)..(28): n is a, c, g, or t
  misc_feature (86)..(86): n is a, c, g, or t
  misc_feature (281)..(281): n is a, c, g, or t
  misc_feature (286)..(286): n is a, c, g, or t
  misc_feature (314)..(314): n is a, c, g, or t
  misc_feature (349)..(349): n is a, c, g, or t
  misc_feature (407)..(407): n is a, c, g, or t
cacagcgccgggatgcctcgcagaggcngcgctcgcagaacaacgtctacagcgcctgcccccggcgcgcacggggaccagacagncttgggtccagcggaggctccgctcctcaacgccccagcctcagcgtcccccgcttctccgcaggtacttgaagctccttggccccacaccccatctctgaagatgagctgtgaatacgtgagcttgggctaccagcctgctgtcaacctggaagaccctgattcagatgattacatcaatattcctgacccatntcatntccctagctatgccccagggcccagatnttcatgccaatgagttctgcctgtttgctgatgtntagcacgttttccttataggatccctgtcatggcgtatgtcctataccctaagtcgantctcacctgactatctgaatgccttgag

SEQ ID NO: 4265 - DNA, 446 bp, Mus musculus
  misc_feature (94)..(94): n is a, c, g, or t
  misc_feature (232)..(232): n is a, c, g, or t
  misc_feature (234)..(238): n is a, c, g, or t
  misc_feature (240)..(243): n is a, c, g, or t
  misc_feature (344)..(344): n is a, c, g, or t
aagaaggaccaagccgctgaacaatttatcctgcaattttttgggtcaagctttattgtacaatgctcataggcagaaaaaaatttcttttttnaatagaatgagtgttatttttctgggttgtttgtttgttgttttttgacagggtctgatttggtcagggtgggctcagcgtcgctatgtaaccaagagtggttatcaactcttattaaatcctgttatcatctcttanannnnnannnntgctcagtccctagcttccctaccctcctactgtgtgaggttcatgttcccaaagcaggaaagggggagggtcactgggggccaggaggctggagagattntgaggactcacaatcatctttcactccagcctaaagccaccaggcaagcagccaccagcaggcaccaggcacatactggctacacacaagccacgtggagat

SEQ ID NO: 4266 - DNA, 332 bp, Mus musculus
  misc_feature (40)..(40): n is a, c, g, or t
  misc_feature (204)..(204): n is a, c, g, or t
  misc_feature (217)..(217): n is a, c, g, or t
tacagtcagactttggttgtgaaaatcatttcctgttctnggttttgggtagtcacatgggtgccattggtaaaatgctcaagactagaaagaaaggacactggtaatactgcctgtccagtcgtcacaagctcttctccctacatgccactgttgacgctaacagaaggagaggtgacaggatatgaatggtgaacccttctntctgctaccagtntcctgggaaaatcaaaagctttaatgcctattgcaagctaaaatctgctgtaattggatgagatctgccaagatgaataggatgggctacacttgctccacaatttttgaagaat

SEQ ID NO: 4267 - DNA, 538 bp, Mus musculus
  misc_feature (93)..(95): n is a, c, g, or t
  misc_feature (171)..(171): n is a, c, g, or t
  misc_feature (173)..(179): n is a, c, g, or t
  misc_feature (189)..(189): n is a, c, g, or t
  misc_feature (230)..(231): n is a, c, g, or t
  misc_feature (237)..(238): n is a, c, g, or t
  misc_feature (252)..(252): n is a, c, g, or t
  misc_feature (258)..(258): n is a, c, g, or t
  misc_feature (265)..(265): n is a, c, g, or t
  misc_feature (269)..(269): n is a, c, g, or t
  misc_feature (271)..(276): n is a, c, g, or t
  misc_feature (280)..(290): n is a, c, g, or t
  misc_feature (293)..(293): n is a, c, g, or t
  misc_feature (296)..(296): n is a, c, g, or t
  misc_feature (307)..(307): n is a, c, g, or t
  misc_feature (332)..(332): n is a, c, g, or t
  misc_feature (336)..(336): n is a, c, g, or t
  misc_feature (338)..(339): n is a, c, g, or t
  misc_feature (372)..(372): n is a, c, g, or t
  misc_feature (393)..(393): n is a, c, g, or t
  misc_feature (403)..(403): n is a, c, g, or t
  misc_feature (451)..(451): n is a, c, g, or t
  misc_feature (454)..(455): n is a, c, g, or t
  misc_feature (485)..(485): n is a, c, g, or t
aaatccacatggagggtcaacgtgacatgggtaccttaattaaggatcttaacccagtgtttaaacctgacagtatttccctcactcagctcnnnaaaagtaaaaatattcaatacattccatggtgagagataagataggctgtcggttcaacagctgactactgtgctntnnnnnnnactcaaatcnactgatatgaatgataactgcaatgagctgggtaaatactnncacaannagtagttagctgtncgaaangaaagantgancnnnnnntttnnnnnnnnnnnttnttnttgttgttgtngttgttgttgttgttgttgttgttnttancnntcattatttattatcctgaagaggcagagatgnccctaagaaccaaagcacggncatcacgttncacacatctgggatccatatccatgaactttgtaataatcagtgtttnttnnttcgtgggtgataaaggaaaaggaaagacnaaatgatctttcaatgagaagagtatttgtagtgactgacactgggtccaaat

SEQ ID NO: 4268 - DNA, 526 bp, Mus musculus
  misc_feature (139)..(139): n is a, c, g, or t
  misc_feature (313)..(313): n is a, c, g, or t
  misc_feature (319)..(319): n is a, c, g, or t
  misc_feature (334)..(334): n is a, c, g, or t
  misc_feature (423)..(423): n is a, c, g, or t
  misc_feature (483)..(483): n is a, c, g, or t
gttgttttgtggctaggtgacttttcacactgggcttgaacactgtcagtgatggtgaaatccttgccacagctttgggagtctcttgcagtctcccagcagtagagggagttagaaatatccagaggggaaaaaaaantctctcttttcagacagtatctgctttattggtggtagctgaacttcatttatacagagctcctttaacctgtctgtcttcttcttggtatctaagctgccttttgtttttgtttttgtttttgtttttatgatattaacttcttttcacattcaagtttctttaaagttgacnatagtnccttctgaactcttncagagagtttggattttggaagctgccaggtacccatcacagcaggggtgccagtgacaaggatggtgtacaaatgaaacactgaagcnatccaaataaattcctctaagtgtaattcattttactgcagcacaggaagaacaaatttntcttacaactttaataattagtaccattatgaaccctaggaga

SEQ ID NO: 4269 - DNA, 461 bp, Mus musculus
  misc_feature (27)..(27): n is a, c, g, or t
aagtgggccaagaatcttgccctgagncgagagctggatgtcagtgttgctctgagtggcaagcccagcaaggcaagtcctgctgtgacagctctggccatcactaggaaccagagcaagctcttggttggcgatgagaaggggcgaatcttctgctggtctgctgatgggtaggagacaaggagctggagggaccgacctgaaagcctggagccctggggtcggcagcaacaggctacaggcacaagatgatgtgtagcctgggctgcttaaccagagcaagttttgggggggctccactccacacagttctcaaggagtccctgatggtttgcaccgtgtaccctaaacatgtctgtagtctatgggacttctgtaagaaggatcttggtagacactgatgctggaaactgacgctgcatgggaaatttctacgtggctcacttcaccaaggcttattg

SEQ ID NO: 4270 - DNA, 474 bp, Mus musculus
caggtccctggctcggaattggaaagctgaaccagatgccccttctaggagctcacccctggacactcacttccctaaaccaaagaagaagcaaaaggacccacatttcacgtaccctggttgcccagatcccacatcatcctctcaggtcccagtctctgagaataacccggaagaactccactatgctgctctcaacttctcccgcctgagactgcaggagacccaggatccccaagacacctattctgattacacagaggtcagagtccactgagggtgtcctggggcttaggactgagacctaaatggtaaagtagttaagggagcctccaaaagaaagcagatgctctccttaaaaataatcctgggggtagggggtgttaaatatgtgtgccaccaagcttgatgaactcttagattgatcccgaggacccgcatcgtggaagggacctcccacaaactgacctttga

SEQ ID NO: 4271 - DNA, 335 bp, Mus musculus
  misc_feature (104)..(109): n is a, c, g, or t
  misc_feature (111)..(111): n is a, c, g, or t
  misc_feature (116)..(116): n is a, c, g, or t
agtgatatatcctgtagctccaatacttggaaggatgaggcaggagggatgcttgagggagacctcagctagtcagtcaccagagaactttaaaacactattgnnnnnngnttaantagacccctacaaaacaggggaatctttgctgttgttttgaccttaaattgaatattgacctgcctctcccttctgagtactaggattgtaggcatatgtcaccacacctcacctaatgtaaaatatttagatttcagagaggaggggagcatcatgctgggattgaacccagggtctcatacaagttatggttggtgttagctctctaccactaagtt

SEQ ID NO: 4272 - DNA, 509 bp, Mus musculus
ctttcagaattgtctccggctttaaaaggaaaatacttcgctctactctgtttaaaacaatcttttaaaaacgttgtgtgtacatgtatatttgggtatgcatgtatgtgtgtatatggtgtatgtgcgtggtgtacacacatgtgtatgcaggagccagaagagaaagtcaggcacccttttctattgcactccactttattctgttaagggaaggtctctcattgaacctggagctctgctagcaagcagcaagccagcgatggatcctcccatccctgacccccacattgctagactatatttgctcatgcccagctttttacaaggatgtggagaactgaaattcaggtcctcatgattgcataacaagcactctcacttactaagcatgttctaatatgttttacaatgaaagacgctgctcaagatttcacctcaatgaatgatcaattctgtttgtaccttgtttgccaatcacatagcatttatgctcttattcctactta

SEQ ID NO: 4273 - DNA, 483 bp, Mus musculus
  misc_feature (59)..(60): n is a, c, g, or t
acacctgtctttgggtccctgtttgcaggggtctttgctgtaagtgcacacgtgccttnntttatgttctttctggttccttctgtgtctaaagccttgagtgagagacttggagttttctagaacacatgatctctctacagagttcagtcttgatgtgttctatggacctggagtcaatggacattgtatcatttcttcacctatttgtgctctgtcaggcactccatgatccaccaagtcatgaactggatctggtctgtcctatcccctggcctcactcacatgatggcagacatagaatgtggcagatcaaatgtcccttggtctctgttcattgcagcaaagaaaaccactaacatcttgagtgtgttgcagtggcaatgttcaacatcagcctgtcaatactttccaaagtgaccactctagagaaacaaacaggagtggcctccatgttaagatgtgaatgccaaagtgccttgc

SEQ ID NO: 4274 - DNA, 554 bp, Mus musculus
  misc_feature (193)..(193): n is a, c, g, or t
  misc_feature (243)..(243): n is a, c, g, or t
  misc_feature (489)..(491): n is a, c, g, or t
tgatgcaagtgcacctccaatctatgccttacgaactccagaggccatatgcaaaacagggtcttctcagtgtatgcaaggggctgcggcccctcctctcctccccagctgaacaatacggacagttttcacacatatctacctgtataaccctccgtacctctcataactggtcaacgactgtaacaggttnacatcaggtgtttttctacatactttttacacagattctatgcgattaantgtaacttaattcagcgcatcattgtacaagttcttacgcttggccttatttttttcctaagtgattgtggtttttcttgtggttttttcttgtggtttttcttgtaaagatattgagatggctgttgatgcttattctctgtaactaagaatttttacctttttgggaaaaagcattgctatggattaatgaattgagacttcatttactcgttgtaaatacactattgtgcaaaaaaaaaaaannngtttcattcaattgaattgctagtgtttactgaattttgtctagacgccatttctgttgatga

SEQ ID NO: 4275 - DNA, 452 bp, Mus musculus
  misc_feature (328)..(328): n is a, c, g, or t
  misc_feature (352)..(352): n is a, c, g, or t
  misc_feature (377)..(377): n is a, c, g, or t
  misc_feature (381)..(381): n is a, c, g, or t
gcaggagatcctgagccagctcaaggctcagtctcaggtgttcggttggattctgatagctgccgttattatcttacttcttcttgttaagtctgtgacccgatgcttctctccggttagttatctgcagttaaaattctgggaaatctattgggaaaaggagaagcagattcttcaaaatcaagctgcagagaatgcgacacagttggccgaagagaatgttagatgtttctttgagtgctcgaagccgaaggaatgcaacactccaagcagtaaagactggcaggaaatctcagcgttgtacacattcaatcccaagaaccagttntacagcatgctgcacaagtatgtnagcagagaagaaatgagcggcagtntccnctctgtggaaggagatgcagtgatccctgcccttggctttgtagatgacatgtccatgactaacactcacg

SEQ ID NO: 4276 - DNA, 524 bp, Mus musculus
  misc_feature (288)..(288): n is a, c, g, or t
  misc_feature (290)..(290): n is a, c, g, or t
  misc_feature (292)..(292): n is a, c, g, or t
  misc_feature (319)..(319): n is a, c, g, or t
  misc_feature (328)..(328): n is a, c, g, or t
  misc_feature (343)..(343): n is a, c, g, or t
  misc_feature (360)..(360): n is a, c, g, or t
  misc_feature (395)..(395): n is a, c, g, or t
  misc_feature (397)..(397): n is a, c, g, or t
  misc_feature (437)..(437): n is a, c, g, or t
atggccagagacagaattacccttctgtttcttttacacaccaaagtatcctgattcccctgggagtagagagaaagatatgaaccaatagggagagtcaggccattctactggtattcatccaactgtcatttgaagggaggaggcatgaattcagagacctattctcctatgatgatggtggctaacacttctagttccagtctgtaagctgaaaaagaagaacacatttatttactgacagaaatgatctgctccagccaaactttgaactgaattctaagaaangntntacatgataatacatatcctgcttagnatccatttnttctttggcttaaanacctatacaaatagatnttatgtgcatagacaataacttgtttttttttttntnaattgcagcattttcatcaccactagtaccagcatcaccntcttcctaaaatataaattttagaaactgtaatccccaaataactgggttaagagtaaaatcacatccgatattttatgggcatcca

SEQ ID NO: 4277 - DNA, 431 bp, Mus musculus
atgcgctcatcttgttttgacttcatattgcattgcatagttttagttctgatcacaaattttgctattgtatgaagattttgaagggactagacgaagggagagctcagattctccttatgttcctgctatgctcttgttcgcttagcatccttagagcactcaaggctggttctggtaaataaggccttcctagatgtgcacatggtaccaggagaattgttgccctgggacaaaggtccagacagaccttcgtgttgcaccctaggcattaggtcattcattcaacatacatttgtttggtataattaatgagtcaattttaactatttgtggcaaagtttgatctcagttacaaggactctgaaaacaccgtgttctaacaaaagtggtaatgagtctgtttgttgctacaagaatccttctccagt

SEQ ID NO: 4278 - DNA, 430 bp, Mus musculus
  misc_feature (273)..(274): n is a, c, g, or t
  misc_feature (305)..(305): n is a, c, g, or t
  misc_feature (315)..(315): n is a, c, g, or t
  misc_feature (318)..(318): n is a, c, g, or t
  misc_feature (330)..(330): n is a, c, g, or t
agatctctctgcacttcacggtgtgcctgatgaacttcaactgctgcatggacccgttcatatacttctttgcatgcaaagggtataagagaaaggtcatgaagatgctcaaacgtcaagtgagtgtgtcgatctccagcgcagtgaggtcagcccctgaagagaattcgcgggaaatgacagagtctcagatgatgatccactccaaggcctccaatggaaggtaaaggcacttgggacttcacagcacagcaagctgcgggatgggccccnncccaccgactggtcggctcccaaccaggatnccttccactnccnccccaccggccnatgcactgagatccagaccagatcgaggagacaaaaaagcaagttcaacttcataaatgaaatataatgtatataaaggaaggctctcataagtctcaat

SEQ ID NO: 4279 - DNA, 376 bp, Mus musculus
  misc_feature (30)..(30): n is a, c, g, or t
  misc_feature (33)..(33): n is a, c, g, or t
  misc_feature (48)..(48): n is a, c, g, or t
  misc_feature (50)..(50): n is a, c, g, or t
  misc_feature (66)..(66): n is a, c, g, or t
  misc_feature (77)..(77): n is a, c, g, or t
  misc_feature (279)..(279): n is a, c, g, or t
gtgtggttcatgcattgtctttgatatccnagncggagctcagcttananctttccaagcgccagngcacagcgttntagggaatggtgctccttggctgggtgagctgccaggcaagtttaaatatgctgtgtgtgccacatttttaaattttgtcaaggtttacccacacacacaccaatcaaaaccttattggtctggaagttgggattccgtttttggtagatcgtggtagatctggtactcctaactccctggtcctcaggcggctcctctgtnaaatgagaaaatgtatatttttttacttcatgagatctttgctggaaattaatgagaagggtcagtgtttgtgacttatgggcttattttacagaca

SEQ ID NO: 4280 - DNA, 434 bp, Mus musculus
  misc_feature (59)..(59): n is a, c, g, or t
  misc_feature (310)..(310): n is a, c, g, or t
  misc_feature (343)..(343): n is a, c, g, or t
aatgccccagtgtttacagttagtaatctggcatctcacagtttgccagataggagctnagcaatctcaggactagttcaaaatagtaaacttagaatcctcattacagtcacttatggcagactacattgcatttttgaagaaagttgagttctattgaccaatggagatttccctacagacacttaaaagagcagcctggttactcccatatgcaagaatttacaatggcctaggaagaaggagggttgtggtttaaggaggaactacagtattgcattattcatgaaaaggtcagcaagagcagaancccctctggtgcaagctttcacaaggctcagangaaatagcataaattgtgactagggtgtgaaatcctcacctggctcctgtcaatagctgcctttagataggtctgatcttatctcaattgt

SEQ ID NO: 4281 - DNA, 457 bp, Mus musculus
ttttaccacaacttttgccaccagagcacctcattctcccatcttgaaaattaaagaaaaaaaatcagcaaagttaaatgcagaatagcaaaattaaggacccaaactatataggttattcttcctattcttcctccttcaactaagaacgttttgcatatttgctctttaaatgaccatcttctgtctgcctttctcacattcagagccataatgttcttgtgatgccatgttttcagatagcttcttttatttactgcctatttgcatgtacctttgaaatgtacttttattcgcagttttcgttagttgatggtgttttgtatttgggtgataagcaagcactctaccagtgcccaagtcttcagccctctacacggattcctgaagtcatgttaattctatcaattaatgacgtgcacagtaatatttcagaacatggatgcctcgcacattg

SEQ ID NO: 4282 - DNA, 307 bp, Mus musculus
  misc_feature (227)..(227): n is a, c, g, or t
acatctgtccagagacttggcagtggaggtagggtgggggtgggaatcaagccatagctttcttagggaagcactggccaaaggaaggggactcctagagttgtaaccttcctcacagaagacaagaaaatgagttggggtatcagcctcaggctagacagagagccagaacctcttcacagattcccagatcaccggagaagtcactattgaatccggacacccantcaggcacaagaggtctacattctctaactcctttccagtgcttccccaacggtcacttacttccagactgcgtgtttta

SEQ ID NO: 4283 - DNA, 546 bp, Mus musculus
  misc_feature (76)..(76): n is a, c, g, or t
  misc_feature (253)..(253): n is a, c, g, or t
  misc_feature (259)..(259): n is a, c, g, or t
  misc_feature (285)..(285): n is a, c, g, or t
  misc_feature (288)..(289): n is a, c, g, or t
  misc_feature (295)..(295): n is a, c, g, or t
  misc_feature (298)..(298): n is a, c, g, or t
  misc_feature (498)..(498): n is a, c, g, or t
gcaagattgctgttagctctcaggccaactgaagaaagttagcgacactatgttatggggatgttggggataaaanggcacatagcacttagagtggaagcatgacgtgatagaaagtaatcagggtcacaaactccagctggctaccaagcagctgtggccccgggcaggccaaaaggaggatcaggctggggtagtgggagatttccagcttgagaagagctggtgagggtgtagaacgacaggagccctnttgatnctggtggattacagatcagatacctnccnnttgganccntccatctcacccttaggatgtgaaactactttcaatgtgtacaaataagttagtctattgtagataaggaggggcaggttccctttaagctgtttttactttattaacctgagtgatatatggtcactttctttttttttaaacttttgattctctgtgaatttcacatcatgtaccccaatctcattcatctccccatncctttctatctgccctccacccttgcaatctccctcagcaaaagaaaa

SEQ ID NO: 4284 - DNA, 490 bp, Mus musculus
  misc_feature (352)..(352): n is a, c, g, or t
  misc_feature (373)..(373): n is a, c, g, or t
  misc_feature (463)..(463): n is a, c, g, or t
tctgtttcccaagtgagctactcacaaggcccatgcctgtccactctactcacgttcacaagctcaccttcttggtttgctctagatttcctaaaatgagggggaaactaacttaaaggctaacacggggagccaagaaaggctgtgtgctgcggaccacaaaccgagaaagtccagaagttaaaggggggaaaaaagtgttttaaacaagaccaaaacctccccaaactgacccttcatgcacatcatgctgacttcatgcacatcagagctgaccaccaggggtcagtattgtgctggtttacccagtgatgcaatttcatctgcacaaagtctgcttatacaaagaggnatggttggctgatgggagganccggggagaatcccttagggaacaaaaagaatgtcacatctgtaaaacaagaagagtccagagtgacgttcaggagagcctggatactgncatacgctactaacaacatgctgaatg

SEQ ID NO: 4285 - DNA, 501 bp, Mus musculus
  misc_feature (131)..(131): n is a, c, g, or t
tgttcatcatgatcgggtgctacgtggtcatcattcacagtctcctccgagggcagacgtctaagctgaagcccaaggtcaaggagaagtccatacggatcatcatgaccctcctgctgcaggtgctcgtntgcttcgtgcccttccacatctgctttgccgtcctgatgctacaaggacaggagaacagctatagcccctggggagccttcaccaccttcctcatgaacctcagcacctgtctcgatgtagtcctctactacatcgtttccaaacagttccaggctcgagtcatcagcgtcatgctgtaccgcaattaccttcgcagtgttcgcagaaaaagtgtccgatcgggcagtttacggtcacttagcaacatgaacagtgagatgctttgagtcagagcaagctgccagtcttcagtctctttaaaattcttttcctatctactttcgggtgaaccagcattctacactatccagtcccttctctaacaaagag

SEQ ID NO: 4286 - DNA, 322 bp, Mus musculus
  misc_feature (70)..(70): n is a, c, g, or t
tgctttcatgtctctatttccatccccaaatgcaaagaaaccgcgctggctggtctacgtcaacttgacnacgagctggtgtcatctaagagagggaacctcgattgaggaaacacctcagtggttaagagcaccagctgcttttctgaggactggtgttcgatttccagcatccacatttgcctgtaactccggttttagggcatctgacaccctcacacaggcatatatgcagacagaagatcaatgcacataaattaaaatacacactgaaaaaaatttaaaaagagaggatatgcctccataagatcttggtgattaa

SEQ ID NO: 4287 - DNA, 551 bp, Mus musculus
gagatacctgctggttacccataagttatttttattatttctgcatgcttaggatcatcatgcaattctggtaattgttggagttcataggcatcatatctgtgtatggctgttggttagctccctcctttggattcatacatggcacctaaattgatataatttactttcaaaatgttctgaccatagatttcttgcattcctttcttccttgtttttggttttgttcaagaagaactggttaatatctcataagtggtctatgtgaaagcaaagctccttgctgttgttaccgattggcctctgagactgaatcagataaaaacaaagctcaagaactggtaggatgttttgaagtttctgtttaaccagagccatctccaaacttgatctcaatggtgctgcaattgcagattaaaggaaagagagatcaaactaggaacctacaagatagttcactagcctaagatctttacttggagtaattaaatattgtttggttctggctcccaccctggcttctgggatgtgccccagatcactgtggttta

SEQ ID NO: 4288 - DNA, 462 bp, Mus musculus
gaacagcgtatgtaccacacagtgattattctgatatattttgatgctttaaaacccacattttttcctctaaattattacctgaaattactatttatgattcaaaccatctgccctaactattcatatatacaacagtggtgttggagccgggcatagtaggtacacacctgtaatcccaacactctggaagcttaggacttcagggttatcctctcctacatagtgaatcccaactaaaggctagcctaggctgcatgagagctttcttcaaaagtcaaacaaacaaacaaggtttaaaactcaatgaataaatccagtaatgaaaatatcttttcacattgtgtggtaatggtgttttcccttaataacaatgaaaggtttggctttgatggcctgacttactgctcaaggagaaaaaccagcttgacagaatgacattgtcttcaagtgtgtttacct

SEQ ID NO: 4289 - DNA, 513 bp, Mus musculus
  misc_feature (81)..(81): n is a, c, g, or t
  misc_feature (84)..(84): n is a, c, g, or t
  misc_feature (153)..(153): n is a, c, g, or t
  misc_feature (161)..(161): n is a, c, g, or t
  misc_feature (187)..(187): n is a, c, g, or t
  misc_feature (251)..(251): n is a, c, g, or t
  misc_feature (278)..(278): n is a, c, g, or t
  misc_feature (305)..(305): n is a, c, g, or t
  misc_feature (338)..(338): n is a, c, g, or t
  misc_feature (341)..(341): n is a, c, g, or t
actgagcatgcttcattcaatacagcatcattttgtctttgtagaagatatttcttattaaccttttattgtttgagaatnttntacatgagtattatgtgttttgatcaaatccacccccattcactcccttctaatttttcctttctcctnatcacatntacctcccaacttcatatgcgttttngctttaattcactaagtcaatgtagttctgctaggattacatgggggcaggtccatctgccctnaggagcacattcttgaagaacatggantttccctctgcctcagccgtcaactcntcctcagctaaggttgacacttcacaaatcccnccnacccatgctgggagtgtggaatgcttgatcttggacatttagaagcgttctaactgacttttagcttgttttgcaataaattacagtttagttggtagtggattttctggtgtattttcattgtctgaagggatactattttgtcttgaatggtctcaacatttgttctaca

SEQ ID NO: 4290 - DNA, 114 bp, Mus musculus
  misc_feature (75)..(75): n is a, c, g, or t
gtcaaatttaatactgcatttatagcttcagattaaaaaattccactttcctatgcttactttcccatttcatcnaaatacctattatatgctgatagtcacatgattaacatg

SEQ ID NO: 4291 - DNA, 493 bp, Mus musculus
tttctgaaccccttattattcttatttatccaccatgtgtgacaaaagaacttcccagaactcccattctgtgtattatatcccagactaacttacttaacctttttgagtaaaaataataagcatgcctcttggtgtcatataatttgcaaaatattcaaaatgattttttaataacaggttaatacttgcatgctcataaactcatgggtagaagctcacttttgtgttatttctagaagctcacttttgtgttatttcttacagtattaaaagactggaagaggagaaatatactttaattttgatttaagaccagaaattgtttaagtttagagattcattgcaatcctaaaactagaaatatgacttaatgtctcaatgtccttggggataagatattgtgtcaagatgaaagaaatgtgtgacaattcagaaatactttacaaatgattacttggtttgtttgtttcatgggatcacagcaacatca

SEQ ID NO: 4292 - DNA, 296 bp, Mus musculus
  misc_feature (64)..(64): n is a, c, g, or t
gctgacgctcagctctaagagagagaaagagagagaaagagagagagacttactctgcaggccnaatgcggccactccatacaacatggcttccaagaacagtcgagagcagagtcttgacccacccacacccatcctggaggacagtggataaagacctggagtggcctccctgggccaagggtatgaacgcttctggctttgtaacttatgtattcaacaaagcatcatagatggtgttcctgctaaaatttgtacactcaggttctgagctagcctaccctaccataataaga

SEQ ID NO: 4293 - DNA, 564 bp, Mus musculus
  misc_feature (121)..(121): n is a, c, g, or t
  misc_feature (123)..(125): n is a, c, g, or t
  misc_feature (152)..(152): n is a, c, g, or t
  misc_feature (183)..(183): n is a, c, g, or t
  misc_feature (186)..(187): n is a, c, g, or t
  misc_feature (213)..(213): n is a, c, g, or t
  misc_feature (216)..(217): n is a, c, g, or t
  misc_feature (226)..(226): n is a, c, g, or t
  misc_feature (462)..(462): n is a, c, g, or t
gtgcctcagatcatgaatgaccacaaagaatgttggaatgtactttcagacaatttgatgtcactgtagatgaagaagaaaaattgtcaaatgaaagaaggagagaaagaaagaaagaaanannnaaagaaagaagagaaaaagaaaggaanacatattatatatactatatacatatatacnacnnatatatacatatataatagatgtatnacnnatatatatnacaaatatatacatatataatagatatataaatgtgtcagtacatacttgtcttattttacttctattaatgtgataacacactgatgaaaaacttacaatccctatcatagcccatcatgaagggacatcaggcaggaacagaagcagaggccacactgcttactgacctataccttacggcttgctcaaccagtgtttttatacaatccaagacttccagcccaggggtggcantgcccatggcagactggacccgcacacatcaaccatgagaatatgtctccacagattggcttttaggcaacctgatggagacatttcctgaggtgaggtttc

SEQ ID NO: 4294 - DNA, 235 bp, Mus musculus
gcaactccgtcagcagttcaacaacctcactcaaaatccagagttgttccagattaaaggtgaacgaggctctccaggtccaaaaggggccccgggtgctcctggaatccccgggctgcctgggccagctgctgagaagggagaaaagggggctgcaggtcgtgatggaacatctggctggacaatgtgaattgtcggggcacagagaacagtttgtgggactgcagtaagaact

SEQ ID NO: 4295 - DNA, 246 bp, Mus musculus
  misc_feature (124)..(124): n is a, c, g, or t
  misc_feature (137)..(137): n is a, c, g, or t
  misc_feature (152)..(152): n is a, c, g, or t
  misc_feature (162)..(162): n is a, c, g, or t
  misc_feature (175)..(175): n is a, c, g, or t
  misc_feature (189)..(189): n is a, c, g, or t
ttttgttgtgtcatactgcctctattcagtttcccttcccaagtaatttttttttttttgttttttgtttttttgagacagggtttctctgtatagccctggctgtcctggaactcactttgtngaccaggctggcntcaaactcagaaatncacctgcctntgcctccagagtnctgggattaaaggngtacgccaccatgcccggcttccgatgtgtaacagcttgggaggtattcataatgaa

SEQ ID NO: 4296 - DNA, 134 bp, Mus musculus
  misc_feature (52)..(52): n is a, c, g, or t
  misc_feature (54)..(54): n is a, c, g, or t
  misc_feature (58)..(58): n is a, c, g, or t
  misc_feature (82)..(82): n is a, c, g, or t
ttgctttttttttgaccctgaggctgtccctttcacagctcacacacccttngnattnttccctgatttgaattttgttttntgtcattttccaagttacatttactgcagactttctcagagaccctgatcca

SEQ ID NO: 4297 - DNA, 518 bp, Mus musculus
  misc_feature (31)..(31): n is a, c, g, or t
tagatgcaggcagttgccaccgggtttttcntagaagtgcacaatagctaccaaagcaaatcactgagaagacactgggtagaacattgcttttgggtggggaattccaggaaagaggagattataactgaggttgctatagaatgtcaaggacagatggggagaaggtatgaatcaatatatgtcaactgcacagatggtatagccacacagtgtccacatcccagttttctatcccctgaatctgaaattaataatgccttcattataggcaggagctgccaagtagctgagaggggcccagcaaagctctgagagccgcattggtgttggaaacaggctctcttcatcccaccctactccaccctatgctcgactctcacctcccagatttggaacagtgagagacagaaagggagaaggaaccaccttattaggatggtgagttgtacagatgaaagacaccccaaacagcttactacctgtcttgctatgtgatctccgtaactccagtaact

SEQ ID NO: 4298 - DNA, 130 bp, Mus musculus
cctgtgtggatggtaccagcagacttccaaccctccagcttttggtcacgtgtgttcaatgggagcttaagtagatggcgagagggagaaggaacatttgttttgttagctgtatacaatcacagtgggc

SEQ ID NO: 4299 - DNA, 70 bp, Mus musculus
ctttccctggacttgcatccagaagacccttcatcaggacccccaggctccacctaaccactaccttata

SEQ ID NO: 4300 - DNA, 76 bp, Mus musculus
ttgggaaccctgcagcttttagagacccagggtggggttttttttttatattagctattttaacccttctttcctg

SEQ ID NO: 4301 - DNA, 352 bp, Mus musculus
  misc_feature (45)..(45): n is a, c, g, or t
  misc_feature (47)..(48): n is a, c, g, or t
  misc_feature (50)..(50): n is a, c, g, or t
  misc_feature (53)..(53): n is a, c, g, or t
  misc_feature (55)..(61): n is a, c, g, or t
  misc_feature (63)..(64): n is a, c, g, or t
  misc_feature (66)..(79): n is a, c, g, or t
  misc_feature (81)..(87): n is a, c, g, or t
  misc_feature (89)..(90): n is a, c, g, or t
  misc_feature (92)..(92): n is a, c, g, or t
  misc_feature (288)..(288): n is a, c, g, or t
tcacccaggagctttactggcagatcaccattgacgacttccttntnngnaancnnnnnnntnncnnnnnnnnnnnnnntnnnnnnnanngnattgtagacacaggcacctctctgctcgtcatgcctgcccagtacctgaatgaacttctgcagaccataggagcccaggaaggagagtatggacagtattttgtgagctgcgacagcgtcagtagcctgcctaccctcacttttgtcctcaatggtgtccagttccccctgtcaccctcttcctacatcatccagnaggaaggctcctgcatggtgggtctggagagcctctccctgaacgctgagagtggccagcccct

SEQ ID NO: 4302 - DNA, 365 bp, Mus musculus
  misc_feature (170)..(170): n is a, c, g, or t
  misc_feature (179)..(179): n is a, c, g, or t
  misc_feature (183)..(183): n is a, c, g, or t
  misc_feature (187)..(187): n is a, c, g, or t
  misc_feature (191)..(191): n is a, c, g, or t
  misc_feature (200)..(200): n is a, c, g, or t
  misc_feature (202)..(202): n is a, c, g, or t
  misc_feature (218)..(218): n is a, c, g, or t
  misc_feature (241)..(241): n is a, c, g, or t
  misc_feature (243)..(243): n is a, c, g, or t
aggtgccatgatctgggccattgaccttgatgacttcactggctctttctgtgatcagggaaaatttcctctgacttctactttgaacaaagcccttggcatatccactgaaggttgcacagctcctgacgtgccttccgagccagtgactactcctccaggaagtgggnagtgggggntggnaagntccnggaggaagntntggaggcagtggattnctgtgccgacaaagcagatggcntntaccctgtggcagatgacagaaatgctttttggcagtgcatcaatggaatcacataccagcagcattgtcaagcagggcttgtttttgataccagctgtaattgctgcaactggccatgaac

SEQ ID NO: 4303 - DNA, 127 bp, Mus musculus
tgtggccaggagctgtcaccatgtcggagaaatttgaggtcaaagacctgaacatgaaaccagggatgtccctgaagattaaaggcaagatccacaatgatgtggaccgcttcctcattaacctggg

SEQ ID NO: 4304 - DNA, 203 bp, Mus musculus
  misc_feature (154)..(154): n is a, c, g, or t
  misc_feature (165)..(165): n is a, c, g, or t
ggaaagaaaccctcaacctgcattttaaccctcgcttcgatgaatccaccattgtctgtaacaccagtgaaggtggccgctggggacaagagcaacgagaaaatcacatgtgcttcagtccagggtcagaggtcaagatcaccatcaccttccnaagataaaganttcaaggtgacgttgcctgacggacaccagctgacctt

SEQ ID NO: 4305 - DNA, 561 bp, Mus musculus
  misc_feature (307)..(307): n is a, c, g, or t
  misc_feature (320)..(320): n is a, c, g, or t
  misc_feature (344)..(344): n is a, c, g, or t
  misc_feature (361)..(361): n is a, c, g, or t
  misc_feature (366)..(366): n is a, c, g, or t
  misc_feature (404)..(404): n is a, c, g, or t
  misc_feature (419)..(419): n is a, c, g, or t
  misc_feature (431)..(431): n is a, c, g, or t
  misc_feature (519)..(519): n is a, c, g, or t
  misc_feature (527)..(527): n is a, c, g, or t
  misc_feature (534)..(534): n is a, c, g, or t
atggcaagaaagcacagccccactacagcaaccctctggtggcagccaagctcctcaacgtccccaagaacatgcaagtcagcatcgtgtgcaagatcctggcagaccacgtgaccttcaacaacccccatgacccctacgaagggaaggtggagtttaaacttacaatacagaagtaaaacgtgggagtggtgtccacccctcagatgggtggacacggatggacactcttcctgactgcacagcctctgctggccagcatgcacggccacttccatcatggcccagagctgacaccaggaagtgntccagcccagcantccccgagtatcaccaaccctcangtgagcgcaatcctatnggagntgtggggttaacacggggacccagagtccggctgccantaaggaaggcctatntgtccacatttntgtcctgtgatcatttgcccgtcctgcacttcaatatgaactatgggtccacatcagggtaacactggtcaccctggcatgacacatntccagttngtgcttntgagaccacagtccctatgccatcaaa

SEQ ID NO: 4306 - DNA, 348 bp, Mus musculus
  misc_feature (93)..(93): n is a, c, g, or t
  misc_feature (108)..(108): n is a, c, g, or t
  misc_feature (111)..(111): n is a, c, g, or t
  misc_feature (154)..(154): n is a, c, g, or t
  misc_feature (201)..(201): n is a, c, g, or t
  misc_feature (219)..(219): n is a, c, g, or t
  misc_feature (233)..(233): n is a, c, g, or t
  misc_feature (244)..(244): n is a, c, g, or t
  misc_feature (258)..(258): n is a, c, g, or t
  misc_feature (267)..(267): n is a, c, g, or t
  misc_feature (305)..(305): n is a, c, g, or t
  misc_feature (314)..(314): n is a, c, g, or t
  misc_feature (317)..(317): n is a, c, g, or t
  misc_feature (319)..(319): n is a, c, g, or t
atgctgtcttcaggcaccatctgcagtttgctgctactcagcatgctctggatggacatggccatggcaggctccagcttcctgagcccagancaccagaaagcccancanagaaaggaatccaagaagccaccagctaaactgcagccacganctctggaaggctggctccacccagaggacagaggacaagcagaaganacagaggaggagctgganatcaggttcaatgntcccttcgatnttggcatcaagctngtcaggagntcagtatcagcagcatggccgggccctggggaagtttnttcaggatntcntntgggaagaggtcaaagaggcgccagctga

SEQ ID NO: 4307 - DNA, 567 bp, Mus musculus
  misc_feature (134)..(134): n is a, c, g, or t
  misc_feature (195)..(195): n is a, c, g, or t
  misc_feature (276)..(276): n is a, c, g, or t
  misc_feature (373)..(373): n is a, c, g, or t
  misc_feature (393)..(393): n is a, c, g, or t
  misc_feature (417)..(417): n is a, c, g, or t
  misc_feature (419)..(419): n is a, c, g, or t
  misc_feature (422)..(422): n is a, c, g, or t
  misc_feature (424)..(424): n is a, c, g, or t
  misc_feature (473)..(473): n is a, c, g, or t
  misc_feature (485)..(485): n is a, c, g, or t
  misc_feature (520)..(520): n is a, c, g, or t
  misc_feature (522)..(522): n is a, c, g, or t
gtgccccaagtaacatgtggtcctgatcatgaagtgccaccaactttaactgactatcctaccccggtccccacttcagtatctaacattaccgtcatatataccataaacaaccagctgagaggggttgatcngcttttcaatgtgaccatcgaggttagtgtgaaaagtggatctgtgctacttgctgtcctngaagaagcacagcgcaaaaactccatgttcaaatttgaaaccaccatgacatcctggggccttattgtctcttctatcaanaatatcgctgagaatgttaatcacaagacatactgggagtttcttagtggcaaaacgcctttggatgaaggggttgcttactatatccccttcaatnatgagcacatcacagccaanttcacccaatactgagacggagtntnttntntcccatgtgacaaaaggatggtttgggttgttttgttttgtttttcatntcatttcaaatntgtgccaagaaaagcagatattaacaatgctactntnttcctgagccactgtgtggaataaatgatgcaggtgctcaccatt

SEQ ID NO: 4308 - DNA, 557 bp, Mus musculus
  misc_feature (146)..(147): n is a, c, g, or t
  misc_feature (340)..(340): n is a, c, g, or t
  misc_feature (362)..(362): n is a, c, g, or t
  misc_feature (410)..(410): n is a, c, g, or t
  misc_feature (412)..(412): n is a, c, g, or t
  misc_feature (532)..(532): n is a, c, g, or t
caggcacctgggatgagtattttgaaaccttcatcaatggaaaagtaagttggggatcctggtttgaccatgtgaaaggatggtgggaaattcgagacaaatatcagattctcttcctcttctatgaagatatgaagaggaacccnnagcatgaaatccagaaggtgatgcagtttatgggcaagaatttggatgaagatgtggtggataaaatagtcctggagacatcatttgagaaaatgaaagagaatcctatgacaaatcgttctacggcccccaaatctatcctggaccagtccatttcccctttcatgagaaaaggaactgtgggtgattgganaaaaccactttactgtggctcnaaatgagaggtttgatgaaatctataagcaaaagatgggcagaacctntntgaacttctccatggaactctgatcaagatgttgatcaccaagaacaggagtctgtctgcaagcctcaatccagccaaaggaagccctgaaagcaaactgtaaaggccaaagattgtgtntctgactctgtgattactaacatca

SEQ ID NO: 4309 - DNA, 361 bp, Mus musculus
  misc_feature (280)..(280): n is a, c, g, or t
  misc_feature (283)..(283): n is a, c, g, or t
  misc_feature (316)..(316): n is a, c, g, or t
cgatggttatttccaggagctgctggttgctattgttcgttgtatccaggacaaaccaagctattttgcttataaattatacagggcaatccatgattttggcttccataacaaaactgtcatcaggattctcatcgccagaagtgaaatagacctaatgaccataaggaaacgttacaaagagagatttggaaaatccctctttcatgatatcaaaaattttgcttcagggcactatgagaaagcactacttgccatctgtgctggtgatgtggaagantantgaaaagagggagagtttgaaggtgatgcgatnttctttataggcacccgacatagactgctgaacgcgtgctgtatt

SEQ ID NO: 4310 - DNA, 383 bp, Mus musculus
  misc_feature (282)..(282): n is a, c, g, or t
  misc_feature (299)..(299): n is a, c, g, or t
  misc_feature (301)..(301): n is a, c, g, or t
  misc_feature (308)..(308): n is a, c, g, or t
  misc_feature (344)..(344): n is a, c, g, or t
  misc_feature (352)..(352): n is a, c, g, or t
atttttaatatcttcgtcccaagcaaaaatggaggcaatatccaggagacagtgaccatcgacaaccagcagaacacggccaccatcaacatccactcaggctcgtgctcctccaccacgatttttgactataagcatggttacatcgcatcccgggtgctctcccggagagcctgttacgtcatcaagatggaccacaaagccatccctgctctggacaaactccaacggttcctctacgagaagcagacaatgaatgctatcgactccccagagtatacntgggtcaggtacaaccntntgaagtntctgatcacgaaggtggactggttcctgtttgggtngcctattngacagctatgcaagcacatgcccctgtatga

SEQ ID NO: 4311 - DNA, 300 bp, Mus musculus
  misc_feature (42)..(42): n is a, c, g, or t
tgaccaagtgcccatggtggagattgatgggatgaagctggngcagaccagagccattctcaactacatcgccaccaaatatgacctctatgggaaggacatgaaggagagagccctgattgacatgtatacagaaggtattttagatctgactgaaatgattgggcaattggtattatgtcccccagaccaaagagaagccaagactgccttggcaaaagacaggaccaaaaaccgttacttgcctgcctttgaaaaggtgttgaagagccatggacaagactaccttgtgggcaacag

SEQ ID NO: 4312 - DNA, 500 bp, Mus musculus
aatctctttgccttctacttgagcagcaaggatgaaaagggcagcatgctgatgctaggtggagtggatccctcctactaccatggagagcttcactgggtaccagtgtccaagcccagctactggcaattagctgtggatagcatctccatgaatggggaggtcattgcctgtgatggtggctgccaaggtattatggacacagggacctccttgctgaccggcccccgaagctccatcgttaacatccagaatctaattggtgccaaggcttctggtgacggcgagtacttcctcaagtgtgacaccatcaacaccctgcctgatattgtcttcaccatcggcagtgttacctacccagtgccagccagtgcctacatccgaaaggatcggtcacacaattgcaggagcaactttgaggagggcatggatgacccatcagaccctgagatgtgggtgctgggggatgtcttcctgaggctgtatttcaccgtgtttga

SEQ ID NO: 4313 - DNA, 496 bp, Mus musculus
ggctgcttattcctatttccagattggtgccattcagtcatttgccggctttgctgactacttcacggccatggcgcaggagggctggttccctctgttgtgtgtaggactgcggccacaatgggaggaccaccatctacaagatcttcaagacagctacggccaggaatggacatttggtcagcgcctgtaccagcagtacacctgttacaccgtgttcttcatcagcatcgagatgtgccagatcgcagatgtcctcatccgcaagacacggcgcctctctgttttccagcagggattcttcaggaacaagatcctggtgatcgccatcgtgttccaggtctgcattggctgcttcctgtgctactgcccagggatgcctaacatcttcaacttcatgcccatccggttccagtggtggctggtccccatgcccttcggccttctcatctttgtctatgatgagatccggaaacttggagttcgctgttgccca

SEQ ID NO: 4314 - DNA, 314 bp, Mus musculus
  misc_feature (45)..(45): n is a, c, g, or t
  misc_feature (65)..(65): n is a, c, g, or t
  misc_feature (226)..(226): n is a, c, g, or t
  misc_feature (248)..(248): n is a, c, g, or t
  misc_feature (259)..(259): n is a, c, g, or t
  misc_feature (287)..(287): n is a, c, g, or t
agcagtcggtgagcatcaatggtgtgcacaacgtggccaatatcnacaacaataacggctgggantcctggaatagcctctgggactatgaaaacagtttcgctgccacgagactcttctccaagaagtcatgcattgtgcacagaatgaacaaggatgccatgccctcccttcaggacctcgatacaatggtcaaggaacagaagggtaaagggcctggaggagntcctcccaaggacttgatgtantccgtcaaccntaccagagtggaggacctgaatacattnggaccaaagattgctggcatgtgcagg

SEQ ID NO: 4315 - DNA, 467 bp, Mus musculus
  misc_feature (75)..(75): n is a, c, g, or t
  misc_feature (296)..(296): n is a, c, g, or t
  misc_feature (319)..(319): n is a, c, g, or t
  misc_feature (385)..(385): n is a, c, g, or t
  misc_feature (402)..(402): n is a, c, g, or t
  misc_feature (408)..(408): n is a, c, g, or t
aacctatgtgccttggagttctcagcaacactggggaatcgacagaaatttagatacaagacccagtgctgcacnggtgagcagtgcaacaaagaaaatctcactctgcctccattatcttcagaagtcaatggtgttgaatgtcctgcctgctacaataataaaaccaatacgtgctccacgacaactcccctaaagtgcacaggggcagagaaaaggtgtattgaggttaccagcagagacctatcttctaatatagtaatgtatggaaaaggctgtgcaacagaaaatgcctngtgcactgtatatgactgtcttncaataacatacaaattaaaacctcgtgcatttcgaccaatggaagccctgccctcaaatccgctgnatcactcccagttattntgcttntccagaaaatcttgctttgatcacccaggcaccggcaatcccacaatcctgtgtacata

SEQ ID NO: 4316 - DNA, 542 bp, Mus musculus
  misc_feature (326)..(326): n is a, c, g, or t
  misc_feature (432)..(432): n is a, c, g, or t
  misc_feature (436)..(437): n is a, c, g, or t
  misc_feature (477)..(477): n is a, c, g, or t
ggtcatgtcacagccagaacgatgttctgtctactcccatggatgacctcaccaccatccaggctcatgagtggctctatcaacggccaccagccagtaatccacacagccaaaccgtatgtgacaagatcttggcccttccaaacttcttcccactgaggcacaccgtgacgacatactattccccagtcacgtccacacccatgcccctccagcacgctccttccaacaaatgttcccaaatataaaggtttcctggtctgtgattgtgcacacagaccttctacaaatgaggaccagcgacccaaagaaaaagggtttcccangtcatgttatcaggggcctgctctcaaacgcattctgatctctgagctgcctgcaagtcctcatgagagtgctggaaatgtatcctcctcctggaaggactaactngccnncacagggatgatgcaggggagtgctgttagctgtttccanccctccttatcaggacagaagccatagctgacctctttgtgacttgaaggttcccgttttgcaat

SEQ ID NO: 4317 - DNA, 375 bp, Mus musculus
  misc_feature (230)..(230): n is a, c, g, or t
  misc_feature (295)..(296): n is a, c, g, or t
  misc_feature (298)..(298): n is a, c, g, or t
  misc_feature (325)..(325): n is a, c, g, or t
  misc_feature (328)..(328): n is a, c, g, or t
  misc_feature (336)..(337): n is a, c, g, or t
gaactctttcttagcaggcacattatattgtatctgaacagtctctagagagcttactgtggccagactatgagtcaaggtctttgttacagacaaatgtgatttatgagctatcagtagcacctattggtcttcaagatgtgctcacattaacctacacttgactttcttcagattctgcaaccattcttttcccttattagaaaaacaaattaaatacaattaaatgnaacataaagtcatcaattttttttagcaacagcctactctaactcaattagtcctcttttacttnntntcaattaaagattaatactaatgatancancacttcanntctgagttgaaacagctgagaactaaaccattgccaag

SEQ ID NO: 4318 - DNA, 363 bp, Mus musculus
  misc_feature (177)..(177): n is a, c, g, or t
gaatgtgactctgcgctgcgatgatggctccagtcagaccttcagctacacccaggttgagaagtgtggctgcctgggccagcagtgccatgctttaggggacacaagccatgcagagtcctcagaacaagagttcaagtccaaggaaagtgaggaacatggccagcagttggcatncagggtcagcgaggacatgcttgggcctttccagtaaactgaatactgctgctgtcccaaccaaaaggtcctcccgaggccagaaagtggcttgaattctacctacctgccgcttcctcttcaagagggacatcgaccccagatggtcttggaggtaggagaggcccctctccactgattaggtgg

SEQ ID NO: 4319 - DNA, 190 bp, Mus musculus
  misc_feature (81)..(81): n is a, c, g, or t
  misc_feature (83)..(83): n is a, c, g, or t
  misc_feature (98)..(98): n is a, c, g, or t
  misc_feature (104)..(104): n is a, c, g, or t
  misc_feature (128)..(128): n is a, c, g, or t
  misc_feature (157)..(157): n is a, c, g, or t
  misc_feature (159)..(159): n is a, c, g, or t
  misc_feature (165)..(165): n is a, c, g, or t
gcatccctacctatgtggccgaggagattccaggaccaaaccagcctttgtattcaaagaagtgctacacagctgacatantntggattttgcggatntccttntgtggaacatcagtggagacatantagaagtcacaggaaaacaacccgtgggntntgaccntcgcaatgcttgattatgagagtgt

SEQ ID NO: 4320 - DNA, 88 bp, Mus musculus
gagatgtggaggtgccaacaatgatgaaggtaaaggggactgtgggcctgtcacaaagcagcacgctggaggtacagatgctcagtgt

SEQ ID NO: 4321 - DNA, 537 bp, Mus musculus
  misc_feature (145)..(145): n is a, c, g, or t
  misc_feature (148)..(148): n is a, c, g, or t
  misc_feature (198)..(198): n is a, c, g, or t
  misc_feature (202)..(202): n is a, c, g, or t
  misc_feature (225)..(225): n is a, c, g, or t
  misc_feature (227)..(227): n is a, c, g, or t
  misc_feature (241)..(241): n is a, c, g, or t
  misc_feature (272)..(272): n is a, c, g, or t
  misc_feature (287)..(287): n is a, c, g, or t
  misc_feature (289)..(289): n is a, c, g, or t
  misc_feature (298)..(298): n is a, c, g, or t
  misc_feature (324)..(324): n is a, c, g, or t
  misc_feature (326)..(327): n is a, c, g, or t
  misc_feature (333)..(334): n is a, c, g, or t
  misc_feature (336)..(336): n is a, c, g, or t
  misc_feature (341)..(341): n is a, c, g, or t
  misc_feature (360)..(360): n is a, c, g, or t
  misc_feature (370)..(370): n is a, c, g, or t
  misc_feature (383)..(383): n is a, c, g, or t
  misc_feature (386)..(386): n is a, c, g, or t
  misc_feature (422)..(422): n is a, c, g, or t
  misc_feature (424)..(424): n is a, c, g, or t
  misc_feature (429)..(429): n is a, c, g, or t
  misc_feature (447)..(447): n is a, c, g, or t
  misc_feature (450)..(450): n is a, c, g, or t
  misc_feature (457)..(457): n is a, c, g, or t
  misc_feature (480)..(480): n is a, c, g, or t
gaggtgccaacaatgatgaaggtaaaggggactgtgggcctgtcacaaagcagcacgctggaggtacagatgctcagtgtggctcccacggctctggagaacttgcacatggagaggtgagagaggacagggctgaggggctgcnagnatcaatatttgataaatggaacttcatgaaagtaaaagtttctataaggnaaanaatgctgtcaataggacaaaaangnagtgtacagattgnaaagtatcttcaccaaccctacatcttacanagggctaatgcacanantttaagaanaaaccaagaagttaggtgttaatacncnnaacaanntnatctnaaaatggggttgagagctnaacggagaantctcagcaagggnatntagaagagcagagaagcacttaaggaaatatttgantntttantcatcagtgaaaagtcantcnaaacctntctgtagttccatcctgtacctntcaggatggctaagaccaaacctcaagggatagcacatgctcacaaggatttagagc

SEQ ID NO: 4322 - DNA, 198 bp, Mus musculus
gctctgacagagctaagtgaagaacaactgaagattctagtaaaatccttggagaacaaggtcctaccggtgcaactgaagctggttgagagcatcttggaacagaacttcctgcaagataaagaggatgttttccccctgcgacctgatctgctctcctccctcggggaggaggaccagattctaacagaagcactg

SEQ ID NO: 4323 - DNA, 236 bp, Mus musculus
atccagacacttgtcacaacctctgtgccctctatgctggcctctccctccttcacctgctaagcagggattcctaatgcaacttctctgcctgctgccctaaagccttcccggccttactgtgctctgtctgaaacactccaagatggtggcattcacctttaatcccagcagtcaggaggcagaggcagtgagttcaagaccagccttgtctacaggctgctcccaggataaca

SEQ ID NO: 4324 - DNA, 406 bp, Mus musculus
aagctggttgagagcatcttggaacagaacttcctgcaagataaagaggatgttttccccctgcgacctgatctgctctcctccctcggggaggaggaccagattctaacagaagcactggtgggactaagcggcctggaagtccagagatcagggccccagtacacgtggaatccagacacttgtcacaacctctgtgccctctatgctggcctctccctccttcacctgctaagcagggattcctaatgcaacttctctgcctgctgccctaaagccttcccggccttactgtgctctgtctgaaacactccaagatggtggcattcacctttaatcccagcagtcaggaggcagaggcagtgagttcaagaccagccttgtctacaggctgctcccaggataa

SEQ ID NO: 4325 - DNA, 308 bp, Mus musculus
  misc_feature (160)..(160): n is a, c, g, or t
  misc_feature (179)..(179): n is a, c, g, or t
  misc_feature (219)..(219): n is a, c, g, or t
  misc_feature (229)..(229): n is a, c, g, or t
acatctcttgtacacttggctagagcgctgggctctggaacctcgtgcttcataggcacttgggtgagggtaccagtaagaccccgagattaggtgaaaaaatatctcgaaaggaaacaaagtccaatatggtggccactacattttcttgtttcttggnaagctgtggcttcagtccnaatagtctatttctttgtcactcaaagaaggttttcaggntcgtgtctancctgtcccaccctgctccacatcactctgcacctctgtaggagtcaccttgttaagctcttgtgacattcaaacttggt

SEQ ID NO: 4326 - DNA, 495 bp, Mus musculus
  misc_feature (62)..(62): n is a, c, g, or t
  misc_feature (98)..(98): n is a, c, g, or t
  misc_feature (188)..(188): n is a, c, g, or t
  misc_feature (409)..(409): n is a, c, g, or t
  misc_feature (441)..(441): n is a, c, g, or t
gggacctctccatgaaatgatagattaaggcaggcatactttttaaggactggtgacaagtngtttcttaaggatggtgacaagtagtttctgttttntgaaggacggcgatgtagattgcacgtctcattttaatcaggctttcttccctgccgggctggaagacccagagctcacccactgaccgngactgcacatggaaaacggaaaggaggaagccacaacttacatggacttcagttgtgatgtgacgagatgtttagctataaatgtgcactttttagataactccaacaggaaactgtaacttctatgtctaatagggatgcagaaaagaaaaatgattgttctttatttgggagctacttaaacagattaagtgggaaataaatctatctataaatttgtntctttatctcagtacattgatgaaaagtattntcttgactattttatagttttatagggaagatgtgcatctatttttcttgactt

SEQ ID NO: 4327 - DNA, 60 bp, Mus musculus
tggtacgcttcatactgtggtcctgtttggggacctatatggactataggctggcccggc

SEQ ID NO: 4328 - DNA, 95 bp, Mus musculus
  misc_feature (61)..(61): n is a, c, g, or t
  misc_feature (63)..(63): n is a, c, g, or t
  misc_feature (66)..(66): n is a, c, g, or t
tggtacgcttcatactgtggtcctgtttggggacctatatggactataggctggcccggcntnatnctggcaaacccaaggaagagtaagccaag

SEQ ID NO: 4329 - DNA, 185 bp, Mus musculus
  misc_feature (42)..(42): n is a, c, g, or t
  misc_feature (68)..(68): n is a, c, g, or t
  misc_feature (70)..(70): n is a, c, g, or t
  misc_feature (78)..(85): n is a, c, g, or t
  misc_feature (101)..(101): n is a, c, g, or t
  misc_feature (103)..(103): n is a, c, g, or t
  misc_feature (111)..(111): n is a, c, g, or t
  misc_feature (114)..(114): n is a, c, g, or t
  misc_feature (116)..(116): n is a, c, g, or t
  misc_feature (121)..(121): n is a, c, g, or t
atgggactgtccatttgtggtgagatccctgggttttgaacntttacgtcagccagactggacagacntnatttagcnnnnnnnngcctgtgagaagtgtntncattgcantcntntgtgntccacatgttggcttcccatggaaccttgtgatttggggggaataagtgcatttttaccttgta

SEQ ID NO: 4330 - DNA, 429 bp, Mus musculus
  misc_feature (268)..(268): n is a, c, g, or t
  misc_feature (271)..(272): n is a, c, g, or t
  misc_feature (278)..(279): n is a, c, g, or t
  misc_feature (281)..(282): n is a, c, g, or t
  misc_feature (286)..(287): n is a, c, g, or t
  misc_feature (289)..(290): n is a, c, g, or t
  misc_feature (292)..(294): n is a, c, g, or t
  misc_feature (298)..(298): n is a, c, g, or t
  misc_feature (306)..(306): n is a, c, g, or t
  misc_feature (313)..(313): n is a, c, g, or t
  misc_feature (338)..(338): n is a, c, g, or t
  misc_feature (346)..(346): n is a, c, g, or t
  misc_feature (357)..(358): n is a, c, g, or t
  misc_feature (377)..(377): n is a, c, g, or t
  misc_feature (390)..(390): n is a, c, g, or t
  misc_feature (403)..(403): n is a, c, g, or t
acttttgccaaggagtgttgccaactgggcatgggaccttgcctgccctggacactatccaccacactttgctgacacctccccaggtgcagatcactgccacccatgctcccggatgctccaggacacacatacacccagcagggctgccgactgcattctctccttgtgcccacaggcactggcctgggactttcatggaggtcctagcctttcctcccacactctagcctttctcaggctgcaccaaagattccaccttcagggnccnnacaganngnngggnngnncnnncccnaccaggangcccaanccctcccttggatcagagagagaanccctctcntgaactgcccnnggttggtattgaatcccantccactgaaagtnccattgaccaccnctgcatccgggctgtacaagacgaca

SEQ ID NO: 4331 - DNA, 278 bp, Mus musculus
  misc_feature (38)..(39): n is a, c, g, or t
  misc_feature (42)..(42): n is a, c, g, or t
  misc_feature (52)..(52): n is a, c, g, or t
tacagtcacaaggacatggtcgctgaggggctgcgccnngcntattaggggnaagaaaactaccgtcagaatctgactgtacctccgggctactgcacagactttctactctgtgtgagtagttctggtgctgtgctgcctatgaggacacaagaccccttcctgccctacccaccacggtcctgccaacaggaccaggcaaactttaactccacaacccaagaccctgcccaaagggtggtgctgatgctgagagaacgctggcatttctgccgaga

SEQ ID NO: 4332 - DNA, 242 bp, Mus musculus
atctgccacaactggaaatgctcaagaaccagctggaccaggaagtggagtttttgtccacgtccattgctcagctcaaggtggtccagaccaagtacgtggaagccaaggactgtctgaacgtgctgaacaagagcaacgagggaaaagaattactggtcccactgacgagttctatgtacgtccccgggaagctacacgatgtggagcatgtgcttattgatgtgggaaccggctactac

SEQ ID NO: 4333 - DNA, 370 bp, Mus musculus
  misc_feature (314)..(314): n is a, c, g, or t
  misc_feature (337)..(337): n is a, c, g, or t
accaagtacgtggaagccaaggactgtctgaacgtgctgaacaagagcaacgagggaaaagaattactggtcccactgacgagttctatgtacgtccccgggaagctacacgatgtggagcatgtgcttattgatgtgggaaccggctactacgtggagaagacagctgaggacgccaaggacttcttcaaaaggaagatagacttcctcaccaaacagatggagaaaatccagccagcgctgcaggagaagcatgccatgaagcaggctgtcatggaaatgatgagccagaagattcagcagctcacagcccntgggggcagcgcaggccacggtncaaagcctgagagtgcactgcagaaatgaagca

SEQ ID NO: 4334 - DNA, 285 bp, Mus musculus
gctgaataccggaacttccaggcttgtctgcacaactcatggattgagcaggcggcagcagccctagagattgagctagaagaagagatgtacaaaggaggaaaagctgaccagcaagaagaacgtcggcgacagaagcagatgaagatgctgaagcaggagctacgccatctgctctcccagccactcttccaggagaacctgaagaccagataccccacacagtctggcaggccgcctcagcctgtgctggcctccaggaatatcgagtctgcgctgagctgc

SEQ ID NO: 4335 - DNA, 447 bp, Mus musculus
  misc_feature (355)..(355): n is a, c, g, or t
actggcaggagctctcactgtggagaggccactgacagaagctgctctgtggagccagcagcggggccgactgactctcatctgctccctttcctaagtatccattcctttgaatgtaaagaatgaaactctttgatactaactttgagccacttggggattaactccatgtcagtatttgagtctttacccattttctcctactgtactcaagctgaagtgaaacaaaccagaacgatcttttctatagtgtacaaattgcaggagttaccaattttgaaaggtggcattctccttttgtcttggtaaccctcctggacttctcccggaacccctgcgcccgcccaccctttgntcaggcatccccgtttgcacgaatgcgtgtcaagaatggctgtgcactgagacagccccaactggaagcatgctttccctgttgctgttaga

SEQ ID NO: 4336 - DNA, 367 bp, Mus musculus
gctgtttgtcatggcccgagaacatgctccatccatcatcttcatggacgagattgactctattggctcctcacggctggaggggggctctggaggcgacagtgaggtacagcgcacgatgctggaactgctcaatcagctggatggctttgaggccaccaagaatatcaaggttatcatggctactaataggattgatatcctggactctgccctgcttcgtcctgggaggattgacagaaaaattgaattcccaccccccaacgaggaggcccggctggacattttgaaaatccactctcggaaaatgaacttgaccagggggatcaacctgaggaaaattgctgagttgatgccgggagcttca

SEQ ID NO: 4337 - DNA, 322 bp, Mus musculus
  misc_feature (224)..(224): n is a, c, g, or t
  misc_feature (227)..(227): n is a, c, g, or t
  misc_feature (268)..(268): n is a, c, g, or t
  misc_feature (272)..(272): n is a, c, g, or t
cagctcttagctttcttttgggattcctagagtccccagaccctagaggaaccaagctttcaatagatgttggtttcttctccggggcaggaccaggctctgcatggtgcacttctctcacagctacactgcgcaggctcagggtagatcccaggttacccctctcctgccctgagaactccatccagggctattgattgaactgatggtatgtttgagttgtntcnttgtctgagattttgttgtctgtctgagatttgggaaaggnaggnccacactctggggctgcaggtggtggctggcagcttaagcatggtctaac

SEQ ID NO: 4338 - DNA, 376 bp, Mus musculus
  misc_feature (204)..(204): n is a, c, g, or t
  misc_feature (317)..(317): n is a, c, g, or t
  misc_feature (320)..(320): n is a, c, g, or t
  misc_feature (324)..(324): n is a, c, g, or t
  misc_feature (333)..(333): n is a, c, g, or t
gaatcgacggtctgttgcggttcctcccacttttccataagcagaacaagaaccaaatcaaaacgtcttaacgcgtgtagcgagatcacgtcccgagagcagacacaaaatggtggcaggcttggcgaacaggaactagaccacccgaagggcagcccaccaccgtaaatcagacctcacttccgaatgtaaaaggttcacatncctttggcttcctgttgacttcctcccgacccagaaagcatgggaaatgtgaagggtatgcaaaaatggttgttggttactgttgctccccgtgcccttgacccatcccatgntcncctntcgctccancaaaccccaaggactagctgaccacagactccacagacgggat

SEQ ID NO: 4339 - DNA, 537 bp, Mus musculus
tgaaagctgcgtactccttctacaacgtccacacccagacccctcttctagaccttatgagcgacgccctcgttctagccaaaatgaaagggttcgacgtattcaatgcactggatctcatggagaacaagacattcctggagaagctcaagttcggcataggggacggcaacctgcagtattacctgtacaattggaagtgcccgagcatgggggccgagaaggttgggttggtgttacagtaaccagttgccagtgagattctggataaagccactgagaattcaaaccaggaaacggaacccttccacttgttggtccaactttcacagatgtgagatctctggcaaacaaaacagaactgaaccggctttaccaaaccgccagcgaacttgacaattatattgcgatggcgtaggctgcgtgatgtcacctttagccatgtttctggtctccctattttcaatgaattaacatgctcatgcagccgtgatcaagggaatgtaactgctgaaacctagctcgtgattggcatat

SEQ ID NO: 4340 - DNA, 454 bp, Mus musculus
gttagagctggagcgcataggccctcagcaccaggcaggatctgactcactgcttacaggaatggcctttttcaaaatgagagaaatgttctttgaagatcacattgatgatgccaaatactgtggtcacttatatggccttggttctggctcatcctatgtacagaacggcacagggaatgcatatgaagaggaagccagcaagcagtcatgacaggaaatagtcttcttatttttattttatacgagttacacaactgcttgtatataggttttatcatcccttaaataataggcaatacccccccccttttgtagaccttctctgctttcagtaataagtatggcctttcttagctatgatcttaataaattaaagtacattcaccttaaatctggccttaatttaatacacttcttatcaagcttgtgtgacaaagctacattactgaat

SEQ ID NO: 4341 - DNA, 304 bp, Mus musculus
  misc_feature (200)..(201): n is a, c, g, or t
tcaccacagttcctctcagaaggtaataacctttccaggatcatcttacactctataatgtttaggttaactcctattaacaagtttcgcaactgttgccttcattgctacccaaggagagcatgccagatagcgaggatccaaggtcaaggcagagccttgacagctaagagtcctaagcttttgcgattttttttttnngtttagactacatattttaagggctagagggatggctcaatggttaagaacactggtgattcttccagatggcgtccagtgcttagcgcccacatggtgactc

SEQ ID NO: 4342 - DNA, 383 bp, Mus musculus
  misc_feature (322)..(322): n is a, c, g, or t
tcacagggtggctacagtcggaacacagagcacagcatgaactaccagtacagataaaggcccaggctgcctgcccctctcaaccttctgcacctctgcctccaacttgtctcgggagattgagtctgcacatcaccagttgccatgttcactgggccagtgcccacccgtccacgttgctgacattgccacgctttgaggtgtggtggtcgctgggacccgtgccgtgacccctatttagctgtgttttggactccgtgtcttcagtggtttgttagttaccattacgtaaaccttgtctgagtagtgttccgaggtcttnccgttccggatccctctgtctgtttatgcctggtgtgagttccatcgggtgtctttaaata

SEQ ID NO: 4343 - DNA, 499 bp, Mus musculus
  misc_feature (244)..(244): n is a, c, g, or t
  misc_feature (275)..(275): n is a, c, g, or t
  misc_feature (299)..(299): n is a, c, g, or t
  misc_feature (330)..(330): n is a, c, g, or t
  misc_feature (422)..(422): n is a, c, g, or t
  misc_feature (443)..(443): n is a, c, g, or t
gctggcatggctgccacatctgttgctctgcttctcatggtgccgcacagtccttgccatggttagaactgtataatccccagttgacatctagaacttccagtgtagcttttcttcattatggccgttgtgtttgaggttgtaccccgattagatggtgagaacagttaatgcaattttgcacaaatatttttacattctgatcattcacttctgtcattgtgatctttgctgttagaaaaangaaatgatggaaagataagggttctgtcaancatttgtaaagctaagaattctgntttaaattgtgaactgcttttttttttcctntgctgaaaccattgcaaaattgagctttggtagggtagggggagtatgttcatgagacttttaatttgtataaaacacagaacttagttctntctgcaatttatttaatacantcaacattaaattgagtgttcaaaaagaagagatgtttccctacaataacaacctt

SEQ ID NO: 4344 - DNA, 481 bp, Mus musculus
gaagtccctgctgatgggcaaggaattccaacgacgtgccaaagctatgattctgagagcagctgtgctccgcaaccagatccatgtcaagtctcctcctagagaagggagccaaggggagctgactccagccaacagccagtcacgcatgagtaccaacatgtgaaaggcattcctgtgaccgtcagaccatagtctgcacacctactctgcctgtggaagcagcacctgggcctcctgcctgctttcctcaagacgagagagaccccagactgtgtgtggttcattagagcagtctggccactggggtgccagttcgttggccttccacgctgaggtaccctctgcagtggtaggcagcctgcccatatggccacttgggcctgactctaagtttctgccccagtgaaacagaccatgtgcaattcccaggtaagggtacctcagacccttcctgtccatgtagttccgactgcagcag

SEQ ID NO: 4345 - DNA, 394 bp, Mus musculus
agaggcctcgagtggctactgcactgcgctcagccatggtcatctgcaccattttctacaccagatctgcttggcaccatggggaactctgcccctgcacaatgacattccaatcactaccagccagaagttacagccgaccttgctgattgtcacaagcaggaccttgggtccattggcactgtcggtgatagtaagccatttcttgggaagaggagactcttccctacagatctgcttgggcctgtgcaaatggcactgcaaacgagccacacacacgtggagtccatgagctagtgggatgtacaaagacgcttaagcatttcagggctggttctgttcatatccaattctggtgcttaggaacagggacccatgttaatgccccagggca

SEQ ID NO: 4346 - DNA, 499 bp, Mus musculus
gaagagtgtctgctagtccagtctccagtccattcgagcagatgccacaggtgcctgccaggttcccaccagttgcctgagcgggagtagaaatgaggggttttatacactactgggtcagccagaaaagggaaatgtgcgtcagttcgtgaaagagcccggggaacgccctctgtctggaatgtgcctgaggtctgacatcaagtcagggtttccatcccacacttggcaccgtaccttaacctgcagtttcttccaaatgcccaaagccttgtttccgcttaccttaggctgaaacccggcctaaggaaatctatgggaaagtaacattttaagttttttaaaagaaaaaatgtttttctttgtttcagtgtttggagatttttgttgtttgttgtccctccctttcctgaatcctgttatgaaccaattttatataatataattagtgttaatctaaggtgttactcggcaccgttgttgcggtcatctttataag

SEQ ID NO: 4347 - DNA, 296 bp, Mus musculus
  misc_feature (150)..(150): n is a, c, g, or t
  misc_feature (162)..(162): n is a, c, g, or t
acaccagtctcttcagaccatctttttctctttggaggatttaccactgaaaaacagccactaagtgatgcctggacttactgcatcagtaaaaatgaatggattcagtttaatcatccttatgttgaaaaaccaagattatggcacacngcttgtgcgagngatgaaggagaagtcattgtttttggtggttgtgctaacaatctgctggttcatcacagagctgcacacagtaatgaagtacttatattttcagttcaaccaaaatctcttgtacggctaagcttagaagcagt

SEQ ID NO: 4348 - DNA, 353 bp, Mus musculus
  misc_feature (153)..(153): n is a, c, g, or t
gtgctggggctaaataccatcatttgtttttctctttaaactaagacatgtttcaacagaatttctactgaactgactacaactcaattctttcagaatacaaaatactcaattttaaggaaaaacatacaggcgtaccacttggtaattaanagaccatagcaaatcctttattacaaataattaaatctctccacgtcgcacacagtatcaaacagcattctgtagtcccactagacagcacaggaggcattcaatgctacaagtgaggacggagttaaacttgcaactcctgacccggtgtcctttccccacatcacccaactgtgtgccacaagcatctcatctcaaac

SEQ ID NO: 4349 - DNA, 226 bp, Mus musculus
caaggatggcgaggtttactgcattgatgcccgttactatggcaacatcagccgattcattaaccacctgtgtgaccccaacatcatccctgtccgggttttcatgctgcaccaagatctacggttcccacgcattgccttcttcagctccagggacatccggactggggaggagctgggctttgactacggtgaccgattctgggacatcaagagcaagtatttc

SEQ ID NO: 4350 - DNA, 201 bp, Mus musculus
  misc_feature (106)..(106): n is a, c, g, or t
gtactaggaaaagtgcaccagcatcttcatgttactgagaccattttcccagcatgggcactcataaacagcacatagcagacagaccagtgagatgctctctctntcattagcacctgacatcctgctcccaccacaccagacccatttcccattgttttagagatttggaaactttgtacaaattatccacggcaagat

SEQ ID NO: 4351 - DNA, 484 bp, Mus musculus
  misc_feature (344)..(344): n is a, c, g, or t
  misc_feature (356)..(356): n is a, c, g, or t
  misc_feature (408)..(408): n is a, c, g, or t
  misc_feature (412)..(412): n is a, c, g, or t
  misc_feature (437)..(437): n is a, c, g, or t
  misc_feature (453)..(455): n is a, c, g, or t
  misc_feature (457)..(458): n is a, c, g, or t
aaaagctcatactcctaaccctaggaaagggttttagggagccaaggaccagagagccacaggactatccagaaagaaacccatcaggggtgtagcacagggttagccaagcccctgtggggtgcttggatcaggagaggatacctcagtggttaaggttctgatggacgcacatatacatagatgtactcacttatctatggtacagatgggtggggaagaggttgctctttactctccatctctgacacaaagtgtagctgctagagggatgacctctccttcaacttgtcctgaagcacttacatttagttgttgaaagcagtagtagcagaccaagctanccccttatccanccaacactgcacctaaccccagggatttgctaccagagcaaactcagttctncctntccctgaagtatgaccaggagacanccagtttcaagggctnnntnngcctagcagaggccaagtggtttgaa

SEQ ID NO: 4352 - DNA, 309 bp, Mus musculus
gagtgctggagcgttttcagtccctgggactcatcgtgaaagagtggaccagtgtgaaactgcacgccacggtcatgaacacactgctcaggaaagaccccaacgcggaaggcaggtacaatctctacacagcagatggcaaatatatcttcaaggagagagagtcttttgatggccggaacattttaaagacatttgagaacttctactttggttccctgaggctcaattctattcacatctcccagaggttcacggtggacagctttggaaactatgcctcctgcggacatgttgacttctcctgac

SEQ ID NO: 4353 - DNA, 448 bp, Mus musculus
  misc_feature (333)..(333): n is a, c, g, or t
  misc_feature (336)..(336): n is a, c, g, or t
  misc_feature (359)..(359): n is a, c, g, or t
gcgcgacacctcaaactttttggttaccagccaactatctattaccccaaaagacctaacaagcccctcttcactgggctagtgactcagtgtcagaaaatggacattcctttccttggtgaaatgcccccagagcccatgatggtggacgagctgtatgagctggtggtggacgccatcttcggcttcagtttcaagggtgacgttcgggagccattccacagcatcctgagtgtcttgagtggactcactgtgcccattgctagcatcgacattccctcaggatgggatgtagagaagggaaaccctagcggaatccaaccagacttactnatntcactgacggcacccaagaagtntgcaactcactttactggccgatatcattaccttgggggtcgctttgtaccacctgctctagagaagaagtaccagctgaacctgccat

SEQ ID NO: 4354 - DNA, 377 bp, Mus musculus
aagcctgtgaggatccaaaaagcgaagctaaaagtgttcctaaatccaaaggaaagaaaaccaaagatgtgaaaaaatctgtcaaagcacctgctgaagcacagccagtgagtgatgtcctcatcagctgtgcgacttgccacagtgaatttccatcccggaataaactgtttgatcatctaaaggctactggtcatgcaagagcaccttcagccacagcatctttaaacagtgtaactaggaacaagaaagagaagcgtagaagtagataggaattctgttaactcttttttttttttaactgtctctagatctggaaccaaaaactgaactgacataatctagagttaaaatttcagtgatctgcaattcattgc

SEQ ID NO: 4355 - DNA, 176 bp, Mus musculus
atactttcaaagttctcacaagggataagcgtcttgtacctggaggtggagctaccgaaattgaattggctaaacaaatcacatcatatggagagacgtgtcctgggcttgaacagtatgctattaagaagtttgctgaagcgtttgaagcgattccacgggcactggcagaaaat

SEQ ID NO: 4356 - DNA, 371 bp, Mus musculus
  misc_feature (250)..(250): n is a, c, g, or t
  misc_feature (253)..(253): n is a, c, g, or t
  misc_feature (255)..(255): n is a, c, g, or t
  misc_feature (315)..(315): n is a, c, g, or t
  misc_feature (321)..(321): n is a, c, g, or t
  misc_feature (328)..(328): n is a, c, g, or t
  misc_feature (335)..(335): n is a, c, g, or t
gtggacacacggctttcccaggttctgctgggttttgtctcccctgagcactagctgaagccaaactgttcagtgtgggtgtggaagccactcactcgcctgtcttcccttactttaccttcatcctgtgtttgttctctttgaagtgaactcactgtcatgactgggtagtgtggactatcctgagccgtaactgctctgaatgttcactcgattagccatgtatattttaaatgctaatatttaatgnaantntaagtttcaacattgttgctatttctgcatttaaacataattgggagacaactgacattnctacantcaactngccaggnccttagactaagtatgtccatttttgttcaggtaca

SEQ ID NO: 4357 - DNA, 529 bp, Mus musculus
  misc_feature (243)..(243): n is a, c, g, or t
  misc_feature (248)..(248): n is a, c, g, or t
  misc_feature (250)..(251): n is a, c, g, or t
  misc_feature (257)..(257): n is a, c, g, or t
  misc_feature (267)..(270): n is a, c, g, or t
  misc_feature (277)..(277): n is a, c, g, or t
  misc_feature (293)..(294): n is a, c, g, or t
  misc_feature (304)..(304): n is a, c, g, or t
  misc_feature (330)..(330): n is a, c, g, or t
gccaggacaggcttctgttcagagtactggtttgtggaacaagaggctcttattacagtgaagagcaatgtccactgtcaggtgttttccaagtccagttccaggagcctcctcatgtttgcctgctgggatccctgcacaaggtgtttctttacaatagaccaggatgtgaagcactgctgctaacccctgctccctgtgacatcaccatctcctccctctcttcctctctccattttgggnaattntnngtcagncgaggtcttnnnnttacttngtttttgactcatgtnnccgtgggcanctagagtagagaattctggaggaaanaaagtttatttcatcttgacttttgtgtttgagttatttttaatattttcctgtaaatattttgtaatattttccttgtagtgaaatggattacagtatcatttcctaattcaaaacaggatatgtgggaagaaaatatacaattctgggattaaagttacttcccacaagctaaactcttttgagtgtttcatggaca

SEQ ID NO: 4358 - DNA, 58 bp, Mus musculus
acatcgccgacaacttccaggcatttgtgtgggagccagccatggtgcgcatcaacgc

SEQ ID NO: 4359 - DNA, 221 bp, Mus musculus
catcatgattgtgaggagggccatcaagaatgactctgtggtggctggtggtggagccatcgagatggaactttccaaatacctgcgggattactcgaggaccattcctgggaagcagcagctgttgattggggcatatgccaaggccctggagattattccacgacagctatgtgacaacgctggctttgatgccacaaacatcctcaacaagctgcggg

SEQ ID NO: 4360 - DNA, 250 bp, Mus musculus
  misc_feature (225)..(225): n is a, c, g, or t
aaatcttgacaaaacttctggaggtatcagatgatccacaagtcttagctgttgctgctcacgatgttggagaatatgtccggcattatccccggggaaaacgggttattgagcagcttggtggaaagcagttggtgatgaaccacatgcaccatgaagaccagcaggttcgctacaatgctcttctggccgtgcagaagctcatggtgcacaactgggaatatncttggtaaacaactacagtcagagc

SEQ ID NO: 4361 - DNA, 516 bp, Mus musculus
  misc_feature (147)..(148): n is a, c, g, or t
  misc_feature (299)..(299): n is a, c, g, or t
  misc_feature (310)..(310): n is a, c, g, or t
  misc_feature (353)..(353): n is a, c, g, or t
  misc_feature (369)..(369): n is a, c, g, or t
  misc_feature (387)..(387): n is a, c, g, or t
  misc_feature (394)..(394): n is a, c, g, or t
  misc_feature (412)..(412): n is a, c, g, or t
  misc_feature (431)..(431): n is a, c, g, or t
  misc_feature (477)..(477): n is a, c, g, or t
  misc_feature (483)..(483): n is a, c, g, or t
  misc_feature (485)..(485): n is a, c, g, or t
aggtcagctgcagcctcaatccagaacctcctgatctcctggcaccatggttcgctaccgaatgaggagccccagtgagggtccgcaccaggggcctggacaagaccatgaacgcgaggagcaggggcaggggcaagggctgagccnngagcgcgtagaggactatgggaggacacacaggggccaccaccaccacagacacaggcgctgctctcgtaagaggctacataggatccacaagaggcgtcggtcatgcagaaggcggaggagacactcctgccgccacaggaggcggcatncgcagaggctngcagaagatcccgaaggaggaggagatgcaggtgcaggaaatntaggaggcaccatcantaagcctccccaggcctntccattntgcctggagccaaggaantcacttgcccaaggaatantcacctgcccaagcaacatcatgtgaggccacaccaccattccatntcgatntntgagccctgagctgccaaggagccacgagat

SEQ ID NO: 4362 - DNA, 493 bp, Mus musculus
  misc_feature (258)..(258): n is a, c, g, or t
  misc_feature (268)..(268): n is a, c, g, or t
  misc_feature (271)..(272): n is a, c, g, or t
  misc_feature (281)..(281): n is a, c, g, or t
  misc_feature (288)..(288): n is a, c, g, or t
  misc_feature (309)..(309): n is a, c, g, or t
  misc_feature (311)..(311): n is a, c, g, or t
  misc_feature (313)..(313): n is a, c, g, or t
  misc_feature (323)..(323): n is a, c, g, or t
  misc_feature (326)..(326): n is a, c, g, or t
  misc_feature (400)..(400): n is a, c, g, or t
atttgtccaaacaggtgctggcccagcatggaatccgatgaaaaccctctgattggtctgggtagctgtgagcagaagacggtttaccaggggcccaggagtatttggaagcaacgtgttaattataaacagcagggtttgagcacaatctgttctactcttaatgatgttatcttaacactgaaattgcctgaaacccatttacttaggactgtgttttgctctatgaactatcccctgcgctttgaacgtgccagncagcccttgnttnntttgcccanccttttncacttcctctccacaggagtntntnctggctcttnccnaagcagatttcctaaggccactattttaaaagatcatagttgctaaagtatgtgctgtgtatgtttatcttctnacctagttttctcaaaacctggcagcttgttcattgtgcacacagcagcttcatgtctaactctgcttgctaacctgacagtactggtcactc

SEQ ID NO: 4363 - DNA, 433 bp, Mus musculus
  misc_feature (329)..(329): n is a, c, g, or t
  misc_feature (359)..(359): n is a, c, g, or t
ctatcacagtgatcggcagctcatgagtcaagtagcggtggcagggctactcacggtgcttgtttctttcctggatgttcgaaacatcatcctaggcaagtctcactatgtcctgtatgggctggtagccgccatgcagcctcggatgctggttacatttgatgaggagctgcgaccattgccagtttctgtccgtgtgggtcaggcagtggatgtggtgggccaggctgggaagccaaaaacaatcacagggttccagactcatacaacgccagtgttgctggcccatggggagcgggcagagttggccactgaggagtttcttcctntcacccccattctggaaggctttgttattnttcggaagaaccccaactatgatctttgaaaaagtggcttctagagaccctggctgcagcggaattttttgttt

SEQ ID NO: 4364 - DNA, 82 bp, Mus musculus
  misc_feature (42)..(42): n is a, c, g, or t
  misc_feature (51)..(51): n is a, c, g, or t
gaccgtgtgacagatgcctgatcacatcactgatcacggcantcccactgnaagtgtttccacatcataacaaagttcaata

SEQ ID NO: 4365 - DNA, 294 bp, Mus musculus
tgggtgtcaaccctacaagctgccacggctgggttcttggagaacatggggactccagtgtgcccatatggagtggtgtaaacgttgctggcgtaactctgaagtcactgaacccagcaataggaactgactcagataaggaacactggaaaaatgttcacaagcaggtggtggaaggcggctatgaggtccttaacatgaagggctatacctcttgggctatcgggctgtctgtgactgatctggcgcgatccatcttgaagaatcttaagagagtgcatcctgttaccacgc

SEQ ID NO: 4366 - DNA, 362 bp, Mus musculus
agccacagcagtgtacaaggtctctgagtatgcccgtcgctttggtgttcctgttattgctgatggaggaatccaaaatgtgggtcatattgccaaagctttggctcttggggcttccacagtcatgatgggctccctcctggctgccaccactgaggcccctggcgagtacttcttctcagatgggatccggctgaagaaataccgaggtatgggttctcttgatgccatggacaaacatctcagcagccagaaccgatacttcagtgaagctgacaaaatcaaagtggcccaaggagtttcaggggcagtgcaggacaaggggtctatccacaagttcgttccttacctgattgctggca

SEQ ID NO: 4367 - DNA, 515 bp, Mus musculus
  misc_feature (269)..(269): n is a, c, g, or t
  misc_feature (275)..(275): n is a, c, g, or t
  misc_feature (302)..(302): n is a, c, g, or t
  misc_feature (397)..(397): n is a, c, g, or t
  misc_feature (402)..(402): n is a, c, g, or t
  misc_feature (441)..(441): n is a, c, g, or t
  misc_feature (456)..(456): n is a, c, g, or t
  misc_feature (467)..(467): n is a, c, g, or t
  misc_feature (490)..(490): n is a, c, g, or t
gaaagtgtgggaccttttccctgaggctgacaaagttcgcaccatgctagttcggaagatccaggaagagtctctgaggacctacctttttacctacagcagtgtctatgactcaatcagtatggagacactatcagatatgtttgagctggatctacccactgttcactccatcatcagcaagatgatcattaacgaagaattgatggcttccctggaccagccgacacagactgtggtgatgcaccgtactgagcccactgcccagncagaancttggctctgcaagctggctgagaagncttggcagcctagtggagaataatgaacgggtgtttgaccataagcagggaacctatggtggctatttccgagaccaaaagggatggctaccganaaaanatgaaggctatatgccgccgtggtggctacccgccagcnagcagtctcagacangcctactgagnttctccacttcagtcaccctgtngaacagaccatcttagcctttttgc

SEQ ID NO: 4368 - DNA, 407 bp, Mus musculus
  misc_feature (115)..(115): n is a, c, g, or t
agaacctttgatgaacctcctgagtgcaaaagataccaagattattcaggttattcttgacgccatttcaaatatctttcaggctgcagagaaactaggtgagacagaaaagctnagtataatgattgaagagtgtggaggcttggataaaattgaagcactacagaggcatgaaaacgagtctgtatacaaggcctcattgaacttaattgagaagtacttctcagtggaggaagaggaagatcaaaatgtggtgccagaaactacctctgaaggcttcgccttccaagttcaggatggagctcctgggacctttaacttctaatgtccagctaaggcacaaagttgttagctatgtgctgtgctattctgtgttctcatagatttgtcttactgtttctctacta

SEQ ID NO: 4369 - DNA, 301 bp, Mus musculus
  misc_feature (39)..(39): n is a, c, g, or t
tagagctggccctcagactgacagagtactcccgaacanctgagtggtatggagtcctactgtgttcgtgctttcgcggatgctatggaagtcattccatctacactagctgaaaatgctggcctgaatcccatttctacagtaacagagctaagaaaccgccatgcccaaggagaaaaaactacaggcattaatgtccgaaagggtgggatctccaacattttggaggaaatggttgttcagcctctgttggtgtcagtcagtgctttgaccttagcaactgaaactgtgcggagcattc

SEQ ID NO: 4370 - DNA, 162 bp, Mus musculus
agtttgctcaagatgtgggccgcatgttcaaacagttcaacaagctgactgaggacaaggcagatgttcagtccatcatcggcttgcagcgcttctttgagacacgcatgaatgatgcctttggtgacaccaagttttctgctgtgctggtagaaccaccac

SEQ ID NO: 4371 - DNA, 522 bp, Mus musculus
  misc_feature (337)..(337): n is a, c, g, or t
  misc_feature (474)..(474): n is a, c, g, or t
gttgaaatctgtggtcccaggtggaggtgctgtagaagctgccctgtccatatacctggaaaactatgcaacaagcatgggatctcgggaacagcttgctattgcagagtttgcaagatctctgcttgtgattcctaatacactggcagtgaatgctgcccaggactccaccgacctggttgccaagttaagagcttttcacaatgaggctcaagtgaacccggaacgtaaaaatctaaagtggattggtcttgatttggtccatgggaaaccacgagacaacaagcaagcaggggtgtttgaaccaaccatagttaaagtgaagagcctgaagttncgcaacagaggctgcaatcaccatccttcggattgatgatctgataaaattacacccagaaagcaaagacgataaacacggaagttatgaaaatgctgttcactctggagcccttgatgactgattggatttccctnttatttataacagtgtcaggtgcaatgccgtagccttgggtgtctcac

SEQ ID NO: 4372 - DNA, 483 bp, Mus musculus
  misc_feature (59)..(59): n is a, c, g, or t
  misc_feature (196)..(196): n is a, c, g, or t
  misc_feature (286)..(286): n is a, c, g, or t
  misc_feature (296)..(296): n is a, c, g, or t
  misc_feature (305)..(305): n is a, c, g, or t
  misc_feature (310)..(310): n is a, c, g, or t
  misc_feature (312)..(313): n is a, c, g, or t
  misc_feature (335)..(335): n is a, c, g, or t
  misc_feature (341)..(341): n is a, c, g, or t
  misc_feature (369)..(369): n is a, c, g, or t
  misc_feature (374)..(374): n is a, c, g, or t
  misc_feature (378)..(378): n is a, c, g, or t
caggctggttgtggttggattttctaagacagaaagtagcatctctctgtggcagaggncccttgcgagggaggtgtgttggagatctagaccctttaaaacaaagcaagctgcagttaaccatgttgccttttgccactctaattgaccagtggactaaatggcagggaggccccttctgggttggtcagattgnagagaaggggctgaccaaagtgccaagacctaatgggtgccagccttgctctcagaagtggtccaagggcctttgcgcctggtacaagcntagggtgagncctgtcttncaccngnncaccctcacccgtgacaccaangtctcncctcagttccagattccagacagtattnctttntccnccatcctatgaccaaaggtccctgccagatgtaaagcgaagctggtgtgtgtggaatcagtgtggcaacccatggactgcagtgcgcataaccagctcacctctt

SEQ ID NO: 4373 - DNA, 234 bp, Mus musculus
tgacagcgaccttgtcatctgggatccagatgccttgaagattgtctctgccaagaaccaccagtcggttgccgaatacaacatctttgaagggatggagctgcgtggtgcacctctggtggttatctgccagggcaagatcatgctggaagatggcaacctgcacgtgacccagggggctggccgcttcattccctgcagcccattctctgactatgtctataagcgcattaa

SEQ ID NO: 4374 - DNA, 303 bp, Mus musculus
aagagatttatcaccggatccccaactcagacccatcatcaagcaaaaccaagcaggtcatctccaagatcaggacacagaaccttcccaactgccagctcatctcccgaagccactactcccccatttacctgtcatttatcatgctcttggctgccctgagctggcagtacctgagcaccctgtcccaggtcacagaagactatgtccagagagaacactgattttgtttagccggaagtggaagttcccgtggagtgggtttttccttttcctccagctggattttgacttcccttgttt

SEQ ID NO: 4375 - DNA, 448 bp, Mus musculus
  misc_feature (313)..(313): n is a, c, g, or t
  misc_feature (319)..(319): n is a, c, g, or t
  misc_feature (328)..(328): n is a, c, g, or t
  misc_feature (363)..(363): n is a, c, g, or t
  misc_feature (379)..(381): n is a, c, g, or t
  misc_feature (385)..(385): n is a, c, g, or t
gcagttttagagtgatgaatcctttgtaggacaggtagagagtatcttagagataaaaaaatgggctatgtcctctcctgcccatgtcttgtgctcactcgcccctcagtctaccctttttgctgggacagtgatggtcttggccaaggtcagcatgtaatggaaagacagtgtattgccaggctggatagatggggtcatctcacagtgggtcacgtgaaaatcagtgtcacgtagtcccagtgaatgttgtgttctttctggggggaggggggaatagaataaactcaaattctttttcagtatagccccntgagtnaatgaatgnaaatttgagcttatgtaagtaaagattcatttatnccaccagggagagccnnntatntgagagacatttagcagagagcactttagttttttgctgctaactgttgtgtgatcctttgct

SEQ ID NO: 4376 - DNA, 380 bp, Mus musculus
  misc_feature (315)..(316): n is a, c, g, or t
  misc_feature (324)..(324): n is a, c, g, or t
  misc_feature (343)..(343): n is a, c, g, or t
  misc_feature (347)..(347): n is a, c, g, or t
  misc_feature (349)..(349): n is a, c, g, or t
  misc_feature (355)..(355): n is a, c, g, or t
gtatttttgccgaactcacttgggacatcttttaaatcctggagacctggtgctgggatttgatttggccaactgtaacttaaatgatgagtatgtcaacaaaatgaactcagacagagttccagatgtggtgttaattaagaagagctatgaccgcaccaaacgccagcgccgtagaaactggaaactgaaagagcttgcaagagacagagaaaacatggacacagatgatgaaaggcaatatcaagattttcttgaagatcttgaagaagatgaggcaattagaaaacatgtcaacatttacagagatgcaannccatcccntgtggaaagtgacacagantgantngaaggnagcacctcgaattagtctggctgag

SEQ ID NO: 4377 - DNA, 150 bp, Mus musculus
gggtatcaatgggttcccttccaggaagaggtatattctgtgcctcagaagagctgccagggtcagggagagagtgaaaatccttctaggcagctcacttgtagatacacacgactgccaggattcaggaaaagcgtggccattttcaaa

SEQ ID NO: 4378 - DNA, 180 bp, Mus musculus
  misc_feature (78)..(78): n is a, c, g, or t
  misc_feature (125)..(125): n is a, c, g, or t
gcgagcaggtgctcctgagcaatagcaatctccaggatgcctaggagggacctcaagcccacacacctcctcctccangcaactcctgtcctcagctcctcccacggcctcctcccacctctggnttcaggcgctctgaaaacactcacagggagaggcttgcagccgagcgagcgagcg

SEQ ID NO: 4379 - DNA, 183 bp, Mus musculus
  misc_feature (106)..(106): n is a, c, g, or t
  misc_feature (110)..(110): n is a, c, g, or t
  misc_feature (157)..(157): n is a, c, g, or t
gggtgctgctgtgtcttgaaagaccaaggattgaggggacctgtctcttagtgttaggggaagagggtggatgcgcctaaggaactctgctcctggtgttacagtngctntccctctccacccttgagtatttatgctgagtaagctccaggctccngctcagtgatgctgccacctgctgga

SEQ ID NO: 4380 - DNA, 288 bp, Mus musculus
cgagagtgctcgagatccagtggaagctagaaagtgcacaggatcccagagctacagcctggcagaagtcatcctctgtaggccctgtaggaagggaccgacgactccggccaccacctggggcttgttcatgtggatgtagtgattgcctgggacttccacaaactggaaccgctagagaaagggggtgggtggtgagatagcgcccactcaggagactcctgtggtcagaggcaaccttgtctattcacagtagcctggggacttggaggctgtcacggaaatgta

SEQ ID NO: 4381 - DNA, 495 bp, Mus musculus
  misc_feature (309)..(309): n is a, c, g, or t
  misc_feature (365)..(365): n is a, c, g, or t
  misc_feature (407)..(407): n is a, c, g, or t
  misc_feature (415)..(415): n is a, c, g, or t
  misc_feature (422)..(422): n is a, c, g, or t
  misc_feature (424)..(424): n is a, c, g, or t
  misc_feature (450)..(450): n is a, c, g, or t
tatttccctggtggcaaccgagaaagaaaaggtttggtatcatgtatgtagcaaccgtgggaagggatgctataacactagactcaaggaagatggcggctgtactatctggtacaatgaaatgcagctactttccgagatagaagagcacctgaactgcaccatttcccaggtcgagccagatataaaggttccagtggatgagtttgatgggaaagtcacatacggtcaaaaaagggctgctggcggtggaaactacaaaggccatgtggatgtcctggcacctaccgttcaagagttggctgcccnttgaaaaggaagcacagacctctttcctacaccttggctaccttcccaaccagctnttccgaaccttctgacgtcatgtagacagaggagcattggantcataaantctgtantnttaactctaaccctctggtgctgctntctgagcagcagtatttacaataaccgagctatcacggctaactc

SEQ ID NO: 4382 - DNA, 274 bp, Mus musculus
  misc_feature (173)..(173): n is a, c, g, or t
agaagaacgccatctatcggcactacaccaagagcagcaagcagatccagtggttctggcaggttgtcaaggagatggacaatgagaagaggatccggctactgcagtttgtcacgggaacctgccgtctgcctgttgggggatttgctgagctcatcgggagcaatggcccngcagaagttctgcatcgacagagttggcaaggaaacctggctgcccaggagccatacgtgcttcaaccgtctggacctgcctccctataagagctacgagc

SEQ ID NO: 4383 - DNA, 473 bp, Mus musculus
  misc_feature (267)..(267): n is a, c, g, or t
  misc_feature (274)..(275): n is a, c, g, or t
  misc_feature (283)..(283): n is a, c, g, or t
  misc_feature (285)..(285): n is a, c, g, or t
  misc_feature (367)..(367): n is a, c, g, or t
  misc_feature (381)..(381): n is a, c, g, or t
  misc_feature (385)..(385): n is a, c, g, or t
gaactctcaagagccatttggtcataacatacattcctatcagatgtgttttaaaataaggagtgtggaatttaatacatttcctttagagctaccatactattttttgacattaagtgtgtggcacctagacaccatgtcatatctagttaatgagcagaaacaagcacaagttcccacttgaccaagtgatagtcctctgtaggaaactaactacccagctacagagggaagagtagccttagggagagagctgacccaagggtntactttnntccttggnanagtttgagcattttcagtgtacagagttttcattcctaggctattttccatcgacttagttttttgtgctagtgttaaactntctgtggtttcctntgcnttctcctttgctgaagttggtttgtgttttgtacttttgtgctagttctggctaattccaattgcttgctttcgaaattgcggttgct

SEQ ID NO: 4384 - DNA, 286 bp, Mus musculus
  misc_feature (75)..(75): n is a, c, g, or t
  misc_feature (142)..(142): n is a, c, g, or t
  misc_feature (151)..(151): n is a, c, g, or t
  misc_feature (155)..(155): n is a, c, g, or t
  misc_feature (164)..(164): n is a, c, g, or t
  misc_feature (166)..(166): n is a, c, g, or t
  misc_feature (171)..(175): n is a, c, g, or t
  misc_feature (183)..(184): n is a, c, g, or t
  misc_feature (186)..(186): n is a, c, g, or t
  misc_feature (188)..(188): n is a, c, g, or t
  misc_feature (192)..(192): n is a, c, g, or t
  misc_feature (198)..(198): n is a, c, g, or t
  misc_feature (200)..(200): n is a, c, g, or t
  misc_feature (257)..(257): n is a, c, g, or t
gtcgaccagccgcaagctaaagactcatggcatgaggagaggcaagaaccgagctcctcacaagggcgtcaagangaggtggaagcaagagaaaataccggaagagcgtcctgaaaagtaggaaacggggcgatgatgcaantcgcaattnaccnatcccactntntgatnnnnncaatgagnntntncccntggtgntnttcaaacaacacggggcaggagcatgaggacatcagagggggactgccaaagagatnctgaagttagaccaaaagccaaagatcct

SEQ ID NO: 4385 - DNA, 186 bp, Mus musculus
  misc_feature (70)..(70): n is a, c, g, or t
  misc_feature (87)..(87): n is a, c, g, or t
  misc_feature (149)..(149): n is a, c, g, or t
gtgctccagacgagagactcacctggggtggagacaggcttctgtgcgtctctaattcctgtcaagcccngtgtcctccagaggctnctggcacatagagtggagtcaccaaagcaccacttttgcactggctacctctcactcctatncttgtgcgcttctgtggcagggactgactgctgatac

SEQ ID NO: 4386 - DNA, 155 bp, Mus musculus
gttttgattccctgttatcagaagtgttttgcaaaggcatgatgttcatggatataacctgtgtgctctggagaccaatgtgaaggtcactgaactctcggccagcatttaaagaacaagggcaagtggtgaatccagcgctcccttgcaagctt

SEQ ID NO: 4387 - DNA, 547 bp, Mus musculus
  misc_feature (299)..(299): n is a, c, g, or t
  misc_feature (311)..(311): n is a, c, g, or t
  misc_feature (322)..(322): n is a, c, g, or t
  misc_feature (403)..(403): n is a, c, g, or t
  misc_feature (412)..(412): n is a, c, g, or t
  misc_feature (522)..(522): n is a, c, g, or t
agggtgctgtagcatacaccacgctcctgtgtgccgctggcctctagctgaaatgatgtgcttgggatttgaggaggactgtcccaggtggtgccctccccacattgtcactcacgctctggagagtgtgctcttcctcctatcccagaacaaggaagcagtgatgtagcatcagaaagctgcgtggtggcggaccctggaggggagcttgtcaatgctccatttgttttcccagtgtgtgcaagcatccattgcgtgagacagacagtctgcagtgagaactcaacttaggtgttctnggggaaactccnaagttctgatncctccttagagaagaagggagggagcagagtgcagtgtgtgctgtgctgaaggagctcctgacctgagagatggactgcangccctcctncctgctgcgcatccagatcctgaggagaaatgccgaatgcatctatttttgttcttgtatggcagcccttgaagatttgaggtggttaatgtatcttcaggttaaaacgnccctagttcatttattctgcatttg

SEQ ID NO: 4388 - DNA, 369 bp, Mus musculus
gccagccgtcacgattctggatagtcccatcccaggttctgtttgattgagtttaggttccgtctggggaggggtctaatgttctgatggagtcattctgttgttgatataaaaaaagcaactctgaaaaaggaagcactccgccaggatcaggtctagaggagagctggagctggtggtgtctgtgagtggttgaacaaggaaactgtccagaaccgggcacagtggggtctttaagggccctgtcccccaactgagacaactcaagactcccatcttagctgagccctgactgtccagatcaggtggctgcgtaggtatcaagtgtctaaagaacagtgctgctgtggagagagaccctcttaagcc

SEQ ID NO: 4389 - DNA, 364 bp, Mus musculus
  misc_feature (63)..(64): n is a, c, g, or t
  misc_feature (97)..(97): n is a, c, g, or t
  misc_feature (100)..(100): n is a, c, g, or t
  misc_feature (122)..(122): n is a, c, g, or t
  misc_feature (125)..(125): n is a, c, g, or t
  misc_feature (128)..(128): n is a, c, g, or t
  misc_feature (143)..(143): n is a, c, g, or t
  misc_feature (191)..(191): n is a, c, g, or t
  misc_feature (194)..(195): n is a, c, g, or t
  misc_feature (201)..(201): n is a, c, g, or t
  misc_feature (236)..(236): n is a, c, g, or t
  misc_feature (254)..(254): n is a, c, g, or t
  misc_feature (267)..(268): n is a, c, g, or t
  misc_feature (303)..(303): n is a, c, g, or t
  misc_feature (330)..(330): n is a, c, g, or t
acctgctcacaggttggctggctcgacccaggtggtgtcccctgctctgagccagctcccggnnccaagccagcaccatggccagataccgatgctnccngcagcaaaagcaggagcagatnccnccntcgcaggcgaagatntcgcagacggaggaggcgatgctgccggcggaggaggcgaagatgctnccnntcgccngccgctcatacaccataaggtgtaaaaaatactangatgcacagaatagcaantccatcaaaactnncctgcgtgagaattttaccagacttcaagagcatnctcgccacatcttgaaaaatgccaccntccgatgaaaaacaggagcctgctaaggaacaat

SEQ ID NO: 4390 - DNA, 360 bp, Mus musculus
aaaagaagcgcttgcccaaacctcagccccagaataaggaagcggggagtgaggcagaatcctcaagtgcagacccaggcccaggaaggaagaggaagaggatacagtcatcacagagtgcagagtgaggtgcacagcccaggctggcacatggtggaatggggcaggatacctgggcatgctcctgcagcctctgaatgccgaggttctgagcgtccgtcctataggggaggagcaggaggaggacggaagaaactcttggtttagtcccagcctttaagcatgatcctgcctcagagccatgacctgcatctcagaaaaacactcaacatttcacttgtacatatgctatggctgtgc

SEQ ID NO: 4391 - DNA, 550 bp, Mus musculus
  misc_feature (225)..(226): n is a, c, g, or t
  misc_feature (229)..(229): n is a, c, g, or t
  misc_feature (231)..(233): n is a, c, g, or t
  misc_feature (295)..(295): n is a, c, g, or t
  misc_feature (301)..(301): n is a, c, g, or t
  misc_feature (351)..(351): n is a, c, g, or t
  misc_feature (493)..(493): n is a, c, g, or t
gaagagccacttcctagagatctttctggaggagctggccaaagtgggcgctgcagagctcaccgcagaccagaatctgcagttcatcgaccccttctgccagatagcagcccgcactaaggattcccaggttttgcataagatcattcagagcatctttcagacgattgtggagcaggctcccttggccatagaagacatcatgaatgaactggacacacagannggngnnngggaagggtcagatgaggacgatggtgatgatgacagtgacgaggcctcagagggtgagcangatctncaagacacaccacccaagaagctgcctgcaggcaccgcacatagggctgnccctgaggcagacaaggaacaggcgtgggatgacgaggagaacgctggccctgtcctccagtttgactacgaggcacttgctaacaggctgttcaagctcgccagtagacagagcaccccttctcagaacaggaagcgcctntacaaagtgatccaaaagctgcgggagctggctggaggcactttcccagaggatgat

SEQ ID NO: 4392 - DNA, 223 bp, Mus musculus
  misc_feature (77)..(77): n is a, c, g, or t
gtgccttggacgagtacacctccgagctgatgctgggtgggacaaacaccttggtgctccataatacctgcgaggantcgctcctggccgcgcccatcatgctggacctagtgctgctcacagagctgtgtcagcgcgtgagcttctgcacagactcggaccccgagcctcagggcttccacacagtgctgtccctgcttagcttcctgtttaaggccccgct

SEQ ID NO: 4393 - DNA, 413 bp, Mus musculus
  misc_feature (352)..(352): n is a, c, g, or t
  misc_feature (383)..(383): n is a, c, g, or t
aaatgaatgcacagggcggcccagtgctgaatgaagaagacttgaaccgcgactggctggactgggtgtacacgttctcccgagctgccgtcctcctcagcatcgtatacttctattcttctttcagtcggtttatcatggtaatgggagccatgctgctggtttatttacaccaagctggatggtttccgttcaggcaagaaggcggtcagcaacaagctcccaacaatgtggacgctaacaatgacgggcataatgcaaacaatctagaacttgaagaaatggagcgccttatggatgatggacttgaagatgagagtggagaagatgcaggtgaagatgccagtgcagntcaaaggcctgggttaatggcttcagcttgntcttttatcaccaccttttttacttcacta

SEQ ID NO: 4394 - DNA, 503 bp, Mus musculus
gacacttcagtaaacctcgcttggacatcaggtaccaactgcactcgttttggcattgcagctaaataccagttggatcctactgcttctatctctgcaaaggtcaacaactctagtttaattggagtgggctatactcagactctgaggcctggtgtgaagcttacactgtctgctctggtagacgggaagagctttaatgctggaggccacaaacttgggcttgccttggaattggaggcttaatccagttaaaagaaacctctgggaacgaatatcagaagatttggccttaatatatttccatgcgaccagcaggctccccttccttcccccagaaggtgatcacatcaaaggatgatgaagcaagagctgtattttaaatatttagacagtcactgttggctggttcctagttggatggttatcagtgctgccgtggtgcggccccctatacattatttaaatgtatttaactgttaaatgtgctacccaccaatgat

SEQ ID NO: 4395 - DNA, 300 bp, Mus musculus
attggctcaggccttgtatgaattattttcagctacagatgattccttgcatcagctccgaaaagcttgctttctgtattttaaacttggtggagagtgtgtgaccggtcctgttgggttgctttcaatattgtctcctcaccctctggtgttgattcgacacttcttttccgttgcaatctacgccacgtatttctgcttcaaatcagagccgtgggctacaaaaccacgggcccttttcagtagcggtgctgtactgtacaaagcgtgttctatcctatttccactcatctattcaga

SEQ ID NO: 4396 - DNA, 532 bp, Mus musculus
  misc_feature (45)..(45): n is a, c, g, or t
  misc_feature (298)..(298): n is a, c, g, or t
  misc_feature (324)..(324): n is a, c, g, or t
  misc_feature (329)..(329): n is a, c, g, or t
  misc_feature (332)..(333): n is a, c, g, or t
  misc_feature (339)..(339): n is a, c, g, or t
  misc_feature (343)..(344): n is a, c, g, or t
  misc_feature (346)..(348): n is a, c, g, or t
  misc_feature (353)..(353): n is a, c, g, or t
  misc_feature (357)..(357): n is a, c, g, or t
  misc_feature (365)..(365): n is a, c, g, or t
  misc_feature (398)..(398): n is a, c, g, or t
  misc_feature (405)..(405): n is a, c, g, or t
  misc_feature (424)..(424): n is a, c, g, or t
  misc_feature (453)..(453): n is a, c, g, or t
  misc_feature (496)..(496): n is a, c, g, or t
  misc_feature (505)..(505): n is a, c, g, or t
gacatctgtgaataccgtccttattcctgtccttgtcctggtgcntcctgcaagtggcagggatccctggaagctgtgatgtcccatctcatgcatgcccacaagagtatcactacccttcagggagaggacatagtctttctagctacagacattaacctgccaggggctgtggactgggtgatgatgcagtcctgttttggccaccacttcatgctggtacttgaaaagcaagagaagtacgaaggccaccagcagttctttgccatcgtcctcctcattggcacccgaaagcaangctgagaactttgcctacagactggnagttngannatgggnaacnngnnngaganctgnacctgggnaggccacacctcggtccattcatgatggcgtgngctgcanccatcatgaacagtgactntcttgtttttgacacagccatagcacatntctttgcagataatgggaaccttggaatcaatgtcacgatatntacatgctntcagtgaggctccaggaggctttccta

SEQ ID NO: 4397 - DNA, 272 bp, Mus musculus
tgggctgcaatgagtgcacacaccccacctgccagcactcactgagtatgctgggcattggccagtgcgtggaatgcgagaatggagtccttgttctggaccccacttctggtcccaagtggaaggtggcctgcaatacatgcaatgtggtggcacactgctttgaaaatgcccaccgagtacgggtatctgctgacacctgcaacacctgcgaggctgccttgctcgatgtagacttcaacaaggccaagtctccccttcctggcaatgag

SEQ ID NO: 4398 - DNA, 394 bp, Mus musculus
  misc_feature (37)..(37): n is a, c, g, or t
  misc_feature (43)..(43): n is a, c, g, or t
  misc_feature (327)..(327): n is a, c, g, or t
gaaatgcattgatattctcatcgaaaaagaatatttnggagcngagtcgatggtgagaaggacacctacagttacttggcttaacccatctagcagggtctgcatgacccacaagcagatagttccagtgaataaaatggaaacaactcaagttcatagcagccagcctgccgccatttggaccttcatttttaaagctgagaccacagttcccaccagctgctggtttcaggctacagcaggactgctcaggactgactgacacatttcagtctgtaaacagacgccaatgccatttaccctaactcacagacagaggggaaccgnaaccttccatgctgaggctgcatgctaccgcacttaaatcaatacattggctccctggttaacagct

SEQ ID NO: 4399 - DNA, 62 bp, Mus musculus
catgggtgatgcttggatatgaacagtgggattttgtgcacaggaaccatgatatttttaat

SEQ ID NO: 4400 - DNA, 296 bp, Mus musculus
  misc_feature (65)..(65): n is a, c, g, or t
gtagttggcaaggacaagcccacctatgatgagatcttctacacactgtctcctgtcaacggcanagatcacaggtgctaatgccaagaaggagatggtgaagtccaagctgcccaacacagtgctggggaagatctggaagttggcagatgtggacaaggatggcctgctggatgacgaggagtttgccctggccaaccaccttatcaaggtgaagctagagggccacgagctgcccgctgaccttcctccacatctcattccaccctccaaacggaggcacgagtgacttccat

SEQ ID NO: 4401 - DNA, 577 bp, Mus musculus
  misc_feature (65)..(65): n is a, c, g, or t
  misc_feature (297)..(297): n is a, c, g, or t
  misc_feature (300)..(300): n is a, c, g, or t
  misc_feature (333)..(333): n is a, c, g, or t
  misc_feature (356)..(356): n is a, c, g, or t
  misc_feature (372)..(372): n is a, c, g, or t
gtagttggcaaggacaagcccacctatgatgagatcttctacacactgtctcctgtcaacggcanagatcacaggtgctaatgccaagaaggagatggtgaagtccaagctgcccaacacagtgctggggaagatctggaagttggcagatgtggacaaggatggcctgctggatgacgaggagtttgccctggccaaccaccttatcaaggtgaagctagagggccacgagctgcccgctgaccttcctccacatctcattccaccctccaaacggaggcacgagtgacttccatnccntgagataccctacaacccccagggctgctgccnactttctacccaccagctccttnttctgcccaggtgggnctggggcctggaggggcagaaattgggggagggaaagggtcaccatttttcaaggtccataaagactgagcggtgtttcctcagctcttgaataggaaaaccaccatctttcttttaaagctgttccggggttcagcgggaggcatgggtgatgcttggatatgaacagtgggattttgtgcacaggaaccatgatatttttaat

SEQ ID NO: 4402 - DNA, 400 bp, Mus musculus
  misc_feature (368)..(368): n is a, c, g, or t
  misc_feature (375)..(375): n is a, c, g, or t
aggtcaaccctttatggcagcttcctggagcccctctctgccttgggacaggcagtaggccctgtgacctggggtggtctggggctggtaagaggaagcctgtggctctggcctgggtgtagtgtccatgcagcacgacaggggaaaacccagccccttccctcgccctgtcatttccttcctctcctcctctgctgagccaaggaggtctgggtgtcctgagagccccagactgagcagtaagaagcctgagctagcaaatgaccactttagtcaccccactgtagcctggggacccggacacatcctgtggccagtggtttggctgtcagggtgggctttccactgagctgggtagggcattgcancctgctncctctgacactgtaggtgggcttca

SEQ ID NO: 4403 - DNA, 532 bp, Mus musculus
  misc_feature (298)..(299): n is a, c, g, or t
  misc_feature (301)..(301): n is a, c, g, or t
  misc_feature (303)..(303): n is a, c, g, or t
gggctttggctcttacatcagtgaagtaaaagaagtcttacaagaatgcaagacagtagcattaaaaagaagaaaggccagttctcgtttggaaaacctcggcattcctgaagaggaattattgagacagcaacaggaattatttgcaaaagctagacagcaacaagcagaattggcccaacaggaatggcttcaaatgcagcaagcagctcaacaagcccagctggctgcagcctcagccagcgcgtccactcaagcaggatcttcacaagacgaagaagatgatgatgacatctgnnantncaccacctgggctttcaagaaaacagtgaaagatatgcctatctgtaattctgtatgcatcttggtggacttaccattggtattctagagacgtctgttgtctggtttcaactactgtgctatacatgtaaaactgtctctttgaactattgaaaatttaaggttaagtataatatcacctttggatttgtaatggtgtttctggaatcttagaccagtgtgaaccctt

SEQ ID NO: 4404 - DNA, 89 bp, Mus musculus
cagtctgtcccatctcagtttgcaaaaagcactgacacgtatctcttctattgtaagctttccatttagtttgcttccaatgattaaat

SEQ ID NO: 4405 - DNA, 321 bp, Mus musculus
tgacagaaaaatctaaggccatgactggtgtggaacaatggccatatagagctgtggcccaggcgttagaggtcatccctcggaccttgatccagaattgtggggccagtaccattcgtctgcttacctcccttcgggccaagcacacacaggagagttgtgagacctggggtgtgaatggtgagactggtaccttggtggacatgaaagagctgggtatttgggagccattggctgtgaagctacaaacgtacaaaacagcagtagagactgcagttctgcttctgcggattgatgacattgtctctggccacaagaaga

SEQ ID NO: 4406 - DNA, 475 bp, Mus musculus
gggccagtaccattcgtctgcttacctcccttcgggccaagcacacacaggagagttgtgagacctggggtgtgaatggtgagactggtaccttggtggacatgaaagagctgggtatttgggagccattggctgtgaagctacaaacgtacaaaacagcagtagagactgcagttctgcttctgcggattgatgacattgtctctggccacaagaagaagggtgatgaccagaaccggcaaactggtgctccagatgctggccaggagtgagtgctgagcacggtgacttccatgcacagaaccagcagtctcccctttcctgagccagagttccaggaacactgtggacatctttgtttgcgaaggatcaggttgaggggcagcccccagtctgtcccatctcagtttgcaaaaagcactgacacgtatctcttctattgtaagctttccatttagtttgcttccaatgatta

SEQ ID NO: 4407 - DNA, 319 bp, Mus musculus
  misc_feature (124)..(124): n is a, c, g, or t
  misc_feature (131)..(131): n is a, c, g, or t
  misc_feature (136)..(137): n is a, c, g, or t
  misc_feature (141)..(141): n is a, c, g, or t
tgagtaccagactatcccacttaataaaatagaagattttggcgtgcactgcaaacaatattatgccttagaagtctcatatttcaaatcatctttggatcgtaaactacttgagcttttgtgngaataanatacnntggngtgaataccctgagttcctctagcttgcttactaatgcagactacaccacaggccaggtgtttgatttgtctgagaagttagagcagtcggaagcccaactgggacgtggcagtttcatgttgggcttagaaacacatgaccgcaagtcggaagacaaacttgccaaagctactagag

SEQ ID NO: 4408 - DNA, 154 bp, Mus musculus
cccatcttgggccaagtcagcaggttccaagtctagtggtggcagggaagattcggagtcgcctggaacacagagaagtaactcttctgaagcaagctctggagatttcttagacctcaagggagaaggtgatatgcatgaaaatgtggacaca

SEQ ID NO: 4409 - DNA, 46 bp, Mus musculus
gaatctctggctgactacatcaccgcagcatatgtggagatgaggc

SEQ ID NO: 4410 - DNA, 186 bp, Mus musculus
aggatgccacctatacttctgcccggaccctgctggccattctccgactttccactgctctggctcgacttcggatggtagacattgtggagaaggaagatgtaaatgaagccataaggttgatggagatgtcgaaggactcccttctaggtgaaaagggacagacagctaggacccagaggccag

SEQ ID NO: 4411 - DNA, 170 bp, Mus musculus
gaagctgtagcaatggagtcgtttgcaaaagccctgagaatgttgccgaccatcatagccgacaatgcgggctatgacagtgcagatctggtggcacagctccgagctgctcacagtgaaggccatataactgctggactggatatgaaggaaggtaccatcggcgatat

SEQ ID NO: 4412 - DNA, 286 bp, Mus musculus
tttcttggtacggaagtgtgctcacgggagctgctagatcttctctgcagcaacgctttattcatcttctgtggatttgacaagaaaaacttaaatgtgagtcgctttgatgtgtatctagggcataatccagcaggaacatctactcaagaccttttccactgggcacagcttgctaaatctgggaagcttcaagcctataactggggaagtccattacagaacatgttacactacaatcagaaaacgcctccctactatgatgtgtcagccatgaccgtgccaa

SEQ ID NO: 4413 - DNA, 460 bp, Mus musculus
  misc_feature (384)..(384): n is a, c, g, or t
  misc_feature (407)..(407): n is a, c, g, or t
gaaagaactgctacctgaaattcgagagaagatagaagacgcaaaggaatctcagcggagtgggaatgtagccgaactggcactgaaagctactctggtggagagctctacttccggtttcactcctagtggagctggtgcctcagtatccatgattgccagtagaaaaccaacagatggcgcttcctcatcaaattgtgtgactgatatttcccatcttgtcagaaagaagaggaaaccagaggaagagagtccccggaaggatgatgcaaagaaagctaaacaagagccagaggtgaatggaggcagtggggatgctgtctccagtggaaaggaagtttcagaaaacatggaggccgaggctgagaatcaggctgagagccnaaacagcagaggggaccgtggantctgcagctacaattaaaagcactgcatgttaagaggcgagcagaaccttcct

SEQ ID NO: 4414 - DNA, 500 bp, Mus musculus
  misc_feature (334)..(334): n is a, c, g, or t
  misc_feature (381)..(381): n is a, c, g, or t
  misc_feature (434)..(434): n is a, c, g, or t
cttcagaagatcagcctatcagggctgcagaaaagcagggcactttaatgaaggtggtagaaatagaagctgaaatagaccctcaagtcaagtcagcggatgtgggaggggaggagccaaaagatcaggtagctacctctgagagtgaactaggtaaggctgttcttatggaactgtcagggcaagatgttgaagcatcaccagtcgtggctgcagaggccggagctgaagtctctgagaagccagggcaggagattacagttattcccaacaatggtccagttgttggacaatcaactgtaggagatcagactcctagtgaaccacagacttntgcagaaagactgacagaaactaaagatggctcaagtgtagaggagntcaaggcagagctggttcctgaacaggaggaagctatgctacctgtagaagantctgaggcagctggagatggggttgagaccaaggtagcccagagggccacggagaaagcacctgaa

SEQ ID NO: 4415 - DNA, 399 bp, Mus musculus
  misc_feature (292)..(292): n is a, c, g, or t
  misc_feature (298)..(298): n is a, c, g, or t
  misc_feature (324)..(324): n is a, c, g, or t
  misc_feature (343)..(343): n is a, c, g, or t
agaactccccagagaagtttgccctgaagctgtgctcagagctgggcttgggcggggagtttgtcaccaccattgcatacagcatccgaggacagctgagctggcaccagaagacctatgccttcagtgagaacccacttcccacagtggagattgccatccgaaataccggagatgctgaccagtggtgccccctgctggagacactgactgatgccgagatggagaaaaagatccgggatcaagataggaacacaaggcgaatgaggcgtcttgccaacactgccccagncctggntgatgaagacatccatgctcgacctntacggagcatctcagactngcctttccttcctctgtggaaagagaaaggcaaagggacagctggtgccatcctga

SEQ ID NO: 4416 - DNA, 471 bp, Mus musculus
  misc_feature (314)..(314): n is a, c, g, or t
  misc_feature (375)..(375): n is a, c, g, or t
  misc_feature (397)..(397): n is a, c, g, or t
tacgaacgtggttccgcacacgcagcgccatcatcctgcacctcagcaacggcaccgtgcagattaacttcttccaggaccacaccaaacttatcctgtgccccctgatggcagcggtgacctacatcaacgagaagagggacttccaaacgtaccgcctgagcctcctggaggagtatggctgctgcaaggagctggccagccgcctccgctacgcccgcaccatggtagacaagctgctgagctcgcgctccgccagcaaccgcctcaaggcctcctaggtctctctccttcggactggtgccccttcactntgctagctctgagcctgcactgtaggctccttgggggctgctgttcagtgcccctggcccntgggggctgggcaggagcaggnccccctttgaaggggttgctgtgtgtaagttattttgtacatgtctgggtgtgggtttacatctgcttccctgc

SEQ ID NO: 4417 - DNA, 473 bp, Mus musculus
  misc_feature (108)..(108): n is a, c, g, or t
  misc_feature (182)..(182): n is a, c, g, or t
gagccagctgtcctaaagtggatacgggagaatatatctgagtggagaaactgtactattgtctcacctgatgctggtggagccaaaagagtgacctccattgcagancggctgaatgtggattttgctttgattcacaaggaacggaagaaggccaatgaagtggaccgcatggtacttgntgggagatgtgaaggaccgtgtggctatacttgtggatgacatggctgacacttgcggtacaatctgtcacgccgctgacaaacttctctcagctggcgctaccagagtttatgctatcttgacgcatggaatcttttctggccctgccatttctcgaatcaacaatgcatgctttgaagcagtagtagttaccaataccatacctcaggaggacaagatgaaacactgctccaagatacaggtgattgacatctctatgatccttgcagaagccatcaggagaacccaca

SEQ ID NO: 4418 - DNA, 548 bp, Mus musculus
aatgtggactgaactgccctgtaagaattttcatcttcttctgtgttgtgccatcctggaatcagaaaagcaacagataatggcaaagcactatggcttcaatgaaatccttaagcacatcaatgagttgtccatgaagattgatgtggaagatatactctgtaaagcagaagcaatttccctacagatggcacaatgcaaggaattgccacaagcagtttgtgagatcctgggacttcaggacagtgaaattacaacgccagattccgacactgatgaaaatgttggcagcccttgtcctgtatctgcgtttccaagtagcaccttgcccatccttgctgccagtgaagccaaagatgacagtccaacacagacattagcatccccgaatgcctgcagattaacacctgcatgatcatttgtcttacagtttttgagatactttgttgcaattcctttttaagtacatgaaagatagacattcacggtcttggtattgatcatgctttaagttttatggagagacagtgtactgatgttcttgcatt

SEQ ID NO: 4419 - DNA, 539 bp, Mus musculus
  misc_feature (471)..(471): n is a, c, g, or t
tattcactcatcttgcggaaaggcaaatgaccaagacagcttgatttcaggaatattgcgtgttttagaaaaggatgctgaagtaatagtggactggagaccattggatgatgcattagattcttccagtattctgtgtgctggaaaggactccagctcagtcgtagagtggactcaggctccaaaggaaagagctcatcgggggtcggaccagcagagcagctatgaagcggagtgggacatggttactacagtgtcctttaagaagaaaccacacaccaatggagatgctccaggccataggaacgggaaaagcaaatggtcgttcctgttcagcctggcagacctgaagtcagtcaagcagagcaaggagggcatgggctggtcgtacctggtcttctgcctgaaggatgacgtcatgctgcctgccctgcacttccatcaaggagacagcaaactgctgatcgagtntcttgagaaatacgtggtattgtgtgagtcaccacaagatagtagaacacttctagtcaattgtcaga

SEQ ID NO: 4420 - DNA, 425 bp, Mus musculus
  misc_feature (283)..(283): n is a, c, g, or t
  misc_feature (321)..(321): n is a, c, g, or t
  misc_feature (377)..(377): n is a, c, g, or t
atggagtggatctcggccaaactgaaggggtcccagggcacagggaaaaaatttgttagcgatgattccatttgtgtcctgggaatttgcaagagagatctcctgtttcaaccagtggcagagctgaagaaagtcactgactttgagcacaggatccccaaggagcagtggtggctgaaactgcggcccatcatgaagatcttggccaagtatgaggcgagctatgacatgtctgattcaggcaagctggagtccttgcagcaccatgaagaactatgagccnatctcatcaagtctgccatcacctgacctggaatgttnctccagggaccatccttttttgtaacatagttatttatcagcactttatggaagcnaagcattgttgacggagtcagcagtaataatcagagagcaccacttgc

SEQ ID NO: 4421 - DNA, 174 bp, Mus musculus
  misc_feature (144)..(144): n is a, c, g, or t
agccatgatggcaagcttaagaagagaggcggtggtggcggattcggctaccagaaaacaaagaaagtggagaagtccaagatctttaaacacatcagtaagaagccagcagaccgcaggcagttctcacactgaggcaatctnccttcagcctggactgactttgcccagctt

SEQ ID NO: 4422 - DNA, 475 bp, Mus musculus
tggagtcatccccttgaacgagaaggacttcctcctggctgggaacgagtagagtcatcagaatttggaacctattacgtggatcacaccaataaaagggctcagtacaggcacccctgtgctccgagtgtacctcggtatgatcagcctccacccatcacgtatcagccacaacaaactgaaagaaatcagtctctcctggtccctgcaaatccctaccatactgcagaaattcctgactggcttcaggtttatgcccgagcccctgtgaaatatgaccacattctgaagtgggagctcttccagctggctgacctggacacgtaccagggaatgctgaagttgctcttcatgaaggaactggagcagattgtgaagttgtacgaggcctacagacaggctcttctcactgagttggaaaaccgcaagcagaggcagcagtggtatgcccagcagcatggcaagacgttcttaa

SEQ ID NO: 4423 - DNA, 151 bp, Mus musculus
agagttctgaacttcagcctgggtcgccctctgcctctgcacttcctccgtagagcatctaaagtcggagaggttgacgtcgagcagcacactttggccaaatacctcatggagctctccatgctggactacgacatggtgcattttgctc

SEQ ID NO: 4424 - DNA, 366 bp, Mus musculus
ttgctccttctcaaattgcagctggggctttctgcttagcgctgaaaattcttgacaacggtgaatggacaccaactctgcagcactacctatcctacagtgaagactccctgcttcctgttatgcagcacctggctaagaatgtagtcatggtgaactgtggcctcacaaagcacatgactgtcaagaacaagtatgcagcatctaagcatgctaagatcagcacgctggcacagctgaactgtacactagttcagaatttgtctaaggccgtgacaaaggcataactccaatagactgctacatctgcagatgcagttggcaccatgtgccgcctgtacataggatacctaccgtgtttacttg

SEQ ID NO: 4425 - DNA, 549 bp, Mus musculus
aaaggtttcagcgtggtggcagacacgcctgagctgcagagaatcaagaagacccaggaccagatcagcaatatcaaataccatgaggagtttgagaagagccgcatggggcccagtggaggagaaggggtggaaccagagcgccgagaagcccaggacagcagcagctaccggaggcccacagagcagcagcagccgcagcctcaccatatcccgaccagtgcccccgtgtaccagcagccccagcagcagcagatgacctcgtcctatggtgggtacaaggagccagcagcccctgtctccatacagcgcagtgccccaggtggcggtgggaaacggtaccgtgcagtgtatgactacagcgctgccgacgaggacgaggtctccttccaggatggggacaccatcgtcaatgtgcagcagatcgatgacggctggatgtacgggaccgtagagcgcaccggtgacacggggatgctgccagccaactacgtggaggccatctgaaccctgtgccgccccgccctgtcttcaatgcattccatggca

SEQ ID NO: 4426 - DNA, 390 bp, Mus musculus
  misc_feature (286)..(286): n is a, c, g, or t
  misc_feature (314)..(314): n is a, c, g, or t
  misc_feature (330)..(330): n is a, c, g, or t
  misc_feature (344)..(345): n is a, c, g, or t
gtatctgcttacaccttgtttgcaaaagagtgttcagaataaaataaagagcctgaactggctagaaatggaaaagagtcggtgcatccctgagatgagcgattctgagttttgtattcgcattcctggaggtggaatcacaaaaacgctctatgacgaaagctgttctaaagagatccagatggcagttctgctaaaatttgtttcagaaggggacaatatcccagatgccgtcagccttgtggagtaccttaatgaatggcttcagataatcaaaccctgtaancgacggccccatggcatctgccctgccnttggaagatccccagnctcttggcggctgnntctttggcagtgggcttcctcccgcgctgttttgatctgttttca

SEQ ID NO: 4427 - DNA, 517 bp, Mus musculus
  misc_feature (227)..(227): n is a, c, g, or t
  misc_feature (232)..(232): n is a, c, g, or t
  misc_feature (237)..(237): n is a, c, g, or t
  misc_feature (283)..(283): n is a, c, g, or t
  misc_feature (289)..(289): n is a, c, g, or t
  misc_feature (291)..(291): n is a, c, g, or t
  misc_feature (297)..(297): n is a, c, g, or t
  misc_feature (305)..(305): n is a, c, g, or t
  misc_feature (309)..(309): n is a, c, g, or t
  misc_feature (315)..(315): n is a, c, g, or t
  misc_feature (323)..(323): n is a, c, g, or t
  misc_feature (325)..(325): n is a, c, g, or t
  misc_feature (345)..(345): n is a, c, g, or t
  misc_feature (359)..(359): n is a, c, g, or t
  misc_feature (380)..(380): n is a, c, g, or t
  misc_feature (393)..(393): n is a, c, g, or t
  misc_feature (401)..(401): n is a, c, g, or t
  misc_feature (403)..(403): n is a, c, g, or t
  misc_feature (406)..(406): n is a, c, g, or t
  misc_feature (442)..(442): n is a, c, g, or t
  misc_feature (456)..(456): n is a, c, g, or t
  misc_feature (461)..(461): n is a, c, g, or t
gaaggagatcccgagtctccactgaggaggctgtcagatattggcgggggttgccctactctgggcagcttgggccctgcaggaagaagtgaagtcagacagctagggtgggtcagtgtggctgattgtgttggtattgtgtgtatgctgcttttctaaccaagaggctggttttggcatctatctcattccctgggaatgcggtggttaaatgtgtgatacaaaancaggnctggnagaaacagaaatgaaggtcaaaatcgctggcctgtacctacaggcnatagcnancccaantcctcatntctnggggancctgaaantntccagaacgcttgtgaacantggggaatcaggtntgaaaatttaaaactaaaatncatgagactgagnccatccantnttntggtgtggcgggagaggtggagccatggtggtgcanccatcccagcgtgntctgntcatggatgggatggttgcaatgttgagaaaatcccgggaattttatcaacacaag

SEQ ID NO: 4428 - DNA, 177 bp, Mus musculus
gtccttcatgatcagtgcagacatggcccatgctgtgcaccccaaactactcggacaagcatgaagaaaaccaccggcctttgttccataagggtcctgtgatcaaggtgaacagcaagcagcggctacgcctctaatgcagtgtctgagtccatgattcgagaggtggctggccaa

SEQ ID NO: 4429 - DNA, 551 bp, Mus musculus
  misc_feature (75)..(75): n is a, c, g, or t
  misc_feature (329)..(329): n is a, c, g, or t
  misc_feature (343)..(343): n is a, c, g, or t
  misc_feature (368)..(368): n is a, c, g, or t
  misc_feature (431)..(431): n is a, c, g, or t
  misc_feature (498)..(498): n is a, c, g, or t
gagcttctttatacatctctggcgctgataactattgagctcgccaatgaagaggtggttattgacctcattcgnctggccattgctttacaggacagtgcaattatcaatgaagataacctgtcaatgtttcatcgttgtgggatcatggccctggttgcagcttatctcaactttgtgagtcagatgatagccgttccagcattttgccagcatgttagcaaggttattgaaactcgaactatggaagccccttattttctaccagagcatattttccgagataaatgcatgcttccgaaatctttagagaaacatgacaaaaattnatattttttgaccnacaagattgcggagtccctgggtgncagcgggtacagtgtggagaggctgacagttccttatgtgccacaggtgacagatgaagatcncctttctagaagaaaaagtattgtggatactgtatctattcaggtggatattttatccaacagtgtnccttctgatgatgtggttagcaacaccgaggagatcacctttgaagcactgaa

SEQ ID NO: 4430 - DNA, 392 bp, Mus musculus
  misc_feature (320)..(320): n is a, c, g, or t
  misc_feature (322)..(322): n is a, c, g, or t
  misc_feature (357)..(357): n is a, c, g, or t
  misc_feature (363)..(363): n is a, c, g, or t
aaggttactcggcaaggcaagttcaaacccaacagtgtcacttacaggaccaaatctggcaacatcttgctgcataagtcaaccattaacagggaggctacccggttacggagccgatggctgacatatttcatggccgtcaagtccaatggtagcgtctttgttcgagattcctcccaggtgcacccactagctgtgttgctcctaacagatggggacgtgcacatccgagatgatgggcgtcgggccaccatctcattgagtgacagcgacctgcttcggctggaaggtgattcacgaactgtgcggttgctaagggnantttcgtcgagccctaggacggatggtggagcggancctccncagcgagttagctgcacttcctcttagtg

SEQ ID NO: 4431 - DNA, 495 bp, Mus musculus
  misc_feature (299)..(299): n is a, c, g, or t
  misc_feature (383)..(383): n is a, c, g, or t
  misc_feature (438)..(438): n is a, c, g, or t
ttaggtcaacccattaagacacggttccaggaatctgaagaaagaccaaaattatttgaagaactagggaagcaaatccaacagtatatgaaagtgatcagctctttcaaaaacaaggaggaccagtatgaacacttggatgctgctgacgtgacaaaggtagagaaaagcaccaatgaggcgatggagtggatgaatagcaagcttaacctgcagaacaaacagagcctgacggtggatccagttgtcaagacaaaggagattgaagctaaaattaaggagctgacaagtatttgcantcctataatttcaaaacccaaacccaaagtggaacccccaaaggaggaaccaaaacatgctgagcagaatggaccagtggatgnccaaggagacaacccaggctcccaggctgctgagcacggtgcagacacagctgtnccttctgatggcgacaagaagcttcctgagatggacattgattgattccaacacttg

SEQ ID NO: 4432 - DNA, 224 bp, Mus musculus
atctcagatgataacggaaggacgcatgaatgggtttattgaccagatcgatggaatagttcattttgaaacacgagaagccctgccaacatgggacaagcagatccagtcactttgtttccaagtaaacaacctcctggagaaaattagtcagacggccccggagtggacagcacaagccatggaagcgcagatggcccagtgagccctcagcgctgtgcgca

SEQ ID NO: 4433 - DNA, 433 bp, Mus musculus
  misc_feature (356)..(356): n is a, c, g, or t
  misc_feature (359)..(359): n is a, c, g, or t
  misc_feature (408)..(408): n is a, c, g, or t
gaaaccccaggttatggccggcactgtgaagctggaagacaagcagcggctggcccaggaggaagagagtgaggctaagcgcttggccatcatgatgatgaaaaagcgagagaagtacctttaccaaaagatcatgtttggcaagcggcgcaaaatccgagaggccaacaagctggcagagaagaggaaagcccatgatgatgctgtgaggtctgagaaaaaggccaagaggacaaggcccgtgtgagctccagttgtccctcactgagatttggacttggcagaagcaagctagtgaaacacacatacacaccagccagcactctcatactttggtggtatgtggctagccccanccngcctttgtggttcatgccagtgcctgggcaaagagacctcaacccaacncagtttctttaatccaggagtccgt

SEQ ID NO: 4434 - DNA, 441 bp, Mus musculus
  misc_feature (54)..(54): n is a, c, g, or t
  misc_feature (57)..(57): n is a, c, g, or t
  misc_feature (61)..(61): n is a, c, g, or t
gaggccacaaggttggattgggatttgaactggaggcttagtgtggttttgagntangagntatcacttgtccctggaaatgaagagaaatgaacccactatgttttggccttaaaattctgtgaaatttcaaaagtgtgaactttttattcttccaaagaattgtaattcttcccacactgaagtctagagattacagatctatccaatgggaggtcctggaaggcatgcctggaaattgtcatgtttgtgccacatttcagttgagttctgcagagttaatttaaatatgttcctcagcaacaacgtagtgtcatgttaaaggagcgacctgcctccccggtctgtacaccgtgtcctgcatgtcccagtccacttttccatggccttttgttatatcagtctctgctctagtgagagctttggttttgcatcagagta

SEQ ID NO: 4435 - DNA, 503 bp, Mus musculus
  misc_feature (422)..(422): n is a, c, g, or t
  misc_feature (424)..(424): n is a, c, g, or t
  misc_feature (427)..(428): n is a, c, g, or t
  misc_feature (437)..(437): n is a, c, g, or t
  misc_feature (439)..(439): n is a, c, g, or t
  misc_feature (467)..(467): n is a, c, g, or t
gtatgctgtccaagccaagtatggagattataataaagagattcacaaaccaggctatctggctaatgacagactcttaccacagcgtgttttggaacaacacaaactgaccaaagagcagtgggaggagagaatacagaactggcatgaggaacacagagggatgctaagggaagattcgatgatggaatacttgaagattgcgcaagatctagagatgtatggtgtcaactactttgaaatcaagaataagaagggtactgagctgtggctaggtgttgatgctttaggcctgaatatttatgaacatgatgacaagttaacacctaaaattggttttccctggagtgaaatcagaaatatttcatttaatgacaaaaaattcgttataaagccaattgacaaaaaggcacctgattttntnttnnctatgcacntncgtctgagaatcaataaacgaattttgnccttatgtatgggaaaccatgaactgtacatgcgaa

SEQ ID NO: 4436 - DNA, 403 bp, Mus musculus
  misc_feature (82)..(82): n is a, c, g, or t
  misc_feature (259)..(259): n is a, c, g, or t
  misc_feature (273)..(273): n is a, c, g, or t
aatgcgcttgttcatcgtgtgaggaaagaaggatgcttccactgagggcccacgttctgcatagcccaacaactataaagtnggcgaggagggaccagcagagtcttgcataggagtggacctcatctacagtatttctaagcggtttcctttgatgaagtgcctaaacttgtgcttttgtatggtactctcatgatgtgctgctgttcacatctgtttctgctgttcataggttgaagcttcgctaaaagaacatttnctatgaggatgccnatttttaagaactcacattcttttaaaacctcagttgtggtttgaaattcgaaatagtacatgtacacgtacccggctagaaattgtcactgttaagagtgtcacagtgtgaagaattgccctaccctgc

SEQ ID NO: 4437 - DNA, 359 bp, Mus musculus
  misc_feature (124)..(124): n is a, c, g, or t
  misc_feature (320)..(320): n is a, c, g, or t
  misc_feature (330)..(330): n is a, c, g, or t
  misc_feature (333)..(333): n is a, c, g, or t
tgcagagccactgatcaacttggatgtaaataatcctgattttaaggcgggtgtcatggctctggctaacctccttcagattcagcgtcatgatgactacttggtaatgcttaaggcaattcgnattttggttcaggaacgtctaacacaggatgcagttgctaaagcaaatcaaacaaaagagggcttacctgttgctttagagaaacatattcttggctttgacacaggcgatgcagttcttaatgaagctgctcagatcctgcggttgctgcacatagaagagctcagagagctacagacaaaaattaatgaagccnatagtagccngtnccaggccatcattgctgatccaaaga

SEQ ID NO: 4438 - DNA, 551 bp, Mus musculus
  misc_feature (284)..(284): n is a, c, g, or t
  misc_feature (286)..(286): n is a, c, g, or t
  misc_feature (326)..(326): n is a, c, g, or t
  misc_feature (330)..(330): n is a, c, g, or t
  misc_feature (342)..(342): n is a, c, g, or t
  misc_feature (345)..(345): n is a, c, g, or t
  misc_feature (359)..(359): n is a, c, g, or t
  misc_feature (366)..(366): n is a, c, g, or t
  misc_feature (393)..(393): n is a, c, g, or t
  misc_feature (464)..(464): n is a, c, g, or t
  misc_feature (474)..(474): n is a, c, g, or t
  misc_feature (523)..(523): n is a, c, g, or t
gtaatgtccatctctactctggagagtggaatctgaccaggaagtcctagggcctaaggttagcttctgcaggtgagtgcagctgcatgtccccacctgccctttcctgagagtggacaggtggaggaggagccatagccaccaacctctagggtggtcttcagatcacgatcatgctcatcttcactggcaaagcactgctcctccctctgggccctgctggacctagaagtgggaagcagcagaggaactaggtgcaagacattttggaggacctagcggcnangaagaagcctcagcactctctgggagccatgtggatatgncctntccctgttcctnccnacagtgactcagtncctcttntcccaggagaagacacctcagggagtncttgccctgtaatgctcacgtccatcctgtaacctaagagtcactccagttgctccagggtctgtattctntcttgggagnccaccgggtgttaagaataagcccccaggcttctagtgagctgtggctntctgttctctgtgtgttgtcatattgga

SEQ ID NO: 4439 - DNA, 497 bp, Mus musculus
  misc_feature (61)..(61): n is a, c, g, or t
  misc_feature (63)..(63): n is a, c, g, or t
  misc_feature (229)..(233): n is a, c, g, or t
  misc_feature (237)..(237): n is a, c, g, or t
  misc_feature (258)..(258): n is a, c, g, or t
  misc_feature (333)..(333): n is a, c, g, or t
  misc_feature (336)..(336): n is a, c, g, or t
  misc_feature (439)..(439): n is a, c, g, or t
  misc_feature (441)..(441): n is a, c, g, or t
aagaggtcaagttggcctgagcaaggtctgcagccccatcttctccccaagttcctcactntncctcaacttctcagattttatattttctattcctctgtgtatttatataaaatatattaactataacgtccccagggaccagagcacagggcagtggtgctaggagggctcttcccagagcgaccttgtccatcctgccaccccccctccccccatttgcgtgggnnnnnaaanaaaacaaccagaagagaaaantcctgaactgccaagtgcctgcttaggagctctgctaagatgcccctgttaaactttttaggaggggtctgggtntcntaggacccccttttcaggcttgggtaatagcagccatttttagattggttctgtttataccttcccacccatcttgggcaaacaaaaaaacttatattgcctntnttcttcccccaattctgtagggtggaggttgatagcctagcttcctttttgagata

SEQ ID NO: 4440 - DNA, 464 bp, Mus musculus
  misc_feature (359)..(359): n is a, c, g, or t
  misc_feature (400)..(400): n is a, c, g, or t
gcccagagcctgattgacaagacaacggctgcatttcaacaagggaagatccctcctgctccgttctctgctcctccgcctgcaggggccatgatcccacctccccccagtctcccgggccctcctcggcctggcatgatgcctgccccccacatgggaggccctcccatgatgccaatgatgggcccccctccgcccggaatgatgcccgtgggaccagctcctgggatgagaccacccatgggaggccacatgcccatgatgcccggacctcccatgatgagacctcctgcccgccctatgatggtgcccacccggcctggcatgacccggccagacagataagagcagaagcgctnttgatggttttgtatttcttgttctgttccaccaggagctnttggtgctgagcccgagtgtttactagatgcatggaaaggaaacttcccttcctaactgaatat

SEQ ID NO: 4441 - DNA, 137 bp, Mus musculus
gtagatgttactggacctcatctctacagcatctatcctcatggatcaactgataaattgccttatgtcaccatgggttctggctccttggcagcaatggctgtgtttgaagataagtttaggccagatatggagga

SEQ ID NO: 4442 - DNA, 368 bp, Mus musculus
gccttaccgaagctgattacctgagttcacacctgactgagggtccacaccgtgtggtggcacatctgtacgcacggcagctgacattggaacaactgcatgctgtggagatcagcgctgtgcactcacgggaccacggtctggaggtcctgggccttgtacgggtcccactgtacacacagaaggatcgagtaggcggctttcctaactttctgagcaacgccttcgtcagcactgccaaatatcaacttctatttgcccttaaggccctggaattcccgagacgcgtgccttctagtgtgtttgcttttgcatcccttctgactgcaagggacatgcaggcagctgttcatcattactgtcccaag

SEQ ID NO: 4443 - DNA, 541 bp, Mus musculus
  misc_feature (282)..(282): n is a, c, g, or t
  misc_feature (300)..(300): n is a, c, g, or t
  misc_feature (312)..(312): n is a, c, g, or t
  misc_feature (334)..(334): n is a, c, g, or t
  misc_feature (361)..(361): n is a, c, g, or t
  misc_feature (366)..(366): n is a, c, g, or t
  misc_feature (463)..(463): n is a, c, g, or t
  misc_feature (509)..(509): n is a, c, g, or t
aatatcacaggaaacctcaggttagaccttataaagcaagtggtttgggaagcaggccttctctttagaaaacattacttttgaattagaggctttatcagacatggactttctctttatagaaatgctttagagaaaagccccttccatctatcatgacttactaacatctaccacagtttatcagcatttgaagatttccttgatgatccatacttgtcttgggatagggtttgtttatagggaggagtctggaaatttcagtatgaatgaaaactagcnaggcaatggtgagatgcnagtaaaatcctnatctaatgtttacctgatgccntacctagtgaagagttaatgaagggcnagaangccttctgcttgctctcatgagtttgctcaactggcagtttgctcagttgatatgaatcatgctaggtattatgaaagtttctatgaaacatttaantcaattttaacaatacatgattctgggaaagaattgttccatgctntcatgattatgcggaaacccaaaagattactt

SEQ ID NO: 4444 - DNA, 376 bp, Mus musculus
  misc_feature (124)..(124): n is a, c, g, or t
  misc_feature (140)..(140): n is a, c, g, or t
  misc_feature (220)..(220): n is a, c, g, or t
  misc_feature (248)..(248): n is a, c, g, or t
gaagccttccttcctgaggcaaaggccatctcctgagggaccaaggacaccagagcctaccttcgtgacgctgcctttttatacactgtccttcttcctcgatggaccctaactgatgcccctnccttggctggacttancccttccactctgccccacagacaaactgttcccagttactctaaccaacatttcatttagcttccacgtatattttctnacctaagagaatagtttcctgctttaancaaaagacctacaataggtggtggaattataggttggggtggagtgttgatataaatatataaatacaaatgtatatttttcaggatgtggtttaggaactgggaataacgttttctgttactcctga

SEQ ID NO: 4445 - DNA, 562 bp, Mus musculus
  misc_feature (77)..(77): n is a, c, g, or t
  misc_feature (253)..(253): n is a, c, g, or t
  misc_feature (321)..(321): n is a, c, g, or t
  misc_feature (325)..(325): n is a, c, g, or t
  misc_feature (328)..(328): n is a, c, g, or t
  misc_feature (331)..(332): n is a, c, g, or t
  misc_feature (344)..(344): n is a, c, g, or t
  misc_feature (352)..(352): n is a, c, g, or t
  misc_feature (359)..(359): n is a, c, g, or t
  misc_feature (364)..(364): n is a, c, g, or t
  misc_feature (418)..(418): n is a, c, g, or t
  misc_feature (434)..(434): n is a, c, g, or t
  misc_feature (448)..(448): n is a, c, g, or t
  misc_feature (450)..(450): n is a, c, g, or t
  misc_feature (469)..(469): n is a, c, g, or t
  misc_feature (493)..(493): n is a, c, g, or t
  misc_feature (498)..(498): n is a, c, g, or t
  misc_feature (515)..(515): n is a, c, g, or t
aagaacctttttgggactggcagtgagcaagctcactaagatgtttccaagacttctgagccaagagtgcaggaccntttctgactgcctggaggatgtctgggagagaactaagcaccaccctttgcctctcgggagaagcagcctccctgtcccctagggggacacaagggttggcctttccatccttccagtctcccggctctgtgagtcaggccagaggtggggcaagagagtgggaggtggcccactncccatcacccccctgccactcaaagccagtctcactgtgaaccactgggacctcagcagaggaggggnctgnccnggnncctggtgggccntcggggtnccctcanccccngcacccagcacttgaacccttcaccctctcccctggctggcaccttccctcctntccacccctgcaactntgcggaggaacctntngtttgtaagatgtattctncagattggtggagggggaccaagncaatncccagggtctggctttntcctggtttcaagattttgggagaactgggtcaataaagtgtactac

SEQ ID NO: 4446 - DNA, 461 bp, Mus musculus
  misc_feature (53)..(54): n is a, c, g, or t
  misc_feature (305)..(305): n is a, c, g, or t
  misc_feature (333)..(333): n is a, c, g, or t
  misc_feature (342)..(342): n is a, c, g, or t
  misc_feature (353)..(353): n is a, c, g, or t
  misc_feature (360)..(360): n is a, c, g, or t
  misc_feature (374)..(374): n is a, c, g, or t
  misc_feature (413)..(413): n is a, c, g, or t
  misc_feature (419)..(419): n is a, c, g, or t
ggaactacaggattgttccctccacctacctgccagatacagagggtaccttnncacggtaaccatagcaaccagaatcgataggcagtccatccacagccaggagatgctgggccagctgctccaggaggtctcctttatggcagtgatgaaagcctgacacgagaccctgtgtgccagccatggccagagtggctgctgcccctgtgcccagcatccaggtgcatctccagccagctacaagccagcttctcgtcagctctggaggttggctgtggaccttggggctaaaatagggtgctttntcctggattgaagacatctcgggtccantgggtgctncagggcggggnctagaantcccaagtggtatnttcattccttagtgaaggccaggagattcctggggcccnggtttnttgtggaaagctttgcagaatccacataaccttcttgacttc

SEQ ID NO: 4447 - DNA, 344 bp, Mus musculus
agcttctgctcccagatctgtgatccccggacaactggggcattctggcaaacatggaaggactttgaggttcggcacggcaatgaggataccatcagggagatgctgaggatacggcggagtgtgcaggccacatacaatactcaggtcaacttcatggcttcacagatgctcaaggtgtcgggcagtgccacaggcaccgtgtctgacctggctcctgggcagagtggcatggatgacatgaagctgctggaacagagagcagaacagctggcagctgaggcggagcgggaccagccccccagggcccagagcaagatcttctttgtgaggagtgatgcatc

SEQ ID NO: 4448 - DNA, 175 bp, Mus musculus
ggtaggaacgctgcaacctgggtataaatattatgcctttatttttggctagagaaaagttatttttagcctagatctaaccattttcatactcttacctgaaagattcacagaagtgtcaagtgctatgcattgaaacttgttttttaaacattacctggcactgtgtatatta

SEQ ID NO: 4449 - DNA, 328 bp, Mus musculus
tgcccttggtctggtcggaaccaaaagttagatcctttgtgtggctttgatggttccgttcagcgttcatttgctgagactgttcgagactgttgctgtgttgaagtaggaatagaatttgcaaccctttgagcaaagctgggtgatgagctgaaagaacgcgggcgtgcatgttgccttccctgtaaatagccttagctatcatttcctagtggaaaacactgtggggtaggaacgctgcaacctgggtataaatattatgcctttatttttggctagagaaaagttatttttagcctagatctaaccattttcatactcttacctg

SEQ ID NO: 4450 - DNA, 535 bp, Mus musculus
  misc_feature (128)..(128): n is a, c, g, or t
  misc_feature (197)..(197): n is a, c, g, or t
  misc_feature (218)..(218): n is a, c, g, or t
  misc_feature (505)..(505): n is a, c, g, or t
ggagaaggcaccatctattattttcatagacgaattggatgccattggtaccaaacgcttcgacagtgaaaaggcaggagaccgagaggtgcagaggaccatgctggagctactgaaccagctggacngctttcagcccaacactcaagtgaaggtaattgcagccactaacagggtggacatcctggatccagccnctgctgcgctcaggccgcctnagaccgcaagattgagtttccaatgcccaacgaggaggccagagccagaatcatgcagatccactcacggaagatgaatgtcagtcctgatgtgaactatgaagagctggctcggtgcactgatgacttcaatggagcccagtgcaaggccgtgtgtgtggaggcgggtatgatcgcattgcgcaggggagccacggaactcactcatgaggactacatggagggcatcctggaggttcaggccaagaagaaagccaacctacaatactatgcctaggggacacctntagtctgtccgctggtctgagggctaaagt

SEQ ID NO: 4451 - DNA, 85 bp, Mus musculus
tggattcaccctcagtgacggatgtgagaaaagagttacatgcgaatatgagtcagtcaacacgttttgcatggttaagttaaag

SEQ ID NO: 4452 - DNA, 575 bp, Mus musculus
  misc_feature (301)..(301): n is a, c, g, or t
  misc_feature (324)..(324): n is a, c, g, or t
  misc_feature (390)..(390): n is a, c, g, or t
  misc_feature (440)..(440): n is a, c, g, or t
  misc_feature (515)..(515): n is a, c, g, or t
ggaattctcattaaggacttccttgatgaacattatgatattcccaaaatatcgatgataaataacgtcatacacaataatgaaggttatggtgttgttttggtgaagcctacaattttctgtgatctacaggaaaatacacaagatgaaattaatgacaatatggttcagaaaaataaagaggcagatgtcactgaaggattagatctggaagaaatgcttcagtgtgtggctagcaaaatggagccttatgccacagctgactttaatgaacaagctaagggaaactgtgaaattatanatgaactacttgctatttccatncaaaaaggccggatgaagaaaagactgagtgaacttgggattacacaagctgatgacaacataatntcacaggagatgtttattgaaattatggggaaccagtttaagtggaatgncaaagggagttttggcacatttctttactagctacaataatatcaatactcacaaaatactgtattttgaacatntcttaagtatgctgcttatatactttgcttcatttgcttcatggctgtgtattatataaa

SEQ ID NO: 4453 - DNA, 431 bp, Mus musculus
  misc_feature (129)..(129): n is a, c, g, or t
  misc_feature (224)..(224): n is a, c, g, or t
gacatggccaagtatcggagcattcggggggaagatcacccaccgtcctaagtgaagatcccatacccttgtaataaccagactgagccagtgagaagctgtgcctgccactgctgccttccagccacntgaactggcctggcccctacctcctgtttccatcattttgatcttgtgggactcgggctgggggagcagagctgtgcctcagctgtccctgcagntcttagaccctcggtgaccccttctttctccaggggaacaggcaggaagacaaccgtgctgaaatgtgaaatgtgatggggctcctacttgacatttcctttttatgtatgctgttctgttacactatccataagagaaaactcggttttatagttacattttcagatgttgtgtataagaacataactgttttcatgggtttcaac

SEQ ID NO: 4454 - DNA, 349 bp, Mus musculus
  misc_feature (95)..(95): n is a, c, g, or t
  misc_feature (112)..(112): n is a, c, g, or t
  misc_feature (263)..(263): n is a, c, g, or t
  misc_feature (269)..(269): n is a, c, g, or t
tgccacactcaccaaaactgaagctagagggtggccctggacatgcagccaccctctcctcaagcctgagtggactcacacagaaccccttcccnggtcccattctgatccnagggtgggaaggaagggcctgccagcctcccccagggacaagccagctggagctgtgctcctggtgcctcatgactggccacccaccaccctgtagacgccatccctgcccacctccgaagcctccttctgttgccattttgctgagcatngttggntcattgtcattgtcatctgtggctgtcctgtcacctttcttcaagtgtcctgtgcagctgccatgctgcacttaatgagg

SEQ ID NO: 4455 - DNA, 86 bp, Mus musculus
caatgcttgcttcgagccagccaatcagatggtcaagtgtgaccctcgccacggcaaatacatggcctgctgcatgttgtaccggg

SEQ ID NO: 4456 - DNA, 161 bp, Mus musculus
  misc_feature (90)..(90): n is a, c, g, or t
caatgcttgcttcgagccagccaatcagatggtcaagtgtgaccctcgccacggcaaatacatggcctgctgcatgttgtaccggggggnatgtggttcccaaagatgtcaacgcggctattgcaaccatcaagacaaagcgcaccatccagtttgtagat

SEQ ID NO: 4457 - DNA, 483 bp, Mus musculus
  misc_feature (278)..(278): n is a, c, g, or t
  misc_feature (383)..(383): n is a, c, g, or t
  misc_feature (428)..(428): n is a, c, g, or t
tgctgcttacaatgcattctcttccccagaaacacgcaggcagttaaaggtgggaaacaaaggagtgggatgaggaaaaacatcgcaccgtttcagaggtagctcctttaatatccagctctgcttccagctgtgggtagaaatgctcagaaaatcagatttgagtcttcacaggggaaacttcactatgaggataattcctaaaagacaaaagatgtatctgatctaaagaaacaccagagtattattaggggaatttatataaaattgtgattttngtcatggaacaggcagatgttttggtcctaagtattttagctttgcctttctgtagttgcagtatgtgataggaatcagtgattcctgacacagttctttggccngccataagaccgtgaagtaagcagttatgttcagaccctacccgntccccattccttccaaagctattgcagatgaattgcggagctgtttattcattta

SEQ ID NO: 4458 - DNA, 499 bp, Mus musculus
cactgctcctaccaaatgatgttaccagagtccatcgcaatcgtctgttccccaaagttccaggaaactggattctttaagctaactgactatggtcttcaagagatttcaacctgccggcagaaaggctttcacccccatggcagagacccaccgctgttctgtgactgcagccatgtcactgtcaaggacagaattgtgacgatcacagaccttcgataaatctcaaatcatgaaccagggagatggatcactggacaaatgtgaaaatgaccaaatcacaccaagcaactaactcaaaaattaggatgcaagagaaaatacttctctagatccaaacactggccttctgttcctcttgaaatttacctcccaacttgttcatctctgcctttggactaaataggggcatctgtgcaaaactgtagaagccattttgaaggatttggctttttattgtttgtggcattaataagggagcttaccattctggtgggat

SEQ ID NO: 4459 - DNA, 527 bp, Mus musculus
ctcggagccacagagatcctttttttggagggatgactcgagatgatgacgacgatgatgatgatgatgacgaagcggaggaagacagaggcgcgtggggtcgagagagctatgcgtttgatggttctcagcctccagaggaattcggtttcagcttcagccccaggggagggatgcgattccacggcaactttggctttgatgatctattggatgatacatggcctgtgagtccccattctagagccaaagaggacaaagatcttgactcccaggtttcccaggaaggtctgggtccacttcttcaaccccagcccaaatcgtatttcaaaagtatctctgtgaccaagatcactaagccagatgggacagtggaggaacgccgcactgtggtagacagtgagggccggagggagaccacagtgacccatcaagaagcccatgacggttccagaagtgatccagactctcagagatcttcagctttggatgatcccttttccattctggatttgctactaggacgt

SEQ ID NO: 4460 - DNA, 530 bp, Mus musculus
  misc_feature (338)..(338): n is a, c, g, or t
  misc_feature (417)..(417): n is a, c, g, or t
  misc_feature (419)..(419): n is a, c, g, or t
  misc_feature (443)..(443): n is a, c, g, or t
  misc_feature (476)..(476): n is a, c, g, or t
  misc_feature (502)..(502): n is a, c, g, or t
ttgtgtagtgagcaccttgttcccacttttgtagtcctttccgttctgacccgtcagcagcctgcttctgacccaagatggcctcgtgactagacctgtttttaaggaagcgctgtctgtttttaagtattcttaaaaacgttttggaaagcacttcagattttactgtttaccatgagccatgggtttttgttttttctaaattgtcgggttgtgtgggttttggttactcgtttttgttttttcaggttttttggttgtggcttttctttttttttctttttttgtgtggtcgcccctgaagtctggcgccccacccctcctgagatggaatggantcgatttgagcaagccatggccctccagctccccagcccggctgcggagttgcagcaggtcctgcccatcgggcacatntntcaagcccatggggagcatagcantccgggaggctgtggaaatgtttatttatattntccttttttaccgaagacatgcatantccatcgatgttgtattcacagtggctg

SEQ ID NO: 4461 - DNA, 465 bp, Mus musculus
  misc_feature (45)..(45): n is a, c, g, or t
  misc_feature (111)..(111): n is a, c, g, or t
  misc_feature (289)..(289): n is a, c, g, or t
  misc_feature (293)..(293): n is a, c, g, or t
  misc_feature (312)..(313): n is a, c, g, or t
  misc_feature (317)..(317): n is a, c, g, or t
  misc_feature (322)..(322): n is a, c, g, or t
  misc_feature (328)..(328): n is a, c, g, or t
  misc_feature (330)..(330): n is a, c, g, or t
  misc_feature (339)..(339): n is a, c, g, or t
  misc_feature (370)..(370): n is a, c, g, or t
  misc_feature (383)..(383): n is a, c, g, or t
  misc_feature (409)..(409): n is a, c, g, or t
tagaataacctgatatcccctcgacccacccagctgccaccactnccaactttgccacccaaggttggctttctcctgttaatggaagaaaaaaaaaaccacacacattgnttcacttcttcaggctgagttcaatcctggaggccatgtttcacacttccctaccaagtctgagcaggcgtggcaacttgagagaaaaactcagtacctagtcccaagagaaccaatgcgacggtgccatcagagaggagcagtgtcggtgtggtgtgcagagctggtggttcccagnagcnaccattccctgacctcctnnccanaagtnaacacnancaattcttnagagattataacgagtgcattttacattttncaaaccattcccnaggcaggcaaggaaggaggcacggtntccttaagatacatgggatatgctggaggtgggaagcaaggaagtagttccctcca

SEQ ID NO: 4462 - DNA, 368 bp, Mus musculus
tctccaggctctctagaggcaggcaggtccttggaatccccagcctgcaagcagaggctggccagctccccagctcagcacacagagacacctggcacctgctgctcatgaagaagtgcacaaggcacaaatgtgtacacttcccatgggaccacagacccagctcagctctgttgaagaccaagcacaaaggccttgaagagtggacattcccaggtccctggcaccttcccttgagccagctccattgctacttattcatgtgactgaagctgaccacaggcagctggcaggtccttttttcaaccagcaggctaggctggccatagacccagctctgcctcaccctgccatgttccagtaatgga

SEQ ID NO: 4463 - DNA, 344 bp, Mus musculus
gagtctagcttctccggtgaggaaatgcaaaaggtccagtgcactccgactggcctcacacctcaatctggccatgtgtcacctgaaactgcaggccttctcagctgccatcgaaagctgcaacaaggccttggagctggacagcaacaacgagaagggcctgtttcgccggggagaggcccacctggccgtgaatgactttgacctggcaagagctgacttccaaaaggtcctgcagctctatcccagcaacaaagccgccaagacccagctggctgtgtgccagcagcggacccgtaggcagctcgcccgggaaaagaagctctatgccaacatgtttgaga

SEQ ID NO: 4464 - DNA, 214 bp, Mus musculus
gtgtggcaaagagttttagtcagcatgcaggtctcagttctcatcagcgtctgcatacaggggagaaaccctataagtgtaaggagtgtggcaaagccttcaaccatagttcaaattttaataagcatcatagaatccatactggcgaaaagccctattggtgtagccactgtgggaaaaccttctgtagcaagtccaatctgtccaagcatca

SEQ ID NO: 4465 - DNA, 494 bp, Mus musculus
  misc_feature (409)..(410): n is a, c, g, or t
  misc_feature (435)..(436): n is a, c, g, or t
  misc_feature (440)..(440): n is a, c, g, or t
agatccctcggtttttctatgtcagtgtagctgctacattgctgaggatcagcagttccagtggttggagaaggttttcggcttccaacccagaaagagcatgcaggtaaccgttctcacatgccggcacatcacagactacaagacccccgagtctacctgcagcctttcctctcctttcctgagagccctaaaaactcagacattcaaagatgccctctgctgcccactgctggaacagccgaacattgtgcatgacctgtctgcagcagttctgagctactgtcaagtatggaaaatccctgcggttctgtatctgtgctacactgatgtgatgaagttggaccgtgtcacggttgaagcttttaaaccgttactttcttccaggagcttgaaatgcttggtgaannaacattcctgaaagcacagaaattnnctgnaagaagttgatgaccacaaatgagattcagagcaacatttacacatgaccccag

SEQ ID NO: 4466 - DNA, 278 bp, Mus musculus
gctactgcttgaaggtgttcactgagtagagttagcagctactgctccttatcttcccataccacctgccctccagctcccaggagcacctacagtttccagtttcagtgcagtgtgggaggctgctactgaagatgatggggcagtggctgccaggatcactgatggcttagaactgttgtcctgtggagagcttagaaaacttgaagagttagcagagccagggtggcttgtgctctgacagacagtgcctgttttcctcatgaaagtgccagtgc

SEQ ID NO: 4467 - DNA, 364 bp, Mus musculus
  misc_feature (221)..(221): n is a, c, g, or t
  misc_feature (246)..(246): n is a, c, g, or t
  misc_feature (287)..(287): n is a, c, g, or t
  misc_feature (291)..(291): n is a, c, g, or t
  misc_feature (302)..(302): n is a, c, g, or t
  misc_feature (312)..(312): n is a, c, g, or t
  misc_feature (314)..(314): n is a, c, g, or t
  misc_feature (327)..(327): n is a, c, g, or t
  misc_feature (337)..(337): n is a, c, g, or t
tagcgaggaggtctaaaggttttatttttacagatctcagctggtgaacactaaagtcgtcacctgtacagctcatgcttccccccctgggtcttttctctgagcaccactctgagaagagttgcttcaggcagtggcccaataagtcttaagtccaaggtccaaagaccaggatgcagaggagtcaagggtgtcagccagagcaaccccggcagccacantgtgtgcactcgatgatgcgacccntgaaacagaagaagaacatttgaacacactgctacagcccntgcnacactcccttncagagcatcntntactggacacttntacttgggcntctcagctcctttgtgacgtggaacag

SEQ ID NO: 4468 - DNA, 302 bp, Mus musculus
  misc_feature (115)..(115): n is a, c, g, or t
  misc_feature (162)..(162): n is a, c, g, or t
  misc_feature (192)..(192): n is a, c, g, or t
  misc_feature (269)..(269): n is a, c, g, or t
agaaaccctggaggatgggctcccggtacatgatgggaagggagatatacgtaaatgccccttttatgctgctcagccagacaaaggtacactaggaggcagcaactgccccttnccagacaaccgtggctgtgctgaggaagcctagcctgcagctcattntggctgccagtgtggccttggtagctggantcttggcctggtactacatgtgaaggacctgtcatgttgtttgcatcctaccccaagtgacctgttctatccccatntccacctctgcctaaaactaccacctcaggtga

SEQ ID NO: 4469 - DNA, 521 bp, Mus musculus
  misc_feature (237)..(237): n is a, c, g, or t
  misc_feature (250)..(250): n is a, c, g, or t
  misc_feature (255)..(255): n is a, c, g, or t
  misc_feature (260)..(260): n is a, c, g, or t
  misc_feature (263)..(263): n is a, c, g, or t
  misc_feature (277)..(277): n is a, c, g, or t
  misc_feature (287)..(287): n is a, c, g, or t
  misc_feature (302)..(302): n is a, c, g, or t
  misc_feature (305)..(305): n is a, c, g, or t
  misc_feature (311)..(311): n is a, c, g, or t
  misc_feature (316)..(316): n is a, c, g, or t
  misc_feature (324)..(324): n is a, c, g, or t
  misc_feature (379)..(379): n is a, c, g, or t
  misc_feature (398)..(398): n is a, c, g, or t
  misc_feature (444)..(444): n is a, c, g, or t
  misc_feature (452)..(452): n is a, c, g, or t
  misc_feature (478)..(478): n is a, c, g, or t
  misc_feature (480)..(480): n is a, c, g, or t
  misc_feature (486)..(486): n is a, c, g, or t
  misc_feature (488)..(488): n is a, c, g, or t
tttccttgttgtgctagccttcatggctgttaagcggatgattggtaagcggcttgctaagcagaatatctcaaaggcattggagcacaaagaggaagcattcaacagagggtccatgaacccaggcgtggtctccggtggcaacacagaccagaacctcatgacagtccctggtagcttcaacagctacgcatatcatggcaacacagaccagaacttcatgacggtcccaggtancttcaacagctantcatntcatngcnacacagaccagaanttcatgacgntcccaggtagcttcnacnagctantcatntcaggatnttccttactaccgatcaataccagaagacggtaacgacagccagcagtaatagantcaaagcaattatgcaacntcaaagccacaacagaagaagaccacaaccaagaagctcactgttnctgtggtnctgatacaagagcaagaactagcccntntctttntntgtggcttactgtttttggttatacatgcctcc

SEQ ID NO: 4470 - DNA, 105 bp, Mus musculus
ccgaaaggccagttaccagattacacatctccagtagtgctgccttattctaggaccactgtggaagatttctgcatgaagattcacaaaaatctcatcaaagaa

SEQ ID NO: 4471 - DNA, 482 bp, Mus musculus
aacagatgcaatacctggactccatgaacggtgaggatctgctgctgacaggggaagtgagatggcgccctctggtggagaagaatccacaaagcatcttgaagccccatgctcctacttacaatgatgagggcctttgagagactggtccctccggacagctggctggctggctttgaggaccttccatggaagaagtgcctgtttgccccaggaccctgaagaaggtggcctgaactgacttgtgaacagtacctgttgaatactcagcccactcgtgttgagtttcttcttcctgatctggtggggttactggggaggtcctcttgctcttctgacaggtcccctccctcaagagaagccccaggcacacttcccaagtcccctcagcaccacacgtgactgagagctttttccgaaggctgaggaagggatgggtaggttagaagggggtgccttcactcagaaacccctgtgcttgg

SEQ ID NO: 4472 - DNA, 534 bp, Mus musculus
  misc_feature (178)..(178): n is a, c, g, or t
  misc_feature (351)..(351): n is a, c, g, or t
  misc_feature (359)..(359): n is a, c, g, or t
  misc_feature (377)..(377): n is a, c, g, or t
  misc_feature (381)..(381): n is a, c, g, or t
  misc_feature (413)..(413): n is a, c, g, or t
  misc_feature (465)..(465): n is a, c, g, or t
  misc_feature (496)..(497): n is a, c, g, or t
acatcccaagcaacagagtggctgaaggacaggagacatgtccctacctccctcctttccctgctcgaggctctggcttccaccgctttgccttcttgctcttcaagcaggacaagccaatcaacttctcagaggacacccgtccctcaccctgctaccagctggcccagaggacctnccgcacttttgatttctacaagagacaccaggaagccatgactccagccggtctggcttttttccagtgccgctgggatgactctgtcacccacaccttccaccagcttctagacatgcgggaacctgtgtttgaatttgtacggccacccccttaccaccccaaacagaagngcttcccncacgagcagcccctacgntatntggaccgatacagggacagtcatgagcccacntatggaatctactgagagactcagtacattcatctccgagggggaactgtcncagcagctggaaggtcacacctccggagagnnccatctgaagccaactgagacagtcccatgctggcct

SEQ ID NO: 4473 - DNA, 342 bp, Mus musculus
aagaggatgaatcccaacagcccttccatcacatacgatatcagccagttgtttgattttattgacgatctggcagacctcagctgtctggtttaccgagctgatacacagacataccagccgtataacaaagactggatcaaagagaagatctacgtgctcctccgtcggcaggcccaacaggctgggaagtaattgagtcggaagcattggggctgggggtggacttggaacaggtacatacagcgtgctgtagtgaaccttttgtatgatagcgatcctgtttcaacgttgttacactcaagccaagattgaatgtctgacatgaaccgtgaatgatct

SEQ ID NO: 4474 - DNA, 407 bp, Mus musculus
gctgtttcctgagtcagaacggccagagatgttgagtgagcaggagcacatgagcatctcgggcagcagtgctcgccacatggtcatgcaaaagctactcagaaaacaggagtctacagtgatggttctccgaaacatggtggaccccaaggacatcgatgacgacctggagggagaggtgacagaggagtgtggcaaatttggtgctgtgaaccgggtcattatctatcaagaaaaacagggcgaagaggaagatgcagaaatcatcgtcaagatttttgtggaattctccatggcctcagagactcacaaggccatccaggccctcaatgggcgctggtttggtggtcgcaaggtggtggctgaagtgtatgaccaggagcgttttgataacagcgacctctccg

SEQ ID NO: 4475 - DNA, 296 bp, Mus musculus
tacttcatgatgtcagagtgtcttgtcacggtttggacttaacttccctctatagtcagcagaggggatccgaggcccagtgctgcctggagaactgagaatagacctctgttgttgacccttcctcaggctggagcctgggtgttggaagggagagactgtcacccagttgtcatgtcttttggttgtgagcctatgcaccttacctttaatggttgaaccatcttttcagcccaaacagtttatttctaaaaagtagatttaatgctaggggccattatgcaggcttgtaatcc

SEQ ID NO: 4476 - DNA, 572 bp, Mus musculus
  misc_feature (310)..(310): n is a, c, g, or t
  misc_feature (318)..(318): n is a, c, g, or t
  misc_feature (344)..(344): n is a, c, g, or t
  misc_feature (355)..(355): n is a, c, g, or t
  misc_feature (357)..(357): n is a, c, g, or t
  misc_feature (391)..(391): n is a, c, g, or t
  misc_feature (399)..(399): n is a, c, g, or t
  misc_feature (411)..(411): n is a, c, g, or t
  misc_feature (439)..(439): n is a, c, g, or t
  misc_feature (469)..(469): n is a, c, g, or t
  misc_feature (488)..(488): n is a, c, g, or t
  misc_feature (533)..(533): n is a, c, g, or t
gctgacacaccatgcagagctacgaaatctgtgctgagaaaatgccatctggaaagatttttaacccattcattcttagtgtgaattttctaaaatagaagtataaaaaaaaagtctctataatctgataggaaaccgtcttttcccaagtgaattcccttttattcatgagaacaaaagtacttagatactataaaaccttaatttccccaacttttaaaataaaatggaatatttgctgaatgaattaagcatagaaaatgtcaacccatcagaattatatttatacatattggtggataagttcttntcttcccnacatcagagaatttttttttaaaccnaaatgggcagnanagcattttgtatgttagagaccattcttttctantccttccnaacattcctgtntcacttaagaatgttagtagaggtcgcnttctttggaaattgaggacttttttttttncctttgaaagtatggcatnctgaagaacacagtatcatgactcgggtggaaagggaggcagaanccatttttcttttagatgaaaagcattctgtgtgattgt

SEQ ID NO: 4477 - DNA, 374 bp, Mus musculus
  misc_feature (334)..(334): n is a, c, g, or t
agccttatcctgttggtggaatactgtaccatatgctcctccaaaacccatgaacacggccaaaacccataaaaacaacaaaagcaaactaagtcaagaaccgtagtatctgtaggcacttagttaagtatagcaactcaaaccagacctgcatccatccgagacaaacgttcctccttcacccttgtttttacttgaaattcgctagaagaaatggcgagcagacatctgttccatgcactagttaatgctactggctcagcatatacaagttagcttgctttaggcaagggacctttcttgtgatggacgtgcactacgaagtgagatggantcctgctccgtgcaggaggcccttcattattgctgcagaa

SEQ ID NO: 4478 - DNA, 405 bp, Mus musculus
gaggttgtaaactcactccagcagcaacctcaggctgcgtccccttcagtcccagagccccactctttgactccagtggctcagtcagatccacttgtgagaaggcagcgtgtacaagatcttatggcacaaatgcaagggccctataatttcatacaggattcaatgttggattttgaaaatcagacgcttgatcctgccattgtatccgcacagcctatgaaccctacccagaacatggatatgcctcagctggtttgccctcaggttcattctgaatctagacttgcccaatctaatcaagttcctgtacaaccagaagccacacaggttcctttggtttcatccacaagtgaggggtatacagcatctcagcccttgtaccagccatctcatgctacggag

SEQ ID NO: 4479 - DNA, 461 bp, Mus musculus
aaggaattgaatgacctggctcgagatcccccagcacagtgttcagcaggtcctgttggagatgatatgtttcattggcaggctacaataatggggccaaatgacagcccctatcagggtggagtatttttcttgacaattcatttcccaacagattaccccttcaaaccgcctaaggttgcatttacaacaagaatttatcacccaaatattaacagtaatggcagcatttgtcttgatattctacggtcacagtggtctccagcactaactatttcaaaagtacttttgtccatctgttctctgttgtgtgatcccaatccagatgatcctttagtgcctgagattgctcggatctacaaaacagatagagaaaagtacaacagaatagctcgggaatggactcagaagtatgcgatgtaattaaagaaattattggataacctctacaaataaagcta

SEQ ID NO: 4480 - DNA, 506 bp, Mus musculus
  misc_feature (68)..(68): n is a, c, g, or t
  misc_feature (324)..(326): n is a, c, g, or t
gtaggtacacagtgtgtgcttggatgggaggaaaagctccagtgacccataggagattgtccttaagntggagtccatccaatctcaaacagtcataaaaagcaaggtgaagaacgtgaagctgtttctatattcatttcatcctgaaggacctacaacttaggtgaaagttatgaccaaacagattaaactacatgctgtgctttaaggtctaaggttaacggatcaacatttaaatggactggagctgttagtacataaagtgtggtgggctttgttcccaacacttcacatctccctgccctttcagccttcctccttttnnnagcccctttccataatctttggtttgtatgtggtttctcagttaatacatagctaatagctcttatttttcttatgtttttaactgctttaggcctatttcgatgtaagggtggagatgtatttgatggaaatccgtgtgtatatttaagaccctgttgctcctctggagcttgtacgtt

SEQ ID NO: 4481 - DNA, 428 bp, Mus musculus
  misc_feature (360)..(360): n is a, c, g, or t
  misc_feature (375)..(375): n is a, c, g, or t
gacgcatcgcgtctggatcttcgaattggttgtattgttactgccaagaagcaccctgatgcagattcactgtatgtggaggaagtagatgtgggagaagcagccccgcgcacggtcgtcagcgggctggtgaatcatgttcctctagaacagatgcaaaatcgtatggtggttttactctgtaatctgaagcctgcaaagatgcggggagttctgtctcaagccatggtgatgtgtgccagttcaccagagaaagtggagattctggcccctcccaacgggtccgttcctggggacagaattacttttgatgcttttcctggagagcctgacaaggagctaaaccctaagaagaagatntgggagcagatccancctgacctgcacaccaatgctgagtgtgtggccacatacaaaggagctccctt

SEQ ID NO: 4482 - DNA, 217 bp, Mus musculus
  misc_feature (50)..(55): n is a, c, g, or t
  misc_feature (57)..(64): n is a, c, g, or t
  misc_feature (67)..(89): n is a, c, g, or t
  misc_feature (91)..(93): n is a, c, g, or t
  misc_feature (95)..(104): n is a, c, g, or t
  misc_feature (107)..(117): n is a, c, g, or t
caaaaagcttggtgagaagagatttggggcctcgggcttggcagatgaannnnnncnnnnnnnnccnnnnnnnnnnnnnnnnnnnnnnncnnngnnnnnnnnnnggnnnnnnnnnnncatgcctttccttgacatacagaaaaagctgggcatcagcctggaccggcactttatgttcctaagcgcagaacagccctataagaacgccgctcggtgc

SEQ ID NO: 4483 - DNA, 378 bp, Mus musculus
  misc_feature (299)..(299): n is a, c, g, or t
  misc_feature (303)..(303): n is a, c, g, or t
  misc_feature (314)..(314): n is a, c, g, or t
  misc_feature (328)..(328): n is a, c, g, or t
  misc_feature (344)..(344): n is a, c, g, or t
  misc_feature (351)..(351): n is a, c, g, or t
gaaacccttggcaccagtttgtagaaaataatctaatattaaaaatgggtccagtggataagcgaaagggtttatttgcaagacgacgacagttattactcacagaagggccacatttatattatgttgatcctgtcaacaaggtcttgaaaggtgaaatcccatggtcacaagaactccgaccagaagccaagaattttaaaactttctttgtccacacgcctaacaggacgtactacctgatggatccaagcgggaatgctcacaagtggtgcagaaagatccaggaggtttggagngcancagtaccagancaatccagatgctnctgtgcagtgacgtgncctgcgnccgggctgcctattgctgccaggatac

SEQ ID NO: 4484 - DNA, 328 bp, Mus musculus
atggctatgaaattcctgtggacatgctgtgcaaaagaattgctgatatttctcaagtctacacacagaacgctgaaatgaggccactcggttgttgtatgattttaatcggtatcgatgaagagcaaggccctcaagtgtacaagtgtgatcctgcaggttactactgtggctttaaagccacggcggcaggagttaaacaaacagagtcaaccagcttccttgaaaagaaagtgaagaagaaatttgattggacatttgaacagacagtggaaactgcaattacatgcctgtctactgttctgtcgattgacttcaaaccttcaga

SEQ ID NO: 4485 - DNA, 447 bp, Mus musculus
  misc_feature (319)..(319): n is a, c, g, or t
  misc_feature (422)..(422): n is a, c, g, or t
aaaggttgcagttatctgtccagaaaccagatcaagttatcaaagaggatgtctcggaactaaggagtgaactgcagcggaaggatgcgctggtccagaagcacttgacaaagctgaggcattggcagcaggtgctggaggacatcaatgtgcagcacaagaagccggctgacatgcctcagggatccttggccttcctcgagcaggcgtctgccaacattcctgcacctctgaagcagacctaagcactcctgcctgtcttgcagccttgcagtcttgccagacacgtttccttacagacctggtgtgttggaaggantctgttggataatgagtttgtatcagtttctgtccctatttataaggtagggtttcattatgaagccgggaagggccttgaatctatgatcccctgcctcagntcctctagtactctaaactcctgaa

SEQ ID NO: 4486 - DNA, 428 bp, Mus musculus
  misc_feature (70)..(70): n is a, c, g, or t
  misc_feature (72)..(72): n is a, c, g, or t
  misc_feature (160)..(160): n is a, c, g, or t
  misc_feature (236)..(236): n is a, c, g, or t
  misc_feature (293)..(293): n is a, c, g, or t
  misc_feature (306)..(306): n is a, c, g, or t
  misc_feature (330)..(330): n is a, c, g, or t
  misc_feature (367)..(367): n is a, c, g, or t
  misc_feature (369)..(369): n is a, c, g, or t
  misc_feature (402)..(402): n is a, c, g, or t
gagttgtgcacaggatgtctgccctgtgctcctgaccgcctggcagccttctggtgctgcatgcctgtangncctttgggagcagaggccctcaggactgttttgggacctgtagttgttggcctgggcaatggctggactatgcgattacatccatgcngagatctgcaggcccccatgtccttggctgacactagcttcaccaaactagtctatagctgaggggatagcctgcntcctgattccttgagataatagcagccttaacctttagcctataggctttcgtccanccctagtcacttnctgccccaggtcaacaggctgctntcatagccacaccacacaggagctggccagtgctttntnatcgagactgacccacacatgctgtgttgtgtnccttttgtgacactgtggtttaccgg

SEQ ID NO: 4487 - DNA, 503 bp, Mus musculus
gggcagcagccagagacaagtatcagctagcatcgggacagaaaggtgttcaagtaccagtatcacagccaactacacctacctaatggccagccccagagctgcgtggaccagcagcagctcctgcctcagtgcccgctcctttcctgccactgctgctgcttctggcttgcctctgtactgtgtggtgtggagggcactaagtatcactgaggagcaacaaggagagacctctgctgccccgtgagcgagcggtgctgggttttgacctgggcagtggccagtgtggctggcggtcatgactggtggctgtgtctggtccgttgagtgtagagctgagaagaggcaggatttggggttgaggtgagtcatggcctcttgctggaaaggtgtgttggggtgtgggtgtcatctcaccctcgtccccactcctccggcctggaatgtgaagtgactccccagcccctttggctgtggcagtgtatggactgggctgccactgt

SEQ ID NO: 4488 - DNA, 517 bp, Mus musculus
  misc_feature (386)..(386): n is a, c, g, or t
  misc_feature (432)..(432): n is a, c, g, or t
  misc_feature (438)..(438): n is a, c, g, or t
  misc_feature (476)..(476): n is a, c, g, or t
  misc_feature (483)..(483): n is a, c, g, or t
tggctgaagacgttcctgagctccagtcagtgcgtgacttgcatggagacatacctggaggatgaggcgcagctggatgaggtggtggagtacctgcagggcgtctgcagagacatggacggccaggtgcctgagcgcggcagtggagaccgcattcgcttcatcttggatgtgctgctgcccgaggcaatcatctgtgccatttccgcggtggaggcggtggattacaagacagccgagcagaagtacattcgtggccccacacttagctaccgggaaaaggaaatctttgacaatgaactcctggaggagaggaaccgacgccgtcgctgatgccgcagtctgcacctggccggccagcactgggtgtgacctgccagaggccntccaccaggcctaggagtgtgagaactttgacctgtgcgtgggttntacgtncttcagcctaagtctgggagatcagatgccatcagatncctgctnccatctatgaacagctgctttctggaagtttctg

SEQ ID NO: 4489 - DNA, 409 bp, Mus musculus
  misc_feature (300)..(300): n is a, c, g, or t
  misc_feature (363)..(363): n is a, c, g, or t
tgatccgacccatcttgaaagctcacttccggagagacgagtttctgggacggatcaatgagatcgtctacttcctccctttctgccactcagagctcatccagctggtcaacaaggaactgaacttctgggccaagagagccaagcagaggcacaacatcacactactgtgggaccgcgaggtggcagatgtgttggttgatggctacaacgtccactatggtgcccgctccattaagcatgaggtagagcggcgtgtggtaaaccaactggcggcagcctatgagcaggacctgctanccagggggttgcaccctgcgtatcactgtggaggattcggacaagcacctcctcaagagcccntgagctgccctcaccccaggctgagaagcgtccacctacattgcga

SEQ ID NO: 4490 - DNA, 560 bp, Mus musculus
  misc_feature (232)..(232): n is a, c, g, or t
  misc_feature (303)..(303): n is a, c, g, or t
  misc_feature (357)..(357): n is a, c, g, or t
  misc_feature (366)..(366): n is a, c, g, or t
  misc_feature (396)..(396): n is a, c, g, or t
  misc_feature (401)..(401): n is a, c, g, or t
  misc_feature (404)..(404): n is a, c, g, or t
  misc_feature (408)..(408): n is a, c, g, or t
  misc_feature (428)..(428): n is a, c, g, or t
  misc_feature (534)..(534): n is a, c, g, or t
cctaaaagttcaccccactcagtgacggcctcatcttcctcggtcccagccctgaccccaggcttttccagacattcactacccccttctcccttgtgccgtagtctgtctccggggactgggggaggagtccgaggtggggttagctacctgtcccgaggggaccctgtgagggtccttgctcgaagagtgcggcctgacggctctgtgcagtacctagttgagtgggganggggggggcatcttcctgacagcctgcttctgctcccctccccattcacacactggcactttcatgccctngacctctgacctcacctacagctgggatgtacctggagagatggggagtggttntccctcctncccaggctggaatccaggggagtgaagagntcctnttntctnccccttcatgactcctaatngccccccctcatttcctttgatgttattttgttacagcttttgagataattttttaagactatttaacccctgggattagagattggggggggggggtttgggtgntccaggattccagactgtatgactgt

SEQ ID NO: 4491 - DNA, 130 bp, Mus musculus
ctgtcttccaccattggcagattgtcccaggcgatcctctggacaagagcattgtcattcgcccgctggagccacagccagctcctcacctggctcgggagttcatgatcaaaacccgtcgtaggaaggg

SEQ ID NO: 4492 - DNA, 192 bp, Mus musculus
gagaattcagattccatctattcatcaactcctgaagttaaggcctgagcatcagacgtgtgctgccgaaaccatatgttcatggactaaacaagcagagacaagcatccgccttcagagttactgtctgcctgaggcaaagagggcagaaaatattggggcatatgagttagctccagtgcacgaacagct

SEQ ID NO: 4493 - DNA, 518 bp, Mus musculus
cgaagcacacctgtacgggaccggggtgggcgccgctagccaagaaaacactagagagctgcaggtacctgccacttggtcctgggaggtcaaaggccacagagggataggtacagtcaccaccaccctggaaccaagggtctcacaacattgctcagtgctgaactataactgccacacgtcccctcatatcaaatgaagcagtggcaatctccctgttccccaacctaactcttggaacttggccctctcctttcttcctgttaagtctgagagggaagagctaggctatgaagggaagatgtggccgtacgtgggaataaccagtgtcccacgctcattttccctccatcctgcgttccgcctcccttggtactcagccttttggggacagctggggccaggactgggtcacctatgagctgaatcagcctctcctgagtcccaggcccctgcagtcccctggttctctggcctgcagcctcttgcccgctggttccactttatagccacctttt

SEQ ID NO: 4494 - DNA, 275 bp, Mus musculus
gctttctcagaaaactccaccaagtatgcggttgaaactgattgcaaacaacacgacggtggagcggaggttcagctcatggattggtggctctatcctagcatctttgggtacctttcaacagatgtggatttctaaacaggaatatgaagaaggagggaagcagtgtgtagaaagaaaatgcccttgagggctccaccctgcctgcccgtcacctcaacgtctgtagctttagtacactcaggaaaaagatgaccatcttttgtagaatgttt

SEQ ID NO: 4495 - DNA, 492 bp, Mus musculus
  misc_feature (102)..(102): n is a, c, g, or t
  misc_feature (358)..(358): n is a, c, g, or t
  misc_feature (421)..(421): n is a, c, g, or t
  misc_feature (423)..(423): n is a, c, g, or t
  misc_feature (427)..(427): n is a, c, g, or t
gactgacgactgaggtcacttcacacatggccagcgtgagccgacaccaagccttgcctcagcctccacctgtggggctcccactaatttcctcctggatgngaacgactcgggcactgttgtcatcagagtgacagccctggagccttgccagtgacttcctcgcctcacatggacccccaggttcactgcacacgctgagaaatagaattgagaagtaaaggaaatggccttcaaaaggccacacctgagacccgcccctgctttatgacacccttccctgggcctcatgctgtaccacaggaggcagagtcagcacagccgtggccagggcacccccaggtccctgacctggtanttagcagtgcacccctccccccagtgctgtgcactgagcagcccccactcagctactgccagntntccntcccaagcaccaaggtagactctgagcacagacagggccccgtggcccagtcagctgaccagcta

SEQ ID NO: 4496 - DNA, 512 bp, Mus musculus
  misc_feature (82)..(82): n is a, c, g, or t
  misc_feature (97)..(97): n is a, c, g, or t
  misc_feature (128)..(128): n is a, c, g, or t
  misc_feature (166)..(166): n is a, c, g, or t
  misc_feature (186)..(186): n is a, c, g, or t
  misc_feature (223)..(223): n is a, c, g, or t
  misc_feature (264)..(264): n is a, c, g, or t
  misc_feature (289)..(289): n is a, c, g, or t
  misc_feature (337)..(337): n is a, c, g, or t
  misc_feature (385)..(385): n is a, c, g, or t
  misc_feature (424)..(424): n is a, c, g, or t
tagcactataaagctctgagttcagaccccaggctggaagatcaggagttcaaggtcatccttggcccactagtgagtttgnagaacagtctaagangcatgaggtaaaggttttacagaacatggtngcccgtgcctttaatcctaatactttggaagtagacanaggaagatttttgagtaagnccaatctgaacttaaatcagactttgtctcaaaaaanagaccgggtgtggtggcactcccctttaatcctacaacttnggaggcaagaggcaggttggatctnctgagcttgaagttagccaggattacctagtgagatcctatcttaagntccccctccctgctcctgacaaaaacacacaaattctgtttgtctcantcttagcacattgggctagaggggaaacgacatcatccnaaacgatctttttctgtacaagtatttctttacctgacttggttaccagttttgcatgtaagaagcagaactctatacccctaataag

SEQ ID NO: 4497 - DNA, 441 bp, Mus musculus
  misc_feature (307)..(307): n is a, c, g, or t
  misc_feature (327)..(327): n is a, c, g, or t
  misc_feature (329)..(329): n is a, c, g, or t
tggtctagagctcgccaagaagcacctccaagccacacaacagaccatcgccagctgtctctgtaccaacctcgtcacttcccagggcccttttctctactgctcactcatggagggcactccagatgtcaccctgttttccaagccagcatccttgagtctgctcagcagacatctgctcaagtcctttgtgtactcgacaaagaatcgacgatgcaagctgctgcccctggtgatggctgccccgctgagcgtggaacagggcacagtgaccgtggtgggcatccccccagagactgatagctcnggatagaaagaacttttttngntcgggcttttgagaaggcagcagaaagcaccagctctcggactctacacaattactttgacctctcagtaattgagctgaaggctgaggaccggagcaagttcctggacgct

SEQ ID NO: 4498 - DNA, 372 bp, Mus musculus
  misc_feature (325)..(325): n is a, c, g, or t
  misc_feature (330)..(330): n is a, c, g, or t
  misc_feature (332)..(332): n is a, c, g, or t
  misc_feature (335)..(335): n is a, c, g, or t
  misc_feature (337)..(344): n is a, c, g, or t
aatctctgggcagcgcagcgctacggccgtgagctccgaaggatgagcgatgagtttgagggttccttcaagggacttcctcgcccaaagagcgcaggcactgcaacacagatgcgacaaagcgccggctggacgcgcattatccagtcctggtgggatcgaaacttgggcaaaggaggctccaccccctcccagtgatcttctgctccacatcccggaactctacccgctcccgtcgcccgccatattgggtgtgggcggaagtctttcgaggccttaggaaaaaaaaagaggatcgctgtgtccctttaacagggagaagagnctgangnacngnnnnnnnncttgagtcccttccggtgcgtgcaatag

SEQ ID NO: 4499 - DNA, 293 bp, Mus musculus
  misc_feature (141)..(141): n is a, c, g, or t
  misc_feature (206)..(206): n is a, c, g, or t
agaggaggaggctcatccgctacgtgaccgctttcaatggcgagctcgaggactatatgaatgagcgggtccagttcgtcatcacggcccaggagtgggaccccaactttgaggaggccctgatggaaaacccttccctgnccttcgtgcggccccggtggatctacagttgtaatgagaagcagaagttactcccccatcagctntatggggtggtgccccaggcctgagtgtacacctgtgtacgtgcagatgtgcacatgtatgcacaggcctgagtgcacacgtgtgta

SEQ ID NO: 4500 - DNA, 475 bp, Mus musculus
gtcgtagagttttgccaccagtaattttcaaagatgaaaaccttaagaccatgtacagccaagaccggcatgctgatgtcctcaatctctgtgttgcccagtttgagccagattccgctgagtatatcaaggttcatcatcagacctatgaagatatagacagacatggaaaatatgagcttttacgttcaacaagacactttggtggaatggcttggtattttgtaaataaaaaaaagattgatggtttgcttattgatcagatccagagagacttggttgatgatgccaccagcctggtccagctgtaccacatgctccatccagatggccagtcagctcaagaggccaaagagcaggctgctgagggagtcgacttaattaaggtcttcgcaaaaacagaagcacagagaggagcatatatagaattagcacttcaaacttatcaagaaatagttaccagtcattccgcagc

SEQ ID NO: 4501 - DNA, 351 bp, Mus musculus
gattcgccggtacaaggccaacaaggatgtgatggcgaaggcagcagaggtctacacccggctcaagtcacgggtcctggggccgaaagttgaggctctccagaaggtgaacaaggctggagccgagaaggaacgggccgataacgagaagctagaggagcagccgggggagcaggctcccagagagctggcagaggatgagcccagcaccgatcggtcagcacctgtgaatggtgaggccacatcccagaagggggagaacatggaagacagagcacaggaagacgggcaggactctgaagatggccccaggggtggctcctcagaagagctgcatgacagcccacgcga

SEQ ID NO: 4502 - DNA, 465 bp, Mus musculus
  misc_feature (425)..(425): n is a, c, g, or t
atctacaaggctttcaggtctgacaactctttcagcttcttcgtgttcttttttgtatttttttgtcaaatagggatctacttcatccagttgattggcttgcctaacttggggaccagtggttggcttgcagccctatctacgatgaaaaatgggcccttagctgtgaccatcatcatgatggtagtggctggcttctttaccctctgtgctgggctttcactcttcctcctgcagcgggtacacgccttctaccgccgaacaggagccagcttccagcaggcccaggaagagttctcccagggtatcttcagcagcagaacctttcgcggggctgcctcatctgctgcccgaggagcctttcaggggaattaggcttcccgactctccttccctgagccctggcctctctgtcaactgtcttntgagctgcactttcctcgggtgccttatgcagtgactaca

SEQ ID NO: 4503 - DNA, 541 bp, Mus musculus
  misc_feature (309)..(309): n is a, c, g, or t
  misc_feature (311)..(313): n is a, c, g, or t
  misc_feature (316)..(316): n is a, c, g, or t
  misc_feature (322)..(323): n is a, c, g, or t
  misc_feature (352)..(354): n is a, c, g, or t
  misc_feature (363)..(363): n is a, c, g, or t
  misc_feature (367)..(367): n is a, c, g, or t
  misc_feature (371)..(371): n is a, c, g, or t
  misc_feature (375)..(375): n is a, c, g, or t
  misc_feature (379)..(379): n is a, c, g, or t
  misc_feature (387)..(387): n is a, c, g, or t
  misc_feature (392)..(392): n is a, c, g, or t
  misc_feature (407)..(407): n is a, c, g, or t
  misc_feature (417)..(417): n is a, c, g, or t
  misc_feature (419)..(420): n is a, c, g, or t
  misc_feature (451)..(451): n is a, c, g, or t
  misc_feature (468)..(469): n is a, c, g, or t
gtaaacctgaaaagtgctctggagaagtaccatgagggcatcgagaaggtagcggaggagcgcagcgctaaactggaggagaagacggcagagctgaagaagaggatggtcagaatggtctgaacaacaacagcccttctggaaacggcctgctgcctttctgcttctgtttggcatagttatattgaagctaatggaagtacctgcaatatcagctcactaacacgggtaccactagttcttgtttctctttggtgtcattttatatggcgatgtgcttcctgtgtgcttccagacctatccctgagntnnnacnattccnntggccattcatattagttctattacaagnnntggaagagnttanatcntttntacncaggcccnacgantacagctgatacagntgacataaantnntgatggagatacaactcagggccttgcatgntacactgacttgctttnncaggctccaacatgccatgtattgtatagacttttactacaattcaaataacgtgtacagcttttatgtccc

SEQ ID NO: 4504 - DNA, 457 bp, Mus musculus
  misc_feature (390)..(390): n is a, c, g, or t
  misc_feature (429)..(430): n is a, c, g, or t
  misc_feature (432)..(432): n is a, c, g, or t
gagttagttaccagcaggtgtttccttggcagggagaagtccagcctgacactctacaaatggctctaaaagtagtgaacattcagaccatcgcaatgagcagagctggggcacagccctggaaagcctacctcagtgctcaggatgatactggcggccttttcttagctgaattgctactgaagcctgagaactcagagatgcaaatctctgtgaagcaaagtaaggcaaggactgaatccctgcatggttttgtttctgtcctggaaactgtgattggaacagttggagacataaaatcttaacagagttccttcattgtcttaaaaagctgcttgtaagtccacatattaacttcaaaagagagtgggaggtctgggaacccagctnttatgtttacccaaagtttacgttgttcttttcaagccnntntcaggaattgatcccattttaaaag

SEQ ID NO: 4505 - DNA, 484 bp, Mus musculus
  misc_feature (290)..(290): n is a, c, g, or t
  misc_feature (297)..(297): n is a, c, g, or t
  misc_feature (315)..(315): n is a, c, g, or t
  misc_feature (363)..(363): n is a, c, g, or t
  misc_feature (395)..(395): n is a, c, g, or t
  misc_feature (397)..(397): n is a, c, g, or t
  misc_feature (404)..(404): n is a, c, g, or t
  misc_feature (422)..(422): n is a, c, g, or t
  misc_feature (424)..(424): n is a, c, g, or t
  misc_feature (445)..(445): n is a, c, g, or t
acacgccatcttggagcagtagcagagccaggccaccagccagcctggccagtctgcatggacctcctgtctagacgttggttctggattcttgtctgtgacactggaagggagatgagcctggtgggaagtgtcagccccgtcaccgggcctccaacttcagtgggaacatctgcctgcttttgtgctttcctgctgtctctaactatagaggccagtcataggctcttggtctcgtgcaaagccatcccttgcctttaccgggttgactctggtgagggtcttgtaancatcgcnttttctaacaaaaagagnttgctgcaagaccagatgtgatgatcatattttaccagcaaaactgantcttgtgtgtttcccgtgggcctggagagaantntggcatntacttgggattgatgttntnttctttccctacccagccatntcataaagtgggggaacaggccatttgcgaagacacact

SEQ ID NO: 4506 - DNA, 414 bp, Mus musculus
ctggaggaactctgcctggaagtcaatgtcaccgcctcacagagtgccacccttgatgcctgcagctttggagtcacaggtctgaagctccaaggggccacgtgcagcaacaacaagctatcactctccaatgccatctccacagtcctccccctcacacagctgcgctgggtgaaacaaacaagcgccgagaagaaggccagcgtggtgaccttacctgtctacctgaacttcacccgggcagacctcatcttcaccgtggactttgaaattgctacaaaggaagatcctcgcagcttctatgagcgtggagttgccgttctgtgcactgagtaaagctagacttttctccagtcctctttctggaataggaaactcccaatatttaaccttcattcatccttaacggtgtgg

SEQ ID NO: 4507 - DNA, 437 bp, Mus musculus
  misc_feature (51)..(51): n is a, c, g, or t
  misc_feature (321)..(321): n is a, c, g, or t
  misc_feature (323)..(323): n is a, c, g, or t
aagtgcccctcctatgtgggagttacaggaatccttctgcaggagaccaancatgtctttaagatcatcaccagagaagaccacctaaaagtcatccccaagctgaattgtgtgttcaccatagaaattgatgacttcatttcctacatttatggaagcaaattccagcttcgggcaagtgagcggtctgccaagaagttcaaagcaaagggatcaattgacctgtgaactctgccactggagacagatgtccctgacactgaagaactggaaactccctaaatactcactttttcttgaagagcctctggctgtagcccntnctgtagtccagggaaaacagaggggctgaagagcatcgaacaactcgggagaaagctaggggtaaatatttgtactgttaggtgaccttaagttagctttagttccacagggag

SEQ ID NO: 4508 - DNA, 550 bp, Mus musculus
  misc_feature (208)..(208): n is a, c, g, or t
  misc_feature (351)..(351): n is a, c, g, or t
  misc_feature (391)..(391): n is a, c, g, or t
  misc_feature (416)..(416): n is a, c, g, or t
  misc_feature (425)..(425): n is a, c, g, or t
  misc_feature (442)..(442): n is a, c, g, or t
atactctcgccctgtatcatggaggggacgacgacgcgctactctctgacttctgtgccaccctgctcgatgtttctggggccctgggagcccagcaagtctttggctctacagaggaagccctgcaggccgcagcccacgtactggaagcgggcgagcacccacctgggcccctgggtacgcggggtgctatgcaagaagttgcccngaatcctgctgggcgagggtccagtcaatcagaaaggctacactctgacagcactggggcacctagctcagaccctgggacgagcccggaagcaggctgtgattggtggagagcgagatcgactttaccgggctcggaagaantgccagttcctgctggcttggaccaacgaaaacgaggctnccctcacacccctggcgctagactngtgccagancccaccgagcccatgcntgtgacagctgaggagatggcaacgcttactggagagttagaacggctttggggaggcccagtgccacccactccaaggactctcattgaggaactccctggctgaac

SEQ ID NO: 4509 - DNA, 364 bp, Mus musculus
  misc_feature (127)..(127): n is a, c, g, or t
  misc_feature (337)..(337): n is a, c, g, or t
attgtcaacgtgtggcctagtggtcctggagaaagtggatgggctcccctgcaaacattcactcaacatcaaggcgctgtcaaggctgtggcatggtgtccctggcagtccaatatcctggcaacanggaggaggaaccagtgaccggcacattcgcatttggaacgtctgctcaggggcctgtctgagtgctgtggatgtgcattcccaggtgtgctccatcctctggtctccccactataaggagctgatctcaggtcacggctttgcccagaaccagctggttatttggaagtatccaaccatggccaaggtggctgagctcaaaggacacacngcacgggtcctgggtcttacaatgagt

SEQ ID NO: 4510 - DNA, 322 bp, Mus musculus
  misc_feature (235)..(236): n is a, c, g, or t
agccccaacctgtttgtccagaatgtgtttgtggatacccatgatcttcgcttcccttgggtggccttctttgccagcaagagaatccgggctggaacagaactcacttgggactacaactacgaagtgggcagtgtggaaggcaaggagctgctgtgctgctgtggggccattgaatgcagagggagacttctttagaggaagacttcctcactttgagaacgcttgaactatnnttttccccaggaactgggtcttcctgactgttgaactctgaccccaagtctctgatctagcttcttcccagctcctagtagataga

SEQ ID NO: 4511 - DNA, 450 bp, Mus musculus
tatggcaagccgtgtacagttatctggaccacaggaggcagaaaaatatgttctacacatgatagaagatggagaaatttttgcaagtattaaccagaaggatggaatggtcagtttccatgataaccctgagaagtataataacccagccatgcttcataacatcgaccaagagatgctaaaatgcatagagctggatgagcgactgaaggctatggaccaggagatcacggtgaacccccagtttgttcaaaagagcatgggctcacaagaagatgactcaggaaacaagccctccagctactcttgaaactaacccccatcttgaggtaacagaaccttggcctggcaagtgtgaagagcgcagcaggaagtaccatgcgggttccatgccggttcctcctggacagtcagaaattcagtttaacatctgcagtcctattgctttca

SEQ ID NO: 4512 - DNA, 487 bp, Mus musculus
  misc_feature (239)..(239): n is a, c, g, or t
  misc_feature (241)..(242): n is a, c, g, or t
  misc_feature (250)..(250): n is a, c, g, or t
  misc_feature (258)..(258): n is a, c, g, or t
  misc_feature (280)..(280): n is a, c, g, or t
  misc_feature (288)..(288): n is a, c, g, or t
  misc_feature (296)..(296): n is a, c, g, or t
  misc_feature (353)..(353): n is a, c, g, or t
  misc_feature (390)..(390): n is a, c, g, or t
  misc_feature (407)..(407): n is a, c, g, or t
ggaatttgtcaatctctatttcagactacattctcaataaatctgtagaaaaacaattcaaggcatttcgcagaggttttcatatggtgactaatgaatcgcccttaaaatacttattcagaccagaagaaattgaattgcttatatgtggaagccggaatctagatttccaggcactagaagaaactacagagtatgacggtggctatacgagggaatctgttgtgattagggagttntnnggaaattnttcattcntttacagatgaacagaaaagantctttctncagtttancaacaggcacagacagagcacctgttggaggactaggaaaattgaagatgattatanccaaaaatggcccagacacagaaaggttacctacatntcatacttgctttaatntccttttacttccggaatattcaagcaaagaaaaacttaaagagagattgttgaaggccatcacatatgccaaaggattt

SEQ ID NO: 4513 - DNA, 540 bp, Mus musculus
  misc_feature (367)..(367): n is a, c, g, or t
  misc_feature (398)..(398): n is a, c, g, or t
  misc_feature (458)..(458): n is a, c, g, or t
gtatcccagtacaaaaaggctgtaagatagtgaaccacagtagtcatctatgtctgtgcctcccttcttcattggggacattgtgggctggaacagcagatttcagctgcatatatgaacaaatcctttattattattataattatttttttgcgtgaaagtgttacatattctttcacttgtatgtacagagaggttttctgaatatttattttaagggttaaatcacttttgcttgtgtttattactgcttgaggttgagcctttttgagtatttaagatatatataccaacgaaactattctcgcaaggaaaacattgccaccatttgtagaacatgtaatcttcaagtatgtgctattttttntccctgtatctaagtcaaatcaggaactttnttctaacaatttgcttttgaaacttgaagtcaaggaaacagtgtggtgcaagtactgctnttctagcccccaaagagttttctgtacaaaattttgagaaccaataaagatggaagggagaacttggaatgtttgaaccaca

SEQ ID NO: 4514 - DNA, 553 bp, Mus musculus
gcatgagaactcagggccccatcaaagcatctctgttttgcaatacattgtactcattatgtggagaatgtgcaggacataggaaaccctcactctatacacagttctccagtcacactggggctcaggcgtgcctcctaaggcatgtggacacgtcacaggaacacgtctgaatccagggcacacatttcagtttggaagaaagaccaatagggcatccgcaggatctctgccaccagcagaacctccactttctgggcctcctcagtcatgtgaggaggagaatcagctggaggcaaggggctgtccctgacattcctgcgccaatcttgggtgaagggctgtcagtgctatgatacacaggcagataggcagatactatcactgggacccaccagcctcaacaccatattctcttattctctataccaccaccaagcgtgtgggtttccttcggaatactgcagatggcgctcgccacactgggcagcaatggggagcactctggtgaaaattcccctttttatatgtgcactactctgtcatatgattc

SEQ ID NO: 4515 - DNA, 430 bp, Mus musculus
  misc_feature (331)..(331): n is a, c, g, or t
  misc_feature (341)..(341): n is a, c, g, or t
  misc_feature (360)..(360): n is a, c, g, or t
  misc_feature (385)..(385): n is a, c, g, or t
  misc_feature (390)..(390): n is a, c, g, or t
ccagtagcaatcgtccgtaggagtttacagtaccacacacaagaatgtgctgtgcatcttgctttgtttcttttaagtcacattgtaaagtactaaggcatgtttcttgacttaatttttgacatgtgagctgttctgtgaagcatagagcatctcgcccattccacagtttctccctgctctcctcaggagttagtggggttggatttgtcagaggtgatgagttaaagagtcctttcacactttccagatgtgaaacacaggactcctaggagcccgcgcagcccgcagtggggaggcatccttgttgtattgtgtggaggagcgctgncctcccactnccagaaggctgggcgtgancctcagaccaggctggggcaagggnccttngctgcacaatgcaaggaacttgggctcctcataactgaag

SEQ ID NO: 4516 - DNA, 505 bp, Mus musculus
  misc_feature (233)..(233): n is a, c, g, or t
  misc_feature (239)..(239): n is a, c, g, or t
  misc_feature (241)..(241): n is a, c, g, or t
  misc_feature (254)..(254): n is a, c, g, or t
  misc_feature (260)..(260): n is a, c, g, or t
  misc_feature (290)..(290): n is a, c, g, or t
  misc_feature (292)..(292): n is a, c, g, or t
  misc_feature (295)..(295): n is a, c, g, or t
  misc_feature (297)..(297): n is a, c, g, or t
  misc_feature (301)..(301): n is a, c, g, or t
  misc_feature (303)..(303): n is a, c, g, or t
  misc_feature (324)..(324): n is a, c, g, or t
  misc_feature (334)..(334): n is a, c, g, or t
  misc_feature (337)..(338): n is a, c, g, or t
  misc_feature (353)..(353): n is a, c, g, or t
  misc_feature (360)..(360): n is a, c, g, or t
  misc_feature (362)..(363): n is a, c, g, or t
  misc_feature (430)..(430): n is a, c, g, or t
  misc_feature (432)..(432): n is a, c, g, or t
caacaacaggattcttatgcagctacaggcagatattctgcacattccggtagttaagtctgtcatgcctgaaacgacggccctgggagctgccatggcagccggagctgcagaaggggtaaatgtttggagtcttgaacctgaagatttgtctacgatcttgatggaacgatatgaaccacaaatccaagccacagagagtgaaattcgtttttcaacatggaagagagcantgatgnantcaatgggttggnttacancaaaggaccctgaaaatggcgataaccctntnttntncttntntgcccttgggtttttttatantgagtagcangannttattaattggagcnagatgtntnntcaactgctgaagagtaatttgaaccacggacttgcaatgtgtgaactttttacagaaagaattccntnttttagtgtgaaaccaatattataggtttatttttacctataggccacttgcttacaggaacccatgaggccc

SEQ ID NO: 4517 - DNA, 187 bp, Mus musculus
  misc_feature (42)..(42): n is a, c, g, or t
tttaccattctcagtagccacccaggagctgaagtttccccnctgcttccactgagggaccagggattggtcctggtacaagtttcaatctccaaccctagtggttttctgaaacctgcaactggatggagaagctgtaggcagtatttatctgtatgaagagttctctacacctattgattcccca

SEQ ID NO: 4518 - DNA, 384 bp, Mus musculus
  misc_feature (29)..(29): n is a, c, g, or t
  misc_feature (240)..(240): n is a, c, g, or t
  misc_feature (319)..(319): n is a, c, g, or t
cacagtacgctgaaatcctcgccgaccancccggatgcgcccatgtcccaggtgtacggagcgccacatttgctgagattatttgtgcgaattggagcgatgttggcctacacgcctctagatgagaaaagccttgctttattactgaactatctacatgattttctcaagtacctggcgaagaattctgcaaccttgttcagtgccagtgattatgaagtggcccctcctgagtaccancggaaagccgtgtgagggcgtgctcgccctctctccctcgtgcttggatctctgtaaacagtttggttcttagtccttntcttgtacaaatgatgtactttgaagaccgttagtgtataacagagttgtttgtttcctctttga

SEQ ID NO: 4519 - DNA, 240 bp, Mus musculus
tacttagtaactgtgaatccttgaagacttcagcaggctgtaaacatgagttgctcaagacaaagtgccaggctacttgtttgtgtgaagacaaaattcattaacatgcccagtgtgcagcaggacagactacatgaggaaggggtacagacttagttgagactgatggggaaaatctataggagattagtgacatgtcacatcccaaatgacaaggcttctttccttcctagattcata

SEQ ID NO: 4520 - DNA, 524 bp, Mus musculus
  misc_feature (33)..(33): n is a, c, g, or t
  misc_feature (41)..(41): n is a, c, g, or t
  misc_feature (48)..(49): n is a, c, g, or t
  misc_feature (77)..(77): n is a, c, g, or t
  misc_feature (87)..(87): n is a, c, g, or t
  misc_feature (103)..(103): n is a, c, g, or t
  misc_feature (128)..(128): n is a, c, g, or t
  misc_feature (169)..(169): n is a, c, g, or t
  misc_feature (176)..(176): n is a, c, g, or t
  misc_feature (331)..(331): n is a, c, g, or t
  misc_feature (403)..(403): n is a, c, g, or t
  misc_feature (477)..(477): n is a, c, g, or t
  misc_feature (489)..(489): n is a, c, g, or t
  misc_feature (494)..(494): n is a, c, g, or t
caggtatagacctctctttaaccgccacttgantcacactntcaaatnncacgttcactttttcttacaagaaagcntcagcgagantctgggctatgagccnacttgtcaactgggaggaagcaaancagaaaacctcagagtggatagggacaatagtggaacagcnacagggnagatattggacacaaagtgccagtgatggaaaaagggcaggtacatggctctgggagttataaggtcctgtagcaagtacagaggcacaagccaggtcctgctgtctcctgtagacacagagaccaacttggtatctttctcaagtcaccagaanccttgccagtcactaacccactcacaaacttgcttccctaagcccctgctcagagacaaacatagctgagtntcagttcttaggcttcagcaattacaatttactttcacttagaacttagtattgcttttatttcccccttcaantcctaaatcatntcttncctttggtaaaatcccgttgctttctgaag

SEQ ID NO: 4521 - DNA, 367 bp, Mus musculus
gcgacttgatcgaacaggcagctgagatgctttatgggttgatccacgcccgctacatcctcaccaaccgaggcatcgcacaaatgttggaaaagtaccagcagggagactttggctactgtcctcgtgtatactgtgagaaccagccaatgcttcctatcggcctttcagacatcccaggcgaggccatggtgaaactctactgccccaagtgcatggacgtgtacacacccaagtcctccagacaccaccacacggacggcgcatacttcggcactggtttccctcacatgctcttcatggtgcatccagagtaccggcccaagcgacctgccaaccagtttgtacccaggctctatggtttcaa

SEQ ID NO: 4522 - DNA, 374 bp, Mus musculus
  misc_feature (189)..(189): n is a, c, g, or t
  misc_feature (203)..(203): n is a, c, g, or t
  misc_feature (211)..(211): n is a, c, g, or t
  misc_feature (218)..(218): n is a, c, g, or t
tgacatgtcaccacgttgcctgtgttgctgatcaccgtccagttcagtggaatgtgctgtagcatttcctaaaaccccacctgtgactgcagagtgagagtgctcagactcggacctctgtagccggctcttcctcagggcaggccagcactgcagatcctccggcccgagccacacaggcggctgggngctggggctggggnctggggcnagagccngcctcttccagagcttctattttatctagaacgcgttacacactgttacagtcttaccggctcagccctgcttgtcttgcacatctgaccttgcagaagctggggtgggtggtagcatgctaattaagagaatcagaagtagtttccagagctggc

SEQ ID NO: 4523 - DNA, 503 bp, Mus musculus
caggctcagtgacctcctgaaggagaagcagtctgtggaaaggaagtgtacccagctgaacaccagagtggccaagctcagcacggagctgcaggaggagcaggagctgaacaagtgtctgcgcgccaaccagctggtgctgcagaaccagctcaaggaggaggagaagctgctgaaggagacctgtgcccagaaagacctgcagatcaccgagatccaggagcagctgcgcgatgtcatgttctacctggagacacagcagcagatcagccacctgcctgcggagacgaggcaggagatccaggaaggccagatcaacatcgccatggcctcagcgcccaacccaccctcttccggggccggtgggaagctgcagtccagaaagggccgcagcaagaggggcaagtgaccatcagagacttgtccctgagacttcctgggcaccacagggtctgctgggacctttgctgagcggaagtgtgggccctaataagtacgtctga

SEQ ID NO: 4524 - DNA, 553 bp, Mus musculus
  misc_feature (292)..(293): n is a, c, g, or t
  misc_feature (351)..(351): n is a, c, g, or t
  misc_feature (353)..(353): n is a, c, g, or t
  misc_feature (368)..(368): n is a, c, g, or t
  misc_feature (388)..(388): n is a, c, g, or t
  misc_feature (397)..(397): n is a, c, g, or t
  misc_feature (431)..(431): n is a, c, g, or t
  misc_feature (433)..(433): n is a, c, g, or t
  misc_feature (443)..(443): n is a, c, g, or t
  misc_feature (464)..(464): n is a, c, g, or t
tatagacgctttcagatctacccgacaacagccttctagaaatgtagcccctaagaattactcagagaccattgaggtggatgactctgacgaagatgacatttttcctaccaattccagggctgatcaaaggtggtcgggcacaacatctagcaaacggatgtcccagagccagacagccaaaggggtagactttgaatcagatgaggatgatgacgatgaccctttcatgagcagtagttgcccaagaagaaaccgaagataatgtttttaatggaacttagaaattgcnnatgatgcaggaagaaatcaaagcaccacatactgacttcacagctgaagatgtttaantnctgggcttatatttnatcgttttctgaacggtgantcccttaanccatttcctagcccaatgataaggagattgcagntnttcttagccntttaacctggttgttattgtnctggggctgctctgccatatcgagaacattaacttcctgacagaactgtgttttctgcttgtaagaacttggctaaaatcccattctta

SEQ ID NO: 4525 - DNA, 406 bp, Mus musculus
aagtcggagaaacccagcacggcgttcttcttaccgagtacagtcagaaccccaggaagagagttggtatgactgtcacagggaaacaactgcaagtttttctgatacttaccaggattatgaggagtactggagagcgtattacagggcatggcaagagtattatgctgctgcttcccattcatactattggaatgctcagagacatccaagctggatggctgcctatcatatgaatacagtttatctacaagagatgatgcgtggtaaccaatgaggttagcatgtgcttcagactagtgactgtcaacggataattggatatgcattcttcacctagaacaagtggggtttggtggcattttggaggaacttgagaggacttgaggctttctactgggacaca

SEQ ID NO: 4526 - DNA, 446 bp, Mus musculus
  misc_feature (144)..(144): n is a, c, g, or t
  misc_feature (150)..(150): n is a, c, g, or t
  misc_feature (154)..(155): n is a, c, g, or t
  misc_feature (334)..(334): n is a, c, g, or t
gacatcagatggctggcttacagtcacagtacttgctggtccagaggtagaccttggccacacctggcacttctcagaggcacaggtgattttgtgtgtgtgtgtgtgtgtgtgtgtgtgtgtgtgtgtgtgtgtgtgtgtgtntgtgtntgtnngtaatggactctgaactctagaaggatacaatccttttggattttgcacagtcctagatctaatcccttttgataaaagggtctttgcttctgatgaaaggagcactgtggaacgtatgtaaatatgtttttataattccattggaagctggtgtgcactcagacgaaagcagtccctntcaactactgtccagggctgtgatgggatcagacctgggcgtgaaagtatctgttctttggagctagcctggtgttctgaccattcaactcattgtaagttgccactaccaa

SEQ ID NO: 4527 - DNA, 427 bp, Mus musculus
  misc_feature (213)..(213): n is a, c, g, or t
  misc_feature (256)..(256): n is a, c, g, or t
  misc_feature (284)..(284): n is a, c, g, or t
  misc_feature (309)..(309): n is a, c, g, or t
  misc_feature (311)..(311): n is a, c, g, or t
  misc_feature (313)..(313): n is a, c, g, or t
  misc_feature (326)..(326): n is a, c, g, or t
  misc_feature (339)..(339): n is a, c, g, or t
  misc_feature (360)..(360): n is a, c, g, or t
  misc_feature (400)..(400): n is a, c, g, or t
agacctcgaacaacattccagcagacatcgtctttgttttaaaggacaagccacacaatatcttcaagagagatggttctgatgtcatctatccagccaggattagccttcgggaggctctctgtggttgcactgtgaatgtccctactctggacggcaggaccatccctgttgtattcaaagatgtcatcaggcctggtatgcggcggaaangtccctggagaaggcctccctctccccaaaacacctgagaaancgtggagaccttgttatcgagtttgaangtgatcttcccggaaaggattcccntntnatccagaaccatnctggagcaggttnttcccatatagccacctgcantcctcaaggactgagccaggggctttcagagctgcagatntccagaccgttccactggttgcatact

SEQ ID NO: 4528 - DNA, 430 bp, Mus musculus
  misc_feature (247)..(247): n is a, c, g, or t
  misc_feature (318)..(318): n is a, c, g, or t
  misc_feature (364)..(364): n is a, c, g, or t
  misc_feature (366)..(366): n is a, c, g, or t
tggagttttggagccatgggacaaaggcatcatgttcacttggtatgcacacagcttttgggaatccttaccatcacacaaaacttacatcagtgctggaaatgtaacagaaaatctggggatgcctgactttggttatttccctggtattttattaagcttgagtatggttaatatttatgctggcgttgcattaatctcaaaagattagcacctatattccatggattctctcggctttagtccnaaatatttttaactgggcatggcagtacacacctttaatcccagcactgaggaggcagaggcggcctggtntacagagcaagttccagaaaaaccacagctacacagagaaaccctntntcaaaaggaaagacaaaaagaatccctgggaaacattttcagctttttcagtttgttattctca

SEQ ID NO: 4529 - DNA, 228 bp, Mus musculus
  misc_feature (67)..(67): n is a, c, g, or t
  misc_feature (110)..(110): n is a, c, g, or t
  misc_feature (122)..(122): n is a, c, g, or t
  misc_feature (186)..(186): n is a, c, g, or t
gagccccgaggaggtccagaagaattatgaacacctatttaaagtgaatgataagtccgtgggtggntctttctacctgcagtcaaaggttgtccgtgcaaaggaacgtntagatgaggaantccgaatacaagcccaggaagacagagagaaagggcagaagcccaaaacgtgactgctgggctntccacaccccagccattgcctcataatttatagcctagtaat

SEQ ID NO: 4530 - DNA, 416 bp, Mus musculus
  misc_feature (317)..(317): n is a, c, g, or t
atgggccagggctttgaccgacacttgtttgctctacggtatctggcagcagccagaggggtcaccctgcctgagctctatcaggaccctgcataccagcggataaaccacaacatcctgtccaccagcactctgagcagcccagcagtgagcctcggtggctttgcccctgtggtccctgatggctttggcattgcgtatgctgttcacgatgactggataggctgcaatgtctcctcctactcaggacgcaatgcccgagagtttctccactgtgtccagaagtgcttggaagacatgttcgatgccctcgaagncaaagccatcaaaacttagcttcttggtcgatgaaaagcctccattcttcctcatgaacattggtgttcatgtagctggaaggtaccatcttgtcaaca

SEQ ID NO: 4531 - DNA, 487 bp, Mus musculus
aagagaactatagccatctaccgaaagcagatatttttgctcttgctctcacagtcgtatgtgctgctggtgctgaaccccttcccagaaatggagagcagtggcacgagatccggcagggtcggttacctcggatcccacaagtgctttcccaggaggtgacagagttgctgagagtcatgattcatcctgacccagagagaaggccttcagcaatggagctggtgaagcattcagtgttgttgtctgcatctagaaagagcgcagagcagttacgaatagaattgaatgctgaaaaattcaaaaattctcttttgcagaaagaactcaagaaagcccaaatggcagccaaagttgcagctgaggaacgggcactcttcacagatcggatggccactagatccaccacccagagtaatagaacttctcgacttattggaaagaaaatgaaccgctctgtcagccttactatatactgaactgctca

SEQ ID NO: 4532 - DNA, 285 bp, Mus musculus
tcattcagcacggagcagcatgggaagataagaagactgagtcaggactggctgactgcagcctgcaactggcaaacatctgttgcctgggcagacagccctccatgctgtgacagctgcatgcggctccaccgtttcccccaaactctgcccatacacatcagcaggaactgtggctgacatgagacactgctggcctacacggactagagaccagcagccccccgagccccatggcattacccattgatttactgatgagcaccttcaaatgtgggagtccca

SEQ ID NO: 4533 - DNA, 445 bp, Mus musculus
  misc_feature (175)..(175): n is a, c, g, or t
  misc_feature (296)..(296): n is a, c, g, or t
  misc_feature (304)..(304): n is a, c, g, or t
  misc_feature (313)..(313): n is a, c, g, or t
  misc_feature (321)..(321): n is a, c, g, or t
  misc_feature (324)..(324): n is a, c, g, or t
  misc_feature (328)..(328): n is a, c, g, or t
  misc_feature (331)..(331): n is a, c, g, or t
  misc_feature (333)..(336): n is a, c, g, or t
  misc_feature (347)..(349): n is a, c, g, or t
  misc_feature (363)..(363): n is a, c, g, or t
  misc_feature (380)..(380): n is a, c, g, or t
  misc_feature (396)..(396): n is a, c, g, or t
  misc_feature (398)..(398): n is a, c, g, or t
ctgtggccctgagagcattaaaatcaatgctcaaattgtggcccaagcaaagctgatagtttggaatggacctattggggtatttgaatgggatgcctttgctaaaggaaccaaagctctcatggatgaagttgtaaaggccacctccaatggctgtgtcaccattataggaggnggagatactgctacttgctgcgccaaatggggcactgaagacaaggtcagccatgtgagcacaggaggtggggcaagtcttgagcttctggaaggtaaaatccttccaggggtagaggccntcagcaanatgtaattntcataatntanttgnttncnnnnttcctgcgcannnggaccagaaccaantcaacctaacctatatntcaacatttgttaacntntactatgaatcaagacccaggtaatgagctagcagtgagccatcaat

SEQ ID NO: 4534 - DNA, 294 bp, Mus musculus
  misc_feature (122)..(122): n is a, c, g, or t
  misc_feature (138)..(138): n is a, c, g, or t
  misc_feature (141)..(141): n is a, c, g, or t
  misc_feature (254)..(255): n is a, c, g, or t
  misc_feature (267)..(268): n is a, c, g, or t
ggaaacaatttcacgttcttcttagtaccatccatgaacttcaacagacattggagaatgatgacaagctgtcagaggtggatgaagctcaagaaagcaccatggaagcagaccctaagccnatagatggactgaccntcnccatttacagggacagcgaatagctgcatgggcttcctgggttcagtgtgttgtacttttgggatatttcaacttcagcattgaagtactttgctttcaagtattcatgtgtnncgttcatatttnncttcacagaacggaaatgtatcccat

SEQ ID NO: 4535 - DNA, 537 bp, Mus musculus
gggtgtgacaacatgacgtgcatcatcatttgcttcaagccccgaaacacagtagagcttcaggcagagagtggcaagaggaaactggaggaggcactgtccacggagggggctgaagacaccggcaacagtgacaaaaagaaggccaagagggactagtggtcaaccggaccctgcccatgtggactgttttctgagcccttggacccgagactgagttttgtccttgtcctttagccttagcagtgggtatgaggtgtgcagggggctgggtggctttcctcagcccattacaaagagggccccccaccccccccacgcggcagcctgggaggctctgctgtcctcttaagcctccttactctccttgggctcatcgactatcggttctgtgcctgtgctctgttgtgttggagggaaggactggtagttctgatttttactctgtgaacactttatttaaggacattcttttttattggcggctctgtgacccctagccgcttgcacccgctctctgttgtacactttcaagca

SEQ ID NO: 4536 - DNA, 130 bp, Mus musculus
ggaaccaacaggatgaagcaattacctggtttaatgtcatctatccccggacacagcttccaacctggccacctgaattcaaacccctggagatattacagaaaccaggagaaactgtctttgtaccagg

SEQ ID NO: 4537 - DNA, 428 bp, Mus musculus
  misc_feature (305)..(305): n is a, c, g, or t
  misc_feature (341)..(341): n is a, c, g, or t
  misc_feature (403)..(403): n is a, c, g, or t
ggtttgaactgctgagccgagagttgcgggccatgctggccattgaagagtggcagaaaacagttgcgcagcagcaccgcgagcaactcctgttggaggagctggtgtctctggtgaaccagagggatgaactggtccgggacctggaccagaaggaacggatcgctctggaggaagatgagcgcctagaacgaggcctggagcagagacgtcgcaaggtgagccggcagctgagcaggcgggaacgctgtaccctgagctgagtctcctgtctggtttgtccctttctctggtcgtggaccgtnttcgccactcccccagcctgcacagcagaggccagntccccatgctccttcagcgagcagaagcaagactgaccagactctcgggctggagcagtgancctgctagtgtttatttatccgagt

SEQ ID NO: 4538 - DNA, 433 bp, Mus musculus
tgatattcaccgcactctggtatatggagggatctttttataccccgccaacaagaaaagcccaagtggaaagctgcggctgctgtatgagtgcaaccccatagcttatgtcatggagaaggccggtgggctcgccaccacgggggacaaagatatattagacatcgttcccaccgagatccaccagaaggcaccagtcgtcatggggtcctctgaagatgtgcaggagttcctggagatctacaggaagcacaaagccaagtgaaggccagccttgcccctgccccagagcagagctcaagtgacgctactccattctgcatgttgtacattcctagaaacaaacctaacagcgtggatagtttcacagcttaatgctttgcaatgcccaaggtcacttcatcctcatgctataatgccactgtatcaggta

SEQ ID NO: 4539 - DNA, 404 bp, Mus musculus
atccaagatcggatccaggccctggggcttcatctgccagaccctccattggagagtgaggatgaagatgaggagggagccgccgcattgagcagccacagctctatccccatggacccagaacatgtagagctggtgaaaaggacgatggctggagtaagcctgcctgcaccaggggttcctgcctgggctcgggagatctcggacgctcagtgggaagatgtggtacagaaagccctccaagcccggcaggcatcccctgcctggaagtgaccagagagcgagctgccttacctccctacattccaagtcaggaccagcacaggactaacaactctggtcttaacagcctcctccttcccatgtccctttccacaccaaggcgactcagacctctcagagac

SEQ ID NO: 4540 - DNA, 398 bp, Mus musculus
  misc_feature (344)..(344): n is a, c, g, or t
agctgctcttgaactagctctgagcatcactcgagctgtgcgctccctgcgtgctgactacaacctgacccgcaccaggcccgactgtttcttggaagtagccgatgaggccacaggtgccttggcctcggcagtgtcgggctacgtgcaggctctggccagtgcgggcgtggtggctgtcctcgccctgggtgctcctgcaccgcagggctgcgctgtagctgtggcttctgaccgctgctccatccacctgcagctgcaggggctagtggacccagcccgggagttgggcaagctgcaggccaagcgaagtgaggcacagcggcaggctcagcggctgcagngagcgccgtgctgcctccagctactcagcaaaggtgccccttgaggtccaggag

SEQ ID NO: 4541 - DNA, 509 bp, Mus musculus
  misc_feature (201)..(201): n is a, c, g, or t
  misc_feature (204)..(204): n is a, c, g, or t
  misc_feature (277)..(277): n is a, c, g, or t
  misc_feature (279)..(279): n is a, c, g, or t
  misc_feature (281)..(281): n is a, c, g, or t
  misc_feature (350)..(350): n is a, c, g, or t
  misc_feature (358)..(358): n is a, c, g, or t
  misc_feature (364)..(364): n is a, c, g, or t
  misc_feature (385)..(385): n is a, c, g, or t
  misc_feature (422)..(422): n is a, c, g, or t
  misc_feature (468)..(468): n is a, c, g, or t
  misc_feature (476)..(476): n is a, c, g, or t
agagaacttggccagtcttactcccaaaggcttgagcccagccatgtccccagccctacagcgcctcgtaagcaggacagccagcaagtacacagatcgtgccctgcgggccagctatacaccatccccagcacgatcttcccacctcaagaccccagctggtgggccgcagacacccacaagcactccagcccctgggtntgntacacgcacacccctcacacaggacccagcctccatcacagacaacctgctgcagctccctgcccgacgcaanancnttcagacttcttttagagccaggcctgactggacctgtggatgttttgtggaacactttgtggagcatntagggcangctttntaccactcagaggattccagnccttggagacacagaccacagttgattattccagganccacaaatatctagtgttgttcccgtggccaggttggcacattacncggaccantcccttggaagtacagcgttggtgctgttccca

SEQ ID NO: 4542 - DNA, 535 bp, Mus musculus
tctgctgtcgcctctcagtgggagcgcaccggaaagcccttcaacccgcttctgggagagacttatgaattagttcgagatgaccttgggtttaggctcatctcagaacaggtcagccatcatcccccaatcagtgcattccatgcagaagggctcaacaatgacttcatcttccatggctcaatttaccccaaactgaagttctggggcaagagtgtagaagcagagcctaaaggaaccatcaccttggagcttttagaccacaacgaagcatacacatggacaaaccccacctgttgtgtgcataacatcatcgtgggcaagctctggattgaacagtatggcaacgtggaaatcataaaccacaagactggggacaaatgtgtgctgaattttaagccatgtggtctttttggcaaggaattacacaaagttgaaggctacatacaagataaaagcaaaaagaagctctgtgctctctatgggaagtggactgagtgcttgtacagcgtagaccctgccacttttgatgctt

SEQ ID NO: 4543 - DNA, 454 bp, Mus musculus
atcctgccgtgtgctatcggataaagtctctaagagctacattacagatattttcaacaggaagcatcacagtgacagggcccaatgtaaaggctgtggcgactgccgtggaacagatctacccgttcgtgtttgaaagcaggaaggagattttataactcaaacttggttggttagtctccacctgagcaccgtttgagacctgctgcacattggactcaaaacacaaggaaaactggaccaacagtgaccgaggacagactcggactcacagctgcagtgtaagctccagtccctttggattttacttcaaagtttgctgtaatataaaaaggaagtttacaagacatgacattgctgcttttacaaaaggacgttctatttattttcgcagtaatctccatgtcccacaggcagagctgtcgcagtgtgcacttcccgacagttgttttat

SEQ ID NO: 4544 - DNA, 494 bp, Mus musculus
  misc_feature (333)..(333): n is a, c, g, or t
  misc_feature (351)..(351): n is a, c, g, or t
  misc_feature (398)..(398): n is a, c, g, or t
  misc_feature (445)..(445): n is a, c, g, or t
  misc_feature (447)..(447): n is a, c, g, or t
atacatccatctttcttcacacttcatcggaacactcagaagaggaccagattgtgattgatgaaggccacaaagttgggagttcctttcaaggtgatatgacccgggctggaaaggtgaaggtagacaacttcctagacttagaagatgtggacatggaggaagagagtaagccccagatgaacaaggattgcctgctacttccaggtgaggtggaacaggatataagcaccagcgttccatcttatgatccttctgtggacctaccgctcacctctgaggtgaggccaaagcctgctgtgggaaggactcagaaacaaaccgaagagatancttggagatgaagttcancccttctttctcgatgaagaatttgattatgacaatgtgactctcantcctaagtttactgctggagagatagcaaccatccaagagctatctnangcaaaagagagtgggttccggtacaaacgtgtgcgaactccatgact

SEQ ID NO: 4545 - DNA, 379 bp, Mus musculus
gtaacgccatcctgagatacatcgcacgcaagcacaacatgtgtggtgacactgaagaagaaaagatacgagtagacatcatggagaaccagatcatggacttccgcatgcagctggttcgcctctgctacaattctaaccacgaaaacctgaagcctcagtacttggaacagctacctgcacagctgaaacaattctcattgttcctggggaaattcacatggtttgcaggagaaaagctgacctttgtggattttctcacctatgatgtcttggatcagaaccgtatatttgagcccaagtgtctggatgagttcccaaacctgaaggctttcatgtgccgttttgaggctttggagaagattgctgcattcctgca

SEQ ID NO: 4546 - DNA, 488 bp, Mus musculus
  misc_feature (375)..(375): n is a, c, g, or t
  misc_feature (384)..(384): n is a, c, g, or t
  misc_feature (406)..(406): n is a, c, g, or t
  misc_feature (424)..(424): n is a, c, g, or t
gtcctaacgggcaatgtcatcatagagacaaagttctttgacgatgatcttcttgtcagcacatccaaagtgaggcttttctatgtttgagagaatttgtgtgcacttctaagaatttggccgggggcaggaggaagctgaacttgttctctgcacacctgactgggatactccagctgactcactccttcaacacagaacccacctgtgcaccaggaaaccagctctgaatagacggccagtggcttttctcccaaaacctccatcttcactgacaagactaaactcccaaccccagccaaaggcagggataagcctcgactccttcctggcgcaaacatgggaacaaaccctcccaggagccacgctgcgccntgtcacctncctgcctcctccttgggccccnacaggctttctttagccntctggttttgaaaaaattttacctttctgacccatttaggtttttcctaccacttgtatttcat

SEQ ID NO: 4547 - DNA, 505 bp, Mus musculus
  misc_feature (141)..(141): n is a, c, g, or t
  misc_feature (363)..(363): n is a, c, g, or t
cagggatgcctggactcaacgaaatcctcagtgatccagaggttcttgcagccatgcaggatccagaagtcatggtggctttccaggatgtggcccagaacccatcaaatatgtcaaaatatcagagcaacccgaaggttnatgaatctcatcagtaaattgtcagccaagtttggaggccaatcgtaatgtcaaagcccttgctgaatgaagaacagcttagctcacttcctggatgttgcaataatacaaaccagtgtacctctgacctcaccgggagagctggggcgcttcgaagataatccctaccctctacatcaaatgcggctgaggcattttacagtggtttgccattagcgtgtntcattcagataatgttttcttactaggaattacaaacttaaaacatttttcaacctttaacatattttgtaaaaacttaggggagtcaattcctccatttttctttactaacttgggcttttccttttgaattactgggcag

SEQ ID NO: 4548 - DNA, 563 bp, Mus musculus
  misc_feature (126)..(126): n is a, c, g, or t
  misc_feature (418)..(418): n is a, c, g, or t
  misc_feature (504)..(504): n is a, c, g, or t
ggctagttcatgtgctttaaaccaatgaaaggttatcagaggtttagttaacggcagacccggtggccactctgtgagaagacatctctttctgctcactgcttgcaataaaaactattcttggcnatctcagttaatcttcattctgtcagtttactgggttcttatgtacctgtcaaaggcaagcaggtcaaagaaaatctcctaaaaatgttctgagggctgaagaaaccataatgacttggagactggcggcggtggggacatggagacatccttataagacagcatatttcagacctgcttacgatgtggcagcaagaaactcaaatgtgcatttgtaactgaattgaacacttgtcatgctgtagatgccagcccatcaatagtagagcttatgagactcatttaaactgtnctttggtttaacacgggtttgtgtcattaaaggtttcttacgttactgttgagtcagatatctaaggtttagattcaggtggcctntcctattttgttttgagggagtcattaaccttactgtcactaaataaacccctgctggt

SEQ ID NO: 4549 - DNA, 429 bp, Mus musculus
  misc_feature (383)..(383): n is a, c, g, or t
aacacgctgttacacgagttcctgctgtgggagccagaacccgaggctgagccaaagctcgagccaaagcccaagccacagctgctgcagccagagccggctccaggggaggagaagtgaccagcggcgcagggactcctggatcttgagtagtagaggctcttagactgggcgtgggctggctgggcggggcctcatgccgatgggcggggcctgggcatgccccagagcgaaccaggcacagtcagtgttggagactcagtgcccagggcagctatggtgccctttccacgcgcgaccgaagggtgtgaccttgtacagagccccctccctgcctccccgagtccctgaagctgcagcgcgcgggctgccatcccactcgntcttcccctccgctgtgctccattccgcactgggaagccctaagga

SEQ ID NO: 4550 - DNA, 411 bp, Mus musculus
  misc_feature (347)..(347): n is a, c, g, or t
  misc_feature (386)..(386): n is a, c, g, or t
aaggtaatcacaaagctagctggcatggaggaagaggagctggcgttctccaccaaagaggagcagcagcagctcctgcagaaggtgctggcagccaccgacttggatgcagaggaggaagtggtggctggagagtttggctctagatctggccaggcatcccgacgctgtggcaccatgagctccctgtcaggcgcagacgacaccgtgtacatggagtaccactcctcccgaagcaaggcctccagcaagcacgtgcacccgcttttcaaacgcttcaggaagtgacgcccaccctgtgctcaggtgaagactggctgcctggatccgtgttgaagagagacttnctttcttcaccggtgtgatcgtttctatccaagactgtntcctttcctattgactgactgctga

SEQ ID NO: 4551 - DNA, 474 bp, Mus musculus
acagacattgcacggatggtcaaaaatgcaccatttctgttgagcttctccgtggaaagactagataacagactgggattttttcagaaagaacttgaactgaatgtgaagaagactagagatctggttgttcgccttccaaggctactaacaggaagtctggagcctgtgaaggaaaacatgaaggtttatcatcttgaacttggttttaaacataatgaaattcaacatatggtcatcaagattcctaagatgctaactgcaaacaaaagaaaacttacagagatttttgattatgtacacaatgtgatgaatattccccaccacatcatcgtcaagtttccacagttatttaacacaagagtgtttaaaattaaagaaagacacttgtttcttgcctacctgggaagagcacagtatgacccagcaaaacctaactatgtttctttggacaagttcgtatcttttcctgat

SEQ ID NO: 4552 - DNA, 557 bp, Mus musculus
  misc_feature (311)..(311): n is a, c, g, or t
  misc_feature (327)..(327): n is a, c, g, or t
  misc_feature (339)..(339): n is a, c, g, or t
  misc_feature (344)..(344): n is a, c, g, or t
  misc_feature (403)..(403): n is a, c, g, or t
aatgaagggaacctgcccttgcacttggctgccaaagaaggccacctccctgtggtggagttccttatgaagcacacagcctgcaatgtggggcatcggaaccataagggggacaccgccttcgacttggccaggttctatggaagaaatgaggtcattagcctgatggaggcaaatggggttgggggagccacaagcctgcagtgaatgtgtagaggtctctctcactgacctcacactgtccgttagttggttggctgtccgtttcactatcacttattaaaatatagggttttcctttcgctttgttnttcatattttaagcanccaaatccttcnaaacngcctaagtggaaatcttactacaagtttatgaaatatttaaacttctttttcactgtcnaaattctgatttctaacatgtaatagctattcctttttttctggatattttatctttgattttttttttctttgcttaccctttttcattctcagtgtctgacttggagactttgttttaaaaattatttgtcctgatgcatcttttgcctaat

SEQ ID NO: 4553 - DNA, 480 bp, Mus musculus
  misc_feature (321)..(321): n is a, c, g, or t
  misc_feature (380)..(380): n is a, c, g, or t
  misc_feature (394)..(394): n is a, c, g, or t
  misc_feature (396)..(396): n is a, c, g, or t
  misc_feature (440)..(440): n is a, c, g, or t
aaacgctctgaaggagtacaactccacaggagactatagaagtgaagctgtagacaagatccaaagtacgttgcattgttgcggtgtcaccaattacggagattggaaaggtacgaactattactcagaaacaggatttcccaagagctgctgtaaactggagggctgttatccacagagagatgcagataaagtcaacgaagagggttgtttcataaaggtaatgacaactatagagtcagaaatgggagtcgttgctggaatttcttttggagttgcttgctttcagctaattggaatctttcttgcctactgcctgtntcgtgccataacgaataaccagtatgagatagtataatcactacacacgggctcatatntcctcagttttaangnttacctttgtgagttataacagcgcctggatggagactgacatntgcttagcctgaaaagctacaccagtaggctgattcaatc

SEQ ID NO: 4554 - DNA, 334 bp, Mus musculus
  misc_feature (295)..(295): n is a, c, g, or t
gaaggcagcgaggatgaacactctggaagtgagagtgaccgagaagagggtgacagagatgaggcaagtgacaagagtggcagcggtgaggatgaaagcagtgaggatgaagcacgtgctgcccgggacaaagaggagatttttggtagtgatgctgattcagaagatgatgctgactctgatgatgaggacagagggcaggcccacaggggcagtgacaatgactcggacagcggcagtgatggtggtggccagaggagccgcagccagagcaggagtcgtagccggagtgccnagccccttccccagtggcagtgagcactcagctcaggaa

SEQ ID NO: 4555 - DNA, 393 bp, Mus musculus
  misc_feature (329)..(329): n is a, c, g, or t
  misc_feature (350)..(350): n is a, c, g, or t
  misc_feature (368)..(368): n is a, c, g, or t
aatcctccctcagacagggacaaagagagtaatatttaacaagtctcatcgccgaatcagtgttcatgaatttaatcatgagtttctttgtgtgtgtgtgtgtgtttttttccaaagaattgcaaaggattttagctgcaacaaaaacatcgcaaacagtaacaaaactggcatcttcctcaatgccatagtataaattcatgctttaacatttgttgggatggtcaactcttgagatggtgcacgtagaaaacccacgcacttgctcatctgcgcacctgagttgtgatgaaaacaactaattttttaaatcttccaccgatttttanttttagctgcagaattagatntgcattccagaccttggntcacctaagcacaattcaacattaa

SEQ ID NO: 4556 - DNA, 382 bp, Mus musculus
  misc_feature (263)..(263): n is a, c, g, or t
  misc_feature (265)..(265): n is a, c, g, or t
acggttggccttcgtaaggctcactcttccacctcccaaagtggttgatcgctggaacgagaagagggctctgtttggcgtctacgacaacattggaatcctggggaatttcgagaagcacccaaaagaactgatcaagggcccagtatggcttcgaggctggagaggaaatgaattgcagcgttgtgtccgaaagaagaaatttgtgggaaacaggatgttcattgaggacctgcataaccttaacaaacggatcagctatntntacaaacactttaaccgacatgggaagtacagataggacgggaaatgtgtcaccctggagaaggggaacaggacttatcccagcaaggagagagctttgtgtgctcgatgtaataaa

SEQ ID NO: 4557 - DNA, 395 bp, Mus musculus
  misc_feature (334)..(334): n is a, c, g, or t
  misc_feature (338)..(338): n is a, c, g, or t
  misc_feature (359)..(359): n is a, c, g, or t
ggagcacttgtggatcaataccaatatcccctcaccaaccagggactagtttgatgctatctttgcctgtctcttggctcttaacaatgcctaccctcttgttccccctcgttcatttcccagtccagccattttcccactcctaagttctttactgttaagaatgagagaatcgtcagaagtaatattagtgagtagaaggatagctgtcacccgaccccattcaaatcagagtggacctgtgaaactctcaagtgacatccaaggtcttttgaaatcatgaccaaattcccgtgtctgacaacagttccagagaactgaaagaaatgtattnctcncccatgagacagatttttgtntcttgagtttcttgggacttctcacaaatacctggg

SEQ ID NO: 4558 - DNA, 406 bp, Mus musculus
  misc_feature (282)..(282): n is a, c, g, or t
  misc_feature (309)..(309): n is a, c, g, or t
tgtgtgtgacctgatgtgtccccaccatctctgtaggagccccgtctagacacctctacagtactgttcttgggccaaagtcctgaggaagagaatccagacagctgagaattttgactatcaaaaaaggattgcgtttgatttaccattgtggtagatgagttgtctctgatggttgcaattcccattcgccaaatgaaagacatcgaccagcacacaagataccatggacctgtgtttagaccaagaaagccacaaaaggagtgaaaagaggcaggaagngggcactggaacacgcaagagggttgnactactcggcctttcttccattccaagtttagtgggacacagagccttccttgttaagagaattgtttggaatccctccttgggttatctgttagat

SEQ ID NO: 4559 - DNA, 515 bp, Mus musculus
  misc_feature (65)..(65): n is a, c, g, or t
  misc_feature (230)..(230): n is a, c, g, or t
  misc_feature (242)..(242): n is a, c, g, or t
  misc_feature (257)..(257): n is a, c, g, or t
  misc_feature (269)..(269): n is a, c, g, or t
  misc_feature (272)..(272): n is a, c, g, or t
  misc_feature (275)..(275): n is a, c, g, or t
  misc_feature (293)..(293): n is a, c, g, or t
  misc_feature (298)..(298): n is a, c, g, or t
  misc_feature (349)..(349): n is a, c, g, or t
  misc_feature (371)..(371): n is a, c, g, or t
  misc_feature (373)..(373): n is a, c, g, or t
  misc_feature (390)..(390): n is a, c, g, or t
  misc_feature (393)..(393): n is a, c, g, or t
  misc_feature (398)..(398): n is a, c, g, or t
  misc_feature (432)..(432): n is a, c, g, or t
  misc_feature (479)..(479): n is a, c, g, or t
gggtcccaagccagagtgagagtcaaactgagtccgacatcagtacccaaagcctgcggaagccnaccatgtcgtatgtgattctgaagactttggctgacaagcgggtacataattgtgtgtcccttgctaccttgaagaaagctgtgtctatcacagggtacaatatgacccataacacctggcgcttcaagcgtgtgctccagaatctactcgataaaggcatgatnatgcatgtgacntgctgcaagggtgcntccggctccctnctnccntgtgcaaggagcgggccntcaantccaaccacagggccaagagatgccaggacagacagaagagccagaagccntcagaagcctgggcagcgtgantntgaaccatgccaattgntantaagntccaaaaagaagaatgaccagcttttcaaaggantccgtagggtggccaaaggcaaccgccattgccattattaaggcagntcaggcggggtgccaggcttgccaccaagtgggaat

SEQ ID NO: 4560 - DNA, 434 bp, Mus musculus
  misc_feature (395)..(395): n is a, c, g, or t
gcagctgttgcatttgcaggtcgctatgcatttcagatctggaaacctctagaacaagtaatcacggcaacagcaaggaagatttcctctccaagcttttcatcctactataaaggaggattcgagcagaaaatgagtaagcgagaggctagtcttattttaggtgtaagcccatctgctggcaaggccaagattagaacagcacacaagagaattatgattttaaaccatccagacaaaggtggatctccttacttagcatccaaaataaatgaagcaaaagatttgctcgaagcatccagcaaagctaactgatgctaaaggactgtacataccgagggaaaatggaacaaacgcacagctgtaaaagtccttcagaagaatgtggcacgtgntcgtgttccatactgacccagtctgttttctgtcattaa

SEQ ID NO: 4561 - DNA, 407 bp, Mus musculus
  misc_feature (358)..(358): n is a, c, g, or t
  misc_feature (375)..(375): n is a, c, g, or t
  misc_feature (382)..(382): n is a, c, g, or t
ttgaggacgtcccaattgcacacattaaagcaacctacaacaacacacagatccaggtagtctctgccaccaatgcgtccctggcccgcgcctcctgtggcacagaaggctttcgcaatgccaagaagggcaccggcatcgccgcacagacagcaggcatagctgccgcagcaaaagccacaggaaagggagtgacccacatcagagtcgtagtgaaaggcatggggccaggacgctggtctgccatcaaaggactgaccatggggggtctggaagtgatctcaatcacagacaacaccccggtcccacacaatggctgccgaccccggaaggctcgaaggctgtgacgggaagggancctgcacttggacctgncctcagntcttgactcctgtggatcctacaga

SEQ ID NO: 4562 - DNA, 389 bp, Mus musculus
  misc_feature (280)..(280): n is a, c, g, or t
  misc_feature (286)..(286): n is a, c, g, or t
  misc_feature (305)..(305): n is a, c, g, or t
  misc_feature (326)..(326): n is a, c, g, or t
ctggtctgagaaagaaagtacactaaagcgagcagagaagagagacaaagagctcctaaaggctgagttcctcctggtctaccatgactgcgtgctccctcttctgcactcgacactgctgcccccctttaggtgggccgaggaagagacagaggctgcaagatggaaagccattgctgacttcctcaagcagagccgggagaacgagggttccctgaaggctctgctgtcaccagatggagttcacaaaccatttgacctttcggagcagacctttganttcttngggtgaaataagaaagaantcaggctaatggcgaccatgntccgattcccactggacccagggagcttccaggaagacttgcctcaaacaactgagccaaaga

SEQ ID NO: 4563 - DNA, 440 bp, Mus musculus
  misc_feature (359)..(359): n is a, c, g, or t
  misc_feature (365)..(365): n is a, c, g, or t
  misc_feature (384)..(384): n is a, c, g, or t
  misc_feature (405)..(405): n is a, c, g, or t
atttaatcagtcatcccgtgctggccaccttccctctgctcctggagcagcccgacgtgatggatgctctcaggagttcctggtctgagaaagaaagtacactaaagcgagcagagaagagagacaaagagctcctaaaggctgagttcctcctggtctaccatgactgcgtgctccctcttctgcactcgacactgctgcccccctttaggtgggccgaggaagagacagaggctgcaagatggaaagccattgctgacttcctcaagcagagccgggagaacgagggttccctgaaggctctgctgtcaccagatggagttcacaaaccatttgacctttcggagcagacctttganttcttngggtgaaataagaaagaantcaggctaatggcgaccatgntccgattcccactggacccagggagcttccaggaa

SEQ ID NO: 4564 - DNA, 187 bp, Mus musculus
  misc_feature (39)..(40): n is a, c, g, or t
tggctactgatgcagcacaagagacgtgttttttttttnnaaatgaggaaagacgctgtttaggtttggtttggtttcattttaattactctagggaaaacactgacgaatggtcagcgctcctgtcctgatcttttcatcaaggcgcctttcctgtactatggttcagctgtgaatgtagctatgg

SEQ ID NO: 4565 - DNA, 571 bp, Mus musculus
acggctgtcgcatccatgtcattgaccacagtggcgtccggctcggagagtatgaggatgtgtccaaagtggagaaatacgagatctcaccagaagcttacgaacggaggcagaacacagttcgatccttcatgaaacgcagcaagctaggcccgtacaatgaagaactccgggcccagcaagaggcagaggctgcccagcgtctcagtgaggagaaggcccaagccagtgccatctctgtggggagccgttgtgaggtgcgggcacccgaccactcccttcgcaggggcactgtcatgtatgtaggactcacagatttcaagccaggctactgggttggtgtccgatatgatgagccgttaggaaaaaacgatggcagtgtgaatgggaaacgctactttgaatgccaggccaagtatggtgcctttgtaaagccatcagctgtcaccgtaggagatttcccagaggaggactacgggttggacgagatgtgactgtacctggaaggaggccccgcccctgacacagcccctctgaatgcctgtggcccttttcctctgagatttgtgca

SEQ ID NO: 4566 - DNA, 438 bp, Mus musculus
  misc_feature (67)..(67): n is a, c, g, or t
  misc_feature (303)..(303): n is a, c, g, or t
  misc_feature (315)..(315): n is a, c, g, or t
  misc_feature (339)..(339): n is a, c, g, or t
  misc_feature (380)..(380): n is a, c, g, or t
  misc_feature (385)..(385): n is a, c, g, or t
gggctaagtccagtgtctatatttaaacttgctcttttcttttaataaaatttaggtaacatctccntgaaaagctggtagcaacaaggctcggctggggatggtgtttgacttgggaggaaaaagttgctactgccattaaaggcactagagttagtgtgctagccctgaataatctcagtttctaaaaacatgcagcttccttcaccccttttttatttttgaaagaatacatttggtcataaagtgaaacccgtattagcgagtacgtggcaatgttcattccggtcagatgcagctttntcctccatctgntctcccgcgtgaatgcttccctcncctcagtagggagaaacagtgggagttctgagatgcctggngtttngccatcggacaaagaatgaggttagaagactgcagtttggagtctctctgggt

SEQ ID NO: 4567 - DNA, 213 bp, Mus musculus
  misc_feature (151)..(151): n is a, c, g, or t
ggatgaagacctgctgttcgaatagctgccctcgtctgctcccttcagactgagcatcagctccatgttaactcagtgtgtaggttcggtatgtgtggatatttattttggcatatgaatttctctggctgtaagatttatcagaatgccnttgtaagactttttcctgcatcataattcagcaacccgagatttgcaaaacctgcccagcaa

SEQ ID NO: 4568 - DNA, 462 bp, Mus musculus
  misc_feature (323)..(323): n is a, c, g, or t
tagcgcacttactcctgttcaaggagcacctccatgtcttctgggatggactcctctggaaacttagccagagcacctctgagctaaaagacagtgaattgtggaataaattctttgtgcggattctgaatgccagtgacaagtccacagtgtctgttctgggggagctggcagcagaaatgggtggggcttttgatgccacattccatagccacctgaacagagccctgtggaagctggggaagacaatcagcccggaagctttgctcactcagcaagacaagcagccaggcggctcccagagccctgcctaagccatgggnatggtgaagaactggtctggggctgctgtgatttgtttagagcacacttagacacatcagcagtccttcactaggggtcactctcagtagcacagctttcagccaggtggctgtgccctggcagcctcatctggtttat

SEQ ID NO: 4569 - DNA, 334 bp, Mus musculus
ggttttgctgcccagactctgaaaagttgggactctgtgaagccctgcttaccacgagcctctttctgttcctaacagtagtttacaaggacacagatggtttgtattgtcatcggatccagttgtcatggacccatgcctggggagatctggacaaaggcttttcaaggctctgagtgatctaagccaaatatttgactctaaacaggtgtccatgggcaaaaacactgacccacttgaaaaaaaccaactgtcctcccaaagcacaaggcatcccagtatcccttgggtgtcacctgtcccttccccatcagcctttctgccatagaggact

SEQ ID NO: 4570 - DNA, 468 bp, Mus musculus
  misc_feature (310)..(310): n is a, c, g, or t
  misc_feature (321)..(321): n is a, c, g, or t
  misc_feature (323)..(323): n is a, c, g, or t
  misc_feature (330)..(330): n is a, c, g, or t
  misc_feature (373)..(373): n is a, c, g, or t
  misc_feature (415)..(415): n is a, c, g, or t
  misc_feature (419)..(419): n is a, c, g, or t
agggtatcatcgacagtgccttcggccaaagtggcaagttcaagatccacatccctggtggcctcagccctgagtccaagaagatcctgacacctacactcaagaagcggagccgagccggccgtggagagaccaccaagccagaggagggcactgaacggccagagcccatccagcctgtgacactcaacctgtctttcaagcgctatgtctttgacacccagaagcgcatggtacagactccctgaatgaaccatcctgcccagctgcaagccagaccacagtgccagatgcccccagacatgcctcnacctccccagntntgaggcnagtcaaccccatcccactgccattgcactgttattgagccccnattgagaaaacctggggaaaatgaggaacagtgccaggaggncctnccactccatccctgaacccactcaggatagcaacgaggcctactagaaa

SEQ ID NO: 4571 - DNA, 195 bp, Mus musculus
aggctatagaaagcgccatcggtggtaatgcctaccagcacagcaaagtcaaccagtggaccactaatgtcctagaacagactttgagccaactcaccaaactggggagaccatttaaatacattgtgacctgtgtgatcatgcagaagaacggtgctgggttacactccgcaagttcctgcttctgggacagct

SEQ ID NO: 4572 - DNA, 476 bp, Mus musculus
  misc_feature (340)..(340): n is a, c, g, or t
  misc_feature (342)..(342): n is a, c, g, or t
  misc_feature (345)..(345): n is a, c, g, or t
  misc_feature (447)..(447): n is a, c, g, or t
  misc_feature (449)..(449): n is a, c, g, or t
ggtctattcaaagctgcatcccgcacattacccacccgcagcagctggggttccagtgcagacatatccagtccagtcgcatggtggaaactacctgggccacggcattcaccaagtatctgttgcccagaactataacctaggacctgatcctatgggctcgctgagatctctgcctccaaatatgaactcggtaacagcacacaccgtccaacctccatacttaagcactggacaggacactgtctccaacccttcttacatgaaccagagctctcgtcttcaggcagctgctggtacagctgcttacacacagcctgtggggatgtctacagatgtntnttntttccagaacacagcatccggtttgcctcagctggctggctttccagtggcagttcctgcacctgtcgctgcacagccacaagcaagctaccaccagcagcntntcctgtagagacgcaccaggacctgct

SEQ ID NO: 4573 - DNA, 378 bp, Mus musculus
gacgtaaactacactcagctagtcgatctgcatgcccgatatgctgagtgtggtttacgaatcctggccttcccctgcaaccagtttgggaggcaggagccaggaagtaatcaagaaatcaaggagtttgcagccggctacaacgtcaagtttgacatgtacagcaagatctgtgtaaatggggacgatgcccacccactgtggaaatggatgaaagtccagcccaagggcaggggcatgctgggaaatgccatcaaatggaactttaccaagtttctcattgataagaacggctgcgaggtgaagcgctatggtcccatggaggagccccaggtgatagagagggacctgccgtgctatctctagctagccctacaa

SEQ ID NO: 4574 - DNA, 353 bp, Mus musculus
tgttgttgctcagtcagttcatccggccttatggaggcatgctgccccggcgggtcacaggcttgtgccgggaagaacaccgaaaaatcgaggagtgcgtgaagatggctcatcgagcaggtctgttaccaaatcacagaccacagcttccagaaggatgcttaccaaaggataaacccaagctcaaccgctatctgactcgctgggctcccaagtccgtcaagcccatctataaaaaaggccaccgttggaacaaggtgggtatggccgtggggtcaccactcctgaaagacaatgtctgctactccagaaggcctctgaagatgatgcattagtgggagcaggacttctga

SEQ ID NO: 4575 - DNA, 534 bp, Mus musculus
  misc_feature (378)..(378): n is a, c, g, or t
  misc_feature (431)..(431): n is a, c, g, or t
  misc_feature (474)..(474): n is a, c, g, or t
ggtctggaatcctttattggttcagagagagagactaacccattgtataaggattatcatggtttgatccatatacggaagattcctcggcttaataacttgacttgtgatgaatcggatgtcaaagacttagcttttaagttaaaaaggaagctgttcaccattgagcgactgcatttgcctccagacttgtcagacacagtgggccgttcaagcaaacaggatctggcagcatccaccgcgcggctgggtgcaggctgtagctccatggccgaaaggcaagaagcacctggacttctagggaccctccgtagtcaccgagtgcgaagttatcttgacactctgattaggactgctagtagttcatgtaaacatttntcttaatgatctgaccctccagactttgagaaatacaaggtcacaaagtgganccaccatccttaagtttgagttgtttcatgatttatttttttntactgacttttgtacaaacataatatggcagaaatactgccatttgacatttagctgctg

SEQ ID NO: 4576 - DNA, 274 bp, Mus musculus
acttcaggacctgttttctaagcagttacagccaaagagctatgcaaaactgtctggcttgggtcagccaaaggtccaggctacaccactgcatggaaaccaggaagcaaggagtgcactcactgcaaagttcttcccaggagcagttacggctggaggctaaaagggagagcttttccaacagagaggtggggactaagtgggcagcatatgcctggccatctgttactctctcgcccgcacactacaacacacatgcccatgacagcaggga

SEQ ID NO: 4577 - DNA, 338 bp, Mus musculus
  misc_feature (45)..(45): n is a, c, g, or t
ttgtgaagcccatcgtgggtctcgcggcgttcgacatttagccgnacctccctccctgaactcagcatggaggaaaagtcagaagactgtaaggtcccagaagatctgttcaatggtctgaaagtcgcagatcctcaagaaggagagtctgccagccccatggtttctgatcccaagggtcagcactgccagagcaagctgccgaaggctgctgaagcccatccacaggacgaccatgttgaagaggaatgttttcatgactgtagtgcctcgtttgaggaggaacagccaggggcgcacgtggcagggagcaaagccagcgatgattctagttctga

SEQ ID NO: 4578 - DNA, 358 bp, Mus musculus
  misc_feature (126)..(126): n is a, c, g, or t
  misc_feature (131)..(131): n is a, c, g, or t
  misc_feature (179)..(180): n is a, c, g, or t
tacagctacagctgcgcggccacgatgcagcccgccgcctgcgcgccctcgcggatcagccgcccggtgccctgcgtcgccgcgtcgtgaggttcaaggacactttcaccgaggaactccgccgtnggcgntccgggaccgtccagggcagcagaagggtccgggcgccaaagcgtaanncacgggactggaccctcccgggccgaggtcacgtacccgtcccttcagtgatctacaccgacctcagcagtcacgagtcatctccaggacgctacgctgcttcgaatcctaactcggattgtcctacagatgcctaaagtcaaatggacatgtgcccggtagtcctgcagacgtaaag

SEQ ID NO: 4579 - DNA, 375 bp, Mus musculus
aaaagcattctctagcaaggccccaacgtccacaccaagtgccttccaggccctgtccttagcacctgccggagtccatgtgcagggctgagtccagaggctgaacaagactacggcccaggttcccaatgtatcatccactccatgaaccatggagaagagagccagtccagcccatcccttctcacagcaggagccgggaagagttcctttcctcagcctggccaatctcttgtcatctccacagccaggccaaaatctgtcttcattggtaaatgcccaaggaccagcggtgggaggattatctatcagtgagggctctcaacctccccatagctaagggttaagtctttgtagccaaagggacatctgagg

SEQ ID NO: 4580 - DNA, 479 bp, Mus musculus
  misc_feature (88)..(97): n is a, c, g, or t
  misc_feature (152)..(154): n is a, c, g, or t
  misc_feature (268)..(272): n is a, c, g, or t
  misc_feature (274)..(291): n is a, c, g, or t
  misc_feature (318)..(318): n is a, c, g, or t
  misc_feature (423)..(423): n is a, c, g, or t
  misc_feature (438)..(438): n is a, c, g, or t
  misc_feature (445)..(445): n is a, c, g, or t
  misc_feature (449)..(449): n is a, c, g, or t
ttcagcaggcttcccacatgtaagtgtgtatctcccatatactcccacccagagggtgtagcacataacctgccaggaaaggaaagcnnnnnnnnnngcactcagtgctgcatggcctctggtcatcagcttggtggcgggcagttcttctnnnaaggcagaagtctcctcactgaggcagacaatgcatgtggagttggatatggaagccttgtgaagggcagacctccccaggcctcaggactattctgtggaggaaaacctggcnnnnncnnnnnnnnnnnnnnnnnnggaggcaggctggcagggagggagggnttttgacagtagcacagaccagacatagcggcatagctatgtaccagagtgtaccagaggctggcaggcagtggcagatgttggggtcattcaaatcctcacttnggggggctaaagggnacaaaantatnctggaaatgcctgtgacttcatggtcttac

SEQ ID NO: 4581 - DNA, 424 bp, Mus musculus
  misc_feature (140)..(140): n is a, c, g, or t
  misc_feature (279)..(279): n is a, c, g, or t
  misc_feature (310)..(310): n is a, c, g, or t
  misc_feature (335)..(335): n is a, c, g, or t
cacacaaggctaacattgactccagcattggagagtttgccatcccgaaggacacacatgtgatcatcaatctctgggcactgcatcacgataaaaatgaatgggaccagccagatcggtttatgcctgagcgcttcttnagatccaacaggaagccatctcattacacccacacccagttatttgcccttcggagctggtccccgatcgtgcattggagaggctctggcccggcaggagctctttatcttcatggccttgctgctgcagaggtttgantttgatgtgtcagatgacaaacagctgcccntgtctggtgggtgaccccaaggtgntctttctgatcgaccctttcaaagtgaaaatcacagtgcgacaagcatggaaggatgcacaggttgaggttagcacctagaggccgaat

SEQ ID NO: 4582 - DNA, 334 bp, Mus musculus
aagtatccaggatgatctcgctaatttcacagactatatttaccaaatgcgtttgcccctggttcctaggaatacagtatcaaaatctattaagaataacattaggttgtcggaactactaagcaatcctaatgtactcagcaatgaactcaagatagaattcctcatccttttgcaaatgctgcaaagaaaattaagcagaaaactgaatccagggtggtttgatgtcaagccaactgtgggagaaatcacaatcgaccgtcttcctgcccatagctataagcgcagatacaagtcaagaggttcaaaggagaaagctgcacaacctttatca

SEQ ID NO: 4583 - DNA, 223 bp, Mus musculus
tacagattgaacagctgaacagaacgaaaaagcacgcacaccttacggacacggagatcatgacgctggtagatgagactaacatgtacgaaggtgtaggaagaatgtttattctacagtccaaggaagtaattcacaaccagctgttagaaaaacagaaaatagcagaagaaaaaattaaagagctggagcagaagaaatcctacctggagcggagcgtcaa

SEQ ID NO: 4584 - DNA, 423 bp, Mus musculus
atcatgggccctgaagacacttgttttgagtttggtgtttttcccgccatcctgagtttcccacttgactaccccttgagccctccgaagatgagattcacctgtgagatgttccatcccaatcatctatcctgatggcagagtctgcatctccatcctgcatgctccaggtgatgatcccatgggttatgagagcagtgccgagcggtggagcccagtgcagagtgtggagaagatcctgctttctgttgtgagcatgctggcagagcccaacgatgagagtggagcaaacgtagatgcttccaagatgtggcgggatgaccgggagcagttctacaagatcgccaagcagattgtccagaagtctctggggctctgaggctacccctgtgcacactgagcactctgctcgagaacctgtgg

SEQ ID NO: 4585 - DNA, 300 bp, Mus musculus
ttgatgatgcattgcgtcaagggcattggcaaagaccatgccaagttctcaccagtggccacagccagctacagactgctaccggccatcactctgcttgagcctgtggaaggagaagcggctgaggagctgagccagtgtttctcccctggcgtgattgaggtggaggaagtacaaggtaaaaaggtggccagggtggccaatgctcggctggataccttcagcagggaaatcttccggcatgagaaactcaagaaggctgtgcggcttgcccgggttcgggaccattatatcttttct

SEQ ID NO: 4586 - DNA, 475 bp, Mus musculus
  misc_feature (183)..(183): n is a, c, g, or t
  misc_feature (305)..(305): n is a, c, g, or t
  misc_feature (333)..(333): n is a, c, g, or t
  misc_feature (352)..(352): n is a, c, g, or t
  misc_feature (357)..(357): n is a, c, g, or t
  misc_feature (419)..(419): n is a, c, g, or t
  misc_feature (421)..(421): n is a, c, g, or t
atcctccagtactccaatgtgtattgcccaacaccaaaagtccaggatctggtggatgacaagtccctgcaggaggcatgtctgtcctacgtcaccaagcaaggacacaaaagggccagtctccgagatgtgttccagctatactgcagcctgagccctggtaccactgtgcgagacctcatnggccgccacccccagcagttacaacacgttgatgaaaggaagctgatccagtttgggctgatgaagaaccttatccggagactacagaaatatccagtccgagtgtctcgggaggagcggangccaccctgccaggctttacacgggctntcacagctatgatgagatntgctncaagacaggcatgagctaccatgagctggacgagcgactagaaaatgaccccaacatcatcntntgctggaagtgaggctggctagctggaacatgttactatggctacttgccccta

SEQ ID NO: 4587 - DNA, 315 bp, Mus musculus
tggccttcgacaccgagctggtaaacataggtggcgacttcgacgcggcggccggcgtgttccgctgccgcctgccgggagcctatttcttctccttcacgctgggcaagctgccgcgcaagacgctgtcggtgaagctgatgaagaaccgcgacgaggtgcaggccatgatttacgacgacggcgcttcgaggcgccgtgagatgcagagtcagagcgtgatgctgccgctgcggcgcggcgacgccgtctggctacttagccacgatcacgatggctatggcgcctacagcaaccacggcaagtacatcactt

SEQ ID NO: 4588 - DNA, 455 bp, Mus musculus
  misc_feature (418)..(418): n is a, c, g, or t
aaccctttcaaggagcgaatctgcatggtcttctccacatcacctaccagagacagcctgagctttgaggacttcctggacctcctgagtgtcttcagtgacacagcaaccccagacatcaagtcacactatgccttccgcatctttgactttgatgacgatggaaccctggacagagaagacctgagccagcttgtgaattgcctcacgggagagggcgaggacactcggctcagtgcttctgagatgaagcagctgattgacaatatcctggaagagtcagacattgacagggatgggaccatcaatctttccgagttccagcatgtcatctcgcgctcaccagactttgccagctcctttaagattgtcctgtgatgtcttctaagtaccaacatcctgtccaagacctggccanctgctgagatgtggccaaggttatgcctgcggtgtca

SEQ ID NO: 4589 - DNA, 568 bp, Mus musculus
  misc_feature (66)..(66): n is a, c, g, or t
  misc_feature (90)..(90): n is a, c, g, or t
  misc_feature (218)..(218): n is a, c, g, or t
  misc_feature (330)..(330): n is a, c, g, or t
  misc_feature (390)..(390): n is a, c, g, or t
  misc_feature (429)..(429): n is a, c, g, or t
  misc_feature (459)..(459): n is a, c, g, or t
  misc_feature (471)..(471): n is a, c, g, or t
  misc_feature (484)..(484): n is a, c, g, or t
  misc_feature (516)..(516): n is a, c, g, or t
  misc_feature (537)..(537): n is a, c, g, or t
  misc_feature (541)..(541): n is a, c, g, or t
taagaagctagagcatcctggcctctactccgagtcttgtaccggttctcttagatctctgaggcncagaaaaaggaaagggtgtctcancccgctttctcgcttttcgctttagccatggcggagacaggggccgggataagtgagaccgtcactgagacaacggttactgagacaacggttaccgagacaaccgagccagagaatcagagcctaantatgaaacttcggaaacgcaagccagagaagaaggtggagtggtccagtgacactgtggacaatgagcatatggggcgacgctcgtcgaaatgctgctgtatttatgagaangcctcgggcctttggcgagagctccaccgagagtgatgaggatgaagaagaaggctgtantcataagcactgtgtacggggtcaccgcaaaggacggcntcctacaaccccagcacccaccccaaccantcctccacagcnctcctgatccctntaagccccctccaggacctatgcagcactaanatccctctcaccattcatgtntctngcctgccccaaatatatccatctgaca

SEQ ID NO: 4590 - DNA, 530 bp, Mus musculus
  misc_feature (209)..(209): n is a, c, g, or t
  misc_feature (286)..(286): n is a, c, g, or t
  misc_feature (341)..(341): n is a, c, g, or t
  misc_feature (397)..(397): n is a, c, g, or t
  misc_feature (419)..(419): n is a, c, g, or t
  misc_feature (479)..(479): n is a, c, g, or t
  misc_feature (502)..(502): n is a, c, g, or t
gtctcggctactgcagagcactgactgctctgaggagagggaagagggtctgctgggggttcctgtggccttccgctgtgtctggacaacactaacacaggacccttgttgctacctggttctgactccagacaaccacaatgccaggtacggggtctctgagcagcagccagtgcagatccccatttgcagtaagattgtacctcagnggtacaattcctcaccaaggaagtggctgcagggacactggtgccacggctcctgggccagcccttatgtctgaaanctggttgccaacagccccgagccaaggcaaggatttgtgtttgccaaaaatgttnctggggacccagccagtgtgggtctgaacatccccgcccacccccagactgcattntcatcagggtttcttgtgcccnttctgctgtggcagtgacaactgtgcctagccggggctgccacagctcccaggtattttntacaggaccatctgagcgggcanccaaacctgcttcacagtatcaataaag

SEQ ID NO: 4591 - DNA, 343 bp, Mus musculus
  misc_feature (101)..(101): n is a, c, g, or t
  misc_feature (107)..(107): n is a, c, g, or t
  misc_feature (156)..(156): n is a, c, g, or t
  misc_feature (162)..(162): n is a, c, g, or t
  misc_feature (166)..(166): n is a, c, g, or t
  misc_feature (187)..(187): n is a, c, g, or t
agggtgtctctccagatgaacttaaagacgaactacccgagcggcagcctcgcttcattgtgtatagttataaataccaacatgatgatggcagagtctcntacccnctctgctttattttctccagtcctgtcgggtgtaagcctgagcagcagnatgatntacnctgggagtaagaacaagctantccagactgccgagctaaccaaggtatttgaaataagaaacactgaagatctaactgaagaatggttacgtgagaaacttggatttttccactaatgtgaacttctgtgtttctaaagtatttatgtattaaacctgaccatactggaaccagaca

SEQ ID NO: 4592 - DNA, 523 bp, Mus musculus
  misc_feature (346)..(346): n is a, c, g, or t
  misc_feature (362)..(362): n is a, c, g, or t
  misc_feature (370)..(370): n is a, c, g, or t
  misc_feature (388)..(388): n is a, c, g, or t
  misc_feature (394)..(394): n is a, c, g, or t
  misc_feature (408)..(408): n is a, c, g, or t
  misc_feature (438)..(438): n is a, c, g, or t
  misc_feature (456)..(456): n is a, c, g, or t
  misc_feature (459)..(459): n is a, c, g, or t
attcgtggaagtttgggcctcactgacacccgaaatactacccatggctcagactccgtggtttccgccagcagagagattgcagccttcttccctgacttcagtgaacagcgctggtatgaggaggaggaaccccagctgcggtgtggtcctgtgcactacagtccagaggaaggtatccactgtgcagctgaaacaggaggccacaaacaacctaacaaaacctaggagacccagccaagtaaagtcccgaggactggtcgcagtgttcagcccttcctcctagggtcagggaaggtggtctgaaggcactgtccctgttggacccctccatgagctggcgagntctagccgaccacagntcagctgnctgcagtccagttctatntacctnttcctgtggagtantcatgggtgttcaggaaggatggtgacgcntctttttacaaaggactntcntccttcctcaagaaagagcctgcctgttgactagtcaggaaaatgcagtgcctgggtaaccagc

SEQ ID NO: 4593 - DNA, 532 bp, Mus musculus
  misc_feature (56)..(56): n is a, c, g, or t
  misc_feature (268)..(268): n is a, c, g, or t
  misc_feature (290)..(290): n is a, c, g, or t
  misc_feature (292)..(292): n is a, c, g, or t
  misc_feature (296)..(296): n is a, c, g, or t
  misc_feature (299)..(300): n is a, c, g, or t
  misc_feature (349)..(349): n is a, c, g, or t
  misc_feature (367)..(367): n is a, c, g, or t
  misc_feature (391)..(391): n is a, c, g, or t
  misc_feature (393)..(393): n is a, c, g, or t
  misc_feature (401)..(402): n is a, c, g, or t
  misc_feature (406)..(406): n is a, c, g, or t
  misc_feature (467)..(467): n is a, c, g, or t
  misc_feature (471)..(471): n is a, c, g, or t
tgcccagaaagctgtgcacgatgattgagcccttcttaggcacctggaaactgatntccagcgaaaactttgagaattacgtgagagaactgggagtggaatgtgagccccggaaagtcgcatgtttaataaagccaagcgttagtattagtttcaatggggaaaggatggacatccaagcaggaagtgcatgcaggaacacggagatctctttcaagttgggggaagaatttgaagagaccactgcagacaaccgaaaagtgaaganccttataacctttgaaggtggntnaatnatnncaggtccaaaaatggcttggcaaacagacaacaattaaaagaaaaattntggatggaaaaatggtantggagtgcaccatgaacaatgttntncagcactnngatntacgaaagggtgtagcagaagggtagacaccagcaagaacttggccaccacaaagaacttnccgntcaagaaagccagccccagggacagtgatttaagacatcaccagcattaagttttgctcaa

SEQ ID NO: 4594 - DNA, 386 bp, Mus musculus
gagtaaccacaattagccactgcgcttatcgagaagagtcagagaacagcgaaaactacggccttagggctcttcaagcctcatgattgtacaacctactcgaaatatgacagcactgttgatagtgtgtgttgctactgtgcttctgtgcctataagactattgataatttgtttagtcatatatggtcagtagtctgtcttttcaaggtcatctgctaatagaatgtatgcccatttgcaaaactgtcataccactgaactgagcttatgttgcactgtggatttctccactgacaaagcttatttacgacatcctaaaagcagcgttttttctatttgtgaaagttactgattgtactggtattacctcagtattcatgcact

SEQ ID NO: 4595 - DNA, 477 bp, Mus musculus
acgatcgctgagttctttcagaccattggttgtcacacccacaagcctaactgtgacagccaatgagtgtccatgtgattttgactgcaaatttcgcttatttgatttttagcggagacgtccttgctcttacttgtggatcaggagaggttttcttagcccttctaagtgttcccaacccgtgcgctgtagaacagattgcgcaaactgacagcagagtaaaagggggcggggcttcacttccggcatcccaccagtccacgcccgccgttttcacctctccagactcgccactcctttattcatttgcaactgcaaatgtagcaatttgcaatcctaatacagggccagggcggtggataccttaaagttttatttgacttcatttagtgctttctgtccatttttaatgacttttgtttttttgtttttgtttctccagccccatctcctccctctgccctagtatgaaacttg

SEQ ID NO: 4596 - DNA, 404 bp, Mus musculus
gttccaatgaccagactgtgcgtgtgtgggttgtagcaacaaaggaatgcaaggctgagctccgagaacatgaacatgtggtggaatgcatttcctgggctccagaaagttcatattcttccatctctgaagcaacaggatctgagactaaaaaaagtggcaagcctggacctttcttgctatctggttccagagacaaaactattaagatgtgggacgtcagtactggcatgtgccttatgactcttgtgggtcatgataactgggtacgtggagttctgttccattctggggggaagtttattttgagttgtgctgatgacaagaccctccgtgtatgggattataagaacaagcgatgcatgaagaccctcaatgcgcatgaacactttgttacctccttg

SEQ ID NO: 4597 - DNA, 549 bp, Mus musculus
  misc_feature (186)..(186): n is a, c, g, or t
  misc_feature (244)..(244): n is a, c, g, or t
  misc_feature (364)..(364): n is a, c, g, or t
  misc_feature (385)..(385): n is a, c, g, or t
  misc_feature (406)..(406): n is a, c, g, or t
  misc_feature (424)..(424): n is a, c, g, or t
  misc_feature (484)..(484): n is a, c, g, or t
ggaaaccctagaagtagctcgctgttgccctttggaagctcacacacttaaaaatcatgatttggagagtctcatggggcaagtgggagtgtccaggacacaagcaataacagcgtggagtagaaggctgagagaaatggctggtctctgtggctttgtttcatgtagcccaggctagtctcaganttgtcatctgggaggctagccttgagctgcttgctgaccctcccacctctgccttccntggttctgggatggtgggcacgtgcccccatgtcccacatcagctttcatccatgttattgtgggttgcttggtttgctttggtttttcaggatggggcctcattgtgtagctctgactntcctggaactcactctgtagnccttgaactcagctccacctncctccctcccaagtgctnccattaaaggcgtgtgccaccatgcctgaactgagaggtttttttaatactatctagtantcctttatttggatcagtcacaacctagctttgtactgttgaaatcgtattgtttccctttgagg

SEQ ID NO: 4598 - DNA, 396 bp, Mus musculus
aagagcatgtctgttcgatcctggcttccctcctgcgcaacctgagagggcagcagcggacccggcttctgaataaatttacggagaacgacagtgagaaggttgacagactaatggagctgcattttaaatatctcagcgcaatgcaggtggccgacaagaagattgaaggggagaaacatgacatagtgcggcgtggggagatcatagacaatgacatggaggacgagttctacctgcggcgcctggatgccgggctcttcatcctacagcacatctgttacatcatggcggagatctgcaatgccaatgtcccccagattcgccagcgggttcaccagatcctgaacatgcgtggcagctccatcaagatcgtcaggcacatcatcaaggagt

SEQ ID NO: 4599 - DNA, 445 bp, Mus musculus
  misc_feature (332)..(332): n is a, c, g, or t
  misc_feature (348)..(348): n is a, c, g, or t
  misc_feature (350)..(350): n is a, c, g, or t
  misc_feature (368)..(368): n is a, c, g, or t
  misc_feature (394)..(394): n is a, c, g, or t
  misc_feature (401)..(401): n is a, c, g, or t
gagctactgaagttctcttctctgttaaggatgaaaagtggcaggaccttacactcagttgcaagtactataaaaacgtttatgttaaaatgtttgttttcatgtagatgttttcttgatctaagcaaaggctattttccttggctctacaaataaacatgccgagaatgaaggaggcccatgtggttgttaatgtgaacacggctatgcagtagggatttcggaagggattaatctcaaatattctgctttttaattctttatattatttgtaaactgtgtgttcccatgctattaggaagtgtatatctaggaatggatatacgctatcnaatgggtcatagggantnttccacacttcttccatntatactgcaataaaaatactgtgatntactttntagtattccttccccctaggtttctcaataacaggtacaccaaa

SEQ ID NO: 4600 - DNA, 533 bp, Mus musculus
  misc_feature (472)..(472): n is a, c, g, or t
  misc_feature (483)..(483): n is a, c, g, or t
ggaaaggctgtgtcatcaccatctccggacgcatgaccttcacaagcaataagtccatggagattgaggtcctggtggacgctgaccctgtggtggacaactcacaaaagcgctaccgggccgccagtgccttcttcacctacgtgtccctgaaccaggagggcaagccaatgcctgtgcctcagcttgtgccagagacggaggatgagaagaagcgcttcgaagaaggcaaaggccgttatctgcagatgaaggcgaagcgacagggccacacagagcctcagccctaggtgtcttcctcctgtcccgggtcagcacagttgtggcaatagcccagtatgcagtcacttagaaattgcccccttggccaaacccccgatttccactgagagctggtgttgtgtgaagtgttgagtggcagtgttccctatggcccatccccaaaaacctgtgcaccaaagctttatttatntccccagtgtntgtcccaaaggccaccatggacaccagagcacaccgactggcctgaagaa

SEQ ID NO: 4601 - DNA, 211 bp, Mus musculus
  misc_feature (104)..(104): n is a, c, g, or t
caaggatttctacgaccatggagaatgagacctctttcaggaatgtaacatttacctctgctggggactcatcccgaaacccaagtgcctatggggttattgcngctgctggggtgttgagtgccatcctggtttcggccacccttctcatattgctacgcctccgaggtcagggttatctgcccccaccagggctgttggtggctgtgaa

SEQ ID NO: 4602 - DNA, 473 bp, Mus musculus
  misc_feature (133)..(133): n is a, c, g, or t
  misc_feature (135)..(136): n is a, c, g, or t
  misc_feature (138)..(138): n is a, c, g, or t
  misc_feature (140)..(140): n is a, c, g, or t
  misc_feature (152)..(152): n is a, c, g, or t
  misc_feature (159)..(160): n is a, c, g, or t
  misc_feature (302)..(302): n is a, c, g, or t
  misc_feature (329)..(329): n is a, c, g, or t
  misc_feature (364)..(364): n is a, c, g, or t
  misc_feature (366)..(366): n is a, c, g, or t
gagagagtgtgcaaccccatcatcagcaaactttaccaaggcggtccaggcggcggcggctcctctggagggcccaccatcgaggaagtggactaggcttgcgctggagtccgcgtaaacctcttttcctttntnntntnttttcttttttnttttttnnccttttctcccttttgttttggtttcttttaaatgtccttgtgccaagtaagatctattattggaagtctttagcctggtgcatacatatgaaaggaaaggtgcaacaacttagtttagttataaaaggttagttctaaaantttgatttgggggaaaaatgaggtttntctttaatgcatttagagcgattgctgatttaagntntttttgttgttgttaagcttacgtatgtacatggagatttgcttgaaagtagaaccctgatgctcgcacacctgacctgtggaagcttggttacactaagacacagg

SEQ ID NO: 4603 - DNA, 191 bp, Mus musculus
tatcctccagattgaatctgaaaaggctgagttacggttaaaggagcaggaagttcgaaggctgatgcgtgcccgaggtgatggaccctggtatcaatttccaacccctgaaaaggagttcattgatcattctccaaaggcaactcctgacaactgatgattcatttgtctgtccaagaacagtgtgtccc

SEQ ID NO: 4604 - DNA, 538 bp, Mus musculus
  misc_feature (125)..(125): n is a, c, g, or t
  misc_feature (470)..(470): n is a, c, g, or t
  misc_feature (475)..(476): n is a, c, g, or t
  misc_feature (511)..(511): n is a, c, g, or t
ccgctaacatgccattcgttgagttggaaacaaacttgccggctagccgcatacccgcggggctggagaaccggctgtgtgcggccacagccaccatcctggacaaacccgaagaccgcgtgagngttacgatacgacctggcatgaccctgttgatgaacaaatccacagagccttgtgctcaccttctggtctcttccatcggggttgtgggcaccgcggagcagaaccgcactcacagcgccagcttcttcaagttcctcaccgaggagctgtccctggaccaggaccggatcgttatccgcttcttccccttggaggcttggcagatcggaaagaaaggaactgtcatgacatttctgtgacggaaacaaagaacccagggtgtttgctcgaaccgggccagagcccttccagagaggccctcccggcagaatcgtggcctggtagataggatggtaaatccctcnttttnngcctaaacgtctgcgacttcagtggtccatttttntcttccccagcctcgtgaataattgaa

SEQ ID NO: 4605 - DNA, 417 bp, Mus musculus
  misc_feature (55)..(55): n is a, c, g, or t
  misc_feature (162)..(162): n is a, c, g, or t
tgcgagtgcgaatgtgctttccgacgggttctccttgctgggcaccagaacaaangaggctgtgtgctagaagtggaccgcggctctgtcaggacagcatgcgaggtgtgcttgtgcatgcttgtgtgcagtccttcgtgtaggccagtgagctgggggggnttattgggggtagggactctgctgtttgttttcatacaatctctcctgctaagttgatgctcccctgatccagctcagcctgggggtgggggtgggggcaggacacagatttctggtcctctgtcatctttggtggactgccaccaaacagaaagcatgtgtatcacatctctagaaagaagacgaaaacagttcaaaccctaatgcgtacttttgactttaacttttatagtaaacagactccgtgctgacttt

SEQ ID NO: 4606 - DNA, 396 bp, Mus musculus
  misc_feature (195)..(195): n is a, c, g, or t
  misc_feature (237)..(237): n is a, c, g, or t
  misc_feature (240)..(240): n is a, c, g, or t
  misc_feature (245)..(245): n is a, c, g, or t
  misc_feature (262)..(262): n is a, c, g, or t
  misc_feature (286)..(286): n is a, c, g, or t
  misc_feature (369)..(369): n is a, c, g, or t
tctgaggatattccttcgcccttaccgtgcatggtcttgtctggcattctgtgtactcttatgttatgaattatttatgtacagatacatcgtcacacattttcatattctctgatagttggaatttatgtcaaattttagttgggaatcttgtttcctattaagctcaggactttataccctctgaactgagtncctttgagtcacatacataagtagatttcatggtgaatgtancanggggnagctgggaacaaaacangtcgtgttagaacaacttaccttntcaagaataagatgtatgctcatcccgatctgtatgtgttggtcccttgtgtttattgctattgaaaatagcctggatcattntcctccagtcagagtaagtgtttttgt

SEQ ID NO: 4607 - DNA, 555 bp, Mus musculus
aactggctaccaaatactgacgcttgaaaaagaccaggagcaagtggtgatgaacttggacagcagacttctgatcttccctctgtacatctgctgtaacttcttgtatatatcaccagaaaaaagaactgagagtaatcgtcacccagaaaacccaggacactgaggcactcatcagtggccagttttaacttaatgacctactgcgttcacgtccaaggtgactaacagtgaccggccttatgaactgtgggaccctggagatgtcctcaccctcattacatttctatgcacatatgaaaaagttttttaaaactgagaaagcatctgtcaaaccatgttaaaaggatatcaactcttgctttaatttagtagcagtaaaaattgctgtaggtaaatttctcatttctttgcaacaagatatagatttaattttgagcttgaatttcgatcctatctaatgttagtgagtttactcatctgtaaatgtgttcctgttttgttaagagaatgctaaggacggagtttaagtggccaatcataaatgctctttca

SEQ ID NO: 4608 - DNA, 376 bp, Mus musculus
gaccactgtggaagtcatacacccgatgcacagatggtattgtgtttgtggtggactctgtcgatgttgagagaatggaagaagccaaaactgaacttcataaaataactaggatatccgaaaatcagggagtccctgtgcttatagttgctaataaacaagacctgaggaactcgctctctctctcagagattgagaagttgttagcaatgggggaactgagctcatcgactccttggcatttgcagcccacctgtgcaatcataggagatgggctaaaggaaggactcgagaaactacatgatatgataattaaaaggagaaaaatgttgcggcaacagaaaaagaagagatgaatggcagtaccttttatatt

SEQ ID NO: 4609 - DNA, 518 bp, Mus musculus
aacatcgtgcgctgcatagtgcactcccccaccaaccctggcttcatgacgtgcagcgatgacttccgagctcggttctggtaccggaggtccaccactgactgaactggccccatcctagggttcttgtctcaggactctgccctcctccctgtgtcctcaccggctgcggaagtgagcagcttgcaccatctgtggcgggggtgtggccgcctggctcctgccttggatctgtgtgtggaagcttgttttttgaccttgacgtagacgcgtggtgggaaaagtcctattacagtgatttccatgtggtctccaccagcttagtgagtgcaggacttggcacagccttcagctctcattcctggagaaggacggcgtgtggcctcgggatcacacttgtcacttcctgcgttgtcctgccccctctgtattttctttccagatgcattttgacacatgaggagggctacatctctgaggagccgggttccatgtagaaccatcttgcagggatccca

SEQ ID NO: 4610 - DNA, 150 bp, Mus musculus
gggccccggaactctggtggagccagtgcaagtcagggtgagcatccccctatccatcatggaccctccacaccagtatcgaattcacagaaggaagagctttgatgcatctgacactctagctttgcctcggcactgtctgctgggctg

SEQ ID NO: 4611 - DNA, 381 bp, Mus musculus
  misc_feature (294)..(294): n is a, c, g, or t
  misc_feature (322)..(322): n is a, c, g, or t
  misc_feature (333)..(333): n is a, c, g, or t
  misc_feature (355)..(355): n is a, c, g, or t
gaaaagcatgatcgtgtttgtttaaaacacaaggcgtggcttagacagtttgcaacgcagtggaccgagcactcctcacagcttcaaggtaacagcgaccgtgcccatgccgtcctaggcagcttcccttccctcgccttttccttacctcccatgaatgagaaggccatttcccctttgcagaccgcatacagttttagtttatgcatttccttaaaattaactgtagaatccaggatacaaaccattagtaggcaatactattttagaatgtaacataggaggtgtatttancctcttttagaagtcagtgggttgaatntcttttttttnaaaatttttattcattaaggtncctcgtttttcttgactttgtccatt

SEQ ID NO: 4612 - DNA, 577 bp, Mus musculus
  misc_feature (112)..(112): n is a, c, g, or t
  misc_feature (321)..(321): n is a, c, g, or t
  misc_feature (386)..(386): n is a, c, g, or t
  misc_feature (414)..(414): n is a, c, g, or t
  misc_feature (422)..(422): n is a, c, g, or t
tttgagctcgccacaggagactatttgttcgaaccgcattctggggaagactattccagagatgaagaccacatagcccacatcatagagctgctaggcagtatcccaaggncactttgctctgtctggaaaatattctcgggaattcttcaatcgcagaggagaactgcggcacatcaccaagctgaagccctggagcctctttgatgtacttgtggaaaagtatggctggccccatgaagatgctgcacaatttacagatttcctgatcccaatgttagagatggttccagaaaaacgagcctcagctggcgaatgccnttcgacatccttggttgaattcttagcagattctacaaatatagcattctgagctagcaaatttntcccagtacattggacctacacagtggntctcattntttaacaggattaccagtgagctggctccaccctcagacctttgtagtgctttgaggtactgttgtttgacactttgcttcctgtgcaccatggtcctggggaaggctggtctttgtcttcagctaagtagtttactggccattttcttctggaa

SEQ ID NO: 4613 - DNA, 231 bp, Mus musculus
  misc_feature (33)..(33): n is a, c, g, or t
  misc_feature (86)..(86): n is a, c, g, or t
  misc_feature (101)..(101): n is a, c, g, or t
  misc_feature (103)..(103): n is a, c, g, or t
  misc_feature (110)..(110): n is a, c, g, or t
  misc_feature (125)..(125): n is a, c, g, or t
  misc_feature (146)..(146): n is a, c, g, or t
  misc_feature (159)..(159): n is a, c, g, or t
  misc_feature (184)..(184): n is a, c, g, or t
gcatgaatgggatacatgtctgcatggtctttngaagtacttggtcaccatctcctcaaatggatcatcaaatccaactatcaagncctcccagtacgttntntgaagangtatcattcgacagntccttcaagggttagattatntacacagtaagtncaagataattcacaccgacataaanccggaaaacatcttgatgtgtgtggatgacgcttacgtgagaagaat

SEQ ID NO: 4614 - DNA, 294 bp, Mus musculus
  misc_feature (132)..(132): n is a, c, g, or t
gcagattactgcaaaggtggctatcatccagtgaaaattggagatctcttcaatggtcgatatcatgtcattagaaagctaggatgggggcacttttctactgtatggctgtgctgggatatgcaagggaanaagatttgttgcaatgaaagttgtaaaaagtgcccagcattatacagagacagccttggatgaaattaaactactcaaatgcgttcgagaaagtgaccccagtgacccaaacaaagacatggtagttcagctaattgatgacttcaagatctcaggcatgaa

SEQ ID NO: 4615 - DNA, 344 bp, Mus musculus
gggaccttgagcagattttatcacagtacattacgtttgtgaagcctgcctttgaggaattctgcttgccaacaaagaaatacgccgatgtgatcattcctagaggtgccgacaatctcgtggccatcaacctcatcgtgcaacacatccaggacatcctcaacggggggctctccaagcggcagacgaacggctatctcaacggctacaccccttcccgcaagaggcaggcgtcagagtccagcagccgaccacattgactcccgtgcccctgactccaaaccccagccccccagctccaagacacaggaggggtcgagaggctctggtcacctgtacatacg

SEQ ID NO: 4616 - DNA, 499 bp, Mus musculus
  misc_feature (122)..(122): n is a, c, g, or t
  misc_feature (371)..(371): n is a, c, g, or t
  misc_feature (467)..(467): n is a, c, g, or t
tgtgtggacactttacagcatgcccattttctgaagtgtcctaatctctgtagagtgctttagtttttaatattgaattgacttcctggaatctaaattcatgacaagaaaaggctgtgccnaatttaattttttcctttgggaattacccctgcctccctaagaattgaccccagagctttgtgggtgctagggaagcaccctcaagaagctgcacctttagtccccatattttggggtttttaatattttttttaagttctgttagtgaatggcgtgttatttaaaaaccgtgtgttgtcatttcctggggctgagatagagttatttaacctcttatctcgaacattagatggatgttagaatctatntcgtaaggacactgtgaggatttgtttaaagagtaaaagcctagaacaatgttatagtttgttgttgaagacttaataaaatgagtatactgtagnttaatgaggtgggaaagctactatctcatatg

SEQ ID NO: 4617 - DNA, 234 bp, Mus musculus
agtatctcctcgctcttcgaacggacctgtcgccagtttgacaagctgcggaaacgggaggccttcatggagcagttccgcaaggaggacatcttcaaggacaattttgacgagatggacacctccagggagattgtgcagcagctgattgacgagtaccacgcggccacacggccagactatatctcctggggcacccaggagcagtgagtcacggacgacagggaccctcat

SEQ ID NO: 4618 - DNA, 508 bp, Mus musculus
  misc_feature (444)..(444): n is a, c, g, or t
  misc_feature (446)..(446): n is a, c, g, or t
tccacctccaaatgttgactatccattggatggagagaaaattttacatgtgcttggatcaatcagagattcagttgtggaaatcctttttgaacaagataatgaggagaagtcagttgccactttaattttggattcccttttacagtgcccaatagacaccaggaagcaactggcagagaatttggtaatcatcggtggcacatctatgttgccaggctttctccacagattgcttgcagaaatacggtatttggtagaaaagccaaagtacaaaaagacacttggcaccaagaacttccgaattcatactccacctgcaaaagctaattgtgtggcctggttgggaggggctgtttttggagcattgcaagacattcttgggagccgctccatttcaaaggaatactataaccagacgggccgcatacctgactggtgctntntcaacaaccctcccctggaaatgatgtttgatgtggggaaagcgcaaccaccgctgatgaaa

SEQ ID NO: 4619 - DNA, 304 bp, Mus musculus
atcaatccatgatgcttgtaagtgataaatgataaataaggaaactagcttaattgaaaacatggccatattggaatgggatttttagtttttctatcagacatattagaggatacatcagttgctctaaggtagtaaccagatagtccacacacacaaacatgaactatcactctgtcccgtctagggaggacatgtcacaggtgttctgagcgatcaggccagctgttggtttttatcaggcaggatagttcatccttaggctttggaattccattggaaagtgacttcataccagggtttt

SEQ ID NO: 4620 - DNA, 512 bp, Mus musculus
  misc_feature (339)..(341): n is a, c, g, or t
  misc_feature (386)..(386): n is a, c, g, or t
  misc_feature (420)..(420): n is a, c, g, or t
  misc_feature (428)..(428): n is a, c, g, or t
  misc_feature (478)..(478): n is a, c, g, or t
ttggcctgttgcttgaacgctgcttgcatggcattggtggatgcaggtgtgcccatgcgagccctcttctgtggggtcacctgtgccctggactctgatggaaatctcgtgctggaccccacaaccaagcaagaaaaggaggcccgggccatcctgacctttgctctggatagcgccgagcagaagctgctcatgtccaccaccaaggggctctattctgacgctgagctccaacagtgtctggccgccgcccaagccgcctcacagcacatcttccgattctaccgggaatcactgcagaggcgctactcgaagagctgaggcacgccagggtagggnnncccctcccaccatgcccaccgcctaccaccgccacgagccagcantccactgtgcctctgtctgtgcccatgtagcctntggtcctntcgcagcggaggctcctgtgccaggctggggtgggggcttagggacattntaggcctgggtataaccctcccttcatcaggata

SEQ ID NO: 4621 - DNA, 373 bp, Mus musculus
  misc_feature (279)..(279): n is a, c, g, or t
gattgtatgaggctcttcaccaaagaggacatattggatggtgatgagaagccaacttgctgccgctgccgagccagaaaacgatgcataaaaaagttctctgtccagaggttcccaaagatcttggtgctccacctgaagcgattctcagaatccaggatacgaaccagcaagctcacaacatttgtgaatttcccactaagagacctggacttgagagaatttgcttcagaaaacaccaaccatgctgtttacaacctgtatgctgtgtccaatcantccggaaccaccatgggaggccactatacagcctactgccgaagtccggttacaggcgaatggcacactttcaatgattccagtgtcacaccca

SEQ ID NO: 4622 - DNA, 439 bp, Mus musculus
  misc_feature (153)..(153): n is a, c, g, or t
  misc_feature (281)..(281): n is a, c, g, or t
gagtctcttagacaaaggccctctggactgagcttctcagggacacccacaccaccccttaccccatcttggcatcagtctttggtcctgtcctgggagtgtgagcctggatggctggggttagcttgtatgattctttgccctgacgttagncaaaaaaaaaaaaaaaaatactccatgctgtcccaagagccaagctattcagcactaaggcatttcgcacagtgcattttgcaccccccacaggtgggcctggcttatgccctcagaacctcgagtgnttgagtgtcccaggacagggcacccaagaaaagacaccctgagtttacctggcctgatacccttctctagggaagacctgtgaacatgagcccaagggctggtgtacacttgtttactatgtaagcaagagtagaatgtctagtgtacagtggagcct

SEQ ID NO: 4623 - DNA, 473 bp, Mus musculus
  misc_feature (127)..(127): n is a, c, g, or t
  misc_feature (303)..(303): n is a, c, g, or t
  misc_feature (361)..(361): n is a, c, g, or t
aaacagcagcttatcgaaacatgaaagagattctcaccaaaaagaatgatcaaatcaaagacctacggaaaagactggcaaaatatgaatctgaagattaaagactggagattttgtctagaacctnccacacatgaacatacaagctatctccattcacctcaggcatgtatttagaagcattttgtcatattctgttctttttccaatgtttaggctttccttgtaatattagaactatcattcttatcttcagttctgtaattgcgaagagaaaaaaaatgtaatgattcttttctattntcccaaatacgcctctgtcatatgctccagagcctccatgcaagtacagtgagatttnttcatggtagacagcagtttagagtgggaagaagagccatccttttgcgttagtgagtgaactttttaatgttagagaagctggtaacatctatacttgtacagtccctaag

SEQ ID NO: 4624 - DNA, 522 bp, Mus musculus
  misc_feature (242)..(242): n is a, c, g, or t
  misc_feature (244)..(244): n is a, c, g, or t
  misc_feature (320)..(320): n is a, c, g, or t
gacatcacggatgagcgcaaaggcagtctggagcctgaccaccttcatgtcttcagaccagagggataactatttgtcactaaggcaaacctcctgagccctggcctccagaaactcagtggcaaagccgagtccatggatgtaaattgtcaccatcgagacaggtacagctgtcttctcggaacccatatgcaggatttctgtctgttttgaatgaacagtagtaacagtgatctgctttngngtacattgttcaatcaagctgtgggtagtagatttggggaaaaggagttttgggctttgttatccaacagaagaanccggccctttttaataacgtataaattataagttctcagttgagtatttggaaccatttggaagagagaggcatacaaacacaaaattgctttaatgagatagtatggaagatgcattaggcagcggttattgaccattccttatgtgcagttccacagagctctgtaaagacagtgtgtggcccttgcctgaattctaata

SEQ ID NO: 4625 - DNA, 395 bp, Mus musculus
  misc_feature (40)..(40): n is a, c, g, or t
  misc_feature (109)..(109): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (120)..(120): n is a, c, g, or t
  misc_feature (123)..(123): n is a, c, g, or t
  misc_feature (126)..(126): n is a, c, g, or t
  misc_feature (131)..(131): n is a, c, g, or t
  misc_feature (135)..(136): n is a, c, g, or t
  misc_feature (159)..(159): n is a, c, g, or t
  misc_feature (215)..(215): n is a, c, g, or t
  misc_feature (300)..(300): n is a, c, g, or t
  misc_feature (302)..(302): n is a, c, g, or t
  misc_feature (309)..(309): n is a, c, g, or t
  misc_feature (336)..(336): n is a, c, g, or t
  misc_feature (338)..(338): n is a, c, g, or t
  misc_feature (368)..(368): n is a, c, g, or t
cgccttgcaggccttgggactgtcaccgctctgctttganggtactttggccgggtctccggaagtagccctcccagattctcagacactcccattctccccacgccgntnccnccnccnccnccnccatncaanngcgaggacgccagatacctcaanaaggaaagttaaaggggggaatattgatgtacatccatcagaaaaagctctcattnttcagtatgaagtggaagctaccattcttggagaaatgggagatcccatgttgggagaacgaaaggaatgccaaaaaatcatccntntgaagantctcaatgctaacacagacatcacctntntggcccggaaggtggttgaggaatgtaagntcatccatccctcaaagctaagcgagg

SEQ ID NO: 4626 - DNA, 166 bp, Mus musculus
agaagatctcctgccatctagaccagaagttcctaatgttattggagagacagaagaagtggagcttcaggaatttgatagcactcgaggctctggcggtggtcagagacgtgaagcctataatgatagctctgatgaagaaagtagcagccatcatggacctgga

SEQ ID NO: 4627 - DNA, 494 bp, Mus musculus
ggcaccctaatattagttccgtcacaggggctatttgtttggatatcctgaaagatcaatgggcagcagcaatgactctgcgcacggtattattgtcattgcaagcgctgttggcggctgcagaaccagatgacccccaagatgcagtagtagcgaatcagtacaaacagaatcctgaaatgttcaagcagacagctcgactttgggcacacgtgtacgctggagcaccagtttctagtccagaatacaccaaaaaaatagaaaacctctgtgctatgggttttgataggaacgcagtaatagtggccttgtcttcaaaatcatgggatgtagagactgcaacagaactgcttctgagtaactgaggcacaggagctgcgccagcatcgctctcgcctcttgaggagcatcaacacctgttatttttaggattctgcataaagttcttttaaactggcattcttgcctaatgatgttacctaggcaccattgga

SEQ ID NO: 4628 - DNA, 407 bp, Mus musculus
taaaggtttacttcaacttcagtggaagcaagatttggataaaggtttggagcttatcagcaaggctattgaaattgacaacaaatgtgactttgcatatgagaccatggggactattgaagtgcagagaggaaacatggagaaagccattgacatgttcaacaaagctatcaacttggccaagtcggaaatggagatggctcatctgtattcactttgtgatgctgcccatgcccagacagaagtagcaaagaaatacggattaaaaccgccgacattataaacacaggggaaacagactgactcttttcaaagaagtttaccccctcttcaactcaaccctgaagacactgtcataaattgttgaacggtggaacttagtagtccctttgtgatgttgtcattca

SEQ ID NO: 4629 - DNA, 136 bp, Mus musculus
tcctggccaggatccagttgagcagcagaggttgactaaatgaaggtgccgtcttcagcatcatagtttgaccagtgaaaatgttcatagaattttgtgtagttgtaccgtacgattttatcttcttcatttattt

SEQ ID NO: 4630 - DNA, 281 bp, Mus musculus
accctcaggaggactgctcaggaatgccccgtgcgcacttctctggacctggagctggacctgcaggcctcgctgacccgccagagtcgcctcaatgacgagctgcaggccctgagaggcttacggcagaagctagaggagctgaaggctcagggagagactgaccttcccccaggcgtgctggaggacgagagattccagaagcttctgaagcaagcagagaagcaggctgaacagacgaaagaggagcagaagcaagacttgaacgcagagaggttgat

SEQ ID NO: 4631 - DNA, 542 bp, Mus musculus
actgaaaattggcacctacacgggccccctgcagcacggcattgtctactcagggggttcatctgatacaatctgtgacctgttgggagctaagggcaaagacattttgtatattggagatcacatttttggagacattctgaagtcaaagaaacggcaagggtggaggactttcttggtgattcctgagcttgcgcaggagctccacgtctggacggacaagagttcactctttgaagaacttcaaagcttggatattttcttggctgaactctacaagcacctggacagcagtagcaatgagcgcccggacattagttccatccagagacggattaagaaagtaactcatgacatggacatgtgctatgggatgatgggaagcctgttccgcagcggctcccggcagacactctttgccagccaagtgatgcgctatgcagatctctatgcggcctcgttcatcaacctgctgtactacccattcagctacctcttcagagctgcccatgtcctgatgccgcacgagtcaacggtggaac

SEQ ID NO: 4632 - DNA, 541 bp, Mus musculus
  misc_feature (288)..(288): n is a, c, g, or t
  misc_feature (291)..(291): n is a, c, g, or t
  misc_feature (297)..(297): n is a, c, g, or t
  misc_feature (321)..(321): n is a, c, g, or t
  misc_feature (367)..(367): n is a, c, g, or t
  misc_feature (374)..(374): n is a, c, g, or t
  misc_feature (394)..(394): n is a, c, g, or t
  misc_feature (435)..(435): n is a, c, g, or t
  misc_feature (439)..(439): n is a, c, g, or t
  misc_feature (441)..(441): n is a, c, g, or t
  misc_feature (485)..(485): n is a, c, g, or t
  misc_feature (513)..(513): n is a, c, g, or t
gttatcttagaaacccacactatggcagccttatttatgctgatggtcatggagaagtgtggacagactggaatgacatgtccaagtttttacagtacggatggagatgcaccactaatgagaactcctattcgaaccgtaccctggtaggaaactggaaccaggaaagatacgacctaaaaaatattgtaaagcctaaacccttgccttcccagtttggacatgccttcgaaacaacatatgatgcaaactacagcaggaagaagccacaatcaacacatagatttnaancgagancctcactggtttcctggacatcancctgagctggatcctcctcactacaaatgcacagcgaagtcaactnatatganctaactactcagaacctcancccactcattactcctgctgtgtatatgatccaagcgtganccantnttagggcccgggaatctgaagaagaagaagtagcttcatttttntctagagtagactgtagaaaggaacacntgctaagcagactcaacatcactctcaa

SEQ ID NO: 4633 - DNA, 171 bp, Mus musculus
gaaggagaatccacgagttgtaagaaaatggcagacaagccggacatgggggaaatcgccagcttcgataaggccaagctgaagaaaaccgagacgcaggagaagaacaccctgccgaccaaagagaccattgaacaggaaaagaggagtgaaatctcctaaaagcctagg

SEQ ID NO: 4634 - DNA, 487 bp, Mus musculus
  misc_feature (372)..(372): n is a, c, g, or t
  misc_feature (387)..(387): n is a, c, g, or t
  misc_feature (416)..(416): n is a, c, g, or t
  misc_feature (462)..(462): n is a, c, g, or t
acgtcgcgggatggtgacaagttctggaggatgcctgagtgctacatccgtggcagcaccatcaagtacctgcgcatccctgatgagatcattgacatggtgcgggaggaggccgccaagggccgagggcgaggaggaccgcagcagcagaagcagcagaaaggccgaggcatgggcggcgctggccgaggtgtgtttggtggccggggccggggtggcatcccaggtgcaggccgaggccagcccgagaagaagccagggcggcaggcaggcaaacagtgatcactccctgcctgagccgagcccagaacggtgggtgaggcctcagggcacctttgtgtgaagccccacttggcgtctggtccagtgaangtccctcgctggccnctgactcagtttctggaaggttccgagtnctgaggtgcctgtggagccttagatgccctttgaagggctgacttnttccaggcatgtttgagtttcagtt

SEQ ID NO: 4635 - DNA, 271 bp, Mus musculus
gctcggtgatgattcagcgtgtcaatggctctctggctgtatcgagggcccttggggatttcgattacaaatgtgtccatggaaaaggtcccacagagcagcttgtctccccagagcccgaagtccatgatattgaaaggtctgaagaagatgaccagttcatcatccttgcatgcgatggcatctgggacgtcatggggaacgaagagctctgtgactttgtgagatccagacttgaagtcactgatgaccttgagaaagtttgcaatga

SEQ ID NO: 4636 - DNA, 236 bp, Mus musculus
gtgctccggaggaaaaccttgctaaaagaaggcaagaaacccacagtagcatcttggacaaagtattgggcagccttgtgtggaacacagcttttttactatgccgccaaatctctgaaggctacagaaagaaagcatttcaaatcaacgtcaaataagaatgtgtctgtggtgggctggatggtgatgatggctgacgacccagagcatccagacctctttctgctgactgactc

SEQ ID NO: 4637 - DNA, 410 bp, Mus musculus
  misc_feature (339)..(339): n is a, c, g, or t
  misc_feature (351)..(351): n is a, c, g, or t
  misc_feature (377)..(377): n is a, c, g, or t
gagaaataccctgcaggttctgctcagcctctgccagtggctgcctcacgttcccacagcaagacctgggagggacctgctgtggaagctgtgggtgcaggctgggatagatagggagggcatgcctcgctttggatgagggatccatttaaacactaccgtttggaattgagggctagaaggagaacatgatttcctgcaggagggacaaaggctgagtgttcacgtgccagcaggctccagaacacaccagggttaaagtttaactttctgtatgaattcattgttgggcccaaatccgcataggagcacggtgatcccgcgctcgggtttctgtanccttttcacaantcaggtgggttatccagccacgggtntcccagggaagaccctggtgtttcttgtgctgt

SEQ ID NO: 4638 - DNA, 467 bp, Mus musculus
ctgtgtgtgcactaatgaggatcctaaagatcgcccgtctgctgcacacatcgttgaagctttggaactagatggccaatgttgtggtctaagctcaaagcattaacttgtatgggaactgttaactagatatatgtagttaatataacttatggtagctagattctagaagtagctttaacactagtgacccctgtctaagatgacttaagaatcaagggaccattgctttgttacagatctttttagatattcttgcttctttagtgggttactaaaaatttcactacgtacatgtggtacagatatctgtctgctcatagtgtcagtccttcagctggcctgtcagcccatgcgccctgggacttgagaagagttcataaacgtagctcctagggtgtcttgcctctctacacttagcttctaatttattactttgtttctactgattgtgtcttaagtctttt

SEQ ID NO: 4639 - DNA, 466 bp, Mus musculus
ctgctgcctatgctgtacgagatgaccatcaggaacgcctccacagccgtgtacgcctgcagcagcccagcccaggagacctacttccagcagctggcacccactgcccgcagctctggcttcccaaaccctcaggattgcgccttcagcctcgcaggcaaagccaagcagaagctgctgaagcacggggtaaacctgctgtgagctgggtgcagcttgcatatcacgagggccatgtccccaatgctaacggttgagcgggcccttgctcctcagtggcagctgcaagaactgagtgggctcaggtcctgtcctgtggaagccttgagggcggtgcagagcaggctgcaggctcaggaatgcagcggcaggattcactgctgaccgtttacttgagatacccatggtgctttgtaaccgtatggtgcccagttccaggtttatgaagcagattcccaaaggctca

SEQ ID NO: 4640 - DNA, 206 bp, Mus musculus
tggagactggcagtgtcccaatccgggctgtggaaaccagaacttcgcttggagaacagaatgcaaccagtgtaaggcccctaagcccgagggcttcctcccgccaccctttccacctccgggtggtgatcgtggacgaggtggccctggtggcatgcgaggaggaagaggaggactcatggaccgtggtggtcctggaggaatgt

SEQ ID NO: 4641 - DNA, 483 bp, Mus musculus
  misc_feature (384)..(384): n is a, c, g, or t
caatgagagccttgggctttgatgtgaaaaaggctgatgtgttgaagattcttaaagattatgacagagaagccactggcaagatcacatttgaagattttaatgaagttgtgacagactggatactagagagagatccacatgaggagatactgaaagcatttaaactatttgacgatgacgattcaggaaagataagcttgaggaatttacggcgtgttgccagagagctgggtgagaacatgagcgatgaggagctccgggccatgatagaggagtttgacaaagacggcgatggagagataaatcaagaggaattcattgctattatgactggtgacatattaaagaatcaacaccaaaatgttacttttaccatctatncttctctttgtgtgcctggagtccagtttaagaaaacgaaacaaaacaaacgtagttctttttctgaaaggaacaaaaccaagcatcctttgtatgtat

SEQ ID NO: 4642 - DNA, 486 bp, Mus musculus
  misc_feature (79)..(79): n is a, c, g, or t
  misc_feature (339)..(339): n is a, c, g, or t
  misc_feature (413)..(413): n is a, c, g, or t
  misc_feature (434)..(434): n is a, c, g, or t
  misc_feature (449)..(449): n is a, c, g, or t
actcgtggaacttcgtctttggacaggcctccttgtcaagtggtgtgggcatattcagctttgccaggtatggcaaggnacttctacacctcgaaatacgaaggcaatgtgacgtctctgcagctaacgtctcccactgactactccatttttgataactattacatccctgaaatcactagtgttttgctgttgcgatcctgtaagactttaacccatgagatcggacacatacttggactgcgacactgccagtggcttgcgtgtttaatgcaaggctccaatcacttggaggaatctgaccggcgtcctctgaatgtttgccctatctgcttacgnaagctgcagagtgccattggcttcaatattgtggagagatacagagcactggtgaagtggattgacgacgaatnttgcaacgaatcaggagcaantccgaaaagtagttntgagcatgcgcatttgccgaaacctgtggaagccttt

SEQ ID NO: 4643 - DNA, 466 bp, Mus musculus
  misc_feature (324)..(324): n is a, c, g, or t
  misc_feature (371)..(371): n is a, c, g, or t
  misc_feature (399)..(399): n is a, c, g, or t
gcctggccgggaagcttccaaagatacctcaaagaccagttcaggacaaaaacgagcacacgaatcaaaatcatcaaagcaaatgaaggaatcacggtcccagaaacacacacggatgctgaaggaggtggtaaaagacaccttgaagaggcaccacatcacggaggcccatgagagcttcacggcctgcagccagagactcttcgacatctccaagttctacctgaaggatctgaaaacatcaaggggtctctttgaagaaatgaagaaaacagccaacaacaatgtggtgcaggtgatcgaatgggtggtagaaaagatgancaagaaataagctactgcaccccctttccttagagaactgtacacancctgtaaactttccccaaagagcagatncctcatttgtaaggagggtccatggtgtcctgtatctatatagttttgtgacactcagttattttca

SEQ ID NO: 4644 - DNA, 256 bp, Mus musculus
  misc_feature (128)..(128): n is a, c, g, or t
aaatggatgggattgaacagctaaaaaatgtgacagttttggcagctactaatcgcccagatagaatagacaaggctttgatgaggcctggaagaattgacaggatcatttatgtgcccttaccggangcagcaaccagaagggaaatactgaacctgcagttccactcaatgccgatcagtaacgaggttgacctggatgaacttgtcctccaaactgacacctactcaggagcagagatcatagcagtctgcaa

SEQ ID NO: 4645 - DNA, 556 bp, Mus musculus
  misc_feature (228)..(228): n is a, c, g, or t
  misc_feature (251)..(251): n is a, c, g, or t
  misc_feature (291)..(291): n is a, c, g, or t
  misc_feature (299)..(305): n is a, c, g, or t
  misc_feature (503)..(503): n is a, c, g, or t
gaggtggacaatgacccctgatgcccagccggccagcatcctgcaacctcacttagtcatcagaaaggcagctgtctgttgtttgtttgtttgttgctattgtttttaaattctgcattgtaagcaagagcggtgggtcattgggtccagccactgtggcccaggagtttggttcttagaaggaagactgcaggtgtctacaagttgttccttctgcattcctgcctntgggcacttggcagctcccatgngggggttggtttacttccttttaaaggaggtaatttcttncccccccnnnnnnnatggtttcccaacaacagacccagaaacttctagaactttgtgacatgagctgcacttggtggctggggactcttgttactgttaactgtgcctggagttagctacttgatagtcccctgaaaatcccagtgccccttgagaccacagcaaagaccacctggggcaggcctgagccctaagaactgtgcctttttttncaccaagtaggataccagtccatggctgttcacattcccatgactccaaataa

SEQ ID NO: 4646 - DNA, 526 bp, Mus musculus
  misc_feature (428)..(428): n is a, c, g, or t
  misc_feature (474)..(474): n is a, c, g, or t
tcaaaggctgctgggattccatccacgtggtggaagtgcaggagaagtccagcggccgtactgcccattacaagttgacctccacggtgatgctatggctgcaaaccaacaaatccggctcgggcaccatgaacctgggaggcagcctaaccagacagatggagaaagacgaaactgtgagtgactgttccccacacatagccaacatcgggcgcctggtggaggacatggaaaacaaaatccgaagcacgctgaatgagatctactttggaaaaacaaaggacatcgtcaacgggctgaggtctgtgcagacgtttgcagacaaatcaaagcaagaagcgcttaagaacgacctggtggaggccttgaagagaaagcagcagtgttgaagacctctgcttcacgctaaccggacacgccatgcactncgttaggttcctttctttagaaaactcgttttctgctccttttccntcttcctttcccgccctgacaggtcacataacagtttgcatcgaccacgcag

SEQ ID NO: 4647 - DNA, 555 bp, Mus musculus
  misc_feature (50)..(50): n is a, c, g, or t
gagcaacgtgatgtaaccacacctgagagcaggtactgtcctgtgttacnaaaagaatcacatggaaaattgttaaccaaaataagtgtagatttcagaatcattccagctctactcttaactgtcctgaatttgttagaaactgatttgaaagaaatgttttcttaaaattccatacacacacacacacatattatgaattgtctttaattgtagtcagaatttattataacaatatttgatttggaccattttaaacattccctattttaaaattcatacggcttccttaagaagtagaatgaaagggtaaattggtgacatgtttgctctctgcattttctaaccttctaccgaattgtgactgactcagagagctctagcatttaccagtgaggttcagaaactaaactctcaggaattcattgcatctgttgtagaagtgcttctgggtctgagcctggcctcctcagagtggtaatactgcccacttcctctggaaaataggcagggctaatgagaaactaatcaaaatgattaacctctgcggccctt

SEQ ID NO: 4648 - DNA, 459 bp, Mus musculus
tctcgcaacgagtttgaccggaccatcgcagaaaccgaggccgcctacctcaagatcctggagagctctcagactctgcttagtgtactcaaaagagaagctgggaacctgactaaagccacagcttcagaccagaagagtagtggaggcaaggacagctgacgagtgcctgtttcagccgtggcctatggctgcttagtcctcaacatgtctgtcctaaagcatctttgttcttcgtggcctcagatgtcttttatctctggtgcccagaggggcaatttctgacctccacctgcctagacaagaaaagccctaggacagtccaatggaagaggtgttcccagctccgtactcacatgtgctgtggggaccctgagcagctccatgaggggcctctctctgaagctcctgaatccctttgggctaccaggaatgtcctggtcctggtctgagtactgt

SEQ ID NO: 4649 - DNA, 482 bp, Mus musculus
  misc_feature (345)..(345): n is a, c, g, or t
  misc_feature (398)..(398): n is a, c, g, or t
tttgggatccggaatgtcacacacattgaccaggctctccaggaagcccatcgggtcctaaagccaggaggccggtttctctgtctggaatttggccaagtgaatgaccctctcatatccaggctttatgatctgtacagcttccaggtcatccctgtcattggtgaggtcattgcaggagactggaagtcctaccaataccttgtggaaagtattcggaagttcccaaatcaggaggacttcaaggacatgattgaagacgcaggctttcagagggtgacgtacgagaacctgactacagggattgtggccattcactctggcttcaaactctagctccttttnctactgtggcacacaggccagtcatttctactgaaccccggggccagatcatntccctgatgagacagtagctgaccattcgtctcctcttacggccgttaagactttggattagctctcattagtagctgcccagg

SEQ ID NO: 4650 - DNA, 269 bp, Mus musculus
agaagcaatttcctcagtcctttggtcagacgctgaagaaatctgtagtgcatcttgggatcacacaattagagtgtgggatgttgagtctggcggtcttaagtcaactctgacaggaaataaagtgtttaattgtatttcctattctcccctttgtaaacgtttggcatctggaagcacagacaggcatattagactgtgggatccccgaactaaagatggttctttggtgtcgctgtctctcacctcacacacaggctgggtgacat

SEQ ID NO: 4651 - DNA, 475 bp, Mus musculus
  misc_feature (328)..(328): n is a, c, g, or t
  misc_feature (353)..(353): n is a, c, g, or t
  misc_feature (356)..(356): n is a, c, g, or t
  misc_feature (365)..(365): n is a, c, g, or t
  misc_feature (368)..(368): n is a, c, g, or t
  misc_feature (375)..(375): n is a, c, g, or t
  misc_feature (390)..(390): n is a, c, g, or t
  misc_feature (398)..(398): n is a, c, g, or t
  misc_feature (438)..(438): n is a, c, g, or t
  misc_feature (448)..(448): n is a, c, g, or t
gtctcgcaatgggagcaactttgtaggcaaagttagatccaatgtcttgggcacgaaattcaccatcttcgataatggggtgaaccctgagcggagttactgggttccagacagtgcccggatcagagaggagctgggagtcgtctgttatgagaccaatgtcttgggattcagggggcctcggaaaatgactgtgatccttccaggaatggacagccggaagcagaggatgaaagtccagccacaaaatgatcaggattccatattgagtcgcgtacagaagggcgctggacacgggctgcttctactgcagaacaaggccccatcntggagcgacgaaagcggcgcatacntantcaattttnacnggtcgcntcacgcgggcttcantcaagaanttccagatagtgcacccggatgaacccgaccacctggtgntccagtttgnccgtgtggccccaaacatattcacgat

SEQ ID NO: 4652 - DNA, 541 bp, Mus musculus
  misc_feature (212)..(212): n is a, c, g, or t
tggacctgtgcaaagattcctctttctctcaggatggagccatcctgcctcagtggctctgctccaattgtcaagccccctatgactcctctgccattgagtcagccttggtggaagccctgcagaggaaactgatggccttcacacttcaggacctggtatgcctcaagtgccgtggtatgaaagagacccatatgcctgtgtactgcagntgcgcaggggactttactctcaccatccgcactgaggtcttcatggaacagattagaatcttccagaacattgccaagtactacagcatgtcatatctccaggagaccatagaatggctgttacagacaagccctgtatcaaactgttagcaagcctaggctaaagacactttggtatcccacacctactgcctgctccaaaaggcagaaccactgaccaccttgcttttccaaactcatgagcacagcccagaaggaacagaagacttctgctaacgtcatcatgccataaacagacagaagcagggaatggctctatccctagctgc

SEQ ID NO: 4653 - DNA, 215 bp, Mus musculus
  misc_feature (96)..(96): n is a, c, g, or t
  misc_feature (159)..(159): n is a, c, g, or t
tccatggtacagtttattggcagagagtctaagtactgtggactgtgtgactccatagtaaccatctaccgggaagaaggcatcgtaggatttttngcgggtctcattcctcgcctcctaggtgacatcatttctttgtggctgtgtaactcactggcntatctcatcaatacctatgcactggacagtggggtttctaccatgaatgaaatgaa

SEQ ID NO: 4654 - DNA, 466 bp, Mus musculus
  misc_feature (151)..(151): n is a, c, g, or t
  misc_feature (153)..(153): n is a, c, g, or t
  misc_feature (275)..(275): n is a, c, g, or t
  misc_feature (315)..(315): n is a, c, g, or t
  misc_feature (375)..(376): n is a, c, g, or t
  misc_feature (378)..(378): n is a, c, g, or t
  misc_feature (381)..(382): n is a, c, g, or t
  misc_feature (387)..(387): n is a, c, g, or t
  misc_feature (389)..(395): n is a, c, g, or t
  misc_feature (398)..(398): n is a, c, g, or t
  misc_feature (400)..(400): n is a, c, g, or t
  misc_feature (403)..(405): n is a, c, g, or t
  misc_feature (407)..(408): n is a, c, g, or t
  misc_feature (410)..(412): n is a, c, g, or t
  misc_feature (414)..(418): n is a, c, g, or t
  misc_feature (421)..(422): n is a, c, g, or t
  misc_feature (424)..(425): n is a, c, g, or t
  misc_feature (427)..(428): n is a, c, g, or t
  misc_feature (430)..(440): n is a, c, g, or t
gaagagctcgaatatgtcacttagttcagccattggacacagttctggatgatagcattggctgtgctgtgtggtttgcttctagaggaatcggttggttggtgacccaagatgctgtgagatcttacaagagcagtgcaaaggtgattcntnactgggattggtgcagatgagcagttggcaggttattcccgtcatcgtgcccgctttcagtctcttggcctagaaggactgaacgaggaaatagcaatggaattgggtcgcatttcttctanaaaccttggtcgtgatgacagagttattggtgatcatggnaaggaagcaagatttcctttcctggatgaaaatgttgtgtctttcctaaattctctgccnntntgnnaaaangnnnnnnncantntgnnncnngnnntnnnnnacnngnnanntnnnnnnnnnnngcatctgataagtgtggaaggctcca

SEQ ID NO: 4655 - DNA, 544 bp, Mus musculus
  misc_feature (125)..(125): n is a, c, g, or t
  misc_feature (284)..(285): n is a, c, g, or t
  misc_feature (321)..(321): n is a, c, g, or t
  misc_feature (390)..(390): n is a, c, g, or t
  misc_feature (420)..(420): n is a, c, g, or t
  misc_feature (465)..(466): n is a, c, g, or t
  misc_feature (484)..(484): n is a, c, g, or t
agcatgtaatgccattcgtttcatggctaaacacacagactccttgcattttaaaattctgtgcctttacttcctggagctataataacgtgcttgggtgtgtgacttgccgaggttggctttcncaatgctttatgtaaactctgctgttggcacttgcagctgtagaagctgtcggagggattacttacttacggttatagcatctggggtctcttgcagctgcaatgcctgggatcttttgcaactctgactttttcagtagcagcttggaatgttaaaanntatggtgagcctcttctctgtgaaggaagggcctgnacaatctgccagccagggagtcctgttaaagactgggaactcagtgcagtggttttcctgcctttcccnttctcctttggtctatagtgatactgacancaatacaaagtaaaatctgtgtatataaaaatcctaagtatgagnntcttaaatgttctggaanttttagaaaaaacttaattggatgcaattgtttataattaaccaagtcatcttatttata

SEQ ID NO: 4656 - DNA, 466 bp, Mus musculus
  misc_feature (45)..(45): n is a, c, g, or t
  misc_feature (437)..(439): n is a, c, g, or t
  misc_feature (441)..(441): n is a, c, g, or t
gagctggattcttacccagacagtgtaaaaaaggaaaacaaaaanccagtaaacaacctgatccgcaaagactacttagaggagcctgagaaaactcagtggaataatgtagagaacctcactaggtttgaaagaccgatggattactatgaagatctaaaaatgggaatgaagtttgtcagtgatgaacgctacaatgaaagtgaagatggtttggtttctcatgtagatggctccgtaatttccaggagggagtggtatgtctaacagccactgacgcgacttcactatgtacaaggtttcattcacactagttgaccattttcagattgttcatactttttcttgaggaagaataagctttttcaagttgatttcgagcttactttttatattctgatctgacaaatgaaaatgtaaaacctgggttcaatgtnnntntgagctgctttacagttttcactgc

SEQ ID NO: 4657 - DNA, 487 bp, Mus musculus
aagagagttcggatacctctgcctgtatcaaatatactttgggagcattgtatacgattagctaacagaactattgtggaaggatacgccaatgtcaagaaatgcagtaatgaggggcgtgccttgatgcaattggattttcaacagtttttaatgaaactcgaaaaactaactgacattagacctattcctgataaagaatttgtggaaacgtatatcaaagcctactacctaactgagaatgacatggagcgttggatcaaagagcacagggaatactcaacgaagcagttgaccaacctggtgaatgtttgcctaggatctcatatcaataagaaagcaagacagaagctcctagcagctatagatgagatagacaggcctaaaagataatgaacagagctctttcctcggggacattgatcttctttcggcctgtacgacatgaaaggcagttcttcatacactcctcataattctcttctaa

SEQ ID NO: 4658 - DNA, 401 bp, Mus musculus
  misc_feature (142)..(142): n is a, c, g, or t
  misc_feature (201)..(201): n is a, c, g, or t
agaacaatctacttccctagctgaccaatcaactctgccaacttctctacccatgacaacccagtatacgtatgagaagacttcgggggctgggccaaatcaacagaggccgggtgagacccagaaatccgtgctagatccntccacgacatggtcgtggctcctggcgacagtatgatcggaggcacccaaaaggagggngagtgctgcaccccaaaaggtaccagtgaaatccatgaactgccacctcctgagaagcctctcaaggagactgtagacttaaaggcagaaccccgtaacaaagggctcacaggtcatcctcaggagaaggggcctggtagctggcagggcccctcagctcgcaggactcgggactgtgctcgctgggaacgctccaaaaa

SEQ ID NO: 4659 - DNA, 470 bp, Mus musculus
  misc_feature (197)..(197): n is a, c, g, or t
gagttggtacgctgcattcgatttgataacaaaaggatagtgagcggacgctatgatgggaaaattaaagtgtgggatcttatggctgctttggacccgcgtgctccagcagggactctctgtctgcggacacttgtggagcattctggaagagttttccgcctccagtttgatgaattccagattgtcagtagttncacatgatgacacaattctcatctgggacttcctgaatgatccagctgctcacgctgaaccgccccgctccccttctcggacatacacctacatctccagataaataacccaacactggcctcataattgcccaggactcgttaatgttgcagtatttaacagacctgccaagaccaggatgaacaacaatcaaactcctacccggattcccggacggatgagcgaggagcagggctttgagactcctgttgggacacagtcggtcagcagcc

SEQ ID NO: 4660 - DNA, 390 bp, Mus musculus
  misc_feature (316)..(316): n is a, c, g, or t
  misc_feature (360)..(360): n is a, c, g, or t
tcacaggctctgttgtcatgaaggtgaaaattaaatgttggaatggtgtggccacttggctctgggtagccaatgatgagaactgcggcatctgcaggatggcgtttaatggctgctgtccagactgtaaggtgcctggtgatgactgccccctcgtgtggggacagtgctcccactgcttccacatgcactgcatcctcaagtggctgaatgcgcagcaggtgcagcagcactgccccatgtgtcgccaggagtggaagttcaaagagtgaagcccgtgccgtgccacttccctctcctgtgctgtgccaggctncagccccttccctccctcccctcccccagatacagcaccccaantcccctccacacagcacagtggtgcccaga

SEQ ID NO: 4661 - DNA, 413 bp, Mus musculus
  misc_feature (350)..(350): n is a, c, g, or t
aattcggtgaggtgattcccgattatgtgctgggccagagcacctgcgcccttttcctcagcctccgctaccacaacctccatccagactacatccatgaacggctgcagagcctggggaagaacttcgcccttcgtgtgctgctggttcaagtggatgtgaaagatccccagcaggctctcaaggagctggctaagatgtgcatcttggctgactgcaccctggtcctggcctggagtgcagaggaagcagggcggtacctggagacctacaaggcgtatgagcagaagccagccgacctccttatggaaaagctggagcagaacttcctatcacgggccactgagtgntctgaccaccgtgaaatctgtgaacaagaccgacagccagaccctcctggctacatttggatc

SEQ ID NO: 4662 - DNA, 516 bp, Mus musculus
  misc_feature (163)..(163): n is a, c, g, or t
  misc_feature (175)..(175): n is a, c, g, or t
  misc_feature (385)..(385): n is a, c, g, or t
  misc_feature (425)..(425): n is a, c, g, or t
agatccactgtgtgacttccaagttaaaaagggagagtgaagcacaagatcaagctttaaacttttagaagttctaagctttccaagtcttatttctctaggataaggcccatcctttctgatctcctctcttcccacggttcatattaagatttacttggangtggagtaggcnaatactttgaaagggcttgccaaattttaactacattcaaggttaacttctgggaaaacacccatgcttagactactgcatatgtccacagctcctctgatagtgactgtggcaaaggctcacatgttatacagagtggtcctgaaaggaagacttcttagaaacaggtcctgcatggttcatttgaggctatccatctttgatatgatnccaagctctgcctgtgacattgcatggacggcacagtagntcccaagggatattgacaattaagaacaggaaacataggttgctacagggaatgagggagaagccagagacaggctaaagacacctcctca

SEQ ID NO: 4663 - DNA, 476 bp, Mus musculus
  misc_feature (296)..(296): n is a, c, g, or t
agatccaagctgtgaagacgtgaagagatagtccctggagacctcagtgatttttcaatgaatggaatctgcgtaaggcatactggttaatctcaaatttattttaaaagatatatgtaactgagaattttttaaaccacattctgcttgctttggtggactctggaagaacgttttaagggctttaggacttgagacattgttaatctggccattactatacaaaatctaataattctttggaactccttagttaccaacttcttgtaaaagtctacatcattgtgataagtagnatatataaataccacttataagccatctcaatatcctatcatgatttatgatatatttgatgtatttttattttcaattgttttctaaaagtttagttcattgtatgactttgaagtgcaaattgtgttagcgaaacacctttaaagatttataagggatcccaggtaattagtatatat

SEQ ID NO: 4664 - DNA, 265 bp, Mus musculus
ggatacatgctaacggcatctcatctcatcctggacaggtccaagccccaaagagataacaggctccaagcagggccagtcaagcccagatgatcgacccatctgcttgactatagactttctgtccaattcatggttaataccaagataacctggggggcctgtgttagggttccccaagtagccacaggggtcagcaccatatccacgcctcccaacaaaactccaaaacctgtgctcagggcagtgcctgagcccctgcagt

SEQ ID NO: 4665 - DNA, 76 bp, Mus musculus
aaagcatggactgtgccaaacacccagtgatccatccaaaaacaaggactgcatccaaattccaaataccagagac

SEQ ID NO: 4666 - DNA, 352 bp, Mus musculus
gaccggctgtcttctgctgcttgagcggcgcccgcaccttccctaggagctcgcagcagccggctggcctctgctccacggtaaccatgtgcgaccggaaggcggtgatcaaaaatgcagacatgtcggaagagatgcaacaggactcggtggagtgcgctacccaggcgttggagaagtacaacatcgagaaggatattgcggcccatatcaagaaggagtttgacaagaagtacaaccctacctggcactgcattgtgggccgaaacttcggtagttatgtgacacatgaaaccaaacacttcatctacttctacctgggtcaggtggccattcttctgttcaaatctgg

SEQ ID NO: 4667 - DNA, 177 bp, Mus musculus
ggaggacttgacataattaaggagctggaagcatcagaagagctggacacgatctgtcccaaagcacccaagttagaggaaaggctcaaagtgctgaccaataaagcttccgtgatgctctttatgaaaggaaacaaacaggaagcaaaatgtggattcagcaaacaaattctggaa

SEQ ID NO: 4668 - DNA, 254 bp, Mus musculus
aatatcctggcaacatatcatcccgctgacaaagactatggcttgatgaaaatagacgagccaaacaccccatatcacaatatgataggtgacgatgaagacgcctatagtgattcagaaggcaatgaagtcatgactccagatatcttagctaagaaattagctgctgctgaaggctcagagccaaagtatcggactcgggagcaagaaagtagtggagaggaagataatgacctctcccctgaggagcgaga

SEQ ID NO: 4669 - DNA, 379 bp, Mus musculus
accggcgtttccttaagctctgtgaggaatggccagtggacgagaccaaacggggccgggacttgggcgcttacctgcggcagcgggtagcgcaggccttccgggagggagagaacacccagattgcagaacccgaggcctgtgatcagatgtacgagagcttagcacgactgcattcaaactactacaagcacaagtaccctcgccccagagacaccagcttcagtggcctgtccgtggaagagtacaagctgatcctgtccacagacactttggaagagttccaagagatgaataagagcatgtggaagaaactgcaggagaagtttgcgcccaccaggcctgaggagaagcacaaggcctggactcgggtcctgtc

SEQ ID NO: 4670 - DNA, 94 bp, Mus musculus
tcttgcattttgagcatggagtaacaaccttgcttgtatcagcaacgtggactctcagctttgctgaatgttcagaacgactggtgataatttt

SEQ ID NO: 4671 - DNA, 170 bp, Mus musculus
ttttaatccaggtgctggtttgccaactgacaaaaagaaaggcgggccgtctgcaggggatgtggaagcaatcaagaatgccatcgcaaacgcgtcgacgctggctgaggttgagaggctgaagggcttgctgcagtcgggccagatacctggcagagagcgcagatcag

SEQ ID NO: 4672 - DNA, 513 bp, Mus musculus
  misc_feature (379)..(379): n is a, c, g, or t
  misc_feature (411)..(411): n is a, c, g, or t
  misc_feature (423)..(423): n is a, c, g, or t
gaagcattatcgactttatgtgatttataaagttccacaagtcagagtactggactttcagaaagtgaaactcaaagagcgtcaggaagcagagaaaatgttcaagggcaaacggggtgcacagcttgcaaaggatattgccaggagaagcaaaacttttaatccaggtgctggtttgccaactgacaaaaagaaaggcgggccgtctgcaggggatgtggaagcaatcaagaatgccatcgcaaacgcgtcgacgctggctgaggttgagaggctgaagggcttgctgcagtcgggccagatacctggcagagagcgcagatcagggccgagtgatgagggtgaagaagagatagaagacgacacagtcacaaatggntcctgagctctgccagatgctctgataagctntcttgggacaantcttgcattttgagcatggagtaacaaccttgcttgtatcagcaacgtggactctcagctttgctgaatgttcagaacgactggtgataa

SEQ ID NO: 4673 - DNA, 195 bp, Mus musculus
gggctggccagtttctcatgcatgcagcttgatgattgagcacagtcaggcatttgtattaaaactgaaaaatggaaaaaacaaattcaaaatctcagatggcttctagttcaatctgttcagataaattgtcagcagccagtttactgcaagcaaacatttaaaattggtttacctcaggatgattgatgtgca

SEQ ID NO: 4674 - DNA, 61 bp, Mus musculus
gaattcaaggaagctttctccctattcgataaagatggtgacggcaccatcacaaccaagg

SEQ ID NO: 4675 - DNA, 324 bp, Mus musculus
  misc_feature (254)..(254): n is a, c, g, or t
cgttccccaggcagccagggtgtgagggatttcatcgtgcaacggtacgtggagctgaagaaggcgcaccccaacctgcccattctgatccgcgaatgctcggaggtgcagcccaagctttgggcccgctatgcttttggccaagagaagacggtgtctctgaacaatctgagtgctgatgaggtaaccagagccatgcagaatgtgctaagcggcaaagcctgaaggtctccactgaggactgtgagcgagancagctgaacctgctggactgaagacagtgtggggaaatgtgtgctttgggtccttataaagcttacgctg

SEQ ID NO: 4676 - DNA, 531 bp, Mus musculus
  misc_feature (296)..(296): n is a, c, g, or t
  misc_feature (410)..(410): n is a, c, g, or t
  misc_feature (412)..(412): n is a, c, g, or t
  misc_feature (453)..(453): n is a, c, g, or t
  misc_feature (467)..(467): n is a, c, g, or t
agtccttacttttgcactttcagaagaggtccgtccgcaggacactgtgtcggtgattggtggagtggctggaggcagcaagcatgggaggaaagctgcttggaaattcatcaaggacaactgggaggagcttcacaaccggtaccagggagggttcttaatatccagactaataaagctctcagttgaggggtttgcagttgataaaatggctggagaagttaaggctttcttcgagagtcacccagctccttcagctgagcgcaccatccagcagtgttgtgaaaatatcctgntgaatgctgcttggctcaagcgagatgctgacagcattcaccagtacctccttcagcggaaaacctccccaccctcggtgtgaggcctcctccgcacctgggcctcactgcctntntgcagggatgaggtggagctaccaaacagctgactcacatnccaagaatctggantcttacaccagtgggggttggacaatgaatgtagtaggtccctgctcacactccagaattaaat

SEQ ID NO: 4677 - DNA, 525 bp, Mus musculus
  misc_feature (485)..(485): n is a, c, g, or t
tcactctgattgttatggccgcggccgtcgctatggagacagatgatgctggaaatcggcttcggtttcagttggagttggaatttgtgcaatgtttagccaacccaaactaccttaattttcttgcccaaagaggttacttcaaagacaaagcttttgttaattatcttaagtatttgctttactggaaagaaccagaatatgccaaatatctaaagtaccctcagtgcttacatatgttagagctgctccagtatgagcactttcgcaaggagctggtgaatgcgcagtgtgcgaagttcatcgacgagcagcagattctgcactggcagcactactctcggaagcgggtgcgtcttcagcaagccctggccgagcagcagcagcagaataacacagcagggaaatgaagagctggggccaggtcaggctcttaggacgtgtatataatgtattgctattgtacagtacagagaaaaagactnttctgccccctttactgtagccctcagaaccattagtgtt

SEQ ID NO: 4678 - DNA, 458 bp, Mus musculus
  misc_feature (348)..(348): n is a, c, g, or t
  misc_feature (432)..(432): n is a, c, g, or t
aaggttcaacttgcttgcagcttctcttacagcccccatggtgagggagataaatgaaataaaggaactttgggtgtgttactaaaggtagcggtctactctgacaggacccatctgaggccacgtggctgagttgggtctgttcatctgtcttaggtaacgatcaataccagcatgaattgggtctgttcatctgtcttaggtaatgatcaataccagcaaaacaaaagtggctttaggttggtggtgatacttttcttaagttgtctgactacagttaagcatttctcaaaaatgtccccaaagaaatgtgaaaggatttgccacgggacttaagaaatgacaaanccacctccccttgtgtccccacacagaaatgctgcagagtgtttaaaacttgagacattttgtaggacgcctgacaaagcgtancctttttcttgtgtcaggatgcgtat

SEQ ID NO: 4679 - DNA, 525 bp, Mus musculus
  misc_feature (197)..(197): n is a, c, g, or t
agaaagcccattccgaggtggcccaggttcgaagtgaggtctcacaggcgagaagggaaaaggacaacatccagactctcttgaaagccaaagagcaggaagtaactgcgcttgtgcagaagttccagcgagctcaggaagaactggctgggatgcgaagatgctctgagacctcgtcgaagctggaggaggataangatgaaaagataaatgaaatgaccagggaagtcctgaagctgaaggaggccctgaacagcctctcgcagctctcctactccacaagttcatccaagaggcagagccagcaactggacctgctacagcagcaggtcaagcagctgcagaaccagctggctgaatgtaagaaacaccaccaggaggtcatctcagtttacagaatgcatcttctatatgccgttcagggccaaatggatgaagatgtccagaaggtcttgaagcagatcctcaccatgtgtaaaaaccagtctcagaagaagtaaaaatggattctttggcaggacactt

SEQ ID NO: 4680 - DNA, 429 bp, Mus musculus
  misc_feature (106)..(106): n is a, c, g, or t
  misc_feature (169)..(169): n is a, c, g, or t
  misc_feature (171)..(171): n is a, c, g, or t
  misc_feature (182)..(182): n is a, c, g, or t
  misc_feature (189)..(189): n is a, c, g, or t
  misc_feature (197)..(197): n is a, c, g, or t
  misc_feature (367)..(367): n is a, c, g, or t
  misc_feature (371)..(371): n is a, c, g, or t
agatgaagttcctctggcagtggcatgagtgctgaaggctctttccctgcccttcacctgctttcttgatagtctctctgcataccaaacaggcccttgtctcctnggaaatggaaactatgaaatcaatagctgaggcttctctaggaaagcctgccctggtcagtanancctgtttcacngcttctntagaatanttacatcagccttctgaagatggcctcttagagcacatgcacccccaagattctaagatgtcaatactaactgaccaaaccatacctctctagccagccctgctgctcctgttgtcttggtacccaggtgactgaggacatgactggtggaaggaaactaggcccctttntctntcagatggccatacccagcatggctgatgcccagtgtataagaccctacgcttttcca

SEQ ID NO: 4681 - DNA, 484 bp, Mus musculus
  misc_feature (386)..(386): n is a, c, g, or t
  misc_feature (435)..(435): n is a, c, g, or t
  misc_feature (457)..(457): n is a, c, g, or t
  misc_feature (459)..(459): n is a, c, g, or t
ggagcagactgcaaagcgccggaaaaagcgccagaagttaaaagagaagaagttactggcaaagaagatgaaacttgaacagaagaaacagaaggaagaacccagtcagtgccaggaacagcatgccagcagctctgacgaggcatctgaaacagaggaggaggaagaggagcccagcgtcgtcatcatggggcgatgaggagtttcagcagtcgtgagcccagctcattctgtgaccagcctcagaagagaaatggctgtgtgtgaccagctgctagactggctgtgttgggagaaggcaggcacctcctgcagccctgcctgcctggggagcagagggagcagaccttagacatttgcagattgcattctgtatcctgccctgntcttgctgaaggggagtgagtgcttcaccttccccgggtgccgttcccnttctgcttgaacagcagtgagntntgcgctggtttctgtgaagggaata

SEQ ID NO: 4682 - DNA, 423 bp, Mus musculus
  misc_feature (59)..(59): n is a, c, g, or t
  misc_feature (67)..(68): n is a, c, g, or t
ccttacctcggtggacttgtatatattctagagaagggcgtgggttgcaccgtcgccangcccgttnnccattcctcagccccttcctcgagatctctggaactaagctgtgtttttgcttttcccctgagcacaccagagccccaccttcacggagtagtgccaacaaggtgggggaatggaaaagggaccttttgagcatcctagagtcacagagccaacagtcaggttgtgctagtttgtgcctgaagtctgtgtttgtgttgtgggacaaggcctttgagtcttaacgattgtcctttctcctcttgaaggatacgccccttatttctgtactaccccacccttgccatggggatcccaaattgggttgtcatgaaagtgggtggacacaaggtgggagccgcgtagtataggtcttaa

SEQ ID NO: 4683 - DNA, 505 bp, Mus musculus
agccacgagatttctgtactatgaaatgggctacaagtctcgaacagaacaacttacagatagcactgaaatcagcctgctgccttcagacatcgataggtacaagaagagatttcacaagtttgatgaagatgaaaaaggcttcattaccattgttgatgttcagcgtgtcctagagagtatcaatgtacaaatggacgaaaacacactgcatgaaattctctgcgaagtagatttgaacaaaaatggacaggttgagctgcacgagtttctgcagctgatgagcgcagttcagaaaggaagggtctctggaagccgacttgccatcctgatgaaaactgccgaggagaacttggaccgcagagttccaatccccgtggaccgtagttgtggaggattgtgagtctgaccagtaaatccgccaccagcaagcataggacagccagcgctatgtacaaccagagatgacttaaactctaaaatagtggatctcgtagctgccttt

SEQ ID NO: 4684 - DNA, 446 bp, Mus musculus
  misc_feature (77)..(77): n is a, c, g, or t
  misc_feature (81)..(81): n is a, c, g, or t
  misc_feature (91)..(91): n is a, c, g, or t
  misc_feature (105)..(105): n is a, c, g, or t
  misc_feature (116)..(116): n is a, c, g, or t
  misc_feature (118)..(118): n is a, c, g, or t
  misc_feature (121)..(122): n is a, c, g, or t
  misc_feature (129)..(130): n is a, c, g, or t
  misc_feature (133)..(137): n is a, c, g, or t
  misc_feature (140)..(141): n is a, c, g, or t
  misc_feature (143)..(148): n is a, c, g, or t
  misc_feature (161)..(161): n is a, c, g, or t
  misc_feature (321)..(321): n is a, c, g, or t
  misc_feature (341)..(341): n is a, c, g, or t
  misc_feature (353)..(353): n is a, c, g, or t
aaacaagtgttttcgaggtgagcaaggggacctgatgtaattgccaaagccagcttgagggtgataactcttgaatngganttttcctttntgtcaggccaaggncctgaaaaatncntgnntaacagnnaannnnnatnnannnnnnattttcagaagangccagtgggtcccatagtgtcctcactggtcccagcagatgtcagtatacaaaacataatcaatccctgggcaatcttgtgctctactttatcttcatccttagccacgtcctcctgtcatttgtctcggagtcacgttttggagagacaggaagtattntcttagaaactaggttgggnaaatgttcaacnatagagctgagatttaaattttgagtttaaaaatgtacatcaggagcaatggaaagggtgttttcttaaaggcatttctaatttgcttttctg

SEQ ID NO: 4685 - DNA, 367 bp, Mus musculus
  misc_feature (340)..(340): n is a, c, g, or t
gttgagcaacatcagtcttcttggaatgataaagatgtgtccaggtcttcactgtgccagtacatgatgccagatgaggagacaccattggcagctcaggcctatgggctttctcacagagatatcaccactattaaacttctcaatgagacaagagacatgctggaaagtccagattttagtacagttttgaatacctgtctaaacagaggcttcagtcggcttctagacaacatggccgaattctttcgacccactgagcaggacctacagcatggtaactccataaacagtctgtccagtgtcagcctgcctttagctaagataattcccatagtgnacgggcagatccattcagtttgcagtg

SEQ ID NO: 4686 - DNA, 398 bp, Mus musculus
  misc_feature (335)..(338): n is a, c, g, or t
tgacatcctgcgagactacaaggttatcatggctgaaaacatccctgaaaaccctctgaagtacctctaccctgacattcccaaagacaaagcctttggcaaacactacagctcccagccgtgcgaagtctcaagaccaaccgaacggggagacaagggttacgtcccctctgtttttatccccatttcaacaatccgaagcgattccacggagccacaatctccttcagaccttctccccatgtctccaagtgcatatgctgtgctgagagaaaacctgagcccaacgacaattgaaactgcaatgaattccccatattctgctgaatgacggnnnnaaacggacactttaaagaaggaagcagatgaaactggagagtgttctttaccatagatca

SEQ ID NO: 4687 - DNA, 544 bp, Mus musculus
  misc_feature (45)..(45): n is a, c, g, or t
  misc_feature (127)..(127): n is a, c, g, or t
  misc_feature (356)..(356): n is a, c, g, or t
  misc_feature (367)..(367): n is a, c, g, or t
  misc_feature (376)..(376): n is a, c, g, or t
  misc_feature (389)..(389): n is a, c, g, or t
  misc_feature (412)..(412): n is a, c, g, or t
  misc_feature (421)..(421): n is a, c, g, or t
  misc_feature (484)..(484): n is a, c, g, or t
gaaccgagttgctgcccaggaggtacctattgagatcaaggtggntgaacccacccaccctgacccagctgcaggcactggagcccaaacagatgttctgggtgcgtgcccggggctacattggggnaaggtgacatcaagatgcattgctgtgtggctgcttatatctctgactacgccttcctgggtacagcactgctgccccaccagtccaagtataaggtgaacttcatggcgtcactggatcactccatgtggtttcatgccccattccgagccgaccactggatgctgtacgagtgtgagagcccctgggctggtggctctcgagggctggtgcatgggcggctgtggcntcgggatgggntccttgctntgacctgtgcccnaggagggtgtgatccgattgaancctcaggtntcagagagtaagctatagtgaaagatgcctggctcggcctggggctaaaaggactttgcactnccatttctgaggcaggagtcacagttgagagctgggcttcctgcctcttacatacaataa

SEQ ID NO: 4688 - DNA, 281 bp, Mus musculus
gagagaccaacttaatgcagacctgaactccatggaaaagtccttttctgaccttttcaaacggtttgagaagcggaaagaagtgattgaaggctaccagaagaatgaagagtcactgaagaagtatgttggggaatgcatagtgaaaattgaaaaagaaggccagaggtaccaggcgctgaagatccatgcagaagaaaagctcaggctggcaaatgaggagatcgcccaggtacacagcaaggcccaagcagaggtactggctttgcaggcaagcctga

SEQ ID NO: 4689 - DNA, 353 bp, Mus musculus
agctgaacaattcaacggcgctgaagaccctggtggaccaaatcctgtcccagacagccaatgacctgcgcagacagtgcgaagtggtagacgaggcattcataaatgggctgaaggagaccaaggatgccaggaacaagctggctgatcatctggccaaggttatggaagaaattgcttcccaggaaaaaaacatcatggctcttgaaaatgccatcacgcagcaagaagggccagccaaggtagcacacacacgcctggagaccaggacgcaccggccgaacgtggagctgtgtcgagatattgcccagtatcggctgatcaaggagattcaggagatcaaccacaatgtt

SEQ ID NO: 4690 - DNA, 561 bp, Mus musculus
  misc_feature (47)..(47): n is a, c, g, or t
  misc_feature (333)..(333): n is a, c, g, or t
  misc_feature (335)..(336): n is a, c, g, or t
  misc_feature (338)..(338): n is a, c, g, or t
  misc_feature (374)..(374): n is a, c, g, or t
  misc_feature (533)..(533): n is a, c, g, or t
agaacttcaggtctctctttttcaaaccatggtgctgctaatgtttnaatgaaggagaagaattcagtttagaagagatcaagcatgctactgggatagaggatggagaattaagaagaacactgcagtcactagcctgtggcaaagctagagttctggctaaaaatcctaagggcaaagatattgaagatggtgacaaatttatttgtaatgacgatttcaaacacaaactattcaggataaagatcaatcaaatccagatgaaagaaacggttgaagaacaagcaagcactacagaaagagtatttcaagacagacagtaccaaattgatncnncngatcgttcgaattatgaagatgagaaaaacacttanccacaatcttcttgtttcagaagtctacaatcagctaaaatttccagttaaacctgctgatcttaagaagagaatagaatccctcattgaccgggactacatggaaagagataaagaaaatccaaatcagtacaactatattgcatagaatgttggccnttggaacttgtcataatgctgtagccat

SEQ ID NO: 4691 - DNA, 249 bp, Mus musculus
gcagttgtagaaaacacagttccatagtgacagtcacaaaggacttactctgccacaaatgggcactgagaggaagatgtgacgtctgtctccttgagacctctgagccatgcttctgccaggaggaggagagcatgggagtgtcggtgtgaccctcccaccgtgatggctgctggccggcattcgtggcactgtgttgtcaaataaaggagtcttgaaaacatttcttgggcagcagagctcaggccc

SEQ ID NO: 4692 - DNA, 108 bp, Mus musculus
agtgtacaaacctttcatccatacctgtgcatgcgctgtattcttcacagcaacagagctcagtcaaatgcaactgcaagtagggttgttttaagttgttcaagatag

SEQ ID NO: 4693 - DNA, 268 bp, Mus musculus
atggcccacaagcagatctactactcagacaagtacttcgatgagcactacgagtaccggcatgtcatgttacccagagaactctctaaacaagtacccaaaactcatctgatgtccgaagaggagtggaggagacttggtgtccaacagagtctaggatgggttcattacatgattcatgagccagaaccgcatattcttctctttagacgacctcttccaaaagaacaacaaaaatgaagtgcagctgggatcatctaatcttttt

SEQ ID NO: 4694 - DNA, 345 bp, Mus musculus
ggacgatgctttctaaggcctcttatgcaggagcgtagagtggttagagcggtcatctcttgcctgtgcgctaaagctgtccaggtgctgcttttaacaagaactaagtatgactcctgtgtgctgacgctgttcagacgagctctaagaatccattttctaaagcaaagtcattggaggggagggtgaggaaagtttcccataaaggaactactgcttttgtagtcttcccaacatttagtccagtcctgtagaatccgctcctcctgaaagatgtgtatgcaaggctgtgcgctgggagtgacgattgatttgcagtaacctgaatctcggtgcattatgcgg

SEQ ID NO: 4695 - DNA, 288 bp, Mus musculus
acaaccgcaccaagaagcatgacctgctgaggctggcaaaggaggaggtgagccggcaggagctaaggcagcgggtccgcatggccgacaacgaagtcatggatgccttccggaagatcatggctgcccggcagaagaagcgcacccctacaaagaaggaaaaggaccaggcctggaagaccctgaaggagcgggaaagcatcctgaagctcctagacgggtagcctgacctgctgctggctatccccctggcctggcagaagtccacaacatcctttgaagccttgg

SEQ ID NO: 4696 - DNA, 429 bp, Mus musculus
  misc_feature (366)..(366): n is a, c, g, or t
cgcgccattgaatctcagtgctatgtaatagcagcagcgcagtgtggacgccaccatgaaacaagagcaagttatggccatagcatggtggttgacccgtggggcacagtggtggcccgctgctccgagggaccaggcctctgccttgctcgaattgatctccactttctacaacagatgcgccaacacctgcctgtgttccagcaccgcagacctgacctctatggcagtctgggtcatccactctcttaatgcttttaacttctgttggttaagacacagacacagccaactgggaggtgatgctactgtgacttgtaggcaggacacaagcacggttcccttcacttgcagaactttaacctntcttaatggaacacaggcttaatcaagtccatgggaaagaagagactttgacctgacctcaga

SEQ ID NO: 4697 - DNA, 357 bp, Mus musculus
  misc_feature (325)..(325): n is a, c, g, or t
gtagccaagatgtcttcagcacctgatcctccaacagttaaaaaagaaccattaaaagagaaaaactttgaaaacccaggcctccgaggggcgcacacaaccaccttatttcgagctgtgaatcccgagctcttcattaaacccaacaaacctgtgatggcttttggattggtaaccctttcactttgtgtggcttacattggttatctgcatgcaactcaagagaacagaaaggacctctatgaagccattgacagtgaagggcatcggtacatgaggagaaaaacatctaagtgggactaactgctgcttccttcaggtggangtgttattataggctccgacacctttgaaaga

SEQ ID NO: 4698 - DNA, 468 bp, Mus musculus
  misc_feature (129)..(129): n is a, c, g, or t
gtggtccccggaatttgaagagctcctgggaaaggtgagtctgcccactgtcgagatcgattgcagcctggctgagtacattgacatgatctgtgcgatcctggacattcctttctataagagccgganttcagtctctccacctgctcttttccctctactcagagttcaagaactcccagcattttaaagctcttgctgaaggcaaaaaagtattcacccctccacccaactctgcctcccaggctggggatgcggagacactgactttcatctgagcctcctcctgggactgtgcttcaaagttagatgaagatgtggtctctgttggcagcttaatgtctccctgctccacagctgggctctgtcaacatgaaccctgctgccttgtcctcgagggcagggcacaccttgtttacacctgcctcccgttgccattccagaggaaggatgtagccactctgctgt

SEQ ID NO: 4699 - DNA, 192 bp, Mus musculus
ttgttcgtgttctgcaggctccacgccctcgcccccgccctcgcccccgccccttcttctcctggtttgccagccataggcgctgaaggcttcagtgatttgagccattggaacctactggggaaaatggtaccccgtggttctttattgcactggggcagagtagctcatagcagcaatgccttaggaggg

SEQ ID NO: 4700 - DNA, 534 bp, Mus musculus
  misc_feature (116)..(116): n is a, c, g, or t
  misc_feature (287)..(290): n is a, c, g, or t
  misc_feature (293)..(294): n is a, c, g, or t
  misc_feature (298)..(303): n is a, c, g, or t
  misc_feature (305)..(307): n is a, c, g, or t
  misc_feature (309)..(309): n is a, c, g, or t
  misc_feature (317)..(317): n is a, c, g, or t
  misc_feature (326)..(326): n is a, c, g, or t
  misc_feature (350)..(350): n is a, c, g, or t
  misc_feature (371)..(371): n is a, c, g, or t
  misc_feature (376)..(376): n is a, c, g, or t
  misc_feature (425)..(425): n is a, c, g, or t
  misc_feature (434)..(434): n is a, c, g, or t
  misc_feature (453)..(453): n is a, c, g, or t
  misc_feature (477)..(477): n is a, c, g, or t
  misc_feature (483)..(483): n is a, c, g, or t
gagctctcccgttacggaacagcaaccatgaccaatgtcttcttagaccgagttttccaggagtgtctcacttacgatggagaaatggactataagacctacctggactttgttcntgccttagaaaacagaaaggagcctgcagctctgcagtacattttcaaactgctggacattgagaacaagggatacctgaatgtcttttcccttaattatttctttagggccatacaagaactaatgaaaatccatggacaggatcctgtgtcatttcaagatgtcaaggnnnnaanntttnnnnnngnnnanaccaaagnatcctttgnaaatctcacttcaggatttaatcnacagtaatcaaggagacacantcacnaccattctaattgatctcaatggcttctggacctacgagaacagagaancccttgttncaaatgacaacgagaactntgcagatcttgatgacacatgatntctgcnaaatagacttcttcataaagatgcttgaatgctgcatgcaacactgttgaa

SEQ ID NO: 4701 - DNA, 415 bp, Mus musculus
gaaaagaggccagtccccaacaaggaaaccccttttaaatgtaaacatgtataagaaaaaaatacctttactgtttttatttgcagtgttggagctagaacctggggccttgcatatgcaaggcattgctttcccactaaactaaacccccagcccataatgctttcatatattggtaaaggaacatgagaatcaaattgccaaggccaaaactagacagtgtcttccagtgactgcagtaaaggaatttggccacatcatcaggacactgttattagcctctcttaatttgagatcttaaaattaccaaataagcacaaatgtctcaattatgcattccttatgtctactcacattaactatgaaaggccacctttcttcagtatagttgcagagcattcaaaccttaccagga

SEQ ID NO: 4702 - DNA, 315 bp, Mus musculus
  misc_feature (120)..(120): n is a, c, g, or t
  misc_feature (139)..(139): n is a, c, g, or t
gatgctactatttgtggtactgactaccaccttgctcagtctttccttgattcccaccccaccccccaccccctcctgacccttactccctgatgcacattcctgagacactaaagctcnagacattccccagggcccntggggactgtgaagagcaagaggttgcctgttctgagcagctcaggggaacagttggtccaggacttgagggggcatcttgaacatcctgtgagcttatgaacctcagagggaagtctggcatgttcgtgtcagtgttcagtgtttggtaggtgaggcctagctgtatgtttagct

SEQ ID NO: 4703 - DNA, 524 bp, Mus musculus
  misc_feature (354)..(354): n is a, c, g, or t
  misc_feature (389)..(389): n is a, c, g, or t
  misc_feature (403)..(403): n is a, c, g, or t
  misc_feature (405)..(405): n is a, c, g, or t
  misc_feature (458)..(458): n is a, c, g, or t
ggcagatcttcatagttctggcttttctccaataagactttcaaaattaatattgcagtaaagaaaaattttaaccaaggcaaatatagtgtttaattttccattggttaaaatagaattaatgtttttaaattctgtttatcagtggaattctaaaatagattttaaagtcaaccagctaattgctgaagtaaagcattttatctacaattttattttagtgtatgtggcacaagtgtaatttcaaatttaagagttgttttcatagttaaaggaatctgccttcactgtaacgtctggaaacagaaacaatttgttatgatttctacagggatttttaatagagcaaacatnttgaatttaaaatatgaatgacccctccaagtctnagttttgctttggntngaacttagcgtgtgtttatcagccatcagttatttgtgaggatgttaattccntatgaatattgtttcatgtttgtatgggaaactgtagctaagcatttcattgtctgcagtctgcag

SEQ ID NO: 4704 - DNA, 497 bp, Mus musculus
gggctactcaccagaagatgtcatcggcaacattttccgagtctgcaaaaccttcccgatggctgaatacttgaaactggagttcatcaaggagattggatacactcacatgaaagtggcggaaggagtgaactccctgctgcagatggctgggctcctggccaggctgtgtcagaagaccatggctccagtggccagctgacttgagacggcctccactgatggaactaggagagtctttgttgtgggagatgtgcctcagctagaacatgctcactttgtttttcttctgtgaaaatagtctcttgtaccccaggctgaccttgaactcccgatcctgccgagtgctggggttggaggtgtgtgtcatgtgtgctttctgcggtactacagatggaacccaggactcgtgcgtgtcagacgagcactgccagctgggctacagtgagatactgagctctggaagtgacacacctctgctcttctgtgtgaattca

SEQ ID NO: 4705 - DNA, 432 bp, Mus musculus
gagaacccatcttctcagtattggaaagaagtggcagagcagcggaggaaagctctctacgaagcgctgaaagagaatgagaaacttcataaagaaattgaacaaaaggacagtgagattgcccgcctgagaaaggagaataaagacttggcagaagtagctgagcacgtgcagtacatggcggaggtaatcgagaggctgagtaatgaacctctggataactttgaatcaccggatagtcaggaatttgattctgaagaagaagctgttgagtattcagaactggaagactcaggagctgggacgtgtgctgaagagactgtgtcttcctccacggatgctaggccgtgtacatgaggtgtgggacgcactgccagcgttgccctttagtatagctcttggtaaactaactacacggtgcaagtgctggaa

SEQ ID NO: 4706 - DNA, 449 bp, Mus musculus
gtattcacctaccaaagacacactcaggctttagtaaatttaacgttacataacctcaatttttaacatgtatatctttttgaaccatgaaatcaaaacaatgcagagcttgtaccaagcttatataaaaggtctacgtgtggctttgtttccttttccttttgtttacgggggatgttcagctgacacgagcagaagttggccaaaatactgcctgcactattgacttcccacacagctctcccggcagactaacctcatagtggtcaagtactccaccttaggtgtttcctctaagtgttaccattatggtgctactgagcattttcttttggtaaacaaggaaaatgtccgggctgcagccgtgtgccgtccgtcgttttcctcgctgcatccattaatctgcttagagaacactagtgccagctcttttagctgatactgctcat

SEQ ID NO: 4707 - DNA, 482 bp, Mus musculus
aagtgagtttgaggcgccatccctcagtgacagcatgccgtctgtagcagattcccactccagtcatttttctgaatttagctgctcagacttagaaagcatgagaacgtcctgtagtcacggctccagtgattgccacgcccgcttcacagctgtgaacacccttcctgaggtagaaaacgaccgactggagaactcaccacaccagtgcagcagcgctctgctttccaaagctgcttcctgttcagatgtcccacagcccagccatgctgcagacgagcatggcaccagcagaagtggggggaagcctatggtggatttgtgttttggtgatgcactgagagagacaaataataaccactcgcaccagacagcagacctgaaagttgctgtccagactgaaatttaggcccgtgaatgctgcagagtaagaaccactgaacaaccgtgttgggagctggttgaaccatgtgcgactgtta

SEQ ID NO: 4708 - DNA, 492 bp, Mus musculus
  misc_feature (85)..(85): n is a, c, g, or t
  misc_feature (315)..(315): n is a, c, g, or t
  misc_feature (423)..(423): n is a, c, g, or t
  misc_feature (446)..(446): n is a, c, g, or t
aagaagttttctgccatcctgtgaccgaccagagtctgatcatagaacttctggagctgcaggcccacgtgcagggcgaagcggnctgcgcggtaccattttgaggacgttggccgggtgcagggggctagggctgtgcacgtgctatctgtgcagcctctctgtttggagaacttatccctgagaggctgctgtcaggatgcctggtccctttctggcaagcagcaggtagctaaagaaaaccagcaggtagcaaaggatgtcacactgcatcaggccttgctgcggctgccccagtatcagactgatcttttngctcaccttcaatcagcccccgtgtcacagcaggtctcttggccctgaaaatctgtcatgtccaccttggagcctgagtaactttgaacagctggtaactagtttgantcttcatgatcccaacctctttnggtccccagtaaagatcgttgagacacaacgtgctactgaggactc

SEQ ID NO: 4709 - DNA, 369 bp, Mus musculus
  misc_feature (302)..(302): n is a, c, g, or t
gaaaattcatgggacttcgtacaccagtggccaggcagggcctgaagtcgtgaagtcaatagtatttcctctactgcctggctgtcaacctagtaggatgaagaaggggcctccccagctgcagagatgcttcaccatgtaggacacttgagactggctctgcatacttcactactggatgctcacactccttgccctgatctgtttttgtctaacttttgttcccctaaattaatgccgctttgatttctgtcttgtttataaataaagagaaaagtcatctggaaatgttaaggagtggnagctgccaggcccctgctttcactccttgcctcttaactttggctacttgtgagctgactgtggtaa

SEQ ID NO: 4710 - DNA, 430 bp, Mus musculus
  misc_feature (376)..(376): n is a, c, g, or t
gaagcggccaaagcactcaggagctgagtctggttacaagaaaaaaaagatgaagttaccagagcagcctgaagagggagaggccaaggaccacgaggctccatcgaaaggtaaattcaactggaaggggaccattaaggctgttttgaaacaggctccagacaacgagatatcagtcaagaagttaaagaaaaaggttatagctcagtaccatgcggtgatgaacgaccatcacacatcggaggaggagctcctggccatcttcaacaggaagatcagcaggaaccccacctttaaggtgctgaaggacagagtaaagcttctgaagtgaggctctgtggcttcacactctgtcatcctattggctgcttccctntactatttgtaaaatgtgtagtgaattataacaacctgaagattgctttctgaa

SEQ ID NO: 4711 - DNA, 433 bp, Mus musculus
  misc_feature (353)..(353): n is a, c, g, or t
tgacgaactttgaccaccagaactcagaaaatgtgaaacttttcagtgccttctcaggaagttctgatccagacaatcttatagtccactcacggccacggcaaaagaagctacacagtgtggctaatggggtgccagcttgcacatcaaaactgactaaatctcttcctgcctcaccttctacttcagactttcgccagacacattcatgtgtgtctgaacacagttccatcagtgtgctgaatataactcctgaagaaagtaaaccaagtgaggttgcaagagaaagcacggatcagaagtggagcgtgcagtcgaggcccagctcgcgggaggggtgctacagcggatgntcctcggccttcaggagcgctcacggggaccgagatgacttaccttaaatgtgcgggctgcagtgctgttcccagatgtg

SEQ ID NO: 4712 - DNA, 538 bp, Mus musculus
  misc_feature (326)..(326): n is a, c, g, or t
  misc_feature (328)..(328): n is a, c, g, or t
  misc_feature (333)..(333): n is a, c, g, or t
  misc_feature (383)..(383): n is a, c, g, or t
  misc_feature (385)..(385): n is a, c, g, or t
  misc_feature (387)..(387): n is a, c, g, or t
  misc_feature (389)..(389): n is a, c, g, or t
  misc_feature (391)..(391): n is a, c, g, or t
  misc_feature (418)..(418): n is a, c, g, or t
tcaaaaaccttcactactcttgaccctgcgtccctagcttggctgacagaggagccagggccaacagaggtcacacgcacatcccaaagccctcgctctccagattccagtcagagttctatggcccaggaggaagaggaggaagagcaaggaagaactaggaaacggaaacagagtggtcagtgcccagcccggcctgggaagcaacgcatgaaggagaaggagcaggagaacgagcggaaagtggcacagctagctgaagagaacgagcggctcaagcaggaaatcgagcgcctgaccagggaggtggagaccacacggcgggntntgatngaccgcatggtcagcctgcaccaagcatgaacagtgggcatcacctcctntntntntntccggaagtgtacccagcaccatcgcnccagcgccaagcatgtgaccctgcactgcactgcacatgctgaggaggggactgagggtagaccaggagagggctcggcttgcacatagacggtacattgtttattactgtccatgtcca

SEQ ID NO: 4713 - DNA, 353 bp, Mus musculus
gaatcggcccctgaatggtggatcagagccggaaagcaacagcgctcttcaagaagatgaaagagaaaagaaagatgaacttcagacagagtcgtggtcaacaaaacatgaaatagctaatagtgatggtcttcaggacagcagtgaggagctgccacggaaactgctgctgactgaatttaggtcattggttgtcagtaaccacaactccacctccagaaatctatgtgtaaatgaatgtggtccactgaagaatttcaagaaattcaagaaggcgacatttcctggggcaggaaagcttccacacatcatcggaggatcagacttagtaggccaccatgctcgaaagaata

SEQ ID NO: 4714 - DNA, 233 bp, Mus musculus
gctgcaccggcagacggctgagtactctgcattcaagctagagaacgagaggctcaaggctagctttgcccctatggaggacaagctcaaccaggctcacttggaggttcagcagctgaaggcgtcagtgaagaactacgaggggatgatagacaactacaagagccaggtgatgaaaacaagattggaggctgatgaagtggctgcacagctagagcgctgcgacaaagaga

SEQ ID NO: 4715 - DNA, 340 bp, Mus musculus
accagctggcacactgtacagactgcctgtccttccttgcagatatgaatagagcgttttctttacaaacagatgatagtgcgtgtctgcccactcaggccctgtgcgctccgtgttagtgtagccctccacgcattggcatgcagctctttactttactgctcaacgtattcccaaatgtgatgtttcagagatttattcctcagtatccatgtgactgtctgtttaaaagttggtttgatgctttaacagcacttcctatgtcctgctgtcccttgttctcagagaccctcctctctcacccagtctactgactcatttccgccctaggttgtatgca

SEQ ID NO: 4716 - DNA, 478 bp, Mus musculus
  misc_feature (216)..(216): n is a, c, g, or t
  misc_feature (236)..(236): n is a, c, g, or t
  misc_feature (241)..(241): n is a, c, g, or t
  misc_feature (249)..(249): n is a, c, g, or t
  misc_feature (251)..(251): n is a, c, g, or t
  misc_feature (264)..(264): n is a, c, g, or t
  misc_feature (293)..(293): n is a, c, g, or t
  misc_feature (317)..(317): n is a, c, g, or t
  misc_feature (343)..(343): n is a, c, g, or t
  misc_feature (345)..(345): n is a, c, g, or t
  misc_feature (353)..(353): n is a, c, g, or t
  misc_feature (355)..(355): n is a, c, g, or t
  misc_feature (366)..(366): n is a, c, g, or t
  misc_feature (377)..(377): n is a, c, g, or t
  misc_feature (411)..(411): n is a, c, g, or t
  misc_feature (432)..(432): n is a, c, g, or t
agcactaacccagccttcaattagatgagagacactgttcagcaacactcaggccatttcctcatagtaagcacagacggtgacaacctgcctttcaagttacacagaagcacctggaagaagagctgaaaaatgaacctgacgacagggcattgcaacccttgtataagaggtttggatgctaatgcagaagctaagataggctgttaggtttgnttttctaagaatgtaggcantcctntacattgntnactggttttgcancccttctccctcttccctgaagggtcccnagcattgcattctggaatcagtgntcccattttttcttgaggtttcatantncaaaggcncnggaacttttgnccacagtgttntcctggcttaggctcacattaccaaatgcccaantcatgttttccgatgttgatntcatttgagtggaacacaccagactcagactttattcacattttat

SEQ ID NO: 4717 - DNA, 419 bp, Mus musculus
  misc_feature (313)..(313): n is a, c, g, or t
gaagattccagtgctgaatgtttattttaatgtagaactaaatggcttttaaaaactttggtttacatccattctggtaatttgcctgttggctttgaaatccatattgttcactttacttttataatatatcagtttttataatgtaactagtattgcatacttgatgaaaattttgtggattttacttagtataaaattcctataaatttaaatttttcagttagtttttgggactgggtagtacttctgagtttgttattatgtacttaaccattgccaagtttatcagtcttcctgtggaagtttagtntctcccccaccccctttagtaatgtaattcatgggatttggacttcagttatggagtaggcgtctgatagggggagattgattgaaactgtactttctgttgctga

SEQ ID NO: 4718 - DNA, 292 bp, Mus musculus
  misc_feature (55)..(55): n is a, c, g, or t
  misc_feature (62)..(62): n is a, c, g, or t
ggtgtatacagaggtggctatgacttattggtgcggtccaggctggccctagctngatggangtgaccatgcaggtgactgtgagaagcaaagagagaacgcctgtggatgttatcttggcttctgtgggataagttcttgctgggaagggtgatgttgctatgccctccctattggtggtttttaggctagtggcatgatcttccaagaatcacacataaagattaataatgatgactttgaagaagcaaatccaagtgtttggccctgcgccagcagatcaaacatctgt

SEQ ID NO: 4719 - DNA, 285 bp, Mus musculus
  misc_feature (126)..(127): n is a, c, g, or t
  misc_feature (204)..(204): n is a, c, g, or t
ctggctgtgggctcaagctaagcgcgtttgcagccgtctccttggtcctgtcaggacttctggggatggtggctcatatgctatattcacaagtcttccaggcaactgccaacttaggtccggagnnctggagaccacactcttggaattacggctgggccttctacacagcgtgggtttccttcacctgctgcatggcgtcancggtcaccaccttcaacatgtacacgaggatggtgctggagttcaagtgcaggcacagcaagagctttaacaccaacccca

SEQ ID NO: 4720 - DNA, 423 bp, Mus musculus
  misc_feature (384)..(384): n is a, c, g, or t
tagaggactatgacagcgaggagacatagagaacagcctgccaatcaggttgctccttgagagataaattttagtctattcagtggtacttgaacacgtctctgaaggacaagcaatttgttaattgctcagttccttatcgtattcgtcacagcaactgacgactgtcatcttgaagtaaagcaggtctcaagtactcagtgcttagtatttatttagtcttgtgaatggtttgaggagaagtcacggtgtgaagtgtatgaatgttgtactaaatatcaaaatgtgaaggagtaatccagaatatacggactttatggggtgttggaaatttgatttataaaacagtttaggatgcaattatgagtataaataaaccttgtnccttacttacagtttgcatctagcttttcggataccatt

SEQ ID NO: 4721 - DNA, 452 bp, Mus musculus
acattttgaactcccctcagatttcttcagccttacagctgaggaggtgaagcgggagcaaaggctcaggacagaggcggtggagcgactgagctcactcaggaccaaagccatgcgggagaaagaggagcagcgggagcttcgcaagtatacctatgcccttgtgcgcgtgcgcctgccagatggctgtctactgcaagggaccttctatgcccgggagaagctatccgcgctcttccgatttgtgcgcgaggcgctacagaacgactggctgccctttgagctgagggcctccggtggacagaagctggaggagaacgaggccctggccttgaatgagtgtgggctggtaccctctgccctgttgaccttctcctgggatgcttcagtgttggaagatataagggcagcaggagctgagccagcaaaatctgtcttgaggcctgagctgc

SEQ ID NO: 4722 - DNA, 491 bp, Mus musculus
  misc_feature (399)..(399): n is a, c, g, or t
  misc_feature (440)..(440): n is a, c, g, or t
taaatgaatatcgaccccaccaagcaagagagactttgagagtcatgatggaggtccagaaacgccagcgccttgaaacagctgagaggtttcagaaacatctggaacgagtcattgaaatgattcagaattgcttggcttctttgcccgatgatttgccccattcagaagcagggatgagagttaaagctgagccgatggatactgatgataacagcaattgtcctggacagaatgaacaacaaagagaaagttcaggtcacagaagggaccagattatagaaaaagatgctgccttatgtgtgctaattgatgaaatgaatgaaaggccatgaagaatattcctttttttccttttagtaagtagcatcatatattagtttatttcctctcagacantcttaagaggtataactaaagatactaagagactttttttncaattgaaatgctgtaggtggtaatttaacactaaacataggccagcaagt

SEQ ID NO: 4723 - DNA, 468 bp, Mus musculus
  misc_feature (426)..(426): n is a, c, g, or t
  misc_feature (443)..(443): n is a, c, g, or t
cggaagtactcctctatgtttgaagatgacacggtgacagagtacatctaccactgtaatgtacaaaccccaagtggtgagacagctttcaaaaacatgacgattccttatgggtgggccaaacggccaatgcttcagcggataggtggcttgcatcctgacattccagtttcagtgatctttggagcccgatcctgcatagatggcaactctggaaccagcatccagtcactgcgaccgaagtcctacgtgaagacaattgccatcctcggggcggggcattatgtgtatgcagatcagccagaagaattcaaccagaaagtcaaggagatctgccacacagtagactgagcacacagaaccatgcagcacccgtgacgggtgccgttcatgagcaatccccacagcccgaggacccccgcagtntcctggactggactctngcagctttccacatttaaaccaacc

SEQ ID NO: 4724 - DNA, 470 bp, Mus musculus
  misc_feature (110)..(110): n is a, c, g, or t
  misc_feature (304)..(304): n is a, c, g, or t
tggcatgttcatgaaacctgggaccctgtatgtgtacctcatctatggcatgtacttctgcttgaatgtctctagtcaaggggctggggcttgtgtcttgctaagagcantagagcccctggagggcctggagaccatgcggcagcttcgtaactccctccgaaaaagcactgtcggccgttccctcaaggaccgtgaactctgtagtggtccctccaagctgtgccaggccctggccattgataagagctttgaccagcgagacctggctcaagatgatgctgtgtggctggagcatggcccntctggagtccagtagcccagctgtggtggtggcagcagcccgtataggtattggtcatgcaggggagtggacacagaagcccttgcgcttctatgtccagggcagcccatgggtcagtgtggtagacagagtggctgaacagatggatcagcctcagcaaacagcc

SEQ ID NO: 4725 - DNA, 525 bp, Mus musculus
aaggagatctgctatgcccttcgggctgaaggatactgggctgacttcattgacccatcatctggtgtggcattttttggaccatataccaacaacacactttttgaaacagatgaacggtaccggcatttaggattctcagttgacgaccttggctgctgtaaagtgatccgtcacagtctctggggcactcatgtggttgtaggaagtatcttcactaacgcaacagcagacagcagtatcatgaggaagctcagtggaaactagcaggctggcactgtgatccctgcagcgctgtttgtctgtcatggattgctctatataaacactgtcatggacagcagcttctagaggattcttgtttctaggtatttattgtatcatttatgggtttacatggacaggtgacttggggtttcagaattgcaaatgctagttcctattctggagtgcatgctgaacacatccatattctgcaaagtgaggtcatcagcttgtaaccagggtatgtgtgttctcttaggg

SEQ ID NO: 4726 - DNA, 522 bp, Mus musculus
  misc_feature (349)..(349): n is a, c, g, or t
  misc_feature (351)..(351): n is a, c, g, or t
  misc_feature (396)..(396): n is a, c, g, or t
  misc_feature (401)..(401): n is a, c, g, or t
  misc_feature (450)..(450): n is a, c, g, or t
  misc_feature (482)..(482): n is a, c, g, or t
tggctgccggctttgaggaacacaagttcagaaacttctttaatgctttttacagtgtggttgagctggtagagaaggatagctcagtgtccagcctgctgaaggtgttcaatgaccagagttcctcggaccgaatcgtgcagttcttacgcctcctcacgtcggccttcatcaggaaccgagctgacttcttccgacatttcattgatgaggagatggacatcaaagacttctgcactcacgaagtagagcccatggccatggagtgtgaccacgtgcagatcacagccctgtcgcaggcactcaacattgctctgcaggtagagtacgtcgacgagatggacaccgntntgaaccaccacgtgttccccgaggctgccatcccttcggtttatntgctntataaaacatcccactacaacatcctttacgcagccgagaaacactgantacttttgggccatgccggagcccgtcatcgnaatggactgcattctgaatggaacatcctgccttggcaat

SEQ ID NO: 4727 - DNA, 543 bp, Mus musculus
  misc_feature (158)..(158): n is a, c, g, or t
  misc_feature (492)..(492): n is a, c, g, or t
  misc_feature (494)..(494): n is a, c, g, or t
tgtagaaccgctgcagaaaccctggggtttctgtctgaaagcacagcaactagaataccaaagacgattctgaaatgtccagatgtagaagagagatgtttacagtgtgaagaaaataatttccttagtaaagtgaggtgtggttgtacacttggggnatctacacacctgcatccacacactcacagctgaaaatgtttcccctaattttaggggcaatagaaaaagatttgatactgtatttttataactatatagaaatggatcaatgaaggccaatcatttggcctttcggtacaaaccaggaactttttatcaatctagaattcattgttttaaaatccaggtaaacttttgttgtctcttgttgacttgtctgtcaaatatttccttaaacatgaagttgataaggagaggactatttttaacatttaaatttttggaaaatttacaaatattttttagaagcccactccacttgatgcacatgantnttccccaaatagcttttctgaagtgactatactgtgtgttttctcagag

SEQ ID NO: 4728 - DNA, 448 bp, Mus musculus
  misc_feature (68)..(68): n is a, c, g, or t
agaataatccagttggtcctctcaaccaggggctccaacggcaaggacacagaggtcggcactccacnatcctgttacctcacccgtccctggatgcagtggcgacatttgcaggatgggccaacatggctaagagagtctgtcttccgcctgaccccacgatgctgaaactcacaagacctgcccttccaggaggacatttgttcagaagcctggccaccgggcatgagcaggtgtgccaaggatctccatgcggggccacactggctctactgtgttcagtgagggagggatatgctgtatttgcagcagggactcagaacataaatgctgatcacagagggacacactagagcaggttgtgagttataagcaaagtaaatatccaactaaatacacaaagtataaagtaaagccacatctagacaccacgttgtatctgagtaaa

SEQ ID NO: 4729 - DNA, 512 bp, Mus musculus
  misc_feature (418)..(418): n is a, c, g, or t
gaagctcaaagctgtgatcactcagtgggaggcaaagtataaagaagtaaaagcaagaaatggacaattactgaaaatgcttcaggagggagagatgaaagataaggccgagatacttctgcaagtggatgagtctcagagcatcaagaacgagctgacggtccaggtgtcttcacttcatgccgcactggaacaagaaagatctaaagtgaaagtattacaggcagaattagccaaataccagggaggcaggaaggggaaaaggaacttcgaacctgaccattgcaggtgatcgtggcctcggaggccagcacagaattctttcacacttttgcagaaatgtgtatatttaatgctgtgcgactgctaaactgcaggtttttgttgaaggaactaaaagcaactagttcactcatantctacagttttatgttcttttggcttaaagttaaaagaaaatacagaataccagcagaacttgattattgttttctgtccaaacttcttatgac

SEQ ID NO: 4730 - DNA, 516 bp, Mus musculus
  misc_feature (303)..(303): n is a, c, g, or t
  misc_feature (325)..(325): n is a, c, g, or t
  misc_feature (327)..(327): n is a, c, g, or t
  misc_feature (364)..(364): n is a, c, g, or t
  misc_feature (396)..(396): n is a, c, g, or t
  misc_feature (399)..(399): n is a, c, g, or t
  misc_feature (403)..(403): n is a, c, g, or t
  misc_feature (406)..(406): n is a, c, g, or t
  misc_feature (449)..(449): n is a, c, g, or t
aagcactggtgtggaacttccccatcgatgtgacctttaaaagtaccaacccctatggctggccacagattgtactcagtgtctatgggccggatgtgtttgggaatgatgtcgtccgaggctatggagcagtgcatgtgcccctctctccaggacggcacaaaaggaccatccccatgtttgtgccagagtctacatctacactacagaagttcacaagctggttcatgggacggcgacccgagtacacagaccccaaggtggtggcccagggtgaaggccgggaagtgactcgtgttcgcntctcagggatttgttaccctcntncttcaatgtggtgaccaaggacatgaagaagctgggnctatgatactgggcctgtggacacacaaggantcntggntcntagcctgccacagggcaacccacaataaaaatcagcccttctntccgccactgtggaccagatgccctacagcccacacacagccaaggacatgccaaccaggctgggaa

SEQ ID NO: 4731 - DNA, 439 bp, Mus musculus
  misc_feature (340)..(340): n is a, c, g, or t
gactgcagacactgacgccagcgaatctcaccacagtactaaccgtcgtaggcggtctcgtagacggaggactgatgaagatgctgttctgatggatggactgactgaatctgatacagcctcagttaatgagaatgggctaggcaaaagatgtgattgaagagcatggtccttcagaaaaggcaataaatggtccaactagcgcttctggcgatgaaattcctaagctaccgcgtactctgggagaagaaaagactaagaccttaaaagaagacagcactcaagaagcagcagtcctgaatggtgtttcataactgaaggaagttcctagtttacagtntcttttacattacagttacaatagtgcttgtacaagcttgccaaagatagaatacggatcgccagtcttacatcgcactttcagttcctccatttggaa

SEQ ID NO: 4732 - DNA, 531 bp, Mus musculus
  misc_feature (131)..(133): n is a, c, g, or t
  misc_feature (449)..(449): n is a, c, g, or t
  misc_feature (452)..(452): n is a, c, g, or t
  misc_feature (463)..(463): n is a, c, g, or t
  misc_feature (466)..(466): n is a, c, g, or t
  misc_feature (488)..(488): n is a, c, g, or t
atgctcaccagcaaacaggcgggcaggcacatctcagagctaagtagtccaaagccagcacctggccctgggcaactagaaacattgatggaaccactcagggctatccaggaacctcgatcgagcagagnnnctgaaaccaatggcatgttgagtcccaaatgccaaagccattcaacctagaacaccttaggcattataggaacaggacacttctgcctcctgatagaggatgagaaacagaggcagaatgtagtttgaagctagataatagggtgtgatggatgaccattttgtcttttttgtgttggtagagtagaagacacaaactccaaggtggtgtgtctggagggaaggggtgtggcggcactcaggacagagtttggtggcacctgcaccgaggttcaggctaggagtacctagcaccaaagagacaaactttgtgtaantcnccaccactgangantctcactggagaggcacatcantccttgtcaccaacaggaaactgagtgatggaccctcacttca

SEQ ID NO: 4733 - DNA, 479 bp, Mus musculus
  misc_feature (284)..(284): n is a, c, g, or t
  misc_feature (399)..(399): n is a, c, g, or t
  misc_feature (435)..(435): n is a, c, g, or t
  misc_feature (451)..(451): n is a, c, g, or t
  misc_feature (453)..(453): n is a, c, g, or t
ttctgcaagcaggtgaagccgagagaaacatcctcagagcaagggaagggctctgagacgtacaaccccaacacagcctatggtgaggatttcctggtgccagtgatgggctatgtctgtcaaatctgtcacaagttctacgacagcaactcagaattgcggctttctcactgcaagtccctggcccactttgagaacctgcagaaatacaaagccaagaacccaagccctcctcctacccggcctgtgagccgcaagtgtgccatcaacgcccgcaacgcccntgactgcactgttcacctctagccaccagcccagcccccaggacacagtgaaaatgcccagcaaggtgaagcctggatcccccggactccctcctccccttcggcgctcaacacncctcaaaacctgatagagggagctctggccactcancctgactaaggctcantntgctaatgcttcctaggtatctgtgt

SEQ ID NO: 4734 - DNA, 525 bp, Mus musculus
  misc_feature (369)..(369): n is a, c, g, or t
  misc_feature (371)..(371): n is a, c, g, or t
  misc_feature (407)..(407): n is a, c, g, or t
  misc_feature (411)..(411): n is a, c, g, or t
  misc_feature (421)..(421): n is a, c, g, or t
  misc_feature (425)..(425): n is a, c, g, or t
  misc_feature (427)..(427): n is a, c, g, or t
  misc_feature (469)..(469): n is a, c, g, or t
  misc_feature (488)..(489): n is a, c, g, or t
ccatccgcaccagcttgaagagaaagaagaggtaccatataggcaattctttccgaggagatgtcgattcctttctccaacacccactaccgaattccacaaggatttggaaatcttcttgaagggctgacacgggagattctgagggagcaaccggacaatataccagcttttgccgcagcgtattttgagaaccttctagagaaaagagagaaaaccagctttgatccagcagaatggggggctaaggtagaggaccgcttctataacaaccacgcattcaaggaacaagaacaagttgagaaatgtgaacaagaattagctaagtcatctggaagagaagaaacaccagtcactcccttcgaggantntactgaggaagaaagagaacaggaggaggcggctgntctncaaaatccantccntnttccggggacacgtggctagagaagaggtaaagaagatgaantcagataagaatgagaatnnctgaaagaagaggcagacaattgagaccacaggttt

SEQ ID NO: 4735 - DNA, 448 bp, Mus musculus
ggtcctccttcaggccgaattagaaggctattgcacttgacccaagacccaaggctgtcatgagcagaacaagatggaagagctcattgcagagatcagcccatccactctttatgctgccaaagtaactcgccctttgtcgtgttgtttactgaatgtctccccaatgttttactgataaaaatgatgtcattctacactgataattatttaaatcaaaagaccattctgctagtacagtgtcccagcaagtcaaaagtttatatgcatgtttaatagtcatatgtgatggtgctatcagttatcaatagttttcaggtgttgcccacatttatgctgaagaccctgagccaaggctggttaagatatttagtttcttttattaaaatcagttatcgattctgtgcaatcaaaaagcacaactgaatgctgtggtcagttctacaac

SEQ ID NO: 4736 - DNA, 342 bp, Mus musculus
  misc_feature (207)..(207): n is a, c, g, or t
  misc_feature (212)..(212): n is a, c, g, or t
  misc_feature (221)..(221): n is a, c, g, or t
  misc_feature (224)..(224): n is a, c, g, or t
  misc_feature (226)..(226): n is a, c, g, or t
  misc_feature (229)..(229): n is a, c, g, or t
  misc_feature (233)..(233): n is a, c, g, or t
  misc_feature (235)..(235): n is a, c, g, or t
  misc_feature (238)..(238): n is a, c, g, or t
  misc_feature (243)..(243): n is a, c, g, or t
  misc_feature (246)..(246): n is a, c, g, or t
  misc_feature (251)..(251): n is a, c, g, or t
  misc_feature (255)..(255): n is a, c, g, or t
  misc_feature (257)..(258): n is a, c, g, or t
  misc_feature (260)..(262): n is a, c, g, or t
  misc_feature (265)..(265): n is a, c, g, or t
  misc_feature (268)..(268): n is a, c, g, or t
  misc_feature (271)..(271): n is a, c, g, or t
  misc_feature (304)..(305): n is a, c, g, or t
  misc_feature (307)..(307): n is a, c, g, or t
gaaggaccaagtacacctatccggtcacctgcaatgacaggaggaatttttgctataaacagacattattttaatgaacttggacaatatgacaacggcatggatatttgtggaggagaaaatgtggaactttcgctaagaatctggatgtgtggaggccagctcttcatactcccttgctctcgggttggatataacagtaaggcnctgantcaacacangcntncanaccngngtnccttntcnaggantttncnncnnntgnttnacntctggctagatgaatacaagggaaacttttttnntncaaagaccttctttgacatacgtttcctgtggaaa

SEQ ID NO: 4737 - DNA, 489 bp, Mus musculus
  misc_feature (156)..(156): n is a, c, g, or t
  misc_feature (423)..(423): n is a, c, g, or t
accacaggtaccagggcaagttcatgaacaaaaatcctgtgggccctggaaagtacgtatttgatattggatgcgaacagcacggtgaatatcgcctcacagatacggaaagaggagaagaggaggaggaggaagagacattagtgaacatcgttnccaaaatggaaagctctcaacatcacagaattggccctgtggactccaaccctctccgaggagcagcctccccctgagggccaaggccaggaggaaccgcagggacttactggcgtgggtgacccctcagaagacatccaggcagaaggttttgagggcgagctggagccgaggggggccgatgaagacgtagacacgttcaggcaggagagccaggagaacagctacgacatagaccagggaaacttgaactttgatgaagaaccntcagacctccaggattaagatagtggaggcagaagaccacagacacaccaggcgtgccttagttaa

SEQ ID NO: 4738 - DNA, 375 bp, Mus musculus
gactgctgcggccaatgcgaacgacttcttcgccaagcgcaagagaactgcgcaggagaacaaggcgtcgaacgacgtccctccagggtgtccctctccaaacgtggctcctggggtgggcgcggtggagcagaccccgcgcaaacgtctgagatgagttagtttagaggctaacggccagagagaacttgctgggcatctgggcagcggacgatggaagaactctgggcttcggctgggacctttcgttcatgtagcaggaaccggagatggttgcgtagagcagcccacggttttgtggaaatctgaaaactgtgcaatgtattgagaacactctgtaccatgtgcaaggagtacgctggtcccaaggtgtaa

SEQ ID NO: 4739 - DNA, 91 bp, Mus musculus
gcagagatcctgcaagagtcccggatgatgatcccagattgccagcgtcggttagaggctgcatatactgatcttcagcagatattagaaa

SEQ ID NO: 4740 - DNA, 76 bp, Mus musculus
gctggattccgtaaagctagaagcctgacatttttctgtatgggatgtttttttgcattaaatcctggggtccatt

SEQ ID NO: 4741 - DNA, 529 bp, Mus musculus
  misc_feature (222)..(222): n is a, c, g, or t
ggcccggagtttgtgcgcaagcatatcttcaataagcatgccgagaagatcgaggaggtgaagaaggaggtggcgttcttcaataactttctcacagacgccaagcgcccagctttgcctgagatcaagccagctcagccacctggccctgcccagatactccccccaggcctgaccccaggacttccctacccacatcagacgccacagggcttgatgccntatggtcagccccggcctcccatcttgggctatggagctggtgctgtccgccctgcagtcccaacaggagggcctccatacccccatgctccatatggtgccggccgtgggaactatgatgcttttcgaggccaaggcggttatcctgggaaacctcggaacaggatggttcgaggagacccaagggccatagtggagtatcgggacctggatgccccggatgatgttgacttcttttgagccatccatgtcccctcctgcattgctacatcagtacccgtgaccactttatcccatcagctgaaaa

SEQ ID NO: 4742 - DNA, 510 bp, Mus musculus
attaaagctgtcaatctcttccctgctggaacaaactcaagatgggaagtcattgctaattatatgaacatacattcttcttctggcgtcaaaagaactgccaaagatgttattagcaaggctaaaagcctccaaaaacttgaccctcatcaaaaagatgacattaacaaaaaggcttttgataagtttaaaaaagaacatggagtggcctctcaggctgacagtgcagcaccatcagaacggtttgaaggtccctgcatagattccaccccttggacaacagaagaacagaaacttttagaacaggctttgaaaacatacccagtaaatactcctgaacgatgggaaaagatagccgaagctgttcctggcaggacgaagaaggactgcatgaggcgatacaaggaacttgtggagatggtgaaagccaagaaagctgctcaggagcaagtgctgaatgcaagcagagccaggaaataatgcaggcaatcctggttgtgtgtgcacttt

SEQ ID NO: 4743 - DNA, 386 bp, Mus musculus
  misc_feature (62)..(62): n is a, c, g, or t
  misc_feature (184)..(184): n is a, c, g, or t
  misc_feature (300)..(300): n is a, c, g, or t
  misc_feature (331)..(331): n is a, c, g, or t
gttcttggacttggccacgtcagatacacagctacacagagacagatcaaagcagctcatanaagcaatggtcttgaaacatcatccagacaaacggaaagcggctggggaacccatcaaagaaggagacaatgactacttcacttgcataactaaagcttatgaaatgttgtctgatccagtnaaaaaaggcgggcatttaacagtgtagatcctacttttgacaactcagttccttctaaaagtgaagctaaggacaatttttttcaagtgttttctccagtgtttgaaaggaattcnagatggtcaaataaaaaaaatgttcccaagncttggtgatatgaactcctcgtttgaagatgtagatgcgttttactctttctggt

SEQ ID NO: 4744 - DNA, 534 bp, Mus musculus
  misc_feature (331)..(332): n is a, c, g, or t
  misc_feature (359)..(359): n is a, c, g, or t
gaggactgccccaagtagttcagcctgggaagctcaccgaggccttcaagtactttttgcagggaatgggctacataccatctgccagcatgacccggctcgcccgatcacgaacccactccacctcaagtagcattggctctggagaaagtccctttagcaggtctgtgaccagcaatcagtcagatggaactcaagaatcctgtgagtcccctgatgtcctggacagacaccagaccatggaagtgtcttgctaagcagatctcctcccctggaccatgcaagtccctctccttgaaatgaccactccgtaatagaacatttcattccnntcagctggcccccacttcctttcactncacgcatggccacagcatctctctctagtagccgagagtgtcattctctccaccctttctgtgtgtaccagagccacacccatgccattactgtaacattccaacatctccatctgacctgacctccatatcttctcttgccagcctttccctatgctccctcaaatatgtatct

SEQ ID NO: 4745 - DNA, 433 bp, Mus musculus
tgggtgcccacgtgaatacgttctggaggaccccgtgccgaggtgctgccgagggccccagcaagaagtcagtcgtgtgggaaaacaagcatatcacatggtttgcaacccttgacggtggcattgggctcctgctgcccatgcaagaaaagacataccgacgcttgctgatgctgcagaatgcactgacgaccatgctaccccaccacgctggcctcaacccccgcgccttccgaatgttgcacgtagaccggcgcatcttgcagaatgctgtgcgcaacgtccttgatggggaactgctaaaccgctacctatacctcagcaccatggagcgcagtgagctggccaagaagataggtaccacgcctgacattatcctggatgacttggctggagacagaccgggtcacggctcacttctaactctaggatg

SEQ ID NO: 4746 - DNA, 470 bp, Mus musculus
ggagaatctacatcaagcacccacacctctttaagtatgcagcagatcctcaggacaagcactggctggctgagcagcatcacatgcgggcaacaggcggaaagatggcgtaccttctcattgaagaagacatccgggacttggctgccagcgatgactacagaggatgcttggacctgaagttggaggagctgaaatcctttgttctgccatcctggatggttgagaagatgcggaaatacatggagacactgcggacagaaaatgagcaccgcgctgcggaagcgcctccccagacctgagccgggtgtcctggctactacacttggcggcctgcctccaagaccctctttccccacccggctgaggccatcatggggatttggtctagttgactcttaacagcattaagctgtacatgagctagtttgtagtgactcactgcagagcaccccagactggcatgtggt

SEQ ID NO: 4747 - DNA, 388 bp, Mus musculus
  misc_feature (218)..(218): n is a, c, g, or t
  misc_feature (250)..(250): n is a, c, g, or t
  misc_feature (268)..(268): n is a, c, g, or t
  misc_feature (280)..(280): n is a, c, g, or t
  misc_feature (293)..(293): n is a, c, g, or t
gtgacccggacaaggtgcagcgaatgctgtacgtgtgggcactctgcagagaccaggaggagctcaacccttatgctgcctggcgccttctggacatctcagcctccagcacagagcagatcctctgagggcagcaatggagtctaggcagctcgaggctagaccatcatgggacagacacacagagacactttgccacatctgatacagctgtgaancaagcttctgccccaagttcttcagggcagcntgtgaaaccagctggacnaagggaagagcnttggggtgtctgnagcaggatggggactgtctcccagtgcgtccgtcacaggggttgctggcagtgtcagaaggcccccagccccaggactcctgtcgggtgaggcct

SEQ ID NO: 4748 - DNA, 121 bp, Mus musculus
gagaatggcgctgtcattacaggccattggtgtagcttgaaggcagatgctactctggcctcagatacattgctgtggaagcaggcgcttttggtggggagatggtggtgggtttgtcctt

SEQ ID NO: 4749 - DNA, 437 bp, Mus musculus
  misc_feature (159)..(159): n is a, c, g, or t
  misc_feature (208)..(208): n is a, c, g, or t
  misc_feature (210)..(210): n is a, c, g, or t
  misc_feature (212)..(212): n is a, c, g, or t
gaccttgcagaggtacactgtgaatgacctggtgcttcgtaattacaagattccagccaagactttggtacaggtggctagctttgccatgggtcgagatccgggcttctttcccaatccaaacaagtttgacccaactcgttggctggaaaaaagccnaaaataccacccacttccggtacttgggctttggctggggtgttcggcnantntctgggccggcggattgcggagctggagatgaccatcctccttatcaatctgctggagaacttcagaattgaagttcaaaatctccgtgatgtggggaccaagttcagcctcatcctgatgcctgagaaccccatcctcttcaacttccagcctctcaagcaggacctgggcccagccgtgaccagaaaagacaacactgtgaactgaaggctggagtcacatgg

SEQ ID NO: 4750 - DNA, 451 bp, Mus musculus
aactgaagcagctttttgtgcctcccagtggctgcctcaggagcctatgcaataatggacaggtgattctccctcatttcattcttgggctgccatagcccctgctgtaatttatttctttagccatccttcccccgatactaagaggaaaaattattcctcatactgctttcaagctatcctaagccagtgtcactgtggaaaggagcgaacggatgctgcgtccacgagaacttgacagctccatcctcccctcacccgcacagcacggtagtgttaggcttggttcccttgggcctgggggcagttttacttggccagaaagcagtgtttgaatacttgaaatcatgtgttgtgttctgtttaaatgttgtttgtagacattgtgctgtacacctgtctccatgtctgtttgcagatgacactgtgaagtgtgccacccttatatggt

SEQ ID NO: 4751 - DNA, 490 bp, Mus musculus
  misc_feature (312)..(312): n is a, c, g, or t
  misc_feature (317)..(317): n is a, c, g, or t
  misc_feature (374)..(374): n is a, c, g, or t
tggagtcctgcaagactgggtcattgatgactgcattgggaactggtggagaccaaattttgaacctcctcagtatccgtatattcctgcacatataacaaaacccaaggaacataagaagttgtttctggttcagcttcaagagaaagccttgtttgcagtccctaaaaattacaagctggtagctgcaccattgtttgagctgtatgacaatgcaccggggtatggacccatcatttctagtcttcctcagctgctgagcaggttcaattttatatacaactgaattcctgtatgcagaagtaaaagaanccgtntctatgagcacagcttacacgtgtagaagagtaactgtagaacaagttttggttttntcttgttccctaaattgccaccaccttcctgtttgaagagtaaaatgaatatgaccgagatagtggtggaaacatgtggcagtgttcattagcttttggttctactcatacttttt

SEQ ID NO: 4752 - DNA, 483 bp, Mus musculus
tggtatccacctaatgttgtcccagctctgcagagctaacagtcctgccattgacagtcagaccagagccttctgtgagctgtgcctggccccttgtctgctcacaccctctgtgcctggttcttagctctgggcgtggctcagcactgtccctcagcactgctcctctcttgctgatcttttagctcacacccaaagcatttcaccaacctgggccaacagaggaggggcctttcctgccacacccttaagttcagtagctgtttaactacagtttttaatgttactcggatgttcaagtgtgatttagtgcttgcttctccacagggaagtggggggcttgtctggtttgtaacatttctgtgtttataatgtcctttctccctgtgagcacagctcagctatggagttactcagggcgtgaacagctcacctggtgctccccacaggcccttctctaacacgtacttcttgtttgttcct

SEQ ID NO: 4753 - DNA, 554 bp, Mus musculus
  misc_feature (365)..(365): n is a, c, g, or t
ggaaatgagccgtgtctgtagaccagggacaggcagagctgtactgcttactcaggacaagaaatgttttaccaaggccttatctggaatgggacatgtgtggcgaaaggtccatgtagtctgggtgaacatcgggggccttcatgctgcagtttatcttctaaagcgcactgctcaagcctttgttcatccttcagatcaagatgaaggaagagaccctccttggtaaagaaaagagtgaagacaacttattaatatttgtagttcctaacactggaaatatcagcataaagaacttgctttgggagaaaaatagcagaaaagtaacttacagtacaggttacactgcttgaccactccagaantgcttgatttctagcaaggtgattgtaatggtatttcttaagaagcctacactgcttggcttctaagtgtcagaacactttaggccatattctattgcttgtgcaacctactgttttatggtctaaattctttgtatcatctcagaagcagaagcatcccttaagatctacagttttatcatctgcctt

SEQ ID NO: 4754 - DNA, 473 bp, Mus musculus
gcgacattgacagtgagacctcctctgcactcttcatggcgaagaagaagacacccccaaagagggagcggaagccatcgggggggagttcaaagggcaccagtcggccagggactcccagtgcagaagcagcaagcacctcttctaccctgcgggctgcagccagcaagctggagcaggggaagcggacgagtgagactccagcagccaagcgtcttcggatggacacgggtccccagagcctgtctgggaagtccacacccagcagcggtgatgtccaggtgacagaggacgctgtgcgccgctacctgacccgcaagcccatgaccacaaaggacctgctgaagaagttccagaccaagaagacagggctgagcagcgagcagacagtaaatgtgctggcgcagatcctcaagcgcctcaaccctgagcgcaagatgattggtgataagatgcacttctccctcaaagag

SEQ ID NO: 4755 - DNA, 545 bp, Mus musculus
  misc_feature (99)..(99): n is a, c, g, or t
  misc_feature (185)..(185): n is a, c, g, or t
  misc_feature (427)..(427): n is a, c, g, or t
ccagagtccggtgcaggcagtgaattcaaccgcaagcttagggaggaggcgcgccggaagaagtatggcattgtcctaaaggagtttcggcctgaggancagccttggctactccgtgtcaatggcaaatcaggacggaagttcaaaggcattaagaaaggcggggtaacagagaacacagcctnactacatcttcacacagtgtgctgatggtgcctttgaggctttccctgtacagaactggtacaatttcacaccactggcccgacaccgcacactcactgctgaggaagccgaggaggaatgggagaggaggaacaaggtcctaaaccacttcagcatcatgcagcagcggcggctcaaggaccaggaccaggatgaagatgaggaggagaaggagaagcgcagtcgcaagaagcctagtganctgcgcattcatgacctggaggatgacctggaaatgtcctccgatgccagcgatgccagtggtgaagagggcagcagaacctccaaggctaagaaaaaggcccctgtgaccaaggcag

SEQ ID NO: 4756 - DNA, 443 bp, Mus musculus
  misc_feature (34)..(34): n is a, c, g, or t
atacccaagcagtggcagacgctgtcacttaccnagcttggtttccacagtattgaactgaacgagcctccactagtccacacagccgccagtctctttaaggagatgtgttaccggtacagagaagatctgatggcaggaatcatcattgcaggctgggaccctcaagaaggagggcaggtgtactctgttcccatggggggtatgatggtaagacagtcctttgccatcggaggctccgggagctcgtacatctatggctatgttgatgctacgtatcgggaaggcatgaccaaggacgaatgtctgcagttcactgccaatgctctcgctttggccatggaacgcgacggctccagtggaggggtgatccgcttggcagccattcaggagtcaggggtagagcggcaggtgcttttgggagaccaaatccccaagttcac

SEQ ID NO: 4757 - DNA, 561 bp, Mus musculus
  misc_feature (93)..(93): n is a, c, g, or t
  misc_feature (102)..(102): n is a, c, g, or t
  misc_feature (117)..(117): n is a, c, g, or t
  misc_feature (355)..(355): n is a, c, g, or t
  misc_feature (361)..(361): n is a, c, g, or t
  misc_feature (419)..(419): n is a, c, g, or t
  misc_feature (460)..(460): n is a, c, g, or t
  misc_feature (462)..(462): n is a, c, g, or t
tgttgtgaaggctgtggctctgccatgaaggatgtcctgttgccattaaaatctggaagtggttcaagccaggctgaccaagaagccaaaganctggccagncagattagttttaanggccgaagtcaattcatctggaaagactatcgctgaatcagacttaaaccagtgtttctcactaaatgactcacaagacgatttacctacaacattccagggtgctacagcaagcacatcgtatggcgcccagaatccatcaggagcacccttgccacaacctacccagccagctcctaagaatacctccatgagccctcggcagcgcagagcccagcaacagagtcagagaaggccnatccanttcccccgatgtgctccaaggccagccaccaagagcccaccacacagagcacggcggntccgccatgctgatcatcatcctgactttagcattggcggntnttatattccgacgaatatatctggccaatgagtacatatttgactttgagttataatgctggtttgtgacttaagagctgtgactcagttgcttcatta

SEQ ID NO: 4758 - DNA, 86 bp, Mus musculus
gcttatccgggcttgcgccgaggccctaggcagcctgaaacagctggatcactgagacctctatcctgatccctgttcccctgaga

SEQ ID NO: 4759 - DNA, 460 bp, Mus musculus
aggatcgcatctcccgtctgatgggggactacctgctccgtggttaccgcatgctgggcgacacgtgcgccgactgcgggacgatcctcctgcaagataaacagcggaaaatctactgtgtggcttgtcaggagctcgactcagacgtggataaagataacccggcactgaatgcacaggcggcgctctctcaagctcgggaacaccagctggcctcatctacagagcctgcctcgagctctcggcccccatcccagccaccagtaccccgtccagagcactgtgaaggcgcagcagccggggctcaaggcagcccaggcgcctcctcttccggctgcacctccaaatacggacgcggtggcttccacacagacggccctcctgcagaagctaacctgggcgtcagtcgagctgggctctagcacctccttggagactagtatccagctctgtgggctta

SEQ ID NO: 4760 - DNA, 309 bp, Mus musculus
  misc_feature (271)..(271): n is a, c, g, or t
attttgcagagaacgagctggatctgtttagaaaggctctggaactgatcgttgactcagaaactggctttgcttcttctacaaacattttgaacctagttgatcaactcaaagggaaaaagatgaggaagaaggaggccgagcagaaggagggagagttcaccttgcatggccgggctatcttggagatggagcagttcatccgagagagctacccagattctgtgaagatgtgcaacatctgccacggcctcctcatccagggtcaaangttgtgagacgtgtggaattaggatgcatttgccttgt

SEQ ID NO: 4761 - DNA, 140 bp, Mus musculus
atgtggaggagcttgcccgagacggggaggcaccactggacaaggcctgtgcagaggaggaagaggaggaggaagaggaggaggaagagccggagccagagcgagtgtagcacaggtgccctgcccaagtctgggctgca

SEQ ID NO: 4762 - DNA, 332 bp, Mus musculus
ggcagattcccaacgttttagacaatttatcttgcttacccctcaaagcatgagctcccttccctcaagtaaactgattagaattcttcgaatgtctgaccctgaaagagggcaaaccacactgcccttccgacctgtgactcaagaggaagatgacagtgcaagttgacagcttagtgccttgcctcgtactgaaggggaattgtgaggggataactggactggtggatgaaatggcgtgagacagaggcactctgaaataaaggagctcctttaacatcactcatcgcttgtgtaaataagcctagaaagccagctgttccttgtgaaaa

SEQ ID NO: 4763 - DNA, 435 bp, Mus musculus
aattttatccaccagggacctctcggccacagataattgtgtctgagtttcgggatgaggtatatgatgtgagactcagagctgcttaccatccagagtttccaactgttctgacagctttagaaatagacaatgctgttgtggcaaacagcctgattgacatgcggagcatagagacagtgctgctgatcaaaaataattctgtggctcgtgcagtcatgcaatcccaaaagccacccaaaaattgtagagaagcttttactgctgatggtgatcaagtgtttgcaggacgttattattcatctgaaagtacaagacccaagtttctaagcagagatgtggattctgaaataagtgacttggagactgagattgaaaataaaaagggccacataataacccttcagcagcgtctgtctgcgcttgagaaggata

SEQ ID NO: 4764 - DNA, 540 bp, Mus musculus
  misc_feature (343)..(343): n is a, c, g, or t
  misc_feature (350)..(351): n is a, c, g, or t
  misc_feature (353)..(353): n is a, c, g, or t
  misc_feature (384)..(384): n is a, c, g, or t
  misc_feature (411)..(411): n is a, c, g, or t
  misc_feature (502)..(502): n is a, c, g, or t
ggccacagcaccagattcagtttgacgaagacatggacagttctcttaagcaggagaagccaactgatttcagaaaaaggaaatatttattcaaggggaaaagactttcaatttttgctgataaggcgtttgctgatgaaccacctgaaccagaagcatcaccttctctctgggagatagagtttgctaagcagttagcctcggtagctgaccagccctttgagaatggatttgaggagatgatacagtggaccaaggaggggaagctgtgggagttcccagtcaacaatgaagcaggtttagatgacgatggctccgaattccatgagcatatatttttggnataagtnncntggaggatttccccaagcaaggaccaatccntctgttcatggagctggtgacctgtgncctttccaaaaacccatatctgagtgttaaacagaaggtcgagcacatagagtggtttagaaattattttaatgaaaaaagagatattctncaaagaaaataatatagcgttcacttaacatcacaaag

SEQ ID NO: 4765 - DNA, 408 bp, Mus musculus
attttggtatgttgagtcgctgggatgacagtcagaggtttttgtctgaccacccacacctcgtatgtgaagagactgctaaatatcttattttatggtgtttccacctagaagctgagcagaaaggcgctctaatggaacagatagcacaccaagctgtggtaatgcagtttattatggaaatggccaaaaactgcaatgtggatccaagaggctgttttcgtttgtttttccagaaagccaaagcggaggaagaaggttattttgaagcattcaaaaatgaacttgaagctttcaagtcaagagtaagactttacgctcaatcacaaagcttgcagcctgtgacagttcagaatcatgtcccccattctggtgttggatgcataggctccttagaatccttaccac

SEQ ID NO: 4766 - DNA, 479 bp, Mus musculus
  misc_feature (337)..(337): n is a, c, g, or t
  misc_feature (358)..(358): n is a, c, g, or t
  misc_feature (382)..(382): n is a, c, g, or t
  misc_feature (387)..(387): n is a, c, g, or t
  misc_feature (393)..(393): n is a, c, g, or t
  misc_feature (424)..(424): n is a, c, g, or t
  misc_feature (426)..(426): n is a, c, g, or t
tgagaagccggctgtccctgagactgcaggcatcaagtttccagattttaagtcggcaggtgtcacgctacggagccagcggatgaagctacccagctctgtgggtcagaagaagatcaaggcgctggaacagatgctgctggaacttggtgtggagctgagccctacccccacagaggagctggtgcatatgttcaatgagttgcggagcgacctggtgttactctacgagctcaagcaggcctgtgccaactgtgaatatgagctacagatgctgcggcaccggcacgaggccctggctcgggcaggagtgctgggggcccctgccgcagcagcnagtgggaccaaccccggcttntgctgagccaacagtgtctgaatntgganttggtnctggaccccaccaaggataccatcattgatntngtgggtgcacccctcacacccaattcgcggaaacgacgggaatcagcctccag

SEQ ID NO: 4767 - DNA, 128 bp, Mus musculus
  misc_feature (30)..(30): n is a, c, g, or t
tggtaccagaaagggctttcctccaaagcngcctctcctggctctgtggctcagaggaagaatggccaacatcccgaagaaaacatccctccaaaagtcaagcctgagccaagtatctcgtaccaggg

SEQ ID NO: 4768 - DNA, 558 bp, Mus musculus
  misc_feature (205)..(205): n is a, c, g, or t
  misc_feature (234)..(234): n is a, c, g, or t
  misc_feature (245)..(245): n is a, c, g, or t
  misc_feature (255)..(255): n is a, c, g, or t
  misc_feature (300)..(300): n is a, c, g, or t
  misc_feature (306)..(306): n is a, c, g, or t
  misc_feature (339)..(339): n is a, c, g, or t
  misc_feature (349)..(349): n is a, c, g, or t
  misc_feature (373)..(373): n is a, c, g, or t
  misc_feature (392)..(393): n is a, c, g, or t
  misc_feature (396)..(396): n is a, c, g, or t
  misc_feature (404)..(404): n is a, c, g, or t
  misc_feature (419)..(419): n is a, c, g, or t
  misc_feature (491)..(491): n is a, c, g, or t
  misc_feature (516)..(516): n is a, c, g, or t
ataaatggtgtcagctccccaagttgtcctgtaactataaatgtaagcgtatttccttagctcattatccagagatggccaggatggggagagggacggggttgcactttgcttctgcttgtggcctctgggggaaggacctgcagtgcagtctctccacactgtgggttctgctataggcttctagagatacaggttgccgtgnccaggatcctgcttactgccctttcctcncagctccccangtctccaagncagtggtactgcatgaagaaatcctgctgtgaaagcctattggantcgggntgtagggagatgggtgtgcctgaagcaaaagcnatgggtactncacaggagtcctattaggtgtttntctgatagtgttcccaatnnatnccagggantctaccactgagatntcaggctgaggcctgagaaggagaaagtgacccctcacttgcctggcttccttagcttgctcctgagctttncaaaaaaccaccctagaccccactnctacaagctacagaacaacactactgtaactacctactaaat

SEQ ID NO: 4769 - DNA, 327 bp, Mus musculus
  misc_feature (60)..(60): n is a, c, g, or t
  misc_feature (214)..(214): n is a, c, g, or t
  misc_feature (271)..(271): n is a, c, g, or t
  misc_feature (277)..(277): n is a, c, g, or t
  misc_feature (281)..(284): n is a, c, g, or t
  misc_feature (286)..(291): n is a, c, g, or t
cccctgaacatccaggacaaggacagcatccagcgagtcttacaggctgtggataaagcnaatggctactgttttggggttcaagagcagcgaagcctggaagccatgatgtccgctgcaatgggagctgattttcacttctcctccactctgggcatccaggagaagtacttagcaccctcggagcagaccgcagagcaggaagccatgcagnctgtgacacatgggcctggagagccggggacacctcagcgaggtacggacccaaaanaccacntccnnnncnnnnnncagaggctgggaggaaacctccatccctgcaaagga

SEQ ID NO: 4770 - DNA, 529 bp, Mus musculus
  misc_feature (443)..(443): n is a, c, g, or t
  misc_feature (484)..(484): n is a, c, g, or t
tgtgtcttaagactgccagagcccctccctcgataatccgaggctgtggggaaaaggtaaagagtcatctattgcagtctagatgacttcctggaaaaactttgcctcttaaaatatcttaactgtgtgtgttaatttgtaaaattcattatttgttcaaaaagttatgtatgtcccattcccagatatatgcacttttaagtgaagaaaatgttgctagctgtttatttaaaacttgggaaactttttaaataaaaatcaaaaaaatttagaagttatttcataaagccatatggtattgacatatttttatggtagtatttttgaattttttttttgagagttattctggaagtgtgttacaagctaggagaatgcttttggacagttatttttcataaaagatttgtatgattcaaaaccatttcttagactgaagtaantcgttttaatctgcacaggttatcttggcttctgccaaaancaaagtttagtattttctttatatacttggttatctggactggca

SEQ ID NO: 4771 - DNA, 496 bp, Mus musculus
  misc_feature (97)..(97): n is a, c, g, or t
  misc_feature (242)..(242): n is a, c, g, or t
  misc_feature (291)..(291): n is a, c, g, or t
  misc_feature (364)..(364): n is a, c, g, or t
  misc_feature (373)..(373): n is a, c, g, or t
gtgggaatacacttactacagcagaaacaaggacagagatggctatgaatcatcatacaggaggaggactctttcaagagcccattactctagacantcttcaagtccagaatttagaattcagtctttttctgaaagaacaaatgcgaggaagaagaatcacagtgaaaggaaatactactactatgaaaggcgccggtccaggagcgtgtccagtaacaggtcgaggactacatccgccngggcccgaccgggtgagaaatgagaagcccggagggaaacgcaagtacnaaacccggcatttggaaggtaccagtgaagaggctcagccggctcgggagttcacttccaaagggaaggacantcattaccnaaaatcaaaattggatggcagttataaaaatgagagtgacagcttttcagatagcagatcatcagacagagagacaaaacacaagaggaggaggaggaggacccggagcctaagtgtagagat

SEQ ID NO: 4772 - DNA, 267 bp, Mus musculus
gtggcccagagacttttcagtatgggtgatgtcaatgccaaggctagccagactggacagacagccctcatgctggccatcagccatggccaccaggacatggtagctgccttgctagaatgcggggctgatgtcaatgtacaggatgctgatggggccacagcactgatgtgtgccagcgagtatggacgccttgatacagttcaattgttgttggcccagccaggttgtgacctaaccatcttagacaatgagggcacaagtgcc

SEQ ID NO: 4773 - DNA, 432 bp, Mus musculus
  misc_feature (136)..(136): n is a, c, g, or t
  misc_feature (285)..(285): n is a, c, g, or t
  misc_feature (306)..(306): n is a, c, g, or t
  misc_feature (309)..(309): n is a, c, g, or t
  misc_feature (311)..(311): n is a, c, g, or t
  misc_feature (333)..(333): n is a, c, g, or t
  misc_feature (349)..(349): n is a, c, g, or t
  misc_feature (404)..(404): n is a, c, g, or t
  misc_feature (406)..(406): n is a, c, g, or t
ggcctgcagtgcgtgaaatacattgagggtcttcagtggagaacccagcagatccttactgagcacatccggatgatgcagagagagtaccagatcagatccgctgaactgaacagtgcccttttcctgctgagantcatcaatagcgatgtcgtcactgaactctttttcaggcccatcattggtgcagtcagcatggatgatatgatgctggagatgctctgtgcaaagctgtgaaggcatatgtccactcaagtgcattttactatagatggagaaagcggntcgtagctgtaggcagaagantgntnaaatttgtgaaaccaaactttncttgtatttttacatncatagtatatttgtattcaattgaagaaatactttagttacaatgtaaaaatccntntgctccatactggcttcttgtgaagg

SEQ ID NO: 4774 - DNA, 528 bp, Mus musculus
gggaagatcaccgtgagccacatttgctgttgggaatcccaggtgccaccgttgctgtgcgtatgctagtggctaaggaaacattcccaggggttcctgaagatccagaaagggcatgaaacctgctccatgtgcctgtccctccctgctgcagctaccaaaggagagtcctcaaagaggctccactcagggctgctttcctgggcctgagtcaatggcacaaggcccccgccacactgccattgctgtatggctgcatacaccagaccagaacactcccacagccaagacatctctctgggaccgcagcagctccctaccccacagcctaaagtttcctactggggctattcagcaagggccacgtagcttgaccttcctgcctctacactcagctggatgtcagagcccctagtcacccccaggccctgtactgttggggtctttgagccatgcagtcaggttccctggctggacagaaaagacagaggctttatgaagccagaccgtttctatttttgtccactg

SEQ ID NO: 4775 - DNA, 532 bp, Mus musculus
  misc_feature (293)..(296): n is a, c, g, or t
  misc_feature (358)..(358): n is a, c, g, or t
  misc_feature (424)..(424): n is a, c, g, or t
  misc_feature (427)..(427): n is a, c, g, or t
gggaaggctttcagtcagtgctcagcctttacccttcatcagagaatccacactggagagaaaccgtatccctgtgctcagtgtggcaaaagcttcagtcagcgctctgatctggttaaccatcaaagagttcacgctgatcaaaaactacaaatgtgactgatacctgtgtgaagccttcagcactgtgaccaatcttactggatatcagaggatctgcaggagccgtttgcacctctctgaaacgagaaaaaggaagagtgcctcccaggcggaatcaaagcaggtcagtnnnntggcagagttcccggcttgctgatgcatggaacaatgagaagaggtgtgcttgaggctcaantcaagggctgaatcttctgttgaccttggtggaaggaacggggcttactggatgggaacagatgtnttngtgtgtatattgcagcaaattgttaatactggcttgtggctttgctccccatggtactgtagtataaaaaaggctatgagaaatacactcactgctggcgtggta

SEQ ID NO: 4776 - DNA, 516 bp, Mus musculus
  misc_feature (38)..(38): n is a, c, g, or t
  misc_feature (261)..(261): n is a, c, g, or t
  misc_feature (284)..(285): n is a, c, g, or t
  misc_feature (351)..(351): n is a, c, g, or t
  misc_feature (438)..(438): n is a, c, g, or t
  misc_feature (477)..(477): n is a, c, g, or t
  misc_feature (482)..(482): n is a, c, g, or t
  misc_feature (488)..(488): n is a, c, g, or t
aggtgttcaatgtcaccagggacaacagaaacagcctncttgccagatattgtggccgtcgtgcagagcagccggacgtaaagcagcgctgttgggtccagctctgcctctgctcacggtgggccctgagcagcacccagtcagtccaccgtcctctgctcacggtgggccctgagcagcacccagtcagtccaccgtgtcctgtgtgagctccagacttgtatttcctcttacggttgtgcatgcggtttgagtaaattntaaaacgagtctgccaaacattnnggcggaattcgctcccaccggagtgtataatatgtttggggctgaggaaagacgggggttcacttnttccttgactttgagtgctgtagatattaaacacctctccaggtgcagctccacactggtgcagctgaaagcagaaacaactggttntcttcaattatttccaaaggaggaaaaaaaaatcagttntcctntccctntcttgtttattcctctgtttcttgacta

SEQ ID NO: 4777 - DNA, 501 bp, Mus musculus
  misc_feature (81)..(81): n is a, c, g, or t
  misc_feature (149)..(149): n is a, c, g, or t
  misc_feature (153)..(154): n is a, c, g, or t
  misc_feature (156)..(156): n is a, c, g, or t
  misc_feature (158)..(160): n is a, c, g, or t
  misc_feature (162)..(163): n is a, c, g, or t
  misc_feature (186)..(186): n is a, c, g, or t
  misc_feature (281)..(281): n is a, c, g, or t
  misc_feature (319)..(319): n is a, c, g, or t
  misc_feature (321)..(321): n is a, c, g, or t
  misc_feature (333)..(333): n is a, c, g, or t
tttctccacattgtaatccatgcctcagacctcaggaacccctggggtttttaattcacttaactactagccaatttctgncaaagagcaagttaattctgatcccgataacccagagacaaaggtctccaaggaaaactgctgctgtnagtnngncnnntnngggctttgtttttgtttaggganagggctagaggaacaggtttaggaggatagcactgtccgcatctctccgcctaccgtcttctgccaggccgagctgctccctgtggagagggacnaactctttctcatttcgcatatttttagtttgtgagcnangacacaaatgcnagatttggctagtaaagcaaagtaattgaacacctacctccttcagagaaagatcaggaggggctaatagtgggaatggatggaaacttggacaataggaccagagaaattctcaaatggcagcatgcatctcacatctctgagaacccgttgcaattcaatcttcta

SEQ ID NO: 4778 - DNA, 277 bp, Mus musculus
tggacttccgagaccttcctaggaacttccatcaggaagagaaccaggagcacagaatgggcaaccataccctctccagccacctacagatagacaaggtgactgacaaccagacaggggaggtgctcatctcggagaaagtcgaggcctccattgagccagaacggaacccggaaggggactggaaggttcccaaagtagaagcaaaagagcccccggtgcctgtgcagaaggtcaccgacagcttgcacccagagccccggcaggtggctttctg

SEQ ID NO: 4779 - DNA, 370 bp, Mus musculus
  misc_feature (275)..(275): n is a, c, g, or t
  misc_feature (283)..(283): n is a, c, g, or t
  misc_feature (291)..(291): n is a, c, g, or t
  misc_feature (293)..(293): n is a, c, g, or t
  misc_feature (340)..(340): n is a, c, g, or t
  misc_feature (342)..(342): n is a, c, g, or t
acattcaggcaccacgggtggctaagccggacaaggggagcaaggccttttacacaggagcggaaacgcgttgtccagaggttgatattctgcaattttgatgaaagaaatagcactgccttcaaaaagaaaaagggaaaaaaaatcagatgccaagaacttcagacttgtgtttcattttgggttttgatttcaggtgctcaaaatgcagaacacgaaacaaatcctgtacttagatccactttgactgaatccaaagttcccatttcagatantccacatntacctggntntcctgttcagtgtgtgtgcattgatgttgctaagatgtgtgggtttntntctggatggcacaattatacttagtttt

SEQ ID NO: 4780 - DNA, 551 bp, Mus musculus
  misc_feature (393)..(393): n is a, c, g, or t
  misc_feature (405)..(405): n is a, c, g, or t
  misc_feature (433)..(433): n is a, c, g, or t
  misc_feature (468)..(468): n is a, c, g, or t
  misc_feature (525)..(525): n is a, c, g, or t
tgcttttgcaggaaccccagaacatggacaattccaaggcagtccagggggtgcttatgggactgctcagcccccacctcattatgggccaacacaaccagcctatagtcctagccagcagctcagagccccatcagcatttcctgcagtgcagtacctatctcagccacagccacaaccctatgcagtgcatggccactttcagcccactcagacagggttcctccagcccggcagtaccctctctttgcagaaacagatggagcatgccaaccagcagaccagcttctcggactcatcttctctgcggcccatgcacccccaagctctgcatccagcccctggactcctggcttccccccagcttcccgtacagatacaagcagcaggganagtcaggctttngccaccaccagccaacctggcccccgantccctttcatccaacacagccagaacccaagattntatcacaagtaaccaccagagagctccagcccaccctccatccctcaggctggggtnttatgtgccccaaaccaataaaatgt

SEQ ID NO: 4781 - DNA, 417 bp, Mus musculus
gcttcttccccattaattacgtggaagtcattgtgcctttacctccgtaaatgtgtcttttggacctaacttcagaactgaaatgaattggcaccagtgctctctcagtgtggtgttctgtgacatcctcgctctctggcccacttaatcacttttgtatgtgtgttttctttataatgtattttgtatcaatttaatttgtataactgatttctttgtcctaactcataaaaatagttttcttcttgttctaaaaagtcattggttaaatgtatttgcttcctgttgctaaaacgagtaaattgcgcccattcgaatggcctgggtagtccttgactgcagtgggaacgcaccctttgcagccatgaaagctaaaggttttgtttcctgacattattgatggcctctggtcttttc

SEQ ID NO: 4782 - DNA, 493 bp, Mus musculus
  misc_feature (409)..(409): n is a, c, g, or t
  misc_feature (435)..(435): n is a, c, g, or t
  misc_feature (437)..(437): n is a, c, g, or t
  misc_feature (450)..(450): n is a, c, g, or t
  misc_feature (457)..(457): n is a, c, g, or t
aagcctcccaagaactgattcctattgaagattttattacccctgtgaggttcttggataaatcaagacagcgacctcaggaggagcattcacctgaggagagtgaacggagagctcttctgctgaagaggtgggcactgtttaagcagcaggagcatgagatggagagggacgccatcagatccatgctagaagcccagcaggaagccctggaggagctgaaacttgaatctgcagagctctatgccgaggccataaagcgggataccagcctattccccttcgagaaagaagggccacattacacaccacctatctctaactaccaggcccctgaaggcaggtacaatgatatcaccaaggtgtacacacaagtagaattcaaaagataagagactgaaaactgctntcctgggaacatgctggccctaggantntggagtagagatntaaagtntactttccacagacaagtgagtcatcctaggaacaa

SEQ ID NO: 4783 - DNA, 380 bp, Mus musculus
gttcaatgacctctgaaagcctgaacttcagggaaatgctggctacaatcaccgacccgccatggcctccagtagtgtattagctcagtgtgtatctagttggcagttcaccatcctgtgcaacaggtttcttttgctggctgtacatcatgtaatcctcattaaagtatatcttcatagtgtggaccataagaaatcttcaattaaatgctaacttctgcctgtgattagaatttggcataaaatatttggcataaagtaactgtatgaaattctaatctaaacactgttactaaagttgtaagtgaaaatgatggtattcatgattaaatgctgttcatgaatgtgatacaatctagggctactagttacttaacatt

SEQ ID NO: 4784 - DNA, 426 bp, Mus musculus
tgtccgaagggccactcagaaactaggacaagagactacaaggaatatacttggtaggagcatctcctgaggcagggttgtgctggtgtgttctccccactcttgagaggggtctctccttcaggcctcaactcaaacaggcttgcacaggagtggagacttgagccggcagagagaaaggactgagggactgtcttttctcataggaagttgggggtgtccctggtcttgttttcattgtgaacagcacagattccagcactggtgtgggagagagaaattccccacccagacagagagccaggaaagatggagaaagtgaaagtcagtggtcaggagcaaagacctcatatgagccttcagatggttcggggcccaaaaacactcctgggcccctgggaaggctgggaccatagtactcaaacc

SEQ ID NO: 4785 - DNA, 314 bp, Mus musculus
tttccggccggagagcagtcagatatgaacggacgggtggattatttagtcacggaggaagagatcaacctgacgagaggaccttcggggctgggcttcaacatcgtcggtgggacagatcaacagtatgtctccaacgacagtggcatctacgtcagccgtatcaaagaggatggggctgcggcccaggatgggcggctccaggagggtgataagatcctctcggtaaatggccaagatctgaagaacctgctgcaccaagatgctgtagacctcttccgtaatgcgggatgtgctgtgtccctgagagtaca

SEQ ID NO: 4786 - DNA, 342 bp, Mus musculus
  misc_feature (60)..(61): n is a, c, g, or t
  misc_feature (66)..(66): n is a, c, g, or t
  misc_feature (73)..(73): n is a, c, g, or t
  misc_feature (297)..(297): n is a, c, g, or t
aatcttaaggtcttgcctcacaaagtagtttttcctcaggtgagggatgtccacctcgcnngcgcnctggttngcagagaggtacaacacaaatttgaggggaaagatggctctgaggacaactggagtgggatggtgctagcccaggtgccattcttacaggactatttttacatttcctacaagaaggatccggtcctctacgtctatcagctcctggatgactacaaggaaggtaacctccacatcattccagagacccctctggctgaggcgagatcaggtgatgacaatganttcttaataggttcctgggtgcagtacaccagagatgatggatcc

SEQ ID NO: 4787 - DNA, 445 bp, Mus musculus
  misc_feature (397)..(397): n is a, c, g, or t
atgcttggccctgaaatgctacagatgtttttgtagaaatcaagatgaagcaaagagggaagggtgtggtaaagagacaagaaatgggagaatctgagaaatggtgagtaattatagtttgacaagattggaattaacctgtgttcttcaggactctatgtgcattaactctggggtagacaggagcacctgtaaatgcagaacgtctcacagctacgagtacatgtggcggatggcaggcagttctactccgcaatcaggaaatatggtctaacgttactctgaaacccagagccacttcctgcgaaaggctggtttgtacagtggcaagtcctcccacaatgagtgataggtactactgttcagacctgtttgtgagtttagatgtacaaagatntcggcctcacaaatcctctgtgtgcagatgtgtttgttcttactagaa

SEQ ID NO: 4788 - DNA, 500 bp, Mus musculus
tgactttctgttggagcctcctgggcacaacaaagaaaatgaagatgatgttgaggttatgtcaacagactcttcgagcagcagtagcgactctgactgagaaaggtgtggcatgcacagactccagtgcggcagagttctgtcaagggggaaagaaaagcacagacctaaggagcccatgaaaatcagcgggttttcttcctagagcccgagcccctggttttctatctgttacacaatgtttgaggattagtcagaattactgtagtgtttggttgtacatagcagccctggcatgagactgaagaggaactcacacaactcatggagcatacttagaaagagcactgagccagacgtggtggctcacacctatagtcccagcacctgggaggctgagggattgctgtgagtgtcgggccgccttgagctacagaatgagctgagccaccagggtaacagagataagaacaggcatcggagcgctgtgtgatacttca

SEQ ID NO: 4789 - DNA, 528 bp, Mus musculus
gaatcgcttcttctccgataaacagagatttattgatgaaatcaacagtgtgactgcagagaaactcatctataattgtgctgtggaaatggttcaatctgcagccctggatgagatgtttcagcagactgaagacatcgtttatcgctaccacaaggcagcccttcttttggaaggcttaagtaagatcctgcaggaccctacagatgttgaaaatgtgcataagtataaatgtagtattgaaagaagattgtcagcactctgctgtagcactgcaactgtgtgagtagcaggcttgtctgtggactggcatggaacaggaggtgatacatttgggattacatcttggttctgtcacccatcccaggacagtgtggtgactaccaaagaacaagcagcagcttaagaaggaagaacaatacaaaactactacatattgtagaaaacctgccttattggagaagtcactccccctttcctttctcttcatagaagcagaacaaaaagttttccacatggctcaagtta

SEQ ID NO: 4790 - DNA, 472 bp, Mus musculus
  misc_feature (240)..(240): n is a, c, g, or t
  misc_feature (336)..(336): n is a, c, g, or t
agccgaacagaaactccttgtgccaaaacagacactaagctggtgacgccactgagccgctcagcccccaccaccctctacctcgtgcacactgaccatgcttaccaggccacacccccggtgacgattcctggatccgctaagttcacccccaatggcagcagcttcagcatttcctggcagtctcccccagtcactttcactggcgttccggtgtctcctccacatcatcccacagcnggctcaggagagcagagacagcacgcccacacagccctgtcctccccgcccagagggacagtcaccctaaggaagcccagaggagaaggcaaaaangtgccgcaaggtttatgggatggaaaacagggacatgtggtgcaccgcctgccgctggaagaaggcctgccagcggttcattgactgagccattcctgcctctccttccaaaggaagctactcaaggcccagggaa

SEQ ID NO: 4791 - DNA, 170 bp, Mus musculus
attgttgatgaggattcgccggtccttccgcttggagagttctcggagccgtttgtacatttcatcactcagtgcatgaggaagcagcccaaggagagaccggcgcctgaggagctgatgggtcacccattcatcgtgcagttcaatgatggaaactccactgtggtgtc

SEQ ID NO: 4792 - DNA, 371 bp, Mus musculus
  misc_feature (298)..(299): n is a, c, g, or t
gtcaactcaaggacgaggccatcgtgtacctggcgcagagacgcggcgcgggcctccgcagcctctcattagcagtcaacgccaatgttggggacactgcggttcaagagttggctcgaaactgcccgcagctcgagcacctagacctcaccggctgccttcgggtcggaagcgacggtgtcaggacactggccgagtactgcccggcgctgcgctctctgcgggtgcggcactgccaccatgtggctgaaccgagcctgagccgcttgcggaagcgtggtgtggacatcgacgtggnnaccacccctgcaccaggctctggtgctactccaggacatggcaggcttcgcaccctttgtcaacctacaggt

SEQ ID NO: 4793 - DNA, 555 bp, Mus musculus
  misc_feature (279)..(279): n is a, c, g, or t
  misc_feature (323)..(323): n is a, c, g, or t
  misc_feature (330)..(330): n is a, c, g, or t
  misc_feature (333)..(333): n is a, c, g, or t
  misc_feature (341)..(341): n is a, c, g, or t
  misc_feature (399)..(399): n is a, c, g, or t
  misc_feature (452)..(452): n is a, c, g, or t
  misc_feature (516)..(516): n is a, c, g, or t
gataggagcaagtggccctctaggatgctggatgctgagaaagtgccagagccagctggggacagagccatggggcctccctgagcattctttggcccaggcatcttcttgaggcccccttcttcactgcttggggcctcccagacaaagcctggtcctgtgtgctctgtagccagccagggcataggagcctttggttagggcccagtcttgtactgaccaaacctcactttcttctctgagcctggagtctcagcttcactggacacagcccttccnatacccgtggcgcccatctcaccccaagctgctggatacagctntacctgnacnccaacccntggcggactcagaaaagcattcaataggcttggccaggaacttcctgttttccacttntgctagccactgtgacctcacagatccttctgtattccactctcatctggcanccccaaccaggtgttctcagaagaacggactgggggcccagcatgccaattcagagcctcgaanccggacacaggctcttcctctctcttataccctgtataa

SEQ ID NO: 4794 - DNA, 380 bp, Mus musculus
  misc_feature (344)..(344): n is a, c, g, or t
ccaccaagggtgaactcggacattgaagttgaagaaagcgaagctgtatccgttgtgcagcactggttgaacaaaacggaagaggaggcttctcggagcataagggagaagatgtccatcaacgactctcccacccatggacatgacatacatgtgaccagagatttggtgaaacaccatctctcaaagtctgatatgttaacagacccgagtcaagaagtcctggaggaaagaacaaggatccagtttataagatggagccacacccgtatcttccaagtgccaagtgaagtgatggatgacgtcatgcaggaacgaatagatcaagtgagacgaagcgtatntcatctcatgtgtgactcgtacaatgatccaagctt

SEQ ID NO: 4795 - DNA, 427 bp, Mus musculus
atgactcctgtcatcgaggtatgggacctggatatagtggactctctagaaccagtcttcacactgggaagcaagctttccaaaaagaagaagaagaaagggaagaagagttcctcagcagaaggacatactgatgctgtccttgacctatcctggaataagacagtcagaaatgtgcttgcaagtgcatcggcagacagcactgtagttctctgggatctgtctgtggggaagtcagtagccaggcttactgcacatacagacaaggttcagactctgcagtttcatccatttgaagcacagactctgatttctgggtcctatgacaaatcggtggctctgtatgactgcagagaacccagccagaacccacgccagtggcggttcagtgggcagatcgagagagtgacctggaaccacttctcac

SEQ ID NO: 4796 - DNA, 396 bp, Mus musculus
  misc_feature (282)..(282): n is a, c, g, or t
  misc_feature (309)..(309): n is a, c, g, or t
  misc_feature (311)..(311): n is a, c, g, or t
  misc_feature (314)..(314): n is a, c, g, or t
  misc_feature (327)..(327): n is a, c, g, or t
tattaagcagggatcggcgacggaaacgccaggtggtcggggctgtgatagacgaagggctgactacgaagcaccacctcaagaagcgggcgtccagtgctcgtgccaacatcacgctgtctgggaagaagcgcaggaaactcttgcagcagatccgacttgcccagaaagaaaaagcagccatggaagtggaagccccctccaagtcaaccaggactagtcagccacagcccaagcaacaaaagaagataaaagctccccaggacgtagctatggaggatnttgaagataagagctaaaatccctgcntnttntaccagaagatgntcaacagcactgagaaagatttggaggaactttggaaaaaatattagcatatttcactttcctagacac

SEQ ID NO: 4797 - DNA, 284 bp, Mus musculus
atttgcccacaagccctttaatgaagaactttgataccagtcagtggggagacattaaactagttgatgtggataaactgtctttgccgcaagacacaggtgtgttcactagcaagattccctggtacccctatctgctgctcatgatggtagttctgctgggtctcctcatattctttggccccactgtattcctggaatggtctccacttgatgaattggcaacttggaaagactatctttcaagcttcaattcttacctgactaagtctgctgattttata

SEQ ID NO: 4798 - DNA, 480 bp, Mus musculus
  misc_feature (333)..(333): n is a, c, g, or t
  misc_feature (389)..(389): n is a, c, g, or t
  misc_feature (449)..(449): n is a, c, g, or t
acaagctgggctgggttctgagcatgaactgcaaccactggaaatcccctgtgccccctcctggcacagctacacctggtgccgagagtctggagaccaggccctgtcagaggaagcgctgccgaagaagctgacttctcccctgggaacgcagataccttcctctttctcgcccttccagggcagcaggagagggaagaactgaggtccaggcttttccctatctccctgaggccaggacagtcttctccggtgaccatggagtgaaggtcattctactgcctgtgctggtagggaagccgtactcctatttgtcctttgagttgccacgtntcttgggaactgcagctaggcacctgtgaacctagattccaagcccgggaggctgnccgacgaaggggagtgcattcatatcccggggagaagatgggctgtccccacccacgggnccgtggggctttcctgacttgcactgcatgt

SEQ ID NO: 4799 - DNA, 545 bp, Mus musculus
gactgctcatcaatcgagacttggtggggccgttcgttctgagtcctcgaaggaaagatgtggtccagctaggggatgtagttcatggtgtggaaaggctggtggacctcctggggtggacacaagaactgctggatcttatgcagcgggaacgtggcaagctggatggacaggacagataagactatggcttcttcacctggggaagtcacacagcagatcatcctatgtccagcaagacttcatgcctgaagacagctccaacacgtttacaaacatgaaccagaccacaacatgtggcctggacagtggtcctccgaggctgcctttggaaaggctgaccagggatgtctacccttggggcccctccatgtgtgcgccctgtccacctcatcactgctgaaggtgtagtgcaggtgctgctttctgcagcggcccttaagttatcacgagggcagcacagcacgcccgtcgccaggcaggcgatgcactagggcaatctagcatgttgatcggtaaagtggcatctttaactacaacatcat

SEQ ID NO: 4800 - DNA, 160 bp, Mus musculus
gacatcctggaagactggacagccatcaaaaaggccagggcagcagtgtcccctcagaagagaaaagcagacggaccctgaccctgcatttactctcgctcggagggtcctgggagcagctggtacctcacgcaggattaacatttctctgcaaaggcag

SEQ ID NO: 4801 - DNA, 565 bp, Mus musculus
  misc_feature (323)..(323): n is a, c, g, or t
  misc_feature (341)..(341): n is a, c, g, or t
  misc_feature (359)..(359): n is a, c, g, or t
  misc_feature (373)..(373): n is a, c, g, or t
  misc_feature (389)..(389): n is a, c, g, or t
  misc_feature (391)..(391): n is a, c, g, or t
  misc_feature (399)..(399): n is a, c, g, or t
  misc_feature (426)..(426): n is a, c, g, or t
  misc_feature (476)..(476): n is a, c, g, or t
  misc_feature (481)..(481): n is a, c, g, or t
  misc_feature (502)..(502): n is a, c, g, or t
  misc_feature (517)..(517): n is a, c, g, or t
  misc_feature (538)..(538): n is a, c, g, or t
  misc_feature (540)..(540): n is a, c, g, or t
gtgtgtgtctcaaaccaatggtcataaatggaaacctgtctgtggagagagttatctatgctgaactggaaaatatcaccattcaatgtgatcctggatataccatagttggttcaccaaacatcatttgttcaaacagaacgtggtaccctgaggtacccagctgtcagatggaggtcctagaagactgcagaatagtgagcagaggcgcacaactcttgcattgcctctcaagcccagaagatgtgcacagggccctgaaggtgtacaagctgtttctagagatcgaacgattggaacatcagaaagagaagtggatacanttacacaggaaacctcantctatgaaaattaatagntcatttagactttncaattagtggacagantntccacgcnagcagctggcctgacacacaccaccantcctgttaaaaggttttggggccagaagaacttaggttgtgttttttttnttttntgttttgtttttgaaactatntcattcattagtgtntagccattgtggttcaatttntntacttggctggactcactgaaatag

SEQ ID NO: 4802 - DNA, 236 bp, Mus musculus
tgaggccttgtacaagtgccagcatttgactaaagaaaatcaattatactgctgcaggaactgccacctcctgattgaatctaacctcatccagcacaaagtcaggatgttgtggaaggagaacagacagctgctaaggaagcagattgcattggaagaatgcaacataaaaacaaaaatactatgtaaagaaggcagccagaagatcaaagacgaatatagcaggcaagcagcag

SEQ ID NO: 4803 - DNA, 495 bp, Mus musculus
ggcaagggcttattgttcctgacaaccctccatatgataagggagccttcagaattgaaatcaactttccagcagagtatccattcaaaccacccaagatcacatttaaaacaaagatctaccaccctaacatcgatgagaaggggcaggtctgtctgccagtcattagtgctgaaaactggaagccagccaccaagactgaccaagtaatccagtccctcatagcactggtgaatgacccccagcctgagcacccactccgggctgacctagctgaagaatactctaaggaccgtaaaaaattctgtaagaatgctgaagagtttacaaagaaatatggggaaaagcgacctgtggactaaaatctgccatgagtgattccagcaagtttgagcagagaccccgagcagtgcattcagacaccccgcaaagcaggactctgtggaaattgacacgtgccaccaactggcgtccgcttgtggcagttactaactt

SEQ ID NO: 4804 - DNA, 525 bp, Mus musculus
  misc_feature (235)..(235): n is a, c, g, or t
  misc_feature (355)..(355): n is a, c, g, or t
  misc_feature (399)..(399): n is a, c, g, or t
  misc_feature (435)..(435): n is a, c, g, or t
  misc_feature (464)..(464): n is a, c, g, or t
tccagaggagtttgtctttgccaaagagtatatggaccacacggagacccactttaaaaacgttgccttaaagcacatgcctcccaacctgcagaaggtggacctcttgagggcagttcccaaaccagacctagattcatacgtgtttctgcgagtgaaagaacgacaagaaaacatactagtagaaccagaagccgatgagcagagagactacgtgattgacttggaggtgggnctcacagcacttgatccgatacaaaaccatcgcacctcttgttgcttctggagcagttcagctaatataaaacaaagcaagcctgaggacatggagtggtcacagacaatattagaaacnccatcttttgtgtctaatagtgaagtcatgttccatacagttcntcagcaatgtgtggaccacttggacgtagaaaggcnccgatgcagaattcccttcgttgtcacanccttctcctaaattcctgtttaaccagcaccaacagatgggcccgtgctctgaatactcag

SEQ ID NO: 4805 - DNA, 483 bp, Mus musculus
agcgacagggtatttcttccatgcaggaatctggaccaaagaaagtggcctctattcagagaaggaaaaagcctgcttcacagaaaaagcgacggtttaagactcacaatgaacacttggctggagtgctgaaggattactcggacattaccccgggcaaatagggaacacttttattcctaaacacagttacagacacgcagtcgagatctttcttgatgcttgggatctcaagactgtctgccttcctgcctgctcctcaggcctgagagaggagctgctcagtttacagaacaggagcgggttaccagactcattcttttcatccagcaggctagtgggaaggaatgggtgttcctgtttaactttctgggtttgtttgttttattttattagaaagacacttatatgacactcaggtgtctgctatttatcttgatttctaaatggttctggattccatgttttctctattcgctttag

SEQ ID NO: 4806 - DNA, 554 bp, Mus musculus
  misc_feature (381)..(381): n is a, c, g, or t
  misc_feature (412)..(412): n is a, c, g, or t
  misc_feature (448)..(448): n is a, c, g, or t
gtcctcagtgtgcagagcaaccggctagcaaagatcgaaggtctacagagcttggtgaacctgcgggaactatacctcagcaacaatggtatcgaggttatcgagggcctggagaacaacaacaaactcaccatgttggatattgcatcaaatagaataaaaaagattgagaatatcagccatctgacagaactgcaagaattctggatgaatgacaatctactggagagctggagtgaccttgatgagctgaagggtgccaggagtctggagaccgtgtacctggagcgcaaccccctgcagaaggatccacaataccggcggaaggtcatgctggccttaccctctgtgcggcagatcgacgccacatacgtcaggttntgagccctccttgctcctcacctggtccctntcctcaaaagaacttcccagccacggttttttaatnctacctattgctcctgatgtcgtcactataccaacagtcacaacccaatggcaataataaggcactggtggcacctggcctgtgatgctacacaccatttggagat

SEQ ID NO: 4807 - DNA, 361 bp, Mus musculus
caaggctcatgggatgctctgtgtagggcttttcacactgctgctgcttgaactctgccattatcccctgtgatcctgtgcctcacttcagactgcttagagccagcctcttctcagacttaggcacagcctctcttaccagatcagtgttaaaaagaagcaccttggctcccatgcaggaagacagaggcccattcctcttgtctatagccagccgagtggctacttgtcactttccacaaagaattaagtatgagagttttggatgggacagtggactaagctaaaaatgtacttcaccagcaagaatcaactgtaaaattcaagatgttccttcaaatgttttctcatctgtctgtca

SEQ ID NO: 4808 - DNA, 553 bp, Mus musculus
  misc_feature (382)..(382): n is a, c, g, or t
  misc_feature (385)..(385): n is a, c, g, or t
  misc_feature (414)..(414): n is a, c, g, or t
  misc_feature (434)..(434): n is a, c, g, or t
  misc_feature (453)..(453): n is a, c, g, or t
  misc_feature (479)..(479): n is a, c, g, or t
  misc_feature (481)..(481): n is a, c, g, or t
  misc_feature (483)..(483): n is a, c, g, or t
  misc_feature (495)..(495): n is a, c, g, or t
aagttcttcgaggaagccttccagcaggacatggaacagtacctgtccacgggctacctgcagatcgcagagaggcgagagcctatgggcagcatgtcatccatggaagtgaatgtggacgtgctggagcagatggacctgatggacatctcagaccaggaggctctcgatgtcttcctgaactccggcggagaggacaacattgtgatgtcccctggtgtggagatggaatccaaccccaatcagaatgaaatgagtcttcagattccaagtccctcagaatcagcatcccagccacctgcctcaccctctgcctgcactgacctggacactgctgatgcccccctcatccagtctgatgaggaggaggtacaggtggacncgnccttggtcacattacacactgacagaaantccaccccaggtgtcagtgntgacagtgaccagtatgantcaactcaggacatttaagtgacttntnanctgtgcgcagantcctcctgcaaagccaggtgcttagaggttttcaattttacacacttgctaatgggat

SEQ ID NO: 4809 - DNA, 463 bp, Mus musculus
cagtaccttgtctctgtttgttaggaccaaacctcaaagcatggctgagagttttcagtagaaatggagttacatctatttgggagaatagtcttcagatcactacaatttctagtttcacaggagcgtggcttggagcatttcctattccactggattgggaaagaccgtggcaggtgtggcccatctcctgtacactcggagcgacctttggctacgtggctggcctggttatctcgccactctggatctactggaatagaaagcagcttacatacaagaacaattaagaggagaaaggagagaagttatttctctgtgcagattccataagggctgtgcagaagttacatggtccaagccgggcagtccatttacagcactgttgttttctaaatgtcatttcaacatgatgtgattgtagctttttaactatgaaacccctgagagattgtaccttcta

SEQ ID NO: 4810 - DNA, 366 bp, Mus musculus
  misc_feature (337)..(337): n is a, c, g, or t
ggacctgcccctttggaagcaagtgcctttaccgtcatgcttaccctgatgggcggctggcagagccagagaaacctcggaagcagctaagctctgaaggcactgtgaggttctttaactcagttcggctttgggattttatcgagaaccgagaaacccggcaagtccccagcactgacgatgtggatgtgacagagctaggagacctcttcatgcacctttctggagtagaatcatcagaaccctagtcagtgctgacgccttcatttggctctgcagtcaactttccaaggcacggtgtggacgcatctgtcaccgacccgaggtgacgtggtanctgggatgtgagtgcagtagtgagtcccc

SEQ ID NO: 4811 - DNA, 245 bp, Mus musculus
  misc_feature (49)..(49): n is a, c, g, or t
  misc_feature (68)..(68): n is a, c, g, or t
  misc_feature (70)..(70): n is a, c, g, or t
  misc_feature (78)..(78): n is a, c, g, or t
  misc_feature (102)..(102): n is a, c, g, or t
  misc_feature (104)..(104): n is a, c, g, or t
  misc_feature (156)..(156): n is a, c, g, or t
  misc_feature (171)..(171): n is a, c, g, or t
gaaaagatgtaagctatgctcattgataccatgtatgtacctgcatgtntacgtgttgctaaaatgantnttctgtgntcaaaataagcagggggaggagtntnttcatcattgagatgaagcccaaggttgaaagctgtcacctccacgcccctngtcacagctgatgcntcgtctcaggaagctctggtttactgtcagtaaaagcaattatttttatagtaagaaatcaacttgtttctgat

SEQ ID NO: 4812 - DNA, 278 bp, Mus musculus
tgtttataagccactgtcactcgggctctgcggcacgtctgtaatcacatgtctcccagctctggcatgggagcatcctgggtccttcaggaggcattgctgaaatctttcccatactacatttcttcaggtttattccaagcttactctctttgtctaggtctttttagtaagaattctgcttttgtacatattaacatgttgactctactgcagcatgtgttcctacatgggacaggtggttagtgtacagcagatagaatctcatgacgctgtat

SEQ ID NO: 4813 - DNA, 210 bp, Mus musculus
gcagtgctaacgacacggagtcggagagcgccactggtgaaggttcagaaagtgatcctgattttgatgagagtaaagaaagtgatgaagactttggtgtgagaagaagtaaagaatcaaagaagaaaacagtgcagaagaaacctgcaggggaaaagaaggaaaggaaatcaaaacccaaatgtgaggcatcagtgacttcagtagacc

SEQ ID NO: 4814 - DNA, 356 bp, Mus musculus
  misc_feature (304)..(304): n is a, c, g, or t
tgacttcagtagacccagctccagctgccatcaagtcaggatctccatctttaccccaggcagttggtcttccttctgaggccactaggaaaccagcaataatgtgcagcccttcagctgaaagcaagaggcccaagtgggtccccccagctgcctctgggagcaggaactctagcagcaatgcattggcaggaacacctgccaagtccccgagtcagagcctgcgtctgggcctctcccgattagcgccagttaagcgcttgcatccaagtgccacaagcagccaagtgcggtagcaggaaanggactgctgggacccttgggactgcaagcagggttgtcatattcagcttcca

SEQ ID NO: 4815 - DNA, 459 bp, Mus musculus
ctggatccttgacctacttgggcactatgctgtaatgaacaaccccaccagacagcctttggccctgaatgtggcttacaggcgctgcttgcagattctggctgcaggactgttcttgcctgggtcagtgggcatcactgacccgtgtgagagtggcaacttcagggtacacacagttatgaccctagaacaacaggatatggtctgctacacagctcagactctggttcgaattctctcccatggaggctttaggaagatccttggccaggagggggatgccagctatcttgcttctgaaatatctacctgggatggagtgattgtgacaccctcagaaaaggcttatgagaagccacctgagaagaaggagggggaggaagaggaggagaacacagaagaaccacctcaaggagaagaagaagaaagcatggagactcaggagtgaccttcccttta

SEQ ID NO: 4816 - DNA, 424 bp, Mus musculus
  misc_feature (137)..(137): n is a, c, g, or t
ggctgaggaatatgcccggctctgccaagagatcctcggggtgccagccacaccaggtaccaacatgccagccactttcggccacctagctggcggctatgatgctcagtactatggctacttatggagcgaagtgntactcgatggacatgttccacacacgcttcaagcaagagggtgtgcttagccccaaggttggcatggactacaggaccagcatcctgaggccagggggctctgaggacgccagcgccatgctgaagcagttcctgggccgcgaccccaagcaggacgccttcctcctgagcaagggtctgcaggtggagggcagcgaggcgcctgcgtgctgaccggtccccagctcgccgccctgtgccttagcccagcctgctgggcagctcagcaacccttgggcgtacagatg

SEQ ID NO: 4817 - DNA, 74 bp, Mus musculus
tcggaaaatggtaactgaagatgaagtcagacagacagagaacaccgaatccacccagtagtgttctaaaattt

SEQ ID NO: 4818 - DNA, 435 bp, Mus musculus
agcctggtcagagcaccggaagttcctgtgattgctggggccttctgctatgatgtcactttggataagagactggatgagtggatgccaacaaaagagaacctgcgttctttcacaaaagatgcccatgctttaatatatagggaccttccctttgaaactctggacgttgatgcaagagtggcgctggaaatatttcaacataacaagtacaaagtggatttcatagaggagaaggcatctcagaaccccgagagaatagtcaagttacacagaatcggtgacttcattgatgtaagtgaaggcccccttattccgagaacaagtgtttgcttccagtatgaagtgtcagcggtccacaatcttaaccccagccagccgaacctcattcgcagatttcagggcctgtctttacccacgcacttgagagcacag

SEQ ID NO: 4819 - DNA, 391 bp, Mus musculus
  misc_feature (264)..(264): n is a, c, g, or t
gaatttacttcccacctcaaaatcaaatcccttagtatccagacggagtttgcttcagaccgcggaggaggttggaagtcatgccctgaaggggctgtgccctctcctgctggagaactcagttcctgaatcttgatcctgaattcttattcaaagtttcctccactggtcttcaagatccgcctctcaccagccaagaatggttacaaaactcatgagtctccttttctcttagagcatgacctccacacacactgggtcagntcacacaggggagcacctcagctcacactggggagcactcactcccctggcactgttattggctctgcacctcagggattcccttccatgtttccacctcagggagctatgtcagggcctatctgaa

SEQ ID NO: 4820 - DNA, 489 bp, Mus musculus
  misc_feature (98)..(98): n is a, c, g, or t
  misc_feature (100)..(100): n is a, c, g, or t
  misc_feature (292)..(292): n is a, c, g, or t
gtaggcagccatgaacaatctattttgagccactttagggagaaaaactttgtatttttaaaacttgcataaaaattatgcaagtggtttttataaantnggaataatacctcagttttgaggttatgcacactaaattaaatatgtcataaattaatttgtacaaaaagaactctttataaggtggctcattgtaggaaatcctgtgccttcccctttgagcacaagtgttgcatgaacaacagtttgctataagaaacataccaggttagccaccattagcatctatatntactttgtgtttaaaaatcaactggtaattctgaaacactgtagaatggataaaaattattttgtgatcataactctttgttgaactagagtatttttgcagcattccttgtcatcaaaaacatggttaaactttaaaactagaagcagcagaaaactagcttgtaaaatttattcaagtagagtacaggctaggct

SEQ ID NO: 4821 - DNA, 548 bp, Mus musculus
  misc_feature (343)..(343): n is a, c, g, or t
  misc_feature (354)..(354): n is a, c, g, or t
  misc_feature (374)..(374): n is a, c, g, or t
  misc_feature (396)..(396): n is a, c, g, or t
caaacgcaagcagtggttcagtccaatgctgtgccacttttcttgaggcttctgcattcaccccatcagaatgtctgtgaacaggcagtatgggcgttgggaaacatcataggtgatggacctcagtgtagagattatgtgataagtcttggagttgtaaaacctctgctttcattcataagtccatctattcctataacattcttaagaaatgttacctgggttatggtcaatttatgtcgccacaaagacccaccaccaccaatggagacaattcaggagattcttccagctctttgtgtattaattcatcacacagatgtaaatatcctggtagatactntctgggccctntcttaccttacggatgctgncaatgaacagatacagatggtnatagactctggcatagttcctcacttggttccgctactcagccaccaggaagttaaagttcagactgctgcactgcgagctgtgggcaacattgtcactggaactgatgagcaaacacaagtagttttaaactgtgatgctctctcacactt

SEQ ID NO: 4822 - DNA, 532 bp, Mus musculus
  misc_feature (268)..(268): n is a, c, g, or t
  misc_feature (271)..(271): n is a, c, g, or t
  misc_feature (276)..(276): n is a, c, g, or t
  misc_feature (307)..(307): n is a, c, g, or t
  misc_feature (318)..(318): n is a, c, g, or t
  misc_feature (330)..(331): n is a, c, g, or t
  misc_feature (342)..(342): n is a, c, g, or t
  misc_feature (367)..(368): n is a, c, g, or t
  misc_feature (370)..(370): n is a, c, g, or t
  misc_feature (409)..(409): n is a, c, g, or t
  misc_feature (465)..(465): n is a, c, g, or t
  misc_feature (484)..(484): n is a, c, g, or t
  misc_feature (493)..(493): n is a, c, g, or t
  misc_feature (496)..(496): n is a, c, g, or t
aaggacctcatctacagaatgttacagccagatgtcaaccgccggctgcacatcgatgagatccttaaccactgctgggtgcagcccaaggcacgaggtctgtcctctggagccatcaacaaggagggggaaagctcccgggccactgagccctcatggatccctgaacctggtgctgataagaagtctgccaccaagttggagcctagggaagaggcacgatctgaggcccggtctgagtcaaaaccccaggaagatactttgcagntgntcagncagtcagagaacgtgggcctcagcagcgaantgaacaggganacagaggaaggnnacccccaacanccttcagagacacatacttagtganncntcttgcagcccagggggccagcagggaatgaggcagagntcatggcttgaagcctgagcctagaagtcaagggacgagagagagaaggaagacantcccggatgagctattttngtcactttnttntccccccctttgaacttggtaactcacacggctaaa

SEQ ID NO: 4823 - DNA, 454 bp, Mus musculus
  misc_feature (59)..(59): n is a, c, g, or t
  misc_feature (174)..(174): n is a, c, g, or t
  misc_feature (350)..(350): n is a, c, g, or t
tggtgttcttgtaccacagtttttaaccgaaggaaccagttggaacaatctcaatttanactaaaacttgaagaactaaaataacaatgcaaacctttagcattgttttggccaaacttgttaaaactgtaatgcaagaaccaaatgcactgtgatgtggcaccaactaattangcaagcatgaatttttcacctgagagtgaaaaaagaaaactctaccatggcttgaagttacaggagcagaactcctgactaccattctatgactgatgaagagactaatagctaaaacctcagcaggccttgttcacgatatgcagaaaaagtgctgcagtttagatacctctggnaacttttccacagtgtcacaggtttgtaatacttgaagcccttcatttctaagaatatatttctcgctcagttgtttcaggcaagcccaagactttgtaatttt

SEQ ID NO: 4824 - DNA, 486 bp, Mus musculus
ggaattctgattcattgccacatagattatcagctgccaaaatggtatattatttagattcttctagtcaaaaacgagcaatagagctggcgacaacacttgatgggatccctcaccaacagaaaccttcagacttgcatggaggtgttgggaagccttgttgtgatggtagcctaggagactgtaaagaagctgccgaagcctacagagcaagttgtcataagcttttcccttatgctttggctttcatgcctcctggatacgaagaggatatgaagatcacagtgaacggagatagttctgcagaaacggaagaactggccaatgaaatctgaacatcattaaacaagcaaatggaatgactttggaccatatctagtgtataatatttttgtcacgcacctgctgcattgctcttacttacacagaatgagaggagtaaatgttcttgccttcaaatagtcttacgttttttatcctgctgaa

SEQ ID NO: 4825 - DNA, 459 bp, Mus musculus
  misc_feature (102)..(103): n is a, c, g, or t
  misc_feature (369)..(369): n is a, c, g, or t
ggacacagcagacagatttattaattccaagtgtgcaaaatacatgttaaaagccaacctgattaaagaggctgaagaaatgtgttccaagtttacgagggnnaaggaacttcagcggtagagaacctgaatgaaatgcagtgtatgtggttccagacagagtgtgctcaggcatacaaagcaatgaacaaatttggtgaagcacttaagaaatgtcatgaaattgagagacattttatagaaatcaccgatgaccagtttgactttcatacatactgtatgaggaagatcacccttagatcatatgtggacttattaaaactagaagatgtacttcgacagcatccattttacttcaaagcagcgagnattgctattgagatctatttgaagcttcatgacaaccctctgacagatgagaacaaagaacacgaggctgatacagcaaacatgtctgac

SEQ ID NO: 4826 - DNA, 354 bp, Mus musculus
  misc_feature (326)..(327): n is a, c, g, or t
cctctgtgagaaaagctttattcagaggtcaaacttcaatagacatcaaagggttcatacgggtgagaaaccttataaatgtacccactgtggcaagcagttcagctggagctccagccttgacaagcatcagagatcacacttggggaagatgccctgcccatagccacgtccccaggtactacagtccactgcaagcctgctcacctctgcctggaagagcttggaccagaaacgacctcctcctctctgtgtgttggagggagaggagctgggcactgttttgatgtggaggggatgttgttctgagttgagtctagtttttnncttttgcaccaggaaataaaacagttt

SEQ ID NO: 4827 - DNA, 510 bp, Mus musculus
gggaatcattaccaagtagcctgtcagaagtacttcgagatgacacataatgtggacgattgtggcttttctttgaatcatccaaatcagttcttttttgagagccagcgcatcctaactggtggcaaagatatcaagaaggaaatcagtcagccagaaacacctcagcacaaacctagcacccagaagaccagggatgctgcatctgcgctggcctccctagactcctccctggaaatggacctggaggggctggaagagtacttttagtaaatgatgtggccactgtagtatctcctttcccccagcgaatacattcctgtttgaaaggtttacaaaggcacacccatgcacacacacacatttactgggaagcaggcttgcttccaccttacttttgacagaatgggaaaggaagcattcctattgaaactgttaaaatcctcaagcagcaagacaattaaaactaacttttaaagttttgtataatgttggccaagtcctcttttg

SEQ ID NO: 4828 - DNA, 204 bp, Mus musculus
tcatgacctggagctactgagaaagcataaggtgactcatattctcaatgttgcatatggagttgaaaatgctttcctcagtgagtttacatataagaccatttctatactggatgtgcctgaaaccaatatcctgtcttattttccagaatgttttgagtttattgagcaagcaaaactgaaggatggcgtggttctcgtgca

SEQ ID NO: 4829 - DNA, 463 bp, Mus musculus
  misc_feature (423)..(423): n is a, c, g, or t
gaccatttctatactggatgtgcctgaaaccaatatcctgtcttattttccagaatgttttgagtttattgagcaagcaaaactgaaggatggcgtggttctcgtgcactgtaatgcaggtgtttccagggctgctgcaattgtcattggcttcctcatgagttctgaagaagccactttcaccactgccctgtcgttggtgaaagaggcgagaccatccatatgtccgaatcctggcttcatggaacaactccgcacctaccaagtaggcaaggagagcaatggaggtgacaaagtgcccgcggaggacacgaccggtggtctgtgatctgtactccagcagaggcaaacgacttctgcatcagactctgtcctcttgcctgtgttttggaaggaaacttggaaaacttcccttttctgttntcttttaccagtggaaatgaacgttacctttgtcgccctg

SEQ ID NO: 4830 - DNA, 441 bp, Mus musculus
gctccttgacaagtttctgaaccttgaattgcattgtgagatggaaaacccttctcatgggaacgggtatggctaggactttgtgacagagctcttgcctagcatgtataaggtcctaagttccatccccagcaccacagaacaggcaaaaccagtgaatactgagtgctgtataaggtacacagcccagagcttacaacatagagcaaggcttctagggtgccaatggggcccagcacttactcatgctcaccagctggacggccatggctaaagcccagagtgaacttattttttcccatcagcaagtcactgtacaccaacagaggtagggacagcacccctgagactacattgatccctaggaggtccgggggtgctcacacttgagagctttgtagtgtcatcgcagcagagggactgtgtccaagcaaaaattca

SEQ ID NO: 4831 - DNA, 556 bp, Mus musculus
  misc_feature (268)..(268): n is a, c, g, or t
  misc_feature (284)..(284): n is a, c, g, or t
  misc_feature (287)..(287): n is a, c, g, or t
  misc_feature (291)..(291): n is a, c, g, or t
  misc_feature (309)..(309): n is a, c, g, or t
  misc_feature (344)..(344): n is a, c, g, or t
  misc_feature (352)..(352): n is a, c, g, or t
acaagagcctctgtgtaatccagggcttggctgacatttacatcttctcagaggacaccacgtacaagtgggactcctgtgccgcccacgccattctgagggccatgggtgggggcattgtagacatgaaagagtgcttagagagaagtccagacacggggttggatttgccacagctgctgtatcatgtggaaaataaaggtgcttctggggtggaactctgggccaacaagggagggctgatagcttacaggtccaggaatcggcntggacaccttcctganccncctnatccaaaacctcgggccntgtaaagacacaagcataagactctcatctcaggncccttcanccgaactgcatcttttcctgttatctcttgaagatagttttgtcccactggttaaaattcaccttcctgttttgaggaacattttctcattatgtgttcatgatgtgaattttagtaaattagtggcatttgtgtcacagttaagttggtatatgacatcgttatatgaacattgtgctgttattgttgcttggaacccttcaa

SEQ ID NO: 4832 - DNA, 474 bp, Mus musculus
  misc_feature (303)..(303): n is a, c, g, or t
  misc_feature (313)..(313): n is a, c, g, or t
  misc_feature (442)..(442): n is a, c, g, or t
gacaactttgaacaccaggactccactggcctgtttggaacagagcagcaaggcaccagccctgccctcagtactgcgaaccacaccagagagctcggttttcctaggtggaaactaccaagtcctgttacacaagttaatgccccatcttctaaatgggcacggtttctcctggcacctggaaatagtcctcaagtggatgagaaaccaagtcctctgcaggaggccaccatgctagctgacctggcacaagggactgttgagaacaagactccagtggaaggccacttcagcagagccccntgccattagngcctcctcaagccattcacactaccaccccacaactggacagacctgacaggaagacccgagagcagccaagggacatggggactcctcgagcagatggtaggcctttggctcaagggacccagaaggntccacccttgcaactgcacaacctctttacaa

SEQ ID NO: 4833 - DNA, 274 bp, Mus musculus
aagttacatgaggtgatgcgctacagactgagaaacctaaacctaaagtccatcagcaagcgaaaacaacccaaccaaagctccttcctttaaaacaacccaaggactcgaggataaaaaagacccgagcagccaagaagatccaggccttgtggcgcggattcctggtgaggcaaactctgctggctgctgccctcaatgtctgggtgattcagtgctggtggagaagcatcctccacagacaggtacttaaacggcggctggccctgctgag

SEQ ID NO: 4834 - DNA, 561 bp, Mus musculus
  misc_feature (355)..(355): n is a, c, g, or t
  misc_feature (374)..(374): n is a, c, g, or t
  misc_feature (379)..(380): n is a, c, g, or t
  misc_feature (384)..(384): n is a, c, g, or t
  misc_feature (398)..(398): n is a, c, g, or t
  misc_feature (437)..(437): n is a, c, g, or t
  misc_feature (468)..(468): n is a, c, g, or t
  misc_feature (478)..(478): n is a, c, g, or t
  misc_feature (482)..(482): n is a, c, g, or t
  misc_feature (485)..(485): n is a, c, g, or t
  misc_feature (497)..(497): n is a, c, g, or t
gagcatccatattgcctctttgtgatgtggtttgggctaacgaaaaggcttggtttcaaacaccctataccaccttcggacagagtccagatggctgctctaccgttatgtttcccaagattatgggaggagcatctgcgaatgaaatgctgttcagtgggcggaagttgacggcacaggaggcctgtggcaagggtctggtctcccaggtgttttggccaggaaccttcacacaggaagtcatggttcgaatcaaggagctggcttcatgtaacccagttgtcctggaggaatccaaagccctggtgcgctgcaatatgaagatggagctagagcaggccaatgagagagaatntgaagtgctgaagaagatntgggnntccncccagggcatggantccatgttaaagtacttacagaggaaaatcgatgagttntgatgggcaggctgagcaggacatcggtggntcccacttgntacntcntcctgcagtggntcgtgcttggaggcagaactggaaacatccgagctatttattgccgcggagtttttaagtactg

SEQ ID NO: 4835 - DNA, 438 bp, Mus musculus
gtcaccaaggcccaaaagaaggatggcaagaagcgcaagcgcagccgcaaggagagctactcggtgtacgtgtacaaggtcctgaagcaagtgcaccccgacaccggcatctcctccaaggccatgggcatcatgaactcgttcgtgaacgacatcttcgagcgcatcgcgggagaggcgtcccgcctggcgcattacaacaagcgctcgaccatcacgtcccgggagatccagacggccgtgcgcctgctgctgcccggggagctggccaagcacgcggtgtcggagggcaccaaggctgtcaccaagtacaccagctccaaaatcctgtggaacaaattctattatcttccttccttttaaagttgaggaaattaaaatgattgtacggaagctgcaacataaatagaggcttgtcttgagtggagaccgaagtgt

SEQ ID NO: 4836 - DNA, 558 bp, Mus musculus
tcagagcccagacttcctggatattaccaaccctaaagcggtattagaaaatgcattgagaaacttcgcctgtctgacgactggagatgtgattgctatcaactacaatgagaagatctatgagctgcgggtgatggagaccaaacctgacaaggctgtatccattattgaatgtgacatgaatgtggattttgatgctcccttgggatacaaagaaccagaaagaccagtgcagcatgaggagtcaatagagggagaagctgaccacagtggctatgccggagaggtgggcttccgtgccttctctggttctgggaatagactggatgggaagaaaaaaggggttgagcccagtccctccccaatcaagcctggagacatcagaagaggaattcctaattacgaatttaagcttggtaagatcactttcatcagaaattcacgtccattggtcaaaaaggttgaagaggatgaagctggaggcagattcattgctttctctggagaaggacagtcactgcgtaagaagggaagaaagccctaagtctaaaactgttg

SEQ ID NO: 4837 - DNA, 464 bp, Mus musculus
  misc_feature (352)..(352): n is a, c, g, or t
  misc_feature (367)..(367): n is a, c, g, or t
caggtccagcctgatgagcgaagaagcaaagcgaggaactcccaacccttggctctgtgaggagccggaggagaccagaggtttgggttttgatgagatccgacaacagcagcagaaaattattcaagaacaggacgcgggtcttgatgccctttcctctatcataagtcgccaaaaacaaatgggccaggaaattgggaacgaactggatgaacagaatgagatcatcgatgaccttgccaacctcgttgagaacacagatgagaagcttcgaactgaagccaggcgagtgaccctggtggacagaaagtcaacttcctgtgggatgatcatggtgattttattgctgctngtggctattgtggtngttgcagtgtggccaaccaactgatagcaataaagggaccacccgctgtgacacctgccaactacgaatgaaagcccagcatccttttggtacataa

SEQ ID NO: 4838 - DNA, 462 bp, Mus musculus
  misc_feature (93)..(96): n is a, c, g, or t
  misc_feature (213)..(213): n is a, c, g, or t
  misc_feature (314)..(314): n is a, c, g, or t
  misc_feature (317)..(317): n is a, c, g, or t
  misc_feature (323)..(323): n is a, c, g, or t
  misc_feature (327)..(327): n is a, c, g, or t
agaagctgaccaggccggcagcgtcccctgctgtgggcgagaagctgaaaaagaccgagcctgccgctggtaaagagacaggagctgccaaannnncccaagctgaccccacaggagaggctgaagcttcggatgcagaaggctctgaaccgccagttcaaggcggataagaaggcagctcaggagaagatgatccagcaggagcatgagcgncaggagcgagaggatgaactgcgagccatggcccgaaagatccgaatgaaggagcgagagcggagagagaaggagagagaagaatgggaacgccaatatanccnccaganccgntcgccctccccacgctacagtcgagagtacagttcctcccgaaggcgctcaaggtccaggtcccgaagcccccattacagacattaggcagaaaacggagttggggctgttatgctgctgggtttctgtagtgaa

SEQ ID NO: 4839 - DNA, 457 bp, Mus musculus
  misc_feature (383)..(383): n is a, c, g, or t
  misc_feature (407)..(407): n is a, c, g, or t
tgccagctgaggatggttccccaggcgccagaggcgccccagaggacactgaggaggaggaggaggaagcgcctgtatcttctcactactttgcaaatcaaactagaaatgaaagaaagagaaagaaaatgtcagccacccataagcccaagaggagaagaactagttacggtggcttcagagcaaaggggggctctactacatgcagaaaaacgacttctaaaagtaaattctatggtgtaactggatcccgctcggcctcatgtgcttctcaggcaacatcatcagccagtagaaaactggggattatggctcctccaaagcctgtaaatagaacgttcctcaggccttcatatgccttctcctaacagttctcctgcgcnatagattcttgtttgtcagcatcntgaccatcctgttgaatagaaagctgttagtcttgttacagcatttgaag

SEQ ID NO: 4840 - DNA, 378 bp, Mus musculus
  misc_feature (74)..(74): n is a, c, g, or t
gtgagcatctgtcatctcagatcgaggagtgcatcttcctggacgtgggaaatactgacatgaagtacaagaancgggtgcggagccgaatctctaacctgaaagatgccaagaaccctggtctacggcggaatgtgttgtgtggtgccattacaccccagcagatagctgtgatgacatcagaggagatggccagtgacgagctgaaggagattcgcaaggccatgactaaggaggccatccgtgagcaccagatggcccgtacaggtggcacacagactgacctgttcacctgcaacaagtgcaggaagaagaactgcacctacacgcaggtgcagacccgtagctccgatgagcccatgactacctatgttgtct

SEQ ID NO: 4841 - DNA, 344 bp, Mus musculus
aagggcaatggctacagctgccgtttccgtctgtagagttccatccaggttgttgagcacatccacttggaagctggcagacaaccagactcgggacacacagcttataacagttgatgagaaactggatatcacaactttaactggtgttccagaagagcacatcaaaaccagaaaggtcagaatctttgttcctgctcgcaataacatgcagtctggagtaaataacacaaagaaatggaagatggagtttgataccagagagagatgggaaaatcctttgatgggttgggcatcaaccgctgaccccctctccaacatggttctgaccttcagtgccaaag

SEQ ID NO: 4842 - DNA, 312 bp, Mus musculus
  misc_feature (189)..(189): n is a, c, g, or t
gatcaaccagccaatcctacagaagagtatgctcagctttttgcagcactgattgcacgaacagcaaaagatattgatgttttgatagattccttacccagtgaagagtctacagctgctttacaggctgctagcttatataagctagaagaagaaaatcacgaagctgctacatgtctggaggatgtngtttatcgaggagacatgcttctggagaagatccaaagtgcacttgctgacattgcacagtcacagctgaagaccagaagtgttacccgtagtcactctctcccagactcatagcatcaactg

SEQ ID NO: 4843 - DNA, 421 bp, Mus musculus
atgctcaagtggctttatgggtccctgccatggacaaattgccttcccaacaccgaaaagataactaggcagaagcagaagtatctggacagccccgagcgcctcgtgggactgtgtggccgctggaacaaggcctcagagaccctgcgggagtacctgaaggtggtgatggccctcaattatgaggagaagccaccctatgccacgctgaggaacagcctagaagctctgctgcaggatatgcgggtgtcaccctatgaccctctggacctccagatggtgccttagatggaatccagagcttccgacttgcagcttgaagtagaacatgaagtagtgtgactggaggcctgtttgaactcatagctcctaaaagaatcccttgaatgtgcattctcaccgctcccttaggacatatgaa

SEQ ID NO: 4844 - DNA, 194 bp, Mus musculus
tgcccatgccgagggcccaagttctgaggaggaaggctttgcagtggagaaggaagctgatggggagttgtatgcctgggagctgtcagagggtccatcctgcccacccatggaacaggctgcagatctttttaatgaggactgggacttggagctgaaagcagaccaaggaaatccttacgatgctgatgaca

SEQ ID NO: 4845 - DNA, 254 bp, Mus musculus
actcataccacactactccaagatggtcttcgaaaccaggacagtttgatgatgccgaagactagaagtgtcactttccacagtggagtgggggagtttttgtgtcctccagatcacaagttgtttcctgtgtttcaagtgagatactctgtccgttctcagcgactcctcagtgtgggctatagacaggcattaactggggcatgttgttgtggtggttgttgttaatggactctggagtgtgttggaatttt

SEQ ID NO: 4846 - DNA, 432 bp, Mus musculus
  misc_feature (301)..(301): n is a, c, g, or t
  misc_feature (309)..(309): n is a, c, g, or t
  misc_feature (321)..(321): n is a, c, g, or t
  misc_feature (359)..(359): n is a, c, g, or t
  misc_feature (370)..(370): n is a, c, g, or t
ggtacgcgaggaggcaccatgttcctcaccgctgtcctcctccgcggccgcattccgggcaggcagtggatcgggaagcaccggcggccgcgtaccgtgtctttccaagcgaaggagagcatgatccgtcgcctggaggtggaggccgagaaccactactggctcagcatgccctacatgacagcagagcaggagtgcggccacgccgcggagcgacgggcccaggcttttgaagccatcaaggcagcggccacttccaagttccctaagcatagatacattgcagaccagctagaccatntcaacatntcgaagaaatgntcctaacccttcaagattatggataccggactgctctntccttacttgntcctggagctgagaaaatgtaatttatgtaccagtgtgaccccttcgaccagtatcttatta

SEQ ID NO: 4847 - DNA, 495 bp, Mus musculus
agcgctccacggaacagtgtctgtgcatgactcagctgcgcagtgagtcggcagcagagtctgccaagtccttcccaggccgtgtaagacgggctctgggtgggcagaaagtgctcgcccacactgatgatgatgtatcagaggtaaaccctctttgtcttagcatcctttctccagcaggcttgtccggatggaacaccgctgtctaccaccactgtagtatttctgtgcctgcacttagtctaaggaaggaccacatcaaacgtcatttgctgtaaactaaacaaggtcacgcactcatttgagatgcatagcctgtgcatttgaggtgtgggtgggtctttctagtatttccttctcctcagtaaagaagggtaaggcagagaacccctaactgtcgtgttatctcagaattctcaatgcagacaattgacaatgcgtgcctgtgtaaatgtacgtaaatgtacggctgactgtgagagcttcgttcttggc

SEQ ID NO: 4848 - DNA, 562 bp, Mus musculus
  misc_feature (243)..(243): n is a, c, g, or t
  misc_feature (248)..(248): n is a, c, g, or t
  misc_feature (257)..(257): n is a, c, g, or t
  misc_feature (268)..(268): n is a, c, g, or t
  misc_feature (272)..(272): n is a, c, g, or t
  misc_feature (287)..(287): n is a, c, g, or t
  misc_feature (293)..(293): n is a, c, g, or t
  misc_feature (308)..(308): n is a, c, g, or t
  misc_feature (313)..(313): n is a, c, g, or t
  misc_feature (316)..(316): n is a, c, g, or t
  misc_feature (318)..(318): n is a, c, g, or t
  misc_feature (320)..(320): n is a, c, g, or t
  misc_feature (326)..(326): n is a, c, g, or t
  misc_feature (337)..(337): n is a, c, g, or t
  misc_feature (341)..(341): n is a, c, g, or t
  misc_feature (353)..(353): n is a, c, g, or t
  misc_feature (355)..(355): n is a, c, g, or t
  misc_feature (372)..(372): n is a, c, g, or t
  misc_feature (392)..(392): n is a, c, g, or t
  misc_feature (394)..(394): n is a, c, g, or t
  misc_feature (397)..(397): n is a, c, g, or t
  misc_feature (412)..(413): n is a, c, g, or t
  misc_feature (415)..(415): n is a, c, g, or t
  misc_feature (422)..(422): n is a, c, g, or t
  misc_feature (433)..(433): n is a, c, g, or t
  misc_feature (442)..(442): n is a, c, g, or t
  misc_feature (446)..(446): n is a, c, g, or t
  misc_feature (448)..(448): n is a, c, g, or t
  misc_feature (460)..(460): n is a, c, g, or t
  misc_feature (471)..(471): n is a, c, g, or t
  misc_feature (482)..(482): n is a, c, g, or t
  misc_feature (486)..(486): n is a, c, g, or t
  misc_feature (522)..(522): n is a, c, g, or t
  misc_feature (533)..(533): n is a, c, g, or t
gcgaatgctcaactttgtccagaatattcagtactacatgatgtttgaagtgatggaaccgacctggcacatccttgagaaaaacctgaaatctgcctccaacattgacgatgtccttggccaccacacaagcttccttgacaactgcctgaaggactgcatgctgaccaaccctgagctgctgaaggttttctccaagctcatgtccgtatgcgtcatgtttaccaactgtatgcagcatcngtctnagcatgtgnatgctcctcanctgncctctggtttcgagnccaccntcaacaactttgacnaaaanttntntncccatnttcttgatttnctgncccgactaagtntntacagcaccagtgactncgaacatggcatggccagtntnatntccagactagatttnnantggtttntatgctgaacncctggaacntctntntgcagaaaggantcagaaggctnccccccaagtncctntcccacggggaccctcagcaccagcacccagggtgnccattcctgcncaatgagctcacttgttaaatatcattat

SEQ ID NO: 4849 - DNA, 500 bp, Mus musculus
  misc_feature (226)..(226): n is a, c, g, or t
  misc_feature (228)..(228): n is a, c, g, or t
  misc_feature (277)..(277): n is a, c, g, or t
  misc_feature (280)..(281): n is a, c, g, or t
  misc_feature (283)..(283): n is a, c, g, or t
  misc_feature (285)..(287): n is a, c, g, or t
  misc_feature (289)..(290): n is a, c, g, or t
  misc_feature (293)..(293): n is a, c, g, or t
  misc_feature (302)..(302): n is a, c, g, or t
  misc_feature (332)..(332): n is a, c, g, or t
  misc_feature (349)..(349): n is a, c, g, or t
  misc_feature (360)..(360): n is a, c, g, or t
  misc_feature (378)..(378): n is a, c, g, or t
  misc_feature (390)..(390): n is a, c, g, or t
  misc_feature (413)..(413): n is a, c, g, or t
  misc_feature (431)..(431): n is a, c, g, or t
  misc_feature (456)..(456): n is a, c, g, or t
  misc_feature (471)..(471): n is a, c, g, or t
gaaagtagccaagaggtccagaaaaagacgtggaaccccaggaattattcagcaagactcacggaaaacattggactccctctgatactgcttgaaaaacacaacccgtggccagcctacgtcgcttacatctccccggcagtaacccgaatcaccgaaaaaggctgggccagggacctagagtacatttatgctgctgagaaaaacggcaagccagtaaagcgcngnaaacatagtgccgtgctgctgaagaggaggaagccgtccaagccctcanaanncntnnntnnaangagaccctntcagagaccatgctacccacgtgggaatgntccaccatatatgtgantcccacatttntcccagaacctgcacaantccaaatggatntcagagaggggcccacatcaaantacaacaagatcattttntccaagaggcctgcgatgaggaaanttccatttggcttantacaggccagcaaggagatgcataccaaa

SEQ ID NO: 4850 - DNA, 491 bp, Mus musculus
  misc_feature (176)..(176): n is a, c, g, or t
  misc_feature (435)..(435): n is a, c, g, or t
  misc_feature (443)..(443): n is a, c, g, or t
  misc_feature (451)..(451): n is a, c, g, or t
gaaatgccaagcagctgcacgacttcctgcacactgcctatgcagacttggtgtccaaaggcagagtgagaaagtgactgttctcacatggctatttattgatcatttgcatagcaattcattctttccccccaggaatgtcccccagggcattggtccagagccagaacttcccnctgggctctgtactgaggtgtgggcctgtcttcccttgctggctctcacccctctgtgctctgtctgtgccaggcctgcactgatccattttcaataaggtgtggtgagatcttgccccttgaagtaaacacagactatgtttacttttcaggctggtaaaagcactgcaccatggtcctaacactggctgcacagggcttggtaggcctgagacaggactgctgttgcttcttccccacccacacagagacaagctanccctctancctcctgntcaccaggtatatgtaacgtgtactgtgactcggttgtgt

SEQ ID NO: 4851 - DNA, 570 bp, Mus musculus
cgacgatgccttctatgatgatgaggatgatgaggaagaagaattggagaacctgatggatgatgaatcagaagatgaggccgaagaagagatgagcgtggaaatgggtgccggagctgaggaaatgggtgctggcgctaactgtgcctgtgttcctggccatcatttaaggaagaatgaagtgaagtgtaggatgatttatttcttccacgaccctaatttcctggtgtctataccagtgaaccctaaggaacaaatggagtgtaggtgtgaaaatgctgatgaagaggttgcaatggaagaggaagaagaagaagaggaggaggaggaggaagaggaaatgggaaacccggatggcttctcaccttaggcatgcagttgcaaagcccagaagaaagaaatggacagcggaagaagtggttgtttttttttccccttcattaattttctagtttttagtaatccagaaaatttgattttgttctaaagttcattatgcaaagatgtcaccaacagacttctgactgcatggtgaactttcatatgatacataggattacacttgtacct

SEQ ID NO: 4852 - DNA, 428 bp, Mus musculus
tgagttataccagcggactcgcatctcactgctgcaaagcgagttccctcaggccgtgtacatcgacagctacagtagcagaggcttcactatctgcggaaatcgcgtgtttggcccttgcgtgctgctcccacagacggtggtccagtggaacgtgggatctcatcaggatatcactgaagagagcttctcccttttctggatgctggaacctaggatagagattgttgtggtgggcactggaaacaagactgagcggctgcaccctcaagtactacaggccatgaggcagcggggaattgctgtggaggtccaggacacgcccaatgcctgtgccactttcaacttcctgtgccacgaaggtcgagtgacaggagctgccctcattccccctcctggagagactgcactggcttctttgggtcaag

SEQ ID NO: 4853 - DNA, 433 bp, Mus musculus
  misc_feature (279)..(279): n is a, c, g, or t
  misc_feature (289)..(289): n is a, c, g, or t
  misc_feature (314)..(314): n is a, c, g, or t
  misc_feature (316)..(316): n is a, c, g, or t
  misc_feature (324)..(324): n is a, c, g, or t
  misc_feature (335)..(335): n is a, c, g, or t
  misc_feature (378)..(378): n is a, c, g, or t
  misc_feature (400)..(400): n is a, c, g, or t
aaagcttttggactgctgaaggcccagcaggaagagaggctggaggggatcaacaagcaattcctcgatgatcccaaatacagcaatgatgaggatctgccgtccaaacttgaagccttcaaggtgaagtacatggagtttgatctgaatggaaatggagatatcgatattatgtccttgaagcgaatgctggagaaacttggggttcccaagacccacctagagctgaagagattaattagagaggtgtccagtggctccgaggagacgttcagctantctgactttntcagaatgatgctgggcaagagatntnccatcttngagaatgattntgatgtatgaggagaaaaacaaagaacacaagaggccaactgntcccccagccaagaaagctatntccgagctgccctgattggaggtggatgtcaca

SEQ ID NO: 4854 - DNA, 35 bp, Mus musculus
atggatttcctttcgaatggcactaccttagggac

SEQ ID NO: 4855 - DNA, 502 bp, Mus musculus
gcttggagagcaaaggcacttcctcccacgaccttactgcagtaaccataccgatcaaattcccagggacattctgtcattgcagtagctcagacctgtcttttcttgcacaccagctgtgctcttgagaaaatgtaaaggctgccattatggatattaggtatcccaacataaccatctggagtgtgtccagtttatttttcataggaccaatttttatttgcagcttaggtttttatatgaagttgcattattgtggacttggctgtcttgtgatgtattttttttcatatgtatcctgtgccatactattgttaaaatgaactgttgctattgtgagatggatttcctttcgaatggcactaccttagggacattctagtattgcttctattgtttgggcattgtggataatgtacagatttaaaaacaaatcttgttgctgatttgtccatttctttccctgcactttgttacatctgggatacagtctaactcatct

SEQ ID NO: 4856 - DNA, 394 bp, Mus musculus
  misc_feature (345)..(345): n is a, c, g, or t
gcatgctttggaatgtcagcgatacagatgttcaatttggatcgggctaatgttgaagaattctatgaagtctataaaggtgtagtgtctgagtataatgatatggtgacagagctgtgctccggcccttgcgtagcaatagagatccaacagagcaaccctacaaagacatttcgagaattctgcggacctgctgatcctgaaatcgcccggcatttacgacctgagaccctcagggcaatttttggtaaaactaaggttcaaaatgctgttcattgcacggatctgccggaggatgggctcctggaggtccagtatttcttcaagatcttggataattagctnctccagagtaaagacgacacagactgagacgcccagacaatcgagtcac

SEQ ID NO: 4857 - DNA, 175 bp, Mus musculus
aaggtgtgaaaagcgtcttcttcggaccagatttcatcacagtcacaaaggagaatgaagagttagactggaatttactgaaaccagacatttatgccacaattatggacttctttgcatctggcttacccctagtgaccgaggagacgcctccgcctccgggagaagcaggctc

SEQ ID NO: 4858 - DNA, 337 bp, Mus musculus
  misc_feature (260)..(260): n is a, c, g, or t
  misc_feature (289)..(289): n is a, c, g, or t
gattaaagaactgctagatactagaataaggccaactgtgcaggaggatgggggcgacgtgatctacaggggctttgaagatggcatcgtgcggctgaagctccagggctcctgcaccagctgccccagctccatcatcaccctgaagagcgggattcagaacatgctgcagttttatattccagaagtggaaggtgtggagcaggtgatggatgatgacgaatcagatgaaaaagaagcaaattcatcttaaataatcngcattttctttggccacaaccattggacntatctttactgatcctgtaattatagtctctgctatggaagtttatta

SEQ ID NO: 4859 - DNA, 285 bp, Mus musculus
gaacatgcagcttacagctggatctaagctgagagaaatggagtcaaactgggtgtcgctggtgagtaagaactatgagattgagcggacgattgtccagctggagaacgagatctatcagatcaagcagcagcacggggaggccaacaaggaaaacatccgccaagacttctaatgactcaggcgacgtgggctccgcagactcagcggggactttctcggagcgactgtggtggttacatggttagagaccatggactatgtaaactgttgtattgcttctgt

SEQ ID NO: 4860 - DNA, 390 bp, Mus musculus
aatctgagcctagcctggtgtacacacctaatgtgcatgcatgtcacacacatacaaagaaattagtccaatttctgtggcaaaacccacaactctatagcctgggtgagtgaacaagaaaaagaggcttatcttgactcctggttccggtccaaggtcaaagggcatctggatatggccctcttgttgccagagtacccaggtacgcataggctagcatattacaaaacacgagaagcgtttgttttcagagtctcttgcagcccacattgaccttgaacttattatgcggtcccttctgtctgtcctcatcagacatcttatgattcttctgcctcagcctccttaatgcttggattcaaagtgtatgtcactcacttaggaggcgga

SEQ ID NO: 4861 - DNA, 512 bp, Mus musculus
  misc_feature (321)..(321): n is a, c, g, or t
  misc_feature (443)..(443): n is a, c, g, or t
gatatgatcatctggatcctgctgaaatggaaagagttgaaaagtacatcagtgactccatgaactggctaaacagtaagatgaatgcacagaataaattaagtctcactcaagatcccgtggtaaaagtgtcagaaatagttacaaagtcaataggaactggataatttctgtaaccccatcgtttataagcccaaaccaaaagtagaagctcctgaagacaaagcaaaaactggtagtgagcacaatggaccaatggacggacagagtggttcagagaccagcccagatccacccaaaggaagctcacagcacaccgantccggagagatggaagtggactaagtgtcatgttatccaagcagtgggttaactaaagggcccattcatcctttatgcccggtacacacaacatatgttcagttgttcttaactacttttgntcatttgttttttggagtagttttgaaaagtgtctatattgagtacactattgctgtccattgctgctg

SEQ ID NO: 4862 - DNA, 455 bp, Mus musculus
  misc_feature (73)..(73): n is a, c, g, or t
  misc_feature (92)..(92): n is a, c, g, or t
  misc_feature (339)..(339): n is a, c, g, or t
tgatgcgccaccaggaatccagtcttgtcattacataaataatctaaatgacactcagagagggacagtgcantttgacattcagataacancagcattggctgcttttgttggtagcatggattcatgttttctcagaggaacttttcacttgaaactgttgatctacttgtccaaaagaccagctgctgcgacactaatgctaagcctatggggaagcactgttgacctgctcaggtgcacatctgtgatgccgacagacttggttcagtttttatagttgtgttggttttcttaattgatttttgttaataataccttaatccagggtagggagangttgcacaatgcattgcattatatatacctatcactgatttaatgttccaatgtagatagacactattaaataagcagtaattccttgaaaggagtacctgtaccaagtcctagga

SEQ ID NO: 4863 - DNA, 468 bp, Mus musculus
  misc_feature (363)..(363): n is a, c, g, or t
  misc_feature (386)..(386): n is a, c, g, or t
  misc_feature (407)..(407): n is a, c, g, or t
tttctgactgtttgcttttctcgtatgtatgtgtgcctgtgttggtgcgagcctgtggagaaagagtctcccatccttcaaatgcttcgagaacagcgtcagatgtacaactagtttgcctgcgttgctactggtaccttggactctgaactcaggttacccacctgagtcctcagtaggcagtggacccattgagaggcaaatgagaacaggagggagacaagctgtgttctggggcgcacataaacacctgacagacgagtctaggaaaccgcgtgaaagaagaaatgttaaattctttattgttttattatatttatacggaaaatgtggctatccttttgttaagtgcagagtgtattntctgtttgacccatgactgtctntccttcatgaatgagtctttncctgtgattctagtcacgcctgtggctactgatgggaacggccgatctgtcatcatgtgaa

SEQ ID NO: 4864 - DNA, 540 bp, Mus musculus
tcgaacgctcgatcttgactcagatcgatcatatcatgatggacaaagaaagattgcttcggaggacacagaccaagcgctctgcctaccgagttcttggcaaaccggagccagtccctgagcctgttgcagagaccttgccaggagaaccagagacgcttcctcagggccctgccaatgcccacctgagggacttggatgaggagatatttgatgatgatgacttttaccaccagctccttcgagaactcatagagcggaaaaccagctctttggatccaaatgatcaggtggccatgggaaggcagtggcttgcaatccagaaactacgaagcaaaatccgcaagaaggtagatagaaaagccagcaaaggaaggaaacttcggttccatgtccttagcaagctcctgagtttcatggcacctattgaccacaccgcaatgagtgatgatgccaggacggagttgtttcgatctcttttcggccagctcaaccctcctgatgcagaccgtgggaagtgacagtagcatcctctcaggc

SEQ ID NO: 4865 - DNA, 276 bp, Mus musculus
attatcttctgccagacacgtcgaaatgccaagtggctgactgtggagatgatgcaggatggccaccaggtgtccctgctaagtggggaactcacagtggagcagcgagcttccatcattcagagattccgagatggcaaagagaaggttctcataacgaccaatgtctgtgctcgagggattgatgtgaagcaggtcaccatcgtcgtgaactttgacctccctgtaaaccaatcagaagagccagactatgagacctacctccaccgtataggg

SEQ ID NO: 4866 - DNA, 456 bp, Mus musculus
  misc_feature (342)..(342): n is a, c, g, or t
agcaaatactggacactcttaacgtattaaacagtgatgtggaaaatcaggtggtaacattaactgagtcaagaatctttaatgaactgacaactaagatccgtgggataaaggaattcaaggagaagctcttgcttaccttgggtgcttttttagacaatcattttcctctgcctgaagcaagtactccaaagaaaaggaaaaacattcaagactcgaatgcacagctgataacactgaatgaaatattagagatgcttataaatagaatgtttgatgttccacatgatccatatgttaaaattcgtgattccttttggccaccatatattgagctacttntgcgttacggaattgctttgagacatccagaagatccatcccaaataaggttagaagctttccatcagtaaaatgatgacctgttttcacacagtacggaatctttacacccat

SEQ ID NO: 4867 - DNA, 320 bp, Mus musculus
agatgtcgagtgcaccatgtttccagattcgatgtgatccttcaggctctggcttgggcaagcagctgacccgactcagccttatggaagaagatgaggaagaagagctaagacttctggatgaagaatggcaacgtggagacaagatgcttcatagcccttcttctcccagtgagcatgggttggacctattagatacaacagagctgaacatggaggatttctgatgggactttaggcctctccccttctccacttaccactgcaagtccttgagtgagcagaaggaaggagtaaaatgaagcattctttgggtccta

SEQ ID NO: 4868 - DNA, 511 bp, Mus musculus
  misc_feature (40)..(40): n is a, c, g, or t
  misc_feature (328)..(328): n is a, c, g, or t
  misc_feature (349)..(349): n is a, c, g, or t
  misc_feature (380)..(380): n is a, c, g, or t
  misc_feature (387)..(387): n is a, c, g, or t
  misc_feature (392)..(392): n is a, c, g, or t
  misc_feature (394)..(394): n is a, c, g, or t
  misc_feature (397)..(397): n is a, c, g, or t
  misc_feature (416)..(416): n is a, c, g, or t
  misc_feature (430)..(430): n is a, c, g, or t
  misc_feature (451)..(451): n is a, c, g, or t
  misc_feature (461)..(461): n is a, c, g, or t
  misc_feature (466)..(466): n is a, c, g, or t
  misc_feature (481)..(481): n is a, c, g, or t
gggctgtttcttcgccagcgatgactcttttgccatgatncgtggcggacacctccaactgaccatgcttggggccatgcaggtttctcaatacggcgacctggccaactggatggtgccaggcaagaaggtgaagggcatgggcggggccatggacttggtgtctagtaaaaagaccagagttgtagtcaccatggaacactgcaccaagacaaagcagcccaaaatcttgaagaaatgcaccatgccattgaccggcaagcgctgcgtggacctcatcatcactgagaaggcagtgtttgaagtgaaccactcaaaggggctgacnctggtggagctgtgggagggntcgtcggtagatgacatcaaggccaccacancctgttnatttncngtntcccccaacctcaagcccnatgcagcagattanaacttgatgcttgaggagccntccagggctnatttnccagttagtgacaantggacatccttagcagcacctgaccactgt

SEQ ID NO: 4869 - DNA, 400 bp, Mus musculus
  misc_feature (201)..(201): n is a, c, g, or t
  misc_feature (234)..(234): n is a, c, g, or t
gtaaatgacctatcccatgtttcagtgggaagtgaactacacattgagatgctgacagaaaactgcctcttaagtaagaacaactgaaccctcaataagaaaagcctgaaagggaccaagcagctcactacactatcacgttacactaagagttggaacactaacacctgtaagaggttacatagttttcagtgggggggntgggatgggtgacgtcattgttacaaagagcantttcttgatgcattttatatgcataccagcaattagcactgtgcttgggcagtgctcacttaactggtgctatgtgaagactctgctaatacaggtatctagaatgtgaactgagtggatccaaaagcttcacacagaggagagcaagatctagtgcgcttttgtt

SEQ ID NO: 4870 - DNA, 555 bp, Mus musculus
  misc_feature (151)..(151): n is a, c, g, or t
  misc_feature (158)..(158): n is a, c, g, or t
  misc_feature (164)..(164): n is a, c, g, or t
  misc_feature (478)..(478): n is a, c, g, or t
tcctatgtacgacatcattcgcgagaataaaagacatgaaaaggatgtaaggatccagcagttaaagcagttactggaggactccacctcagatgacgacgggagcagctccagctcctcgggggacagagagaagcgcaagaaaaggaanaaaaaanaaaagnacaagaaacgcaagaaggagaagaaaaagaagaagaaacggaagcacaaggcttccaagtccagtgagagctctgactcagagtgacagcaccacccacaggccaaaggacagagccgccgccgagagtgagagactggacatctagcacagccctgggccctcaccgcctcctggtgccaagtgaccactgcagagcaggtgggctcctgcgacacctgtgtcctctaccttatggtcaccgtgtctgtgactgcttcagtaggccgctgcagtgggaggtgatgagaagaccctgaaggggcagacactctnagggcactgccacggcggcgtttgccctccatggtgtggtaactcattttccatgaacttaaggcttcacccttctt

SEQ ID NO: 4871 - DNA, 571 bp, Mus musculus
  misc_feature (269)..(269): n is a, c, g, or t
  misc_feature (348)..(348): n is a, c, g, or t
  misc_feature (353)..(354): n is a, c, g, or t
  misc_feature (362)..(362): n is a, c, g, or t
  misc_feature (388)..(388): n is a, c, g, or t
  misc_feature (442)..(443): n is a, c, g, or t
  misc_feature (446)..(446): n is a, c, g, or t
  misc_feature (458)..(458): n is a, c, g, or t
  misc_feature (505)..(505): n is a, c, g, or t
  misc_feature (521)..(521): n is a, c, g, or t
  misc_feature (523)..(523): n is a, c, g, or t
  misc_feature (526)..(526): n is a, c, g, or t
tggaccagcagatgtacctctgttactctcagcctggaatccccaccttgcccaccccagtggaaatcacggttatctgcgctgcccctggtgcggacggggcctggtggagagcccaagtagtggcttcctatgaggagaccaatgaggtggagattcgctacgtggactatggtggatataagagggtgaaagtcgacgtgctccggcaaattaggtctgactttgtgaccctgccattccaaggagcagaagtccttctggacagngtggttcctctgtcagatgatgatcatttttcaccggaggcagacgcagccatgagtgagatgacaggcaatacagcantgttnncccaggtnacaagctacagtgcgactggccttcntctgattcagctatggagtgtggttggagatgaagtggtgttgataaaccggtnnctnggtggagcgagnccttgcacagtgggtagacagctactatgccagcctctgaccttggntcctgagttgcttcgntnttnctttgcactgttgagagtgggtttggcacccaggacagagtttta

SEQ ID NO: 4872 - DNA, 407 bp, Mus musculus
  misc_feature (44)..(44): n is a, c, g, or t
  misc_feature (254)..(254): n is a, c, g, or t
gacgtggaaggccttgatcctgctcctacagcctctgcactggntccacatgctgggaccgggactggagctgccgctgccacccctcctgctcactgctctcgcaccttcatcacgttcagtgatgatgcaacgtttgaagagtggttcccccaggggcgacccccgaaggtcccggtgcgggaggtctgcccagtgacccaccgtccagctttgtaccgggaccctgttacagacataccctatgccactgnctagagccttcaagatcatccgtgaggcgtacaagaagtacatcactgcccacggacttccacccaccgcctcggcgctgggccccgggcccccaccccccgagccactacctggctctgggcctcgagccttgcgtcagaagattgtcatca

SEQ ID NO: 4873 - DNA, 374 bp, Mus musculus
  misc_feature (201)..(202): n is a, c, g, or t
  misc_feature (214)..(214): n is a, c, g, or t
  misc_feature (274)..(274): n is a, c, g, or t
  misc_feature (289)..(289): n is a, c, g, or t
  misc_feature (315)..(315): n is a, c, g, or t
  misc_feature (324)..(324): n is a, c, g, or t
  misc_feature (326)..(326): n is a, c, g, or t
  misc_feature (341)..(341): n is a, c, g, or t
  misc_feature (343)..(343): n is a, c, g, or t
aaccacagagggtcagctgagcaaaaaccaccacacaagcatcatggccaggaaaaggcaaaggcgaagaagacggaaagtgacccgctcccagagagctgagcttcaatttcctgttagccgtgtggatcgtttcctacgagagggaaactattctagacgcctgagctcttctgctcctgtattcctcgcgggtgtgcnncgagtacttaanatctaacatccttgaactggctggtgaggtggcccacaccactggcaggaagcgcatagntccagagcatgtgtnccgtgtggtacagaacaacgaacagntccaccaantnttcaaacaaggtggnanatcagtgtttgagccaccagaacctgatgac

SEQ ID NO: 4874 - DNA, 193 bp, Mus musculus
aaaagtgtgaacagcctcaccctctgccctgccatcttattaggttgtcagtgccctttctaagaagagctgtgaagatctgtgagcccatccatcctctttattcactgactctgagagtcacactttctcgtgcacatccgccgccagcacaagattgagtaggggagggctgtggattctgtgaacagca

SEQ ID NO: 4875 - DNA, 552 bp, Mus musculus
  misc_feature (323)..(323): n is a, c, g, or t
  misc_feature (327)..(327): n is a, c, g, or t
  misc_feature (332)..(332): n is a, c, g, or t
  misc_feature (340)..(340): n is a, c, g, or t
  misc_feature (344)..(344): n is a, c, g, or t
  misc_feature (346)..(346): n is a, c, g, or t
  misc_feature (348)..(348): n is a, c, g, or t
  misc_feature (355)..(355): n is a, c, g, or t
  misc_feature (357)..(357): n is a, c, g, or t
  misc_feature (359)..(359): n is a, c, g, or t
  misc_feature (370)..(371): n is a, c, g, or t
  misc_feature (373)..(373): n is a, c, g, or t
  misc_feature (389)..(389): n is a, c, g, or t
  misc_feature (467)..(467): n is a, c, g, or t
  misc_feature (508)..(508): n is a, c, g, or t
  misc_feature (510)..(510): n is a, c, g, or t
  misc_feature (525)..(525): n is a, c, g, or t
ggtgtaattgctagcctttttgtttgtttgtatgtccgagattacaaatcagaagtcatcttgctgtcaatgtttagaaagcaaccatgattactaatgacatcctctaggtctgacctgccagggtcctgactcttctgtcacagcccattctgcactccacctgaaacatcaggcactaattgaagaatttattatctctagaaagagaaacggtaactttgtcgtttagaatgtaactctttctgacctgcccaacctaccatctgtgagctgggaagaacgcagttgagtcaccacttaagagtttactccctaacaantttncactnccatcttnattntntnggaaatntntntccaggcagcnntnggtagagtaacagctntgtggtttcctgtgagttaccttatagttactgtgtaagtagtgccacttagtgtatgtcaccagaatgaagaagatntaccccagactagatgtagcatttttggtatatttgtattntntgatactgatatttntcattctcacagcaagcatactggttg

SEQ ID NO: 4876 - DNA, 479 bp, Mus musculus
  misc_feature (277)..(277): n is a, c, g, or t
  misc_feature (293)..(293): n is a, c, g, or t
  misc_feature (295)..(295): n is a, c, g, or t
  misc_feature (319)..(319): n is a, c, g, or t
  misc_feature (370)..(370): n is a, c, g, or t
  misc_feature (375)..(375): n is a, c, g, or t
  misc_feature (400)..(400): n is a, c, g, or t
  misc_feature (418)..(418): n is a, c, g, or t
atctccaccaagacacagtgtagcgaagaagatcagtgcagaattaacaagcagatctacaacctgattcacctggaccccagaacacgggaaggtttttccttgctacacctggctgtcaactcgaacacaccagttgatgatttccatactaacgatgtctgcagctttcccaacgctctggtcacaaagctcctgctggactgtggcgctgaggtaaatgcagtggacaatgaggggaacagtgccctccacattatcgtccagtacaacaggncccatcagtgattttntngaccttgcactccatcatcatcanccttgtggaggctggagctcacaccgacatgacaaacaagcagaataaaantccgntagacaaaagtacaactggggtgtntgaaatactacttaaaantcagatgaagatgagcctcaagtgcctggctgcccgagcagttcgggctaatgacattaac

SEQ ID NO: 4877 - DNA, 524 bp, Mus musculus
  misc_feature (77)..(78): n is a, c, g, or t
  misc_feature (444)..(444): n is a, c, g, or t
gagcagcaagaccatctcttctgaatcattctttgaggaaaatgagttatcaggaaggaaagcctgagcctgcgaannaagcccttaagaagtcaaagctgccactcggtcgttttgactcactggaggattcacccgaagagagagagccactgcagaagtttccggatgatgtaaatccagttaccaaagaaaaaggtggacccaagggcccggagcctacacgatatggagactgggaacggaagggacgctgcattgacttttaagtcacgcactctcacaactgcagaatcattacctgaactgtttacttcaagttgttttctttttctgtgtcctttaagtgtgtaatttccatcgtatgtcctaaaatgcatgtgacagctttgaatagcaaatgctgctatagatgaggaatgtggaaacgcttccattagcatnttaacctcaccttaagtgtgtcagggcagagtctgggatgagagcatcaagtctttgccacgatctttttgtcatttatt

SEQ ID NO: 4878 - DNA, 456 bp, Mus musculus
  misc_feature (290)..(290): n is a, c, g, or t
  misc_feature (320)..(320): n is a, c, g, or t
  misc_feature (332)..(332): n is a, c, g, or t
  misc_feature (335)..(335): n is a, c, g, or t
  misc_feature (340)..(340): n is a, c, g, or t
  misc_feature (342)..(342): n is a, c, g, or t
  misc_feature (345)..(345): n is a, c, g, or t
  misc_feature (348)..(348): n is a, c, g, or t
  misc_feature (352)..(353): n is a, c, g, or t
  misc_feature (357)..(357): n is a, c, g, or t
  misc_feature (360)..(360): n is a, c, g, or t
  misc_feature (372)..(372): n is a, c, g, or t
  misc_feature (405)..(405): n is a, c, g, or t
  misc_feature (413)..(413): n is a, c, g, or t
  misc_feature (418)..(418): n is a, c, g, or t
  misc_feature (431)..(431): n is a, c, g, or t
tagctctcctttcctggctgaggtactttctgaaccctggagcctctccaccagccagatcccccagttccagatctgcatgtttgacccaaaacagtatcccaatcatctgggtgctggaggtggctttggtcccgtggcggatgatggctacggggtctcttacatgatcgcaggagaaaacaccatgttcttccacatctccagcaaatactcaagttcagagacgaacgcccagcgctttgggaaccacatccgccaagcactgttggacatcgccgaacttttcnaaatttccaagacagacagctgaggaaaangagataccccanctnccctntngtnccncacnntggnggnaagaagaggccntgtggccagctcacaggcataaggggtggcgtncacacacncccanttcggagaacagntcttgaggcagtgctccccggagga

SEQ ID NO: 4879 - DNA, 479 bp, Mus musculus
tagtccccaggagcctcatgagtgtgacactgagaacatggagaatttgccttgtggtaaaatccagcggaaagtgagaatgctattagggcaacagaaagcaaatgctgaaccgagtgctgaattggataaaaagagaactgagtatcttcctgcacatgaagacagaacttgtgggtcaccagtacagtctctattggacctttttcagacaagcgaggagaaatcagaatttttgggttttacaggctacactgaaaacagtggaatatgtgatgttttagatatttgggaggaagaaaattcaagtaccctgttgtcaacgtttttttcttccccttcaacttctgcattcgttggattttagtattaaatgtgcttttcagaagtgacagctatattcctgaagtttttataaatacatatataattagtggtgggggtttgttttgttttcgccaacttttttatggagccat

SEQ ID NO: 4880 - DNA, 546 bp, Mus musculus
agatcaccaccggagctcaggacgacctgaggaaggtcacccagagtgcctatgcccagattgtgcagtttgggatgagtgagaagctgggccaggtgtcctttgacttccccagacaaggcgaaaccatggtggagaagccatacagtgaggctactgcccagctcattgatgaagaggtccggtgcctcgtcaggtctgcctataatcggaccctggagctgctcacacagtgccgggagcaggtggagaaggttggcaggcgtctcctggagaaagaagtgctggagaaagccgacatgatagagctcttgggccctcggccctttgcagagaagtccacctatgaggaatttgtagagggcaccggcagcctagaggaggacacatcccttcctgaggggctgaaagactggaataaggggcgggaggaaggaggcactgagcggggcttgcaggagagccctgtgtagcctgtggccaccggggcggcttatgaccactgctgactgggagctgctcagccatcgcagagcagctgtcaga

SEQ ID NO: 4881 - DNA, 542 bp, Mus musculus
cttgatgatgcttgagtgtcacgtaatattgtacaatgtaactgttctgtatgttcatgtctgggtcatttttataatctgctataatttttgaaacaacttcatgttttatacatataaagctgtattttcagagcttaccttatacaataatgaaaaatacaacttttatgtaaagttgtctaaatgtaatatatctcacattaagtccacataacttttgtaagcccgttcgccttgctgtaactagctgtcgtcttctgacgtgactctcctttaaagcagtactatgctgacatgggctctcctttccaaatgggtgacattttaagctgagcaatgtagatgacttctagtgagaagagttgctgttataattcagataaaacagtcctcagcaccaagtgtgtcagcaaggaatggcctgcatattctaagtaaatcacgacagcagcctcctgaggccgcagcctgactttgacgttcaggcaaacagaggagctggtgtatttgtatgagtcaaggtttatcgtcaactctag

SEQ ID NO: 4882 - DNA, 514 bp, Mus musculus
gggtcagagctcaaattcccagcatccccttgtcctgaccacattgctgctataggtagtctgagagaagccacttggctagtcagggtgtgcacacatgggactgctacacattcctgtccccatgcagtcttagccatcaggttgaaaccagtagtggagtgtaggctgggtcagacccacaggctcattctggccgggagatgctgtcctgtgatggagtctataagccctactggaattccagattgtatctagaactgtgcttgttgagggaccctgggccttggctgtaacctggcctttaggtgtttagttctttttaaatcagaaagtgctcagaggtctatgctgcctctgagaggtatatgccaaaaagattataaaggaagggccaagctctgtctttttgagttctcatggccttgttgggagaagaaacagaagtcctggagacattgaaagtgtattaaccagcatgaaagatgtgtttcgtggaggtcagtcggttatt

SEQ ID NO: 4883 - DNA, 507 bp, Mus musculus
  misc_feature (248)..(248): n is a, c, g, or t
  misc_feature (250)..(250): n is a, c, g, or t
  misc_feature (303)..(303): n is a, c, g, or t
  misc_feature (330)..(330): n is a, c, g, or t
  misc_feature (457)..(457): n is a, c, g, or t
  misc_feature (475)..(475): n is a, c, g, or t
gagactgacgccatgatcaagcagaaaaagacaagatcttcaaaaccttcaaagtcagaaagagagaaggagtccaaaaaaggaaaaggaaagaattggaagaaatgaaatcactgtttagtaccaataactgctgttaacttaccctctcggccagtccagctggcctagagcctgagagcctcaccctttgccagagtaacaagtttggtgtagcacagcggggtggcctggtggtcccattatananaggacggtacagctagaaggtctaactagccagctctcctgcacctcttatangaggtgggtaggactgttccagccctngcagtgtccctgcctaactgttagattgctgggcttcaaagtgactgtgtagaatcaaaactagaaagtacacaggcatggagtcagagtttagttaaccatagcaagacgggacgcagtgggcatnttttgtagcttaagtttntcctaatggcctttagaggaacaatgctcaat

SEQ ID NO: 4884 - DNA, 573 bp, Mus musculus
  misc_feature (146)..(146): n is a, c, g, or t
  misc_feature (468)..(468): n is a, c, g, or t
  misc_feature (471)..(471): n is a, c, g, or t
  misc_feature (480)..(480): n is a, c, g, or t
  misc_feature (548)..(548): n is a, c, g, or t
aatccagacccaggaagctgtgcggcaggcacctgctgatagaagttataaaactctgtggccaaagtgactggagccggttcgagatggaggagcaaagtcctatgacacagttctttccccactactcacgcaagggcaaagcnttcaaccctcacccttcttcctccgcctggagaagattcacaaacccagtccctgcaggcgtctctcagaagaaaggaacacacacttgggagcctcagtcactgcccgactatcagtttgaaaagacggagttgcttcctaaggcaagagtgttttcataccacagtggcaagccctatgttaagagcgtacaacttcagaagaaaagcacgaacaaaatgaataccttcagaagtttattttgggggaatcattcccaaaggaaacgcagaggctttgcagataagtgctgtgtgataggatgcaccaaagaagagatgnccntcgcgtgcntcccctttgttgatttttaaaccttaacgattaatcaaacatcactggtgatagagatgtacaaactntcgtaggaactatgctcgcttaata

SEQ ID NO: 4885 - DNA, 299 bp, Mus musculus
ctacgctacctcaccatggttctgagcagcaagggggaggaggtgaagagtggccggagcaaggcagactccagaatggagaagatgaccgagaggctggaggccctcattgacccttttgacctggatgtcttcacaccgcatctcaacagcaacctcaaccgcctggtgcagcggacttcagttctatttggcttggttacaggcacagagaatcagtttgcctcccggagcagcactttcaactcccaggagccccataacatactgccgctggcctccagtcagatcaggtttgg

SEQ ID NO: 4886 - DNA, 584 bp, Mus musculus
  misc_feature (35)..(40): n is a, c, g, or t
  misc_feature (42)..(45): n is a, c, g, or t
  misc_feature (63)..(63): n is a, c, g, or t
  misc_feature (82)..(82): n is a, c, g, or t
  misc_feature (281)..(283): n is a, c, g, or t
  misc_feature (285)..(288): n is a, c, g, or t
  misc_feature (290)..(290): n is a, c, g, or t
  misc_feature (292)..(295): n is a, c, g, or t
  misc_feature (297)..(302): n is a, c, g, or t
  misc_feature (304)..(304): n is a, c, g, or t
  misc_feature (327)..(327): n is a, c, g, or t
  misc_feature (356)..(356): n is a, c, g, or t
  misc_feature (377)..(377): n is a, c, g, or t
  misc_feature (409)..(409): n is a, c, g, or t
  misc_feature (411)..(411): n is a, c, g, or t
  misc_feature (438)..(438): n is a, c, g, or t
  misc_feature (451)..(451): n is a, c, g, or t
  misc_feature (469)..(469): n is a, c, g, or t
  misc_feature (513)..(513): n is a, c, g, or t
accattgaagaagtcacacgggaacaaaaggatgnnnnnnannnnaccaagctgcacgcagtnctcttcatggccagactcntgccagtctctgggagagctgtgccctcacctaaagcagtgcattgtgggacagtgcgggggttctgagaaacctgccagggaggcgagggctctgaaaaagcaggggaaggggagagctcaggatgtcctccccgcgcaggcccagtggcagggagtgaaggaagtcctgctccaacagagcgtcatggcctaccggnnntnnnncncnnnncnnnnnnantttctgatttgtggattcactcnatcactgcttctcagggatgccggctcantcctggccactgccaccaatngggatgaactagaaattcaagaggagacagantntggcagcagtgtcacgtctaagatccncctccctactcanccctcctggtatgtacantccttcctgtttagcttatgccaggaagttaatcgggttggagnccatgctttgccaaaggtcaccctacaggagatgctgaagacctgcatggcccaagtcatagctgcctatg

SEQ ID NO: 4887 - DNA, 504 bp, Mus musculus
  misc_feature (297)..(297): n is a, c, g, or t
  misc_feature (448)..(448): n is a, c, g, or t
  misc_feature (453)..(453): n is a, c, g, or t
cagaaaccaccttgctgtcccaaatccccatgctgcccacccaagtccccatgttgccctccaaagccctgtccctgtcctcccccctgtccctgtccctgtccagccacctgtccttgtccgctgaaaccaccatgctgcccacagaagtgttcgtgctgccccaaaaagtgcacctgctgcccacagccacctccttgctgcgctcaacctacctgctgctcttcagagaacaagactgagtcagattctgatacatctggccaaactctggagaagggctctcaatcaccacantccccaccaggtgctcaaggcaactggaaccagaagaagtcaaacaaatagactgtccctgacaccatgccctttttcaaagggtataggattactacaggtcaggctaagactatgttgtaaagatgctgttttcacaataaccaacaantccantcaaccataagctaccatttcgacctaactgtaggctactattgcaactgg

SEQ ID NO: 4888 - DNA, 318 bp, Mus musculus
  misc_feature (261)..(261): n is a, c, g, or t
  misc_feature (283)..(283): n is a, c, g, or t
ggaagagctctatcggaagtttgcagacgccatccaggaggtgcagcagaagacgggcttcaagaacctgctgctggagcggaagctgcaggccctgaacgctgctgtggagaagagagaggttcagttcaatgaggtgctggccgcctccaacctggaccccacagcattaacgcttgtgtcccgcaaacttgaggatgttctagaatcgaagaataccaccatcaaggacttacagtatgagctggcccgggtctgcanaggcccacaatgacctgctgcngtacatatgaggcgaagttactggccttcgggatc

SEQ ID NO: 4889 - DNA, 426 bp, Mus musculus
  misc_feature (32)..(32): n is a, c, g, or t
  misc_feature (211)..(211): n is a, c, g, or t
  misc_feature (231)..(231): n is a, c, g, or t
  misc_feature (245)..(245): n is a, c, g, or t
  misc_feature (247)..(249): n is a, c, g, or t
  misc_feature (252)..(256): n is a, c, g, or t
  misc_feature (258)..(260): n is a, c, g, or t
  misc_feature (306)..(306): n is a, c, g, or t
  misc_feature (308)..(308): n is a, c, g, or t
agaagattcacatcctaacccacgcaaaggcngggaagaaatgctgaaggtggagacagattgtcctcaggctgggtagtcttaatgacagaggcactggggatacacgcattatgtacagattgttatttgtagggatagattctatggctaaaataattttgcaactcttcattatacagttttaaggcctcttttggtattccatggnatagttccaacaggaaagtnaatggtgaaagcantnnnaannnnntnnnccttactatatgtgctattgaaggggatggggacttttgcatacgncngaaaatcagttatttttaactatgcagttcctaattgcctagcttttacctttagaaatatgcttcatggtaaatttgataatcctaaagaatggccaactttggcagtagtcaacaa

SEQ ID NO: 4890 - DNA, 262 bp, Mus musculus
  misc_feature (49)..(50): n is a, c, g, or t
  misc_feature (53)..(54): n is a, c, g, or t
  misc_feature (57)..(60): n is a, c, g, or t
  misc_feature (62)..(66): n is a, c, g, or t
cggacaatcgggtctgcgtctataaaagggtgaggcgtcggcgccggannacnnttnnnngnnnnnggccgttcgtctgtttgcgctttcgtgatgtccggtcgtggcaagcaaggaggcaaggcccgcgccaaggccaagtcgcggtcttcccgggccgggctacagttcccggtggggcgtgtgcaccggctgctgcgcaagggcaactacgcggagcgtgtgggctgccggcgcgccggtatacatggcggcggtgctg

SEQ ID NO: 4891 - DNA, 553 bp, Mus musculus
  misc_feature (305)..(305): n is a, c, g, or t
  misc_feature (327)..(327): n is a, c, g, or t
  misc_feature (337)..(337): n is a, c, g, or t
  misc_feature (350)..(350): n is a, c, g, or t
  misc_feature (352)..(352): n is a, c, g, or t
  misc_feature (368)..(368): n is a, c, g, or t
  misc_feature (370)..(370): n is a, c, g, or t
  misc_feature (376)..(376): n is a, c, g, or t
  misc_feature (395)..(395): n is a, c, g, or t
  misc_feature (411)..(411): n is a, c, g, or t
  misc_feature (445)..(445): n is a, c, g, or t
  misc_feature (448)..(448): n is a, c, g, or t
  misc_feature (458)..(458): n is a, c, g, or t
  misc_feature (464)..(464): n is a, c, g, or t
caggtgctgagggactcgttcattggggagaactcgaggacctgcatgatcgccatgatctcaccaggcataagctcctgtgaatacaccttaaacacgctgagatacgcagacagagtcaaggagctaagcccccacagcggacccagtggagagcagccggttcagatggaaacagaagtgatggaagccagctctaatgggacgtctctgactggcaatgaagaggaggagctgtcttcccagatgtccagctttaatgaagccatgactcagatcagggagctggaagagagggccctggnaagagctcagagagatcatacngcaaggaccnaactggcttgagntntccgagatgacagatnanccagantatgacttggagacctttntgaacaaagcagaatntgccctgacacagcaggctaagcaggcgaagcanttntcagcccttngagaantcatcaaggccctgcgcctagccatgcaactggaagaacaggctagcaaacaaataaacagcaagaaacggcaccaatgatgacttcaa

SEQ ID NO: 4892 - DNA, 246 bp, Mus musculus
aacctgcagactaagcccgtggacccaactgtggatgggggcgcacaggtgcaacaagtggtcaacattgagtgtatatctgatttcacagaggcacctgtcctcaacatccagttcaggtatggtgggaccttccagaatgtgtctgttaagcttcccatcactctcaacaaatttttccagcccacagaaatggcttctcaggatttctttcaacgttggaagcagttgagcaatccacagcaa

SEQ ID NO: 4893 - DNA, 424 bp, Mus musculus
  misc_feature (206)..(206): n is a, c, g, or t
  misc_feature (264)..(264): n is a, c, g, or t
  misc_feature (266)..(266): n is a, c, g, or t
  misc_feature (299)..(299): n is a, c, g, or t
  misc_feature (371)..(371): n is a, c, g, or t
gacgtgtcacgatgtctgaccggaaggcagtgatcaagaacgcagacatgtctgaggacatgcaacaggatgccgttgactgtgccacacaggccatggagaagtacaacatagagaaggacattgctgcctatatcaagaaggaatttgacaagaaatataaccctacctggcattgtatcgtgggccggaattttggcagctangtcacacacgagacaaagcacttcatctatttttacttgggtcaagttgcaatcctcntnttcaagtcgggctaggtggccgaggcgaaggtntccgtggcggcggcagcgatggcaagcaggcggcgttgctgggactgttgcactggggccagcatcaggaantcctctccaatggctgtgctactgcatggactgtgtactcgatttcatgtgtg

SEQ ID NO: 4894 - DNA, 481 bp, Mus musculus
  misc_feature (231)..(231): n is a, c, g, or t
aatgagcggcactatggtggcctcacaggcctcaataaggctgagacggctgcaaagcacggggaggagcaggtgaagatctggaggcgttcctttgacaccccaccaccacccatggatgagaaacacaactactacacctccatcagcaaggaccgccgctatgcaggcttgaagcctgaggagctgcctacctgtgaaagtctcaaggacaccattgcccgggccttngcccttctggaatgaggagatcgcacctaagattaaggctggccagagagtgcttattgcagcccatgggaacagccttcggggcattgtgaaacatctggaagggatgtccgaccaggccatcatggagctgaacctgcccactggaatccccattgtgtatgagctggaccagaacctgaagcccaccaagcccatgaggttcctgggagacgaagagacggttcggaaggccatggaagctgttgct

SEQ ID NO: 4895 - DNA, 507 bp, Mus musculus
  misc_feature (411)..(413): n is a, c, g, or t
  misc_feature (438)..(438): n is a, c, g, or t
  misc_feature (444)..(444): n is a, c, g, or t
ttgtgtgtctcagagaatcagccagacactgatgacaaaagtggacgcaggaaaagacagacatggctttgggaagaagacagaattttgaagtgtggtgtaaagaaatatggagagggaaattgggctaaaatactatcccattataagttcaacaaccgaacaagtgtcatgttaaaagatagatggagaacaatgaagagactgaaactgattagctgagacactggaggctggatgggtttgattcagcttaatacaaggataaatacttggatcactacactttgtttacaatttcctggtcagtaatgataaagcattatggtggtggtggggcagtgaggagggggaagagaaagagagtttttgtttttttggtttttgtttgtttgtttgtttgtttgtttnnntttagaggagatttgtgctttaaantctatntcatcattattttctgaatctttatttttgtaaaatatagatatgttgaaccctaccaaattc

SEQ ID NO: 4896 - DNA, 163 bp, Mus musculus
caatagcatgccatcggctctgtgaggggccggatttctcaacagatttcaattacatgccccctcagaacatgcctgaaggctctggtgtcctcctctttattttccatgcaaactttttgggcaaagacgttattgctcggctttgtggaccatgcagtgt

SEQ ID NO: 4897 - DNA, 437 bp, Mus musculus
tattttccatgcaaactttttgggcaaagacgttattgctcggctttgtggaccatgcagtgtacaagctgtggttttaaatgataaatttcaacttcctgtttttctggacagtcactttgtttattcattcagtcctgttgctggccccaataagttgtttataaggttgacggaagcaccctttgccaaggttaagttgctaataggtgcatacagagtacagctgcagtgaccacaaaggatggagaaccggcctcttttcagctggattccaaggaccatccctgtagcagtttggaattctggtgcagctcaaatgttcctacctagttgtaaacttaaaatttaagcctgctgcctgttcaggtttgtctacatatatttgtgccattggtcgaaaacgttcaatgttctgcttagtttatttccacaat

SEQ ID NO: 4898 - DNA, 386 bp, Mus musculus
tatccgacgtctgcgaggacttcgacgaagagggcaaatctgtaagaaacaggattcgcaagtacagccagaccatttctattagggacagcctcaacctcgagccagaggagatccagcagcaagcacgtcgagagcttgaactgtgccatggcaggtccttggagcatggggaggaccacgaagaatctgagacctccttagcatcgtctacttcagaatcactaatattcagcctatggaagccacatcgaacctactggacagagcagcagaacaggctgcctctgcctctgatggagctcatggagactgaagttctggatattctcaaaaaagccctcatcacatataggtccacgattggcaggaaccacttcatgact

SEQ ID NO: 4899 - DNA, 253 bp, Mus musculus
agttttcttgagtcattatctgtgaacacagtagtagggcctttaccttcctcgtaggtgtcccagtgtccttatttgttgcccaaaagcagggaagaagctgtgtccaaatgggttctaaatcctacaggctggtcggcttgaggcagtgaatcattacagactccctagtctccttcaggagagtggcatgtcttcattattctgtagcgtattcttatatctacatatgcaaagctttccttcacagtaa

SEQ ID NO: 4900 - DNA, 451 bp, Mus musculus
  misc_feature (321)..(321): n is a, c, g, or t
  misc_feature (363)..(363): n is a, c, g, or t
agccaatttcagatgccttgaccaaattcatgacttgtgtgtgcgtgatttggttacagacctattttcataaatgcagatttataagtttaaaatgatgcatttttcccacactatggaatatgttaaaccctcctctttgatgttagtggggaaggctttatgtagtgggtctcactctagtgtgtaacagagaagccacgtctgcagacaagctctgagcagctgctgtcaggagttttacaggtgccttctcagagaaaaattggatttgaccattttttttccctaaaattttataattgaatttctaaaagcctncctcattttataccatttctataaaatatgccctgcaaagcnaaacctgggtacctagcagctgatattttacaactaacatggggtatttgagtctagaaatataaagggtctatctcctcacattttg

SEQ ID NO: 4901 - DNA, 568 bp, Mus musculus
  misc_feature (275)..(276): n is a, c, g, or t
  misc_feature (297)..(298): n is a, c, g, or t
  misc_feature (325)..(325): n is a, c, g, or t
  misc_feature (341)..(341): n is a, c, g, or t
  misc_feature (348)..(348): n is a, c, g, or t
  misc_feature (367)..(367): n is a, c, g, or t
  misc_feature (373)..(373): n is a, c, g, or t
  misc_feature (375)..(375): n is a, c, g, or t
  misc_feature (395)..(395): n is a, c, g, or t
  misc_feature (403)..(403): n is a, c, g, or t
  misc_feature (438)..(438): n is a, c, g, or t
  misc_feature (442)..(442): n is a, c, g, or t
  misc_feature (470)..(470): n is a, c, g, or t
  misc_feature (477)..(477): n is a, c, g, or t
tgtaacggattccacagggcatgtgagaaagctgggtttaagtgcacagtcaccaaggaggtgcagactgtccttacctgtttccaggacaaactccatgacatcatcatcatagaccacagatatccccgacagatggatgcagagacattgtgcaggtctatcagatcatcaaaattctcagaaaacacagttattgttggcgtagtacgcagggtggacaaagaagaatcatctttaatgcccttccttgctgctggcttcacacggaggtnnatagagaaccccaacgtcatnncctgttataatgaactgctccagttgncatgtggagaggtgcnatcacanctgaaactcagggcttgtnactcantnttcactgcattagagaaaantcaagaancaattgaaattacaagtgaagaccacattatacantatncaaaccctgcatttgaatcaacaatggnttatcantcaggagaattaatagggaaggagttagcacaagtgcccataaatgaaaagaaaggtgatttgctcgatgccataaattcgtgtgtcacag

SEQ ID NO: 4902 - DNA, 520 bp, Mus musculus
  misc_feature (292)..(292): n is a, c, g, or t
  misc_feature (299)..(299): n is a, c, g, or t
  misc_feature (311)..(311): n is a, c, g, or t
  misc_feature (322)..(322): n is a, c, g, or t
  misc_feature (382)..(382): n is a, c, g, or t
  misc_feature (384)..(384): n is a, c, g, or t
  misc_feature (426)..(426): n is a, c, g, or t
  misc_feature (441)..(441): n is a, c, g, or t
  misc_feature (487)..(487): n is a, c, g, or t
aatctcagcattgttcagaggccaacatgttctcagaagtccgtgttccccagaacttcaaagtaacagcctttatgtgaacggtttgcaaagtcacagaacagaacagcacttggtgccttggagctcaacatggggtaggggggttagcactactccagtgggatatgtgtctgccctggttggttctatggagaccagctgtcggaggacatgacttttcctgacattgtagcattgtagccgatgagtagcactgtggctgctgtgcccgtgactcccagtgcccttngtctgcnagaggttacctnactgttctttnaccgtggctttgttcttgaccttcattccctcctggattcctgtggctgtgctaccacantnttcattccagtggtggacagctgctacaccaagagacttttnccgaacctctgaganccagaggggtttgggcaatgttgctttgtgtttctgtatctgtccnaacactaaggatggccattgcagacagctctag

SEQ ID NO: 4903 - DNA, 486 bp, Mus musculus
  misc_feature (284)..(284): n is a, c, g, or t
  misc_feature (303)..(303): n is a, c, g, or t
  misc_feature (317)..(317): n is a, c, g, or t
  misc_feature (319)..(319): n is a, c, g, or t
  misc_feature (342)..(342): n is a, c, g, or t
  misc_feature (352)..(352): n is a, c, g, or t
  misc_feature (358)..(358): n is a, c, g, or t
  misc_feature (400)..(400): n is a, c, g, or t
  misc_feature (404)..(404): n is a, c, g, or t
accggcgataactcttctactgaagagatgggaagtataagggatgcagatgagaatgaattcccagggatcattgatgccggcgacctcaatgtgcttgaagaagtggacagcgtatcgaatgaagattcaactgcaaatagcagcgacaacgaggaccatcaaataaatgccccagaagaggatcccctaaattctggcgatgatgtcagtgagcaggatgtgccagacctgtttgatacagagaatgtaattgtctgtcagtatgataagatccaccggancaagaacagatggaaattntacttgaaagatgntntcatgtgctttggagggagagantacgtatttnccaaanccattggtgaagctgagtggtaacctcccgaggctcggtgcntccntcagcgctgtgagcctgtgtgggactggctactgtattgtatgtgtggcccacattcttattttacatgtgctccatcaaag

SEQ ID NO: 4904 - DNA, 472 bp, Mus musculus
aagaattactacgagtcccaccttgggtccagctacatcactgacagcatgctagaagactgtgcacctcacttctagactccccaggaggaaacacagttgcgaaactgcctggaggcctcttgcagggacatgagaacactctgttagcacaagccctggggaccctgtggctcatactagcaatagtcacagtgtcaccccaacaagcagaaaccaggcatggtgaccatgctccaaggaaggctccacacttgcccttaaaattctggatctgcaaaaaggcagggtggccccaccctgaccccgctgagggtacagagccacgaggatgagcagagtgggtcctgcaattagggcgcaggcaccaatgcatggggcttgcatgatcactccaagttgacattttaaatcttgccgtacttcagtaattcacttatttccaatatttgtcgtcagctttgttaatggc

SEQ ID NO: 4905 - DNA, 527 bp, Mus musculus
  misc_feature (35)..(35): n is a, c, g, or t
  misc_feature (57)..(57): n is a, c, g, or t
  misc_feature (60)..(60): n is a, c, g, or t
  misc_feature (62)..(62): n is a, c, g, or t
  misc_feature (76)..(76): n is a, c, g, or t
  misc_feature (270)..(270): n is a, c, g, or t
  misc_feature (288)..(288): n is a, c, g, or t
  misc_feature (339)..(339): n is a, c, g, or t
  misc_feature (359)..(359): n is a, c, g, or t
  misc_feature (389)..(389): n is a, c, g, or t
  misc_feature (432)..(432): n is a, c, g, or t
  misc_feature (441)..(441): n is a, c, g, or t
  misc_feature (444)..(444): n is a, c, g, or t
  misc_feature (458)..(458): n is a, c, g, or t
  misc_feature (460)..(460): n is a, c, g, or t
  misc_feature (474)..(474): n is a, c, g, or t
  misc_feature (501)..(501): n is a, c, g, or t
gagtctgctgtgaagcttgagaaagaagcaatganaagatgtcatcactaaagcagnggnangaagaaagggaaanatctggagaaagttcatgccgaagaaagggaactgtggaagacagaacatgcaagagatcaggagagggtggcagaggccatccaggccgctgtgcaggagcagcagaggatgagtcaggaagctgtcaaggccgcaatcgtagaggagcagaggagaagtgaaaaggccatggaggaagccgtaaagagaacnagggacgagctggtggantacgtgagggagcagagaaggctcgatcaagtcacccgccagcgtagcctntccagcctggagctgttccntctcctgcgcccagaagcagctgagtgctntaatagctacagagcctgttgacattgagtagagacacagcanatccatcgntcntcaagcctgcccantntgaagctgtttttntcctgcgcccagaagcagcgagtgctntaatggccgtagagcctggtggcatt

SEQ ID NO: 4906 - DNA, 516 bp, Mus musculus
  misc_feature (339)..(339): n is a, c, g, or t
  misc_feature (353)..(354): n is a, c, g, or t
  misc_feature (356)..(369): n is a, c, g, or t
tgtggactcctggaactgcccagattggagacggaatagaaaactcctggggtgaccttgaagattctgagaaggaagaggaagaggaggaaggtggcattgatgaagctgtcattcttgatgatacaaagatggacactggagaagtttctgatattgggagtcaaggtgcccctatagtgctatcagatagtgaagaagaagaaatgattattttggagccagagaagaacccaaagaaaataagagctcagaccagtgcaaaccagaaggcaccaagtaaaggccaagggaaaaggaagaagaagaagagaactgctaactaagctaaagtggtgnatctctgtgtgtgnntnnnnnnnnnnnnnngtgtgtatacatactcagtgctaacagctctgggtatcttacaagctgaacttcttgatacactgtttgtctttaacattatgctttgaataaactttctggaaaacttttctgttgcacaagcttcccaactcatgtaagacctta

SEQ ID NO: 4907 - DNA, 570 bp, Mus musculus
  misc_feature (375)..(375): n is a, c, g, or t
  misc_feature (394)..(394): n is a, c, g, or t
  misc_feature (453)..(453): n is a, c, g, or t
  misc_feature (474)..(474): n is a, c, g, or t
gcattgtggaagcatcgcggatcatgaatttgtaccagtttattcagctctataaagacatcacaagccaagctgctggagtgctggctcagagctccacctctgaagagcctgatgagaacccatcctcggtcacatcttgccaggctagtctatggatgggcagggtgaagcagctgactgatgaggaggagtgttgtatctgcatggacgggcgagctgacctcatcctgccctgtgctcacagcttctgtcagaagtgcattgataaatggagtgatcgacacaggaactgccccatttgtcgcctacagatgactggagcaaatgaatcatgggtggtgtcagatgcacccactgaagatgacatggctnaactatattcttaacatgnctgatgaggcaggccagccccacaggccatgacttggggaagactttctgttgttattntgaactacaaatacactgttntcgtagaggagaagggggggatattgtggcacacacagaaatatcagttttcccaccctcttatttttgctattctggtatgtcccgttcttaaat

SEQ ID NO: 4908 - DNA, 538 bp, Mus musculus
  misc_feature (219)..(220): n is a, c, g, or t
  misc_feature (383)..(383): n is a, c, g, or t
  misc_feature (387)..(387): n is a, c, g, or t
  misc_feature (436)..(436): n is a, c, g, or t
  misc_feature (439)..(439): n is a, c, g, or t
  misc_feature (441)..(441): n is a, c, g, or t
  misc_feature (444)..(444): n is a, c, g, or t
  misc_feature (502)..(502): n is a, c, g, or t
aagtttttagaggtcccagctgagatagctagagggaatatccagactgtagtgatgacctcaaaagactcagagacacttgaagaaaattgccccaaagccctgactttaaggattcatgattctttgaataatactctgtcagttggcctcattccaaccaattcaacaaatactatcatggaccaaaaaaacttaaagatgtcaactccaggtcannaatgaaagctcaagaagttgaaagaacccctccagccaattttaaaaggacattagaagaatccaactctggcccccttatgaagaagcaccgacgaaatggcttaagtcgaagtagcggggcccaggcttccagtctccctacagcatcccagcgcaggcantctntcaaactgaccctgaggcgcagactcaggggccagaggaagatgggaantcntnttntccaccagcaccggaaaacagtgtgtgtgtgctgagatgggcctgggaagtgggggtntccctacctacgactgagggctttttaaacttggtg

SEQ ID NO: 4909 - DNA, 504 bp, Mus musculus
  misc_feature (103)..(103): n is a, c, g, or t
  misc_feature (268)..(269): n is a, c, g, or t
  misc_feature (273)..(273): n is a, c, g, or t
  misc_feature (277)..(277): n is a, c, g, or t
  misc_feature (281)..(281): n is a, c, g, or t
  misc_feature (287)..(287): n is a, c, g, or t
  misc_feature (342)..(342): n is a, c, g, or t
  misc_feature (350)..(350): n is a, c, g, or t
  misc_feature (359)..(359): n is a, c, g, or t
  misc_feature (363)..(363): n is a, c, g, or t
  misc_feature (412)..(412): n is a, c, g, or t
  misc_feature (418)..(418): n is a, c, g, or t
gcaaaggatccttgagggttccggtgctacagaattccactgctctgcccgatcttccagagactcaggaatgaagtttcgaaattcctctgtcgcaatgggnagcttcgcttgctcattcagaatattctctaaaggtaacagatgtgacaaaagtaaggactttgaatgcaattgcaaaggacgtcctagtttagttaaacttgtcggagagacatgggcatcaacagtgtgaagggagaagttggactgacaatacctgacgaanntctnaccnttcnacatgngccatagatgtttgtaagaagaaaaagacattggaacagcaatgcaattactttntttagtantcattggtntctntcatcatggataaatttagtctgtacttcttacaagaagagaggcgtantcattntcagtgggcttaactgatgaactggcaaagttcagctgcaaagtatgaaatcagagtttgtttcagggtcaatttagtgccacttt

SEQ ID NO: 4910 - DNA, 285 bp, Mus musculus
  misc_feature (92)..(92): n is a, c, g, or t
  misc_feature (115)..(115): n is a, c, g, or t
agcaaacgagtcaaggccctactgagtctcaaggatgccagttttccagcacgaaccctgctgtttctggtttccattcctttcctaatctncagactgaacagctcttctccanacatcgcactgtagacagccacaagcagacagccaccgcctctcaccagggactagaaagtcaccagggactagaaagcagagagctggattctgcggaagaaaagcttcctttcccaccagacattgatccgcaagttttctatgagcttccagaagaggtccaaaagg

SEQ ID NO: 4911 - DNA, 523 bp, Mus musculus
  misc_feature (281)..(281): n is a, c, g, or t
  misc_feature (369)..(369): n is a, c, g, or t
  misc_feature (431)..(431): n is a, c, g, or t
  misc_feature (475)..(475): n is a, c, g, or t
  misc_feature (480)..(480): n is a, c, g, or t
  misc_feature (488)..(488): n is a, c, g, or t
aattcaccttcaggaagcggcttcgggaaatggagagtttttacagtgagctcaagtggcaagagaaaaataccttagaagagatagccgagctgcagggagacattcggcgcctggaggaggacctgcgtagaaagatgatgaacttgaagcttgcacatacccggctggagtccagaacctaccggtccaatgtggagctctgccgggaccagacacagtatggcctcattgatgaagtccaccagttagaggcaaccatcaataccatgaagcagaanctggcccaaacacagaacgctttggatgccctgttcaagcacctggcccggatacaggctgatatcgcgtgcaagaccaacaccctgntcttggacaccaagtgtatggacacccgacgcaagctgacggtgccggctgagaaatttgtnccccaggtggacaccttcacgcgcacgacaaaccgcacactgantccantcaaaatntgccagctggagctaacctaggctttggcggctga

SEQ ID NO: 4912 - DNA, 457 bp, Mus musculus
  misc_feature (333)..(333): n is a, c, g, or t
  misc_feature (413)..(413): n is a, c, g, or t
  misc_feature (415)..(415): n is a, c, g, or t
gctggcggtcagtgatgagatccttgaggtcaacggcattgaggtggccgggaagaccttggaccaagtgacggacatgatggtcgccaacagccacaacctcatcgtcactgtcaagcctgccaaccagcgtaataatgtggtacggggggcatctgggcgtctgacagggccttcctctgtagggcctgggcctactgatcctgacagtgacgatgacagcagtgacctggtcattgagaatcgccaccctccctgttctaatgggctgtctcaggggcccctgtgctgggacctgcaacctggctgcctacttcctggtgctggcagctntctgccctccttggatagcagagagcaagccaattctggctgggggaatggcatgcgaggtgatgttagcggattcagcntntgacaggcaaagatgcagcccttgtcactttaggctgcggga

SEQ ID NO: 4913 - DNA, 443 bp, Mus musculus
  misc_feature (285)..(288): n is a, c, g, or t
  misc_feature (290)..(290): n is a, c, g, or t
  misc_feature (330)..(330): n is a, c, g, or t
  misc_feature (394)..(394): n is a, c, g, or t
agaggacaaagctattcccgctcgggacttttgaaggctggtggtttggaatagttcataaggttcctcagttaaggcgccttcctgtgtcgtcgtgatcgtgtgcagctcccgttcgacacgcagagtggtggatcaagtgctcaatcgaaggctggttctgcactgggccaggagaggagcacatgtgtgctggctagagctcagtgctgtgctgggctaggttgcagaagtctcctccagtcgagagctatgatggagcaagcacaaaataggccaagagcnnnntnggaggatgggaggaccatcaggaagggtgatgacagagcntgctagggggttatttattggggtaacaaataagtcacacctctacgtgtcagtaaatactttncacaatgtttttaacagtaattcagagttccactttatggtttagccac

SEQ ID NO: 4914 - DNA, 517 bp, Mus musculus
  misc_feature (208)..(208): n is a, c, g, or t
  misc_feature (312)..(312): n is a, c, g, or t
  misc_feature (348)..(348): n is a, c, g, or t
  misc_feature (350)..(350): n is a, c, g, or t
  misc_feature (362)..(362): n is a, c, g, or t
  misc_feature (403)..(403): n is a, c, g, or t
  misc_feature (457)..(457): n is a, c, g, or t
  misc_feature (488)..(488): n is a, c, g, or t
aatgactccctctgcaacaacaaagacagcctagcgtcagtctggcgagtgccagagaccacagcaacctccaacatgtcaggaacccgccactgcccgacatgtgtggccctgggctcctgttccagtgccccctctatgccctgtgccaatggcacaactcagtgctatcaaggaagacttgaattctctggaggaggcatggacnccaccgtgcaagttaaaggctgcaccactacgatcggctgcagactgatggccatgatagactcagtgggacccatgacagtgaaggagacctgtagttaccantcattccttcagccccggaaggcagaaatcggggcntntcagatgcccanttcactgtgggtgctggagctactgtttccgttactgctgntccccctcacccacttcccttgaagaggacactgggggtcaggggaggccttgntcctagacactggactttgcctaggaggganccttctgcctgctgatactggaagaagtg

SEQ ID NO: 4915 - DNA, 423 bp, Mus musculus
  misc_feature (26)..(26): n is a, c, g, or t
  misc_feature (69)..(69): n is a, c, g, or t
  misc_feature (88)..(89): n is a, c, g, or t
  misc_feature (366)..(366): n is a, c, g, or t
  misc_feature (368)..(368): n is a, c, g, or t
aatcaaactgaggatcgtcgggctanccttcctggtcgtaatgacaactcctacatgtatattctcttngtcatgttcctatttgccnntcactgtgggcagtctcatcctgggatatacccgttcacgcaaagtggacaaacgtagtgacccctatcatgtgtacatcaagaaccgtgtgtctatgatctgatgtgaggaacctgaagacaatggaagattacaatgtctgaggattgtcttctggtgcctccggaactcaactcaaccatatcaagccacagtgtatctatgtaagatcaacaggaaactggtaagaggattaggtcattattaggaccagagaagagggactgataggcccantnttgtggatgagacatttttcgagacacagatgcgcattataaactcagagcccat

SEQ ID NO: 4916 - DNA, 416 bp, Mus musculus
atatgtttatgttctgactgtcactgaaatattggaagactgggaagactccgtgaatataggaaggaagagagagtggttcaaagtagaagatgcaatcaaggttcttcagtgtcataagcctgtccacgcagagtatctggaaaaactaaagctgggctgttctccgaccaatggaaattcctcggtcccttccctcccagataacaatgccttgtttgtgacgtgctgcgccgccctctggggtgccatccagtataagatagagggttggggtccctcccccatcatgtgatgcacatgtcacaaggagaggctctttcacttctaacacacctgactgctgctggcaaactctgtatttgctatgcagggatttcaaataatttgcatgtatttcatctgctttcaagtct

SEQ ID NO: 4917 - DNA, 155 bp, Mus musculus
catgtcacctgggtcaggatttctttcagtgccatttagcaaactgtctttagtctatgcaaatagcaaagatttacagaatgcaactgaatgcagcttcactgttaaatttcacctgagggctcctcattattcttctggaacccagaacttga

SEQ ID NO: 4918 - DNA, 458 bp, Mus musculus
gaccggagcgggaactgccatctctccgtggaccccgagtccccgcctgcatgcagaggccgggcccggccggccgctgagcgtgtctgcgcgcgcgcggagcagctcagaagataagataacagtccacttcaagaaccgagatggcgagacgctaacgaccaaggggaaaattggcgactctctgctagatgttgtgattgagaacaacttagatatcgatgggtttggtgcgtgtgagggaacgttggcttgctctacttgtcatcttatctttgaggatcacatctatgagaagttagatgccattactgatgaagagaatgacatgcttgacctggcttttggactaacagacaggtcaaggttgggctgccaagtttgtctgaccaaggctatggacaatatgactgtgcgtgtgcctgaagcagtggcggatgtccgacagtctgttgaca

SEQ ID NO: 4919 - DNA, 263 bp, Mus musculus
  misc_feature (165)..(166): n is a, c, g, or t
tgcatctaacattggcgggaacctggcaagttgaccggtgctgtgcgggcgatggcgtcgcgtcggggagcgctcatcgtgctggagggtgtggaccgtgctggcaagaccacgcagggcctcaagctggtgaccgcgctgtgcgcctcgggccacagagcgganntgctgcgtttccccgaaagatcaacggaaatcggcaagcttctgaattcctacttggaaaagaaaacggaactagaggatcactccgtgcacctgct

SEQ ID NO: 4920 - DNA, 500 bp, Mus musculus
  misc_feature (215)..(215): n is a, c, g, or t
  misc_feature (432)..(432): n is a, c, g, or t
agctataccaagaggctcgggagtgcctaacccttctctctcagcgtctgggctctcagaagttcttctttggggatgcccctgcctccctggacgcctttgtttttagccatttggccctgctgctgcaggccaagctgcccagtgggaagctgcaggcccaccttcgggggctgcacaacctctgcgcctactgcacccacatcctcaacctnctactttccccgggatggagatgaggtgccacttccacgccagacaccagcagcccctgagaccgaggaggagccataccggcgccggacccagattctctctgtgctggcagggctggcagccatggtgggctatgccctgctcagtggcatcgtttctatccagcggacaagccctgctcgggccccaggcacccgggccttgggcctggctgangaggatgaagaggactgatggcgttcctgttcccaggactgacttttctactcgtgcattccagctgt

SEQ ID NO: 4921 - DNA, 438 bp, Mus musculus
  misc_feature (321)..(321): n is a, c, g, or t
acatggaatccggtcccaggaagaagctgtttgaataccagcaggctcagctggaggctgagatcgaaaacctttcatggaaagttgagcgtgcagacagctacgacagaggggacttagaaaaccagatgcacatagcagagcagcggaggagaaccctgctaaaggattttcacgacacctaaactgggctgtggctgtgccggggtgaggaagatgtagctgtgaggccgcccggctgccctcctgcaggctgtaggctctgcctttcaccacccaggcaacagccagggccccactcctgaaagacactggcaacancacctcttagccgatttgttttctcctcatctttttgatttttatttctaccagggtagaggccgcgttgagctggcctctaatgaggactttacatttcccctggatggttgttgg

SEQ ID NO: 4922 - DNA, 218 bp, Mus musculus
gaatgactatgaagcagagtctggtaacataagtcaaaagtcggatgaagaagactttgtgaaagttgaggatttgccgctcaaactgacagtctattcagaggaagagctaaggaagaaaatgatagaagaagaacagaaaaaccatttatctggtgaaatatgtgaaatgcagacagaagaattagctggaaattctcagatactgaaagaacctg

SEQ ID NO: 4923 - DNA, 325 bp, Mus musculus
gaacctgaaacagtgggagcccagagtatatgaaatgtcttcagagactcatctaactctcttacatagtcagcacatttaaaaaaaaagacactaaataaacatttgctttgatctgtataaaatgtaaattagtttgacactgcatttttgatgggtgtgctaatttctgcccatggcagtttaaaacattagaatctgaatcctggacagattcaaaccttgacacactgtgggatttttcttttgctttttgtcctgttttttctttcttatgatcttgacccaccccctaccccccccacccttcattgtgacatttggt

SEQ ID NO: 4924 - DNA, 458 bp, Mus musculus
  misc_feature (81)..(81): n is a, c, g, or t
  misc_feature (160)..(160): n is a, c, g, or t
  misc_feature (164)..(164): n is a, c, g, or t
  misc_feature (168)..(168): n is a, c, g, or t
  misc_feature (173)..(173): n is a, c, g, or t
tacacagttcagacattgttagtaactagaatttaacaggattatctattagattaatatttttcagaatttaaaatgttncctcattctaaaaattaaaaaaaaagctttatatgtatttctgtacagacaagtagcattctaattaattaaaaaaaanaaanaaantcttncaagttaggataaatagaactaaatttatgtaacagaacactaagatttttaatgcctatggacaaaacatgccttttgagatgataatttaaaaccaaagcctaatagttgtttttgtgtgttttgagagagaagcaagttcaagtgttaagaacgtctctgtgagtttttcatcactaagtaaaccaactcttaaaaagtgctttgccttctgagtctgtctacacttaccacttcctataatattgcagagccagttaaccatgaataatctgtcagtctta

SEQ ID NO: 4925 - DNA, 312 bp, Mus musculus
  misc_feature (202)..(202): n is a, c, g, or t
  misc_feature (208)..(208): n is a, c, g, or t
  misc_feature (210)..(210): n is a, c, g, or t
  misc_feature (213)..(213): n is a, c, g, or t
  misc_feature (218)..(218): n is a, c, g, or t
  misc_feature (278)..(278): n is a, c, g, or t
  misc_feature (287)..(287): n is a, c, g, or t
gttcgtgatgctgaagacgctttacataatttggacagaaaatggatttgtgggcgtcagattgaaatccagttcgcacagggggatcggaagacaccaaatcaaatgaaagccaaggaagggaggaatgtatacagctcttcacgatatgacgattatgaccgatatagacgctctcgaagccggagttatgaaaggagangatcgnangantcgcntcctttgattataactataggagatcttacagtcctagaaacagtagaccgactggaagnaccacggcngtagccgaagccattccgacaatga

SEQ ID NO: 4926 - DNA, 492 bp, Mus musculus
  misc_feature (366)..(366): n is a, c, g, or t
  misc_feature (445)..(445): n is a, c, g, or t
  misc_feature (451)..(451): n is a, c, g, or t
  misc_feature (462)..(462): n is a, c, g, or t
agtactgcctcctgtttacaatcagcagaacgaagacacctgcatcatccgcatcagtgtagaagacaacaatggcaacatgtacaagagcatcatgctgacaagccaggataagacccccgctgtgatccagagagcgatgtcgaagcacaacctggagtcggaccccgccgaggagtatgagctggtgcaggtcatctcggaggacaaagaactagtgatcccggactctgcaaacgtcttttacgccatgaatagccaagtgaactttgatttcattttacgcaaaaagaactcggtggaggagcaggtgaagttgcgcagtcggaccagcctgactttgcccaggacagctaagcggggctngctggagtaacaggcacagcaagatcaccctctgaaagggacagtacactcctactgcccaaggcagagtgaggctgancaaaanccatggcgacnccaaccaccacccagtgttgagcatcattg

SEQ ID NO: 4927 - DNA, 497 bp, Mus musculus
  misc_feature (296)..(296): n is a, c, g, or t
  misc_feature (315)..(315): n is a, c, g, or t
  misc_feature (352)..(352): n is a, c, g, or t
  misc_feature (413)..(413): n is a, c, g, or t
  misc_feature (470)..(471): n is a, c, g, or t
ttcaggatcaacatggtctcctcacactgggatggatccatacacaccccacgcaaacggcattcctgtccagtgtggatctccacactcactgctcctaccagcttatgttgccagaggccattgccattgtgtgttccccaaagcataaagacaccggcattttcaggctcaccaacgctggcatgcttgaggtttctacttgtaaaaagaagggcttccatcctcacaccaaggaccccaagctgttcagtatatgcagccatgtgttagtaaaggacataaaaacaactgtnttggatctgaggtgacatnccctaactgtaagaccatctgtggacgtgtgtgactnccgaatttcttatgatgttttcagaagtgactgatattttatatttatatattttagaccnaaactttgatatttattgttcttgcacattttgaagtttcctttttttttttttttnngggttgctgcgtctcaaacgaggcca

SEQ ID NO: 4928 - DNA, 468 bp, Mus musculus
  misc_feature (323)..(324): n is a, c, g, or t
  misc_feature (366)..(366): n is a, c, g, or t
  misc_feature (389)..(389): n is a, c, g, or t
  misc_feature (426)..(426): n is a, c, g, or t
gatccgttgttatgtgtgccttaaaactctatgtgaatgatcactacccaaatggaaattgcaatgtgctgagaaaaacagtcaaaagcaaagaattcttaatagcttgcattgaagaccacagctatgacaatggagagtgttggaacggtctttggaagtctaagtggatcttccaggtaaacccgtttctaacccaagtcacagggagaatttttgtgcaagctcacttctttaggtgtgtcaaccttcatattgaagtctccaaggacctaaaggagagcttggaggtggtcaatcaagcccagttggctctcagtttnncaaggcttgtggaagaacaagagaataagtttcaagctgctntcatagaagaactacaggagttntctaacgaagccctgagaaaaatattacggagggatnttccagtgacacgcactttgattgactggcaacggatccttt

SEQ ID NO: 4929 - DNA, 172 bp, Mus musculus
  misc_feature (36)..(38): n is a, c, g, or t
  misc_feature (41)..(41): n is a, c, g, or t
  misc_feature (94)..(94): n is a, c, g, or t
  misc_feature (102)..(102): n is a, c, g, or t
actgtgtgctgaacggagggccacttcccgagagcnnngcnaaggccctcttccgccagatggttgaggctattcgctattgccatggctgtgncgtggccnaccgggaccttaagtgtgagaacgccttgttgcagggcttcaacctgaagctgaccgactttggctttgc

SEQ ID NO: 4930 - DNA, 312 bp, Mus musculus
  misc_feature (231)..(231): n is a, c, g, or t
gacgcggaggtctctcttattgatgaagaggaatgcacgacctttttccagacaccagaagtcagcatcacggaatatgatgttataaaagacgatgtgttatgtgccggagatctcaccaatcagaaatcctcctgccgaggagactctgggggccccctggtctgcttcctgaatagcttctggtacgtggtagggctggccaactggaatggagcatgtcttgaaccnatccacagccccaacatcttcaccaaggtctcctacttttctgactggatcaagcagaaaaaggcaaacacgcctgccgct

SEQ ID NO: 4931 - DNA, 169 bp, Mus musculus
gctccaaagaagtgaacaagtttcagatggcctattcaaatctactgagagccaacatggacgggctgaagaagagggacaagaagaacaagagtaagaagagcaaaccagcacagtgacaggcgtggctgctaccaaccagctgcacaagtgcatttttcctctgttt

SEQ ID NO: 4932 - DNA, 420 bp, Mus musculus
  misc_feature (38)..(38): n is a, c, g, or t
  misc_feature (304)..(304): n is a, c, g, or t
  misc_feature (345)..(345): n is a, c, g, or t
ctatcccgaggaagagttctgtggagggcctcgagccntgcagaaaacaagtgtctgttgagagccacggatgggaaaaggaagatcagcaccgtggtgagctccaaagaagtgaacaagtttcagatggcctattcaaatctactgagagccaacatggacgggctgaagaagagggacaagaagaacaagagtaagaagagcaaaccagcacagtgacaggcgtggctgctaccaaccagctgcacaagtgcatttttcctctgtttgctgctttcagcacctctgtatgtaactgtttccnacggaagggtcctttaagagagaaggactgggatgggcatngggctagttgtggtaagacgccagtttttgatttgtgctgtgtggctggatattcttagattccagccgtaaggt

SEQ ID NO: 4933 - DNA, 560 bp, Mus musculus
cttttgggatcgttctctgtgagatcattgggcaggtatatgcggatcctgattgcctgccccgcacactggactttggcctcaatgttaagcttttctgggagaagtttgtcccaacagactgtcccccagccttcttccccctggctgctatctgctgcaaactagagcctgaaagcagaccggcattctcaaagctggaggactcgttcgaggcgctctccctgttcttgggggagctggccatcccactgccagcagagctggaagacctggaccacactgtgagcatggagtatggcctaacccgggactcgccaccctagccctggtccctccccctgcagggggacattccacagccagcattgccccctctgcacgctgtccttgctgtgagcaggactgcctaggtttcctgtggattgaaggcttgcttagaggcacaacaagccatccctacctacctccccaggaggcacttgggtgcagggaaaaaaattctccgcaagttttgggggcctagtttctatctgtaaatccaacactcacctgaaagc

SEQ ID NO: 4934 - DNA, 419 bp, Mus musculus
tgaaccccttaatctacaacatcacaagagtagtcatcctttctgctgtctctggagttataagcgaccttctaggattcaacataagactgtggaaaattaagtcctgagctgagatgtgtgcctggactctgctggctggtgtcactgctcccccactgaggacaaagatggcccacagaaaccagtggccccacctgcaggctcacatgcatcagtctctccactcagccccgtctaacgaatggagcttcggcacctcctttccccggggcctgtgttaaaaacctgcactttcatggttctcaagcaacgtgaatagtcagcaaactaaagcctgcctcacaaagactcggactattcctgagtcaggacatttatcctggagcctccagtactgtgctagttatacttactgt

SEQ ID NO: 4935 - DNA, 454 bp, Mus musculus
  misc_feature (203)..(203): n is a, c, g, or t
  misc_feature (283)..(283): n is a, c, g, or t
  misc_feature (296)..(296): n is a, c, g, or t
  misc_feature (299)..(299): n is a, c, g, or t
  misc_feature (310)..(310): n is a, c, g, or t
  misc_feature (312)..(312): n is a, c, g, or t
  misc_feature (322)..(322): n is a, c, g, or t
  misc_feature (329)..(329): n is a, c, g, or t
  misc_feature (334)..(334): n is a, c, g, or t
  misc_feature (348)..(348): n is a, c, g, or t
  misc_feature (352)..(352): n is a, c, g, or t
  misc_feature (368)..(368): n is a, c, g, or t
  misc_feature (378)..(378): n is a, c, g, or t
attttgttcttcctctgttatgacctattccaaagtaggagatgaaccaccaaaggtgttccaggcctcaactcaaacccgaagggctccaggaggagtaaaagaaaccagaaaagcaatgagagattctgacagtggactagaaagaatggctgttggtcatcacatccatgaccgaggtcatgtcattaggaagtcaaagnacaacaagactggagatgaagaagtcaaccaagagttcatcaatatgaatgaaagtgacgctcatgcttttgatgatgantggcaaaatgaanttntgaagtacaantntattggacgntcagganaacantggaatgcgaagtntggntcatgagcatccaggntcacgggaantcaaaaggagagagaaaattcatcgaaattcagccattgagagtggaagaagatcaaacgtttttgtggacaaact

SEQ ID NO: 4936 - DNA, 464 bp, Mus musculus
  misc_feature (264)..(264): n is a, c, g, or t
  misc_feature (329)..(329): n is a, c, g, or t
  misc_feature (339)..(340): n is a, c, g, or t
tcaggtggatgagacgcaacagcagttcatcttccagcagcctgaggcccccatggagggcttccagctataatgtctgcctccggggaggggagggcacgggaagcaccagcagccagcagagagaggagcagccttctggtgggcaggagagcagccaccccaccagcagccccgcacacctgctgccccgagactgtgctctcgacctgttcatccccttccctggagggagcaagcgccctctggacagacagaaccatntgaggctcacattgggttttgagacaagaaggggacgtgtgggtttctcttccttacactatttnggctgcacanntctttaacccaggagcccaggggtagacaaaggaggactgaggtaatcaatttgcacctttaaaatttttttcttttattttctttagtggtgacttccttcccaattatctttcttcatccat

SEQ ID NO: 4937 - DNA, 536 bp, Mus musculus
gagctggaccctggcgatgtgataattgtgcttgatcagaaggatcatagtgtctttcagagacgaggccaggatctgatcatgaaaatgaaaattcagctctctgaagctctttgtggcttcaagaagacaataaaaacgctggatgatcgagtccttgtcatttcatctaagtcaggtgaggtgataaagcatggggacctgaagtgtatccgcaacgaggggatgcccatctacaaagcccccctggagaagggggtgatgatcatacagtttttagtagtcttccctgaaaaacagtggctctctcaggagaagcttcctcagctggaggctctgcttccccctcggcagaaggtgaggatcacagatgacatggatcaggtggagttgaaggagttcaatcccaacgagcagagctggcgccagcacagggaggcctatgaggaagatgacgaagagccccgcgctggcgtgcagtgccagacggcatgatggtgcggtgtggcctggcctggttggactctagtacatga

SEQ ID NO: 4938 - DNA, 479 bp, Mus musculus
  misc_feature (294)..(294): n is a, c, g, or t
  misc_feature (304)..(304): n is a, c, g, or t
  misc_feature (317)..(317): n is a, c, g, or t
  misc_feature (342)..(342): n is a, c, g, or t
  misc_feature (356)..(356): n is a, c, g, or t
  misc_feature (409)..(409): n is a, c, g, or t
  misc_feature (419)..(419): n is a, c, g, or t
ggcccattaactgtttgtctgctcagccttgctggagattctgggtggcagggatgtcctgatgggaccctctggagtccagccatcccaggctgtctgctttccaggggttgtatcttccttcttacctgttcatcaaccagccctctcattgctgctgcaagtctggctctttgcctctgctgtgccaggcctccatggtgtctgcatagagccacgacagaggcattcctcagctgtacctctgactttcttggctcaggttcagtcagttgctcttcctccttggcaaanccatctaggnttccaggtgggtntcatgcataccacatgtgcacaganccagctgcagaggncaccacaagggcaccttaaccagctcctgatctcaagaacactaaaaggctanccgttgtctntctagagtgaatacttcacagatctcatttagggagagcctggtctatggactaagctga

SEQ ID NO: 4939 - DNA, 560 bp, Mus musculus
  misc_feature (210)..(210): n is a, c, g, or t
ccaagtttattgtaatgtcctcatcttccagtgcctcatcaacccagcaggttctgtccctcagcacctcagctcctggctcaggctctactactacctctcctgtcaccaccacggttcccagcgtgcagcccatcgtcaagctggtctccactgctaccactgcacccccaagcacagcccctgctggttctggcagtgttcagaaantacattgtggtctctcttcccccaacaggggaaggcaaaggaggccctccttctcatccttctccagtccccccttcatcttcttcaccatccccacttgggggaagtaccctctgtggggggaagcaggaagctggggacagcccccctccagctccagggactccaaaggctaatggctcgcagcctactggacctggctctccccagcctgctctgtgatgtgtcacatgtgctgacctcctctcttgtgcagattcctacacactcaaacaacctgtgagggaggaaggaggaaaggttttccccagtgactttctttttagatattgtacagtaagttcctcaga

SEQ ID NO: 4940 - DNA, 319 bp, Mus musculus
aaaagaccaagagctggttcctcagatgcagggtccacagtaaaaaagcctcggaaatgtagcctttgtcaccagcctggacacacccgaaccttttgtcctcagaacagatgatagccggggaggtggaagaaattgcctagaccaggaatgaactagctaggaccaggtggctgtgcactgtcctggaaacctagggaggtactgggttttaaagttggccttcttttgttgagtacaaagaccagacatgtctggagagtctggctggctctgctggatgctgcagctctgtctgcagctcacagtgactctggct

SEQ ID NO: 4941 - DNA, 443 bp, Mus musculus
  misc_feature (64)..(64): n is a, c, g, or t
  misc_feature (76)..(76): n is a, c, g, or t
  misc_feature (287)..(287): n is a, c, g, or t
  misc_feature (295)..(295): n is a, c, g, or t
  misc_feature (301)..(301): n is a, c, g, or t
  misc_feature (308)..(308): n is a, c, g, or t
  misc_feature (314)..(314): n is a, c, g, or t
  misc_feature (316)..(318): n is a, c, g, or t
  misc_feature (321)..(322): n is a, c, g, or t
  misc_feature (330)..(330): n is a, c, g, or t
  misc_feature (334)..(334): n is a, c, g, or t
agatgacacctacaggctgtcgcgattacttctcagactgcccgccttgcggctgatgaacgcnaccattactgangagttgttcttcaaaggtctcattggcaacgtacggatcgacagtgttatcccacacattttaaaaatggagcctgcagattacaactctcaaataattggtcacagcctttgagagctgaggtcaccccgctatgaactaagtttactgttccttctcgggacacaagaaaccaaatggagctgattgcttccagggagtctgcgaatangtaactgntaagangtaaccnaaattnannnaanntatttttntttntggattccttaagaagaaattctaagcgaccaggcaggggtcaggaaatatactaccctgtctgtcctctagggatgatttaaaaaggtactgggctgctctttggtga

SEQ ID NO: 4942 - DNA, 327 bp, Mus musculus
gcttccttttgttggccaaggaaagtaaagaaaaaatatgaagacacgggacctaaaaaaactgaattatgcaaactgcaaagcaaggccgctctggaacaagaggcagaggaggagaaggccccagagaagccagaagatgtgcaagaagaaaagaagccaggtgaagctgaggtcgtcaccgtggaaaaggaagtaattggtgaaccggaagagaagagtaaggaagacagagaaactctagaaggtcaagaggaagtgagcaaggctgagtaaatctggatcagaggatgagatgaaggacgctgatgagagcccaggatctgg

SEQ ID NO: 4943 - DNA, 454 bp, Mus musculus
  misc_feature (35)..(35): n is a, c, g, or t
  misc_feature (114)..(114): n is a, c, g, or t
  misc_feature (328)..(328): n is a, c, g, or t
  misc_feature (330)..(332): n is a, c, g, or t
  misc_feature (368)..(368): n is a, c, g, or t
  misc_feature (374)..(376): n is a, c, g, or t
  misc_feature (385)..(385): n is a, c, g, or t
  misc_feature (394)..(394): n is a, c, g, or t
  misc_feature (403)..(403): n is a, c, g, or t
  misc_feature (417)..(417): n is a, c, g, or t
  misc_feature (422)..(422): n is a, c, g, or t
  misc_feature (429)..(429): n is a, c, g, or t
gcaaactgcaaagcaaggccgctctggaacaagangcagaggaggagaaggccccagagaagccagaagatgtgcaagaagaaaagaagccaggtgaagctgaggtcgtcaccntggaaaaggaagtaattggtgaaccggaagagaagagtaaggaagacagagaaactctagaaggtcaagaggaagtgagcaagctgagtaaatctggatcagaggatgagatgaaggacgctgatgagagcccaggatctggagacgccccactgaagtcattgcggaagaggagggtacggaaggattgaagcgtcaagggtcgcaaatcccngnnngagagagagagagatcgggcatctagagtcagggtntccagnnngacagtganctgcgcatntgcacaaantctttctaagtatntagcnatgttantctttcagacacttctttctatctt

SEQ ID NO: 4944 - DNA, 341 bp, Mus musculus
  misc_feature (57)..(57): n is a, c, g, or t
  misc_feature (81)..(81): n is a, c, g, or t
  misc_feature (262)..(262): n is a, c, g, or t
tgacaaccagggtgcaggagagcaaggtagaccagtgagacagaatatgtaatcggnggttacagaccacgattccgaagnaggggccctcctcgccaaagacagcctagagaggatggcaatgaagaggacaaagaaaatcaaggagatgagacccaaggtcagcagccacctcaacgtcggtatcgccgaaaacttcaattaccgacgcagacgcccagagaaccctaaaccacaaagatggcaaagagacaaaagcagnccgatccaccagctgagaattcgtccgctcccgaggctgagcagggcggggctgagtaaatgccggcttaccatctcta

SEQ ID NO: 4945 - DNA, 207 bp, Mus musculus
aaggacatgtagcaagccccagcattctgcaaggaccttactagtccattcagcaccttcaacaacaccaaagcattgtgcaagccctgtgctaaatagagcctctctcagggaaagattccactctgattggtgttcacctccgaactgtgatgagatccatgaccgggtaaaagatgtcttgaaatcacatcaagctcatgcaag

SEQ ID NO: 4946 - DNA, 365 bp, Mus musculus
  misc_feature (101)..(101): n is a, c, g, or t
caacttccaatctgtgacaaggctatcttgccacatgtgctcctgtcaccatcgacaaactgaagaataggttctttctagaatattcttccaattttatncccttttaattttccacctgcttggctggttatcttatttggataatatttaattagtattagcttcctgttctcaggaatgagcaaaaagatgttctctgcagaaacaaattttaataatttaaacctgttctaatattatctactttttgctcttagaagaggctattgtatttcttgggtcctaaaaactggctttctttgtaaagctcacatatgcactcactccttctttagaagaccagctgagttacctgaatgact

SEQ ID NO: 4947 - DNA, 532 bp, Mus musculus
  misc_feature (313)..(313): n is a, c, g, or t
  misc_feature (320)..(320): n is a, c, g, or t
  misc_feature (326)..(326): n is a, c, g, or t
  misc_feature (336)..(336): n is a, c, g, or t
  misc_feature (343)..(343): n is a, c, g, or t
  misc_feature (348)..(348): n is a, c, g, or t
  misc_feature (359)..(359): n is a, c, g, or t
  misc_feature (443)..(443): n is a, c, g, or t
  misc_feature (445)..(445): n is a, c, g, or t
  misc_feature (458)..(458): n is a, c, g, or t
  misc_feature (460)..(460): n is a, c, g, or t
  misc_feature (471)..(471): n is a, c, g, or t
  misc_feature (505)..(505): n is a, c, g, or t
gagagctgcatgaggtacctgcacaggatatatgtgcctctcatgctggttaatgcagctgacgaccccttggtgcacgaaagccttctaaccattccaaagtctctctcagagaaacgggagaatgtcatgttcgtgctgcctctgcatgggggccacctgggcttcttcgagggctccgtgctgttccccgagccgctgacatggatggataagctggtagtggagtatgccaatgccatttgccaatgggaaaggaataagtcccagtgctcagacacggagcagatggaggccgagttggaatgaggtntctgganctcggncgtgctccangcggccntcctntggaacccacntccctttgacggctgtttcaggtctcccagtgacctggatctgacctcataccatcagtggggggttacccatcatgcaacctntntcaagtaggcggntntccctgggagntccaggctatttttgtgcttagttacgggttttntccattgcatcgttagccatggtgaca

SEQ ID NO: 4948 - DNA, 441 bp, Mus musculus
ggctgtcactgggaagtgccatccagtcaccatcacccagcacaatggaagggtgacaggtttcactgtgagcttgccaaggacacctctaaactcccccatgtcagcagatgaagttaccactttatttcgccaccctgcaggtaactgaaactcaattaccgctgctcctcacgcggttccagccccctgagtttagacagctccgaagcctctcagaactcccgtctgctctctttgctctaccccaggggtgagcccactggagcctgcgaccagccctgcttgccaccgctcacttatctgagcctttcagctctccctggaagaccttcggggaggggctcctgagcccccatgctgaggcctctaatgaggagctggcctgaagcctccctgcacctcggggttcatttgaatacagcctctgttgaagatgca

SEQ ID NO: 4949 - DNA, 470 bp, Mus musculus
  misc_feature (239)..(239): n is a, c, g, or t
  misc_feature (266)..(266): n is a, c, g, or t
  misc_feature (273)..(273): n is a, c, g, or t
  misc_feature (298)..(298): n is a, c, g, or t
  misc_feature (306)..(306): n is a, c, g, or t
  misc_feature (345)..(345): n is a, c, g, or t
  misc_feature (353)..(353): n is a, c, g, or t
  misc_feature (400)..(400): n is a, c, g, or t
  misc_feature (404)..(404): n is a, c, g, or t
  misc_feature (420)..(420): n is a, c, g, or t
aacagtgtgctaggagagcctcagtgtgaagtcctgaggagcagcgggggctgtgggagtcagtgtcagccctcactcagacaggccaagcctgggctcgaagacaacattgtccagggaagcctttagtttgctatagcacccagaggttggcgaggaataagggttagggtcctcaaatacacccatggcttttggagtctatgaccaaggccaggctgagacctgaaatgtaaaanccatagaattaaacagaacagactganaaacgantcttaagttccactttctggatttntctggaantcttttgaatttgtctgtagaagttgctgttcctagcantccttttntctttaggtagaacagatacttgaccataatgccagaatgtactttntctnccttggtttttctatnccttgtttttcagtttcagggccaaacaattgggccctgtggtgtaaaat

SEQ ID NO: 4950 - DNA, 247 bp, Mus musculus
agtgctgtttagtgaggaaccctaaagagaggatatctatccctgagcttctcacacatccgtatgttcaaattcagccccatccaggcagccaaatggctaggggagccactgatgaaatgaaatatgtgttgggtcaacttgttggtctgaattctcctaactccatcttgaaaactgcaaaaactttgtatgaacgttataattgtggtgaaggtcaagattcttcgtcatccaagacttttga

SEQ ID NO: 4951 - DNA, 388 bp, Mus musculus
  misc_feature (249)..(249): n is a, c, g, or t
  misc_feature (252)..(252): n is a, c, g, or t
  misc_feature (254)..(254): n is a, c, g, or t
  misc_feature (257)..(258): n is a, c, g, or t
  misc_feature (272)..(272): n is a, c, g, or t
  misc_feature (334)..(334): n is a, c, g, or t
  misc_feature (336)..(336): n is a, c, g, or t
aaccagcgtgttgatgacgcactcacatcaaaactgcccatgttttacttggtcaacagacctcatattagcttagtgcccaccgcatatcctctgcagataaacttggaccataaatcactcagtttgaattgggcacaaggggacaattctttggagattgtggatggcctaaatgggaagattactgaaagttctccatttaaaagtggtttatcaatggcaagtcggctttgtaaggctgcaatnttnantcnnatttaatctgcttnccaaggaagctaaaacagatgatttacttgaagctcggacataccacgcggctaagtgtatntntggaccctatcaagaagcaaaggcgttactgaaggcctacttgcagcagcat

SEQ ID NO: 4952 - DNA, 262 bp, Mus musculus
  misc_feature (149)..(149): n is a, c, g, or t
  misc_feature (216)..(216): n is a, c, g, or t
gatgagcagagctatgactcctatgacaacagctacagcaccccagcacaaagtgcagctgattactacgattatgggcatggactcagcgaggacgcttatgactcctatgggcaagaggaatggactaactcaagacataaggctcnttcggcgaggacggcgaagggcgtctacagagaccagccatatggcagatactgattgtactgtctngatgttgtgaaatagccaatctccaccgtcctgtatactgttcaaa

SEQ ID NO: 4953 - DNA, 428 bp, Mus musculus
  misc_feature (43)..(43): n is a, c, g, or t
  misc_feature (49)..(49): n is a, c, g, or t
  misc_feature (54)..(54): n is a, c, g, or t
  misc_feature (57)..(57): n is a, c, g, or t
  misc_feature (385)..(385): n is a, c, g, or t
  misc_feature (389)..(389): n is a, c, g, or t
  misc_feature (393)..(393): n is a, c, g, or t
acccttgcaggagccttaaggcttgggcccctgcccagcctgntctttncctgntgngccctgcctgccaggtcaagcccagtcccaggagaccccaggccttggctcctaggctgttccatgaacctccctgacctgcctggtgattgcccagctgaaacctcagccaagccccagctccaattaccttgtgctggtagctgcttgtgtctgcagtctgagtaggccttgttgcggttcctccatctgcctggtctattggtgttctgagaccaattccactgatgttctgacagatcctccaccctgtgcccctgccagcccccacaagtttatttttgcacaaaagccatgacccatactcatttggctggcatagggtgtntagntagnccctggggactagggagaccctggagatctcaaga

SEQ ID NO: 4954 - DNA, 361 bp, Mus musculus
  misc_feature (41)..(41): n is a, c, g, or t
  misc_feature (101)..(101): n is a, c, g, or t
  misc_feature (137)..(137): n is a, c, g, or t
  misc_feature (326)..(326): n is a, c, g, or t
  misc_feature (336)..(336): n is a, c, g, or t
aagtcctggcatttgatctgaccgttccaaccaccaaccanttcctccttcagtacctaaggcgtcaaggagtgtgcatcaggactgagaatttggccaantatgttgcagaactgagccttctggaagctgacccnttcttgaagtatcttccttccttggttgctgcagcagcttactgcctggcaaactatattgtgaacagacacttctggccagaaacacttgctgcatttacgggctattcattaaatgagattgtgccttgcctgagtgagctgcataaagcatgcctcagtatcccccatcgaccgcagcaagcaatnagggagaagnacaaggcttcgaagtacctgcacgt

SEQ ID NO: 4955 - DNA, 422 bp, Mus musculus
  misc_feature (394)..(394): n is a, c, g, or t
ttctttccacgttagtgcgcgaagagagctcgtcctcagatgaggatgatcggggggagatggcagattttggtgctatgggctgtgtagatattatgcctttagatgttgctttagaaaacctaaatttaaaagagagtaataaaggaaatgagcctccaccacctcctctttgatgacctccccactcgaagacaatgtcctctgtgctgtatttgccaatgaaagtggacaacagctatcctgggtttgtgtggtgattgtaatttcaggtctgtcactcttgttacattgtgtacattcaaaaggaagagagaaatatatatgataatcatttccacttaactaatttttacttctagcaggtaaatgtaggtagcagtgcagggtgatntctgcttcctgtaccttgacatgcaaaa

SEQ ID NO: 4956 - DNA, 522 bp, Mus musculus
gaaagttcgtgatccccgggccaattttgaccagtctcttcgtgtactgagacatgccaaggaggtccagcctgatgttgtttccaaaacatcgataatgctgggccttggtgagacagacgagcaagtctatgccacactgaaagctctccgtgcggccgacgtggactgtttaactctagggcagtacatgcagccaacgaagcgccaccttaaggttgaagaatatgttactcctgagaagttcaaatactgggaaaaagtagggaatgaacttggatttctctatacggcaagtggtcctttggtgcgatcttcatataaagcaggtgaatttttcctgaaaaatctagtggctagaagaaaaacaaaagcttctaaagtgtagccaagcccttcaagatcacaggagtgttgcgattttgcttccagttggtgtgaggatggtgtcaccctgtcaggattcctgtgagtgcaaggcagcaccgttctgaagggtctgatggctgatcgaagcggaat

SEQ ID NO: 4957 - DNA, 431 bp, Mus musculus
  misc_feature (65)..(65): n is a, c, g, or t
  misc_feature (72)..(72): n is a, c, g, or t
  misc_feature (84)..(84): n is a, c, g, or t
  misc_feature (96)..(96): n is a, c, g, or t
ttaccagacttggtggttctccgttcttcctgacttcagcctgactctccatgaagggcttcccntccgttntgagctacaccnggatcatcacanaacccaggtggatcccactgctcatttgacctttaaccttcacttatccaagaaagaaagagaagccagagacagcctcactctgcctttccagttcagctctgaaaaacagaaagctctgctgcatccggtacccagccggaccactggccacatcttttatgagccagatgcttttgatgatgtggacccagaagacccagatgatgacctagatatttgacagacaaatggcagaggaaggctgtgggctcagaaccaccctgctgttggcagactctaccttgtcccttgtcctttgttactttgtctgcagaagctgtgtcgtgagccaa

SEQ ID NO: 4958 - DNA, 522 bp, Mus musculus
ttggatgcagcctcagccgtacattctgcagcatcctggtgccgtgttaactccctcaatggaacataccatgtcactacaacctgcttccatgatcagccctctggctcagcagatgagtcatctgtcactgggcagcaccggaacatacatgcctgcaacatcagccatgcaaggagcctacttgccacagtatacacacatgcagaccgcggcggtgcccgttgaggaagcaagtggccagcagcaggtggctgtggagacgtctaatgaccattctccatatacctttccacccaataagtaactgtgagatgtaccgaagggagttcttacctgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcattctagtagctgttcccct

SEQ ID NO: 4959 - DNA, 483 bp, Mus musculus
  misc_feature (437)..(437): n is a, c, g, or t
  misc_feature (445)..(445): n is a, c, g, or t
  misc_feature (454)..(454): n is a, c, g, or t
acaagattctttccggttctcagatgactgaacagaataggaaactggagttgtcagtattgccaagtagacctctccttacgcaagccaaggtgtctgtaggctgctgcttgtcagatctaaggagggagagagactttatgtaaaggttgtcaaacgcctaatctgagacaaacaggctgttttgtaagcatctggactgtcacatttttgtgcattgtgactgcagatacttcatgtgtatattatagcttagactcttggacctctgttctgttttcttacctgcaggtcacaagtgtaatactattctacttcttcgtacattttgtagtaatatgtttaatataatcaaatattggcagccagatatgtgagcagttctgaacgaattcatatccttttaccacttgaatatattgcagtgtgtggtgggntcctaaantcattcgtntcctttctgtacagcatgttccattccat

SEQ ID NO: 4960 - DNA, 551 bp, Mus musculus
  misc_feature (329)..(329): n is a, c, g, or t
  misc_feature (342)..(342): n is a, c, g, or t
  misc_feature (362)..(362): n is a, c, g, or t
  misc_feature (388)..(388): n is a, c, g, or t
  misc_feature (406)..(406): n is a, c, g, or t
gctgggagcctgtacatgacggaaagtgcttcaccgtggccaggcaacagttctcctcagccgcctccttcacccccacctcagcagcctaaggacccctcgtactcctacaacccatcgggtcaaggcctgagccggcacagctttccctgcagcgtccatcagtatgaatctccgggagcagtgaacaatgacaactcagaccttttggattctcaagtccagtatagtgctgagcctcagttatatggtaatgccagcagcgagcatcccagcaaccaagttccgagtaataatctcccagaagagtgtttctcttcagatgaggncactcctccaagntattaaaaagatcatacatntgctggagaaggtgcagtttcttgancaagaagtagaagagttngtaggaaaaaagacagacaaagcgtattggcttctggaagaaatgctgacaaaggaacttttagaactggattctgttgaaactgggggccaggactctgtccgtcaggccaggaaagaagctgtttgtaagatccaggccatac

SEQ ID NO: 4961 - DNA, 406 bp, Mus musculus
  misc_feature (94)..(94): n is a, c, g, or t
  misc_feature (102)..(102): n is a, c, g, or t
  misc_feature (340)..(340): n is a, c, g, or t
  misc_feature (357)..(357): n is a, c, g, or t
  misc_feature (381)..(381): n is a, c, g, or t
gaactttgatttcctcagagaagccatggccaggagctaggtgggcaactgtatagtagagtaagtgatgatattgaccggtaggttgaacttnttccaaanagcgtcaaatatgagcacgattagatcttcagtcttggttatcaggataccgctgaggggcttgctggatcccaagtgcaaagtaattgcacatcgagtattttaaccaaagctgccagcgtattctatcttgtggactgcattttgatcttgtatttttctccttcaaagacctctgaaaggtagatcagttaaaaacaaaaatagtgttcatacacataggctactgaccagtgtnttcggtgtaagacgttnagagtgtattctgacaaagtaagnataacttcaaggcaggcactatggt

SEQ ID NO: 4962 - DNA, 468 bp, Mus musculus
acatctctacggaaatgtgccgggagaaagaggagctggtgttcctggtgcttggccagcagcctgtaatttctgaggcggacaggactcgtgttccccacttgccccaggccttccctgagcagcaggccttcctgacccagcctcaaaccagcacagtgcctcctacctcacctggcctcccttcttcacctgcacaagtcacctctgtccccttagcccaggatcaggaaactcagcagtccgttgactcagaggacagcttcgtcccaggccggagggcctcgctgtctgacctgacccacctggaggacattgaaggcctgaccgtacggcagctgaaggagatcctggctcgtaactttgtcaactataagggctgctgcgagaagtgggagctgatggagagggtgactcggctgtacaaggatcagaaaggactccagcacctggtgtctggtaatgaag

SEQ ID NO: 4963 - DNA, 248 bp, Mus musculus
agtatggatcgctgggactctacgtggctgaacaatttggagatgaaaacgttaacacatacttcatgttgtcaagctggtgggcaaagaccctgttcatcatcattggcctcttgaccggctgctatttttgttgctgcctttgctgctgctgcaactgttgttgtggacattgtcggcccaaatcatcgacaccagaagaggagttctatgtgtcaccagaggaccttgaggagcagatcagaact

SEQ ID NO: 4964 - DNA, 544 bp, Mus musculus
  misc_feature (40)..(40): n is a, c, g, or t
  misc_feature (425)..(425): n is a, c, g, or t
  misc_feature (428)..(428): n is a, c, g, or t
  misc_feature (454)..(454): n is a, c, g, or t
  misc_feature (482)..(482): n is a, c, g, or t
  misc_feature (502)..(502): n is a, c, g, or t
atattggtgcacacactctggcaagatatcatagagaaangaattgaacgacagcgtagcattgagctcgtcagatcgaatgcatgctctcagcctcaagcttgtcctcctcggcaaaatctatgctgggacgcctcggtttttccctctggattttatcgtgcagttcttggagcagcaagtttgtaccttaaactgggatgtggggtttgtgatacagaccatgaatgaaatcggcgtgcctttacctaggctgctagaagtttatgatcagctcttcaaatcacgggatccattctggaacagagtgaaaagcccactgcaccttctggattgtatccatgtactgttgacaagatatgttgagaatcctagcctagttttaaattgtgagaggagaaggtttacaaatctctgcctggatnccntctgtggatatctggtggaacttcantcaatgagttcttcagtagcagtacaanccatcactgggaattttaantcgctccaagcaaagctggaacggctccattgattactgtag

SEQ ID NO: 4965 - DNA, 488 bp, Mus musculus
  misc_feature (258)..(258): n is a, c, g, or t
  misc_feature (306)..(306): n is a, c, g, or t
  misc_feature (416)..(416): n is a, c, g, or t
gggccgataagtccagcagtttcttatacctacaagtaaagggagaagtggaagccaaggttgaagaattaaagtttgatcgactctcagtgtttcggccaggagtcctactgtgtgacaggcaagagtctcgtccaggcgaatggctggctaggaaattcttcggctctctgccagactcttgggccagtgggtacgctgtgcctgtggtgacggtggttagagcgatgctgaacaagcctggtgagtcccagcagncggacaaatggaacttctggaaaataaggccatcctccacctgggganaagacagggatgtgcccaaactgtgaccatgctggaggacattcgtgaaaacctcagtgcctgtcaccaaatcagtcatttgggggctctataaaaagtctctttgtggncctttgtggtgtgcttctccttagccaagcggctccatcagaaaatggcactactccacgtcagttgttgag

SEQ ID NO: 4966 - DNA, 503 bp, Mus musculus
  misc_feature (394)..(394): n is a, c, g, or t
  misc_feature (396)..(396): n is a, c, g, or t
  misc_feature (400)..(400): n is a, c, g, or t
  misc_feature (445)..(445): n is a, c, g, or t
  misc_feature (459)..(459): n is a, c, g, or t
  misc_feature (461)..(461): n is a, c, g, or t
  misc_feature (469)..(469): n is a, c, g, or t
  misc_feature (471)..(471): n is a, c, g, or t
ggaggactcgaagacactgcgtgccctgagggagatggttaacaacttgtctggggcatctggggaagaggatggcaaagtaggccctaacctacctgacagcgctcaacccctgcagctgctgagagagatgaaccaggcgctgcaggccctgcaggaggagaaccggctgctgcaggaggagaacagggctctgcacatcttgcgagaggagcaccgcgtcttccaggaggagaacaaggccctgtgggagaacaataagttgaagctgcagcagcggctggtcatcgacacggtgactgaggtcacagcccggatggagatgcttatcgaagagctgtatgccttcatgccagccaagaacaacaaagatcccaaaaagcccagcagggtntngagnccttggcagcagacatagacaccaagaccagaccagagagaaccntcaaccttcctttntnttccttantntgcccagaagcacgtgcccgtgggacaacgga

SEQ ID NO: 4967 - DNA, 285 bp, Mus musculus
  misc_feature (191)..(191): n is a, c, g, or t
ggaggacctgtatctgcatgtgaacagtgaccatccagggagcacatttctcaaaaagacttccaaaaagttggcggcccttatgcagaacaagctgacgtccccgctgcaggagaattccaccctgagtgaagaggaggaaaaaaagtgaagagcgagcaagaaaaagcagaggagagacgccggcgccnacgtttactccgacttatggtctgaggcgtacccctctgctcccctggatcttttcatattcagtccacctctctcttcttttgggacagcaac

SEQ ID NO: 4968 - DNA, 253 bp, Mus musculus
  misc_feature (57)..(57): n is a, c, g, or t
gaaagagcctgttgccacagcaccggagcaggaaaacttcgtcaagcattaaccaantgtgatgacatcttaatcaagcagaaccagaccctggctgagctgcagaataacatggtgctagtgaaactggaccttcagaaaaaggcagcctgcattgctgagcagtatcacactgtgctaaagctccaaggccaagcctctgccaaaaagcggctgggagcaaaccaggaaaaccagcaaccaaatcatcaac

SEQ ID NO: 4969 - DNA, 525 bp, Mus musculus
  misc_feature (408)..(408): n is a, c, g, or t
  misc_feature (440)..(440): n is a, c, g, or t
  misc_feature (442)..(442): n is a, c, g, or t
  misc_feature (452)..(452): n is a, c, g, or t
gaaaacagcatgactgctccttcacctactggcactatgaagacaggtccactgactggaaaccctcagggcagaaacagtcctgctctggctgttatggcagcatctgtgaccaacatacagtttcctgatgtttccttgcagcatgtgaatcccatagaaagctcaggaattgcactgagtgaaagcatccctcagattccctcacaacctaccatttcaccaccacctaagcctacaatgaccagagtggtttcttcgacacatctggtaaaccatccatctagaccttcaggaaatacagcaacgaacatacccaatcctatactaggagtctagaagacagtctcagctgataagaagaaagaaacaagaaacccaacagaagggaagaaccagatagatgantcccgcttagacaccactcagacagcagcttntntgttggcctntcaggaaacacctgggaacagataagcccggtatccctgtttttcctagagatcctattccttttattgagag

SEQ ID NO: 4970 - DNA, 456 bp, Mus musculus
  misc_feature (97)..(97): n is a, c, g, or t
  misc_feature (118)..(118): n is a, c, g, or t
  misc_feature (332)..(332): n is a, c, g, or t
  misc_feature (335)..(335): n is a, c, g, or t
  misc_feature (354)..(354): n is a, c, g, or t
  misc_feature (372)..(372): n is a, c, g, or t
  misc_feature (399)..(399): n is a, c, g, or t
  misc_feature (402)..(402): n is a, c, g, or t
  misc_feature (427)..(427): n is a, c, g, or t
ccatctcaattaactctggatcctaaaacagctcatcccaatctggtgttatccaaaagccagaccagtgtgtgtcactgtgatgttaagcaggtantgcctgatgatccagagcggnttgattcaagtgtggctgtactgggctcaaaaggcttcacctctggaaaatggtactgggaaatagaagtaggaaagaagacaaaatggacaattggagtcgtcagagagtccatcattcggaaggggagctgccctctgactccagagcaaggattctggcttctaagactaagaaaccaaacagatctaaaggccctggatttgccctcccntantctgactctaggcgacctnagaagagtgggcgtgtanctggattatgagggcgggcaagtatcnttntacaacgctacaaccatgacccatntttacacctttagcagtgttttccaggag

SEQ ID NO: 4971 - DNA, 531 bp, Mus musculus
  misc_feature (273)..(273): n is a, c, g, or t
  misc_feature (287)..(288): n is a, c, g, or t
  misc_feature (294)..(294): n is a, c, g, or t
  misc_feature (305)..(305): n is a, c, g, or t
  misc_feature (318)..(318): n is a, c, g, or t
  misc_feature (327)..(327): n is a, c, g, or t
  misc_feature (338)..(338): n is a, c, g, or t
  misc_feature (362)..(362): n is a, c, g, or t
  misc_feature (381)..(381): n is a, c, g, or t
  misc_feature (413)..(413): n is a, c, g, or t
  misc_feature (419)..(419): n is a, c, g, or t
aaaatttccacatgcttgttaagaaaactctggtccgctgttccattcattatatcaggactcagacaaatgtggtggttccttggttaaaggctttcaatgattagacactcctaattatcagccacaaagaaattgataagcgtatttgtacagtgaattcagaactgtgaatcatattgaaaattcctaaaattataaatgctaaacttttaagaggctcatttctttggttaaatgaatacacttgaattggttgaattaaaattgatnattctcactttagnnataatnatatataattntactatagaaatnttatatatnatatatatatntgaccttaactcaagttgatgatnatagctatttatactgttnatatacataatgatctgtgctgaacaataatntcattntgattattggttattaacatttgtaactgtaactgtattttcattctgttactataaaataataagtataatatagaagaatattctcaccatggcctgtatgttgttatta

SEQ ID NO: 4972 - DNA, 174 bp, Mus musculus
tggtaagtggtggtttggactcaaaagaagattggaggagatgatgattatccttcaaagtggccaaaaccttgaacctgaagagcgaagaacttcaagcctttcctgcttggcatccagttaaatcctagtacactgccaggttcctcgaaaccccttgagtttgtattgact

SEQ ID NO: 4973 - DNA, 445 bp, Mus musculus
  misc_feature (354)..(354): n is a, c, g, or t
  misc_feature (399)..(399): n is a, c, g, or t
aatcactgtggagtctttgagtacagttgcaaagcaagggagacactatctgtgttgtaatcggtcactgagaagcacagatgccgcagggaagaagtttaaaagaaaaatcctaggaggggacacatgataatgaaggggtcagctgaggatctaaaaccataacggaaaggcagtaatagacagctacagaaaggcacactgtcttaatcaccagtcagtcagagtgataggaaaatgtccaaagcacaagagtgaaatatttctctattcagaaatgttatcctaaggattggtaattatagtcagttcataatcttttagagcattttcttacattagcttaacaagatntccatttcaggaatgtgtatggagagatgggatggcttagtaatncctgctgttccagaggaccctggttcaattactaggacccacttgg

SEQ ID NO: 4974 - DNA, 529 bp, Mus musculus
  misc_feature (28)..(28): n is a, c, g, or t
  misc_feature (493)..(493): n is a, c, g, or t
aacggtgaatgagctgcagaacttgacngcagctgaggtggtagtgccaagagaccagaccccggatgagaacgaccaagtcattgttaagatcatcggacatttctatgccagccagatggctcagcggaagatccgagacatcctggctcaagttaagcaacagcaccagaagggacagagcaacctggcccaggctcggaggaagtgaccccgccccctcctgtcccattggctccaagatcagcaggaggaacacagaactggaggggcgggtggagggccggtgtgctcttcccagcaggcctgagaatgagtgggaatcagggcatttgggcctggctggagatcaggtttgcacactgtcttgagaacaatgttccagtgaggaatcctgatctctcgcccccaattgagccagctggccacagcccaccccttggaatatcaccattgcaatcatagcttgggttgcttttaaacgtggattgtncttgaagttctccagcctccatggaaggatgggtca

SEQ ID NO: 4975 - DNA, 311 bp, Mus musculus
tcccagaaaccattgacgagatgcaaaaagtcaaaaaactaaaacaaaggcaatccctaagcaagaaagggtccccgaaggagtctaaaggaaatgtatcccgaacctcccgaacctccgaacctaaaggcttttaacacctggtccagaagctgattgaactgaatggaaaacctgcatgttgtcagaaacactgtcagtgaccgacaacagtgctttctgttgtgttggcattgtgtctaacaagcatctgtcctggagagtcaccttcctctagggccgccaaggcgaactacacacagcttgcacat

SEQ ID NO: 4976 - DNA, 425 bp, Mus musculus
  misc_feature (364)..(364): n is a, c, g, or t
  misc_feature (366)..(366): n is a, c, g, or t
gagatgtatctgaactgccgatccttggtgaaatatctttcaacaaatctctctatgaggggctgaatgcagagaaccacaggacgaagatcactgtcatcttcctgaaagaggaggagacacgctctttgcctctcatcattggcagcagcatcggaggcctcctggtcttggttgtgattatagccattttgttcaagtgtggctttttcaaaagaaaatatcaacaactgaacttggagagcacaaggagggcccagctgaaggctgacagtctgctccaagattagccccctgcttcctcaccggaaggagggagtttgagccagtcggaagccgggatgccccctatcggggccccttnantctccttaggacgatcaagcaacatcaaagaactgtagagtgttgttcatagccacaca

SEQ ID NO: 4977 - DNA, 420 bp, Mus musculus
cttcatatttttcctgtgtctaaaaaactccaaatacatacatacaaacaactgtcatttgaataatgttttgcttctcatcaaagcattagctttgggttataatgctgaatattgttgtaaattattttcaacctaaacataatgcgttcagaactattaattgatctaaatattaaaacttgagaccctcacgtttatgtggctaaagctaagtctattttgagaaatagctgtttttgcatatggtcagaggattaagaactgcatgtttgagaggttttaccacattgtagaaagtataatctgtaatggttatttgctgttacgtaagaaacactacatagataaagaaaattttttgtaaatgacaaatttttacacttgggttttttaatgctgcactacaaaagtcaattg

SEQ ID NO: 4978 - DNA, 420 bp, Mus musculus
  misc_feature (106)..(106): n is a, c, g, or t
  misc_feature (110)..(111): n is a, c, g, or t
  misc_feature (113)..(113): n is a, c, g, or t
  misc_feature (271)..(271): n is a, c, g, or t
  misc_feature (356)..(356): n is a, c, g, or t
  misc_feature (358)..(358): n is a, c, g, or t
  misc_feature (365)..(365): n is a, c, g, or t
  misc_feature (377)..(377): n is a, c, g, or t
cagggacttggcactgaggcgtctctcctgatcatgtcctacggtgtgacgaagttaggtctgaccaagtttgaggccaaaatcgggcaagaaaatgaacctagcnatcnncnggatgttccagaaacttcactttaagcaggtggctatgagcaacgtcttccaggaggtgacactcaggctggcagtgagcgagccagagcggaagtggattctagagcagacgagccacatggaagagagaccctacaggaccaggaaggccgagccntgtgacagccaccctgagcgagcagaagagttggaactgcccactcccaaggccagacggctgcatgggagacacaagtgcagtntnttcagtntgcgccaggctntcctgagccagccatggcctcccctggttagcagtggtcaaga

SEQ ID NO: 4979 - DNA, 356 bp, Mus musculus
agaagcgttctgtgtacgaccgggcaggctgtgacagatggagagcaggtggcggtgccaatgtcccccatagcagtcccttcggtgctggctatcccttccgaaatcctgaggatattttccgcgagttctttgggggactggaccctttttcctttgaattctgggacactccgttcagcggccgaggccggccccatggtttacacagagtcttcccttcgggctttggtgagttcccagccttcatggaagccttgtcatctttcaatactctgggccatggtgggggcagccgctccaccttttcatctgcttcgtttggtggctctggcagctcagggttcaagtcagtg

SEQ ID NO: 4980 - DNA, 165 bp, Mus musculus
  misc_feature (45)..(45): n is a, c, g, or t
ccccaaactcacaaggagctcgggaaggagggggagaggggtttntaagagaaccttaggataactaggtggttcttgatgctcacccaaagcccccaatgctgctaggaggagggcacccccaaagggtgctccccacaggccatctgcttttgccgctaacac

SEQ ID NO: 4981 - DNA, 506 bp, Mus musculus
  misc_feature (108)..(108): n is a, c, g, or t
  misc_feature (355)..(355): n is a, c, g, or t
agaggagcctcagcagccatatttttcttccgatgcatctttccctctcctgtcctcatttgtcccgttccctccgacggcctttcctctgtctctcgccccctctcntgtgcctgtagaccttgctctttgctctctctttgggaggcagaactttgagggaggggagtaggctcaaggtaaccgatgaagtcaggttccctccagtggttccctcctgcccttctcttgtgatttataaatgaattttaatttttatagtgaatctcaagggatcgtcccacctttgatcacaggaagggatcctagcccccaaactcacaaggagctcgggaaggagggggagaggggtttntaagagaaccttaggataactaggtggttcttgatgctcacccaaagcccccaatgctgctaggaggagggcacccccaaagggtgctccccacaggccatctgcttttgccgctaacaccccttcagtccagcgagtatctgccctgcgt

SEQ ID NO: 4982 - DNA, 508 bp, Mus musculus
  misc_feature (44)..(45): n is a, c, g, or t
  misc_feature (64)..(64): n is a, c, g, or t
  misc_feature (159)..(160): n is a, c, g, or t
  misc_feature (418)..(418): n is a, c, g, or t
  misc_feature (471)..(471): n is a, c, g, or t
  misc_feature (481)..(481): n is a, c, g, or t
aggagtcctcgcaactgaagttggtggggaagtcagtacttttnnatttaaattatttaaaaangtcattcattcatggaaaacagttacatttcaaacattatttctaataatatttctgtggtttttaactttttaatgaatgtcatataggacaanntggtaatttgtatataagatcttggtaagagatttgcttaatgtaaatataagccacagttagaatagactcatcagtatatttttgataatttttcatgtatggtaaaagttaaagttaacagatattctgatataaatctcaagagttttgagagtcattgcaggaaaatgggaagtttttaaactttcttaaaagactttgttaaaattttagggcacatttttccagacatcagtgtttgatctaattttgcantctttgataataatgctttagagaatacatgtaatcaagtgcataggcctctntcagcgaggnccatctgtgttacagcctcctgacttg

SEQ ID NO: 4983 - DNA, 438 bp, Mus musculus
aatattgccagcagctagcagcgtggggaggagacagtactcgaagctgattggcacccagctagtttcagggctgttctcatgtaaaggccgacgtgagaatatcagcctgacaacggagggactgcgtcagctaccttataatgtgcagtcttgagtttgctatctttggcctattaagatactttatgaactttacagttaaaagattaaaaatcatttcttaagtccttattgatatctgaagatcatattttgttagaccttggtgaggaactaaagaagtcaatgctgttcagatgaagtctctaggtaccaaaccaacatgttctcttttatcaatgctcgggtgtttagtctcttctcacagggatgtgctttatgtaaacatgctaatgtgaaatcagttcatgtacttttggagaccgtgggcttgct

SEQ ID NO: 4984 - DNA, 528 bp, Mus musculus
  misc_feature (306)..(307): n is a, c, g, or t
  misc_feature (351)..(351): n is a, c, g, or t
  misc_feature (390)..(390): n is a, c, g, or t
  misc_feature (402)..(402): n is a, c, g, or t
  misc_feature (412)..(412): n is a, c, g, or t
  misc_feature (415)..(415): n is a, c, g, or t
  misc_feature (420)..(420): n is a, c, g, or t
  misc_feature (436)..(436): n is a, c, g, or t
tgagatgcgagttcgctgtgcgcccggacggcgcggacgcggtgcccgccgccccgcggggcctgaggcaggcggatccacagcgctttcttctgcctcccgccttggggctgctggtggccgccggtttggctggcgccgcactcttggtcatccacgttcgccgccgaggtcctggccaggataccgggactcgcctgctttctgggacccgggagccttcggtccacacgctcccggatgcactcaacaacctgaggttacaagacggtgctggggatggccccagttcgtcggctgactggnntcatcctgaagatggagactctagatccatttatgtcataccanccccttccatttatgcacgagaggcctgatcctgccccnttctctatcttntcccttctcnatncatcncctggagatggagccntgaatgattttatttactttgtggtgtccaatctctacctccccctaccgactggagactctttgaaagggctttattgtacatattgctta

SEQ ID NO: 4985 - DNA, 212 bp, Mus musculus
aaaatcactcacagaatcgcttcagatgaactattccagcagaggagctcctttactgaagggcactgaccaagtggaaatatgctggacacatagtgatatatctcaactaggagaggctaactttagtgaggtagttgggacgatcatagatggactggcccaagttcaaggctggatcatgacaagaactgttgtggaccaaccctcaa

SEQ ID NO: 4986 - DNA, 290 bp, Mus musculus
  misc_feature (101)..(101): n is a, c, g, or t
  misc_feature (191)..(191): n is a, c, g, or t
  misc_feature (200)..(200): n is a, c, g, or t
ttcctggtaattgccgatgctgttcccagcgcgttgaactctatcgtatgaggcagcactacaaaacttgcgaaaagtaccaggatgaatttggagtttcnacatctgtttcaagcttccaacagtctccaaactccgtgggcaacagtaacaacgaggcaccggcctcagcgaatgctgaggttttacangaagaggangagaacgcaagcccacctgatgagcccaccttcgattgtcctctgtgtgaagaagtaaccatgagcaggcaacgtttgctggatcattgc

SEQ ID NO: 4987 - DNA, 575 bp, Mus musculus
  misc_feature (26)..(26): n is a, c, g, or t
  misc_feature (66)..(66): n is a, c, g, or t
  misc_feature (70)..(70): n is a, c, g, or t
  misc_feature (72)..(72): n is a, c, g, or t
  misc_feature (115)..(116): n is a, c, g, or t
  misc_feature (120)..(120): n is a, c, g, or t
  misc_feature (136)..(136): n is a, c, g, or t
  misc_feature (246)..(246): n is a, c, g, or t
  misc_feature (302)..(302): n is a, c, g, or t
  misc_feature (305)..(305): n is a, c, g, or t
  misc_feature (312)..(312): n is a, c, g, or t
  misc_feature (332)..(332): n is a, c, g, or t
  misc_feature (341)..(341): n is a, c, g, or t
  misc_feature (343)..(343): n is a, c, g, or t
  misc_feature (348)..(348): n is a, c, g, or t
  misc_feature (356)..(356): n is a, c, g, or t
  misc_feature (367)..(367): n is a, c, g, or t
  misc_feature (377)..(377): n is a, c, g, or t
  misc_feature (392)..(392): n is a, c, g, or t
  misc_feature (431)..(431): n is a, c, g, or t
  misc_feature (445)..(445): n is a, c, g, or t
  misc_feature (478)..(478): n is a, c, g, or t
  misc_feature (504)..(504): n is a, c, g, or t
  misc_feature (506)..(506): n is a, c, g, or t
tgacactgaccctaaagaggtcactngatttctccaaggtcctaccatcttatatgtgacatagtngtgncnagactccaggcctctcctgctcagtctagctctacaaagttcnntaanagactggtccgcatanataaaggtcaccaggaagcacagtcataaacctggtcccccacctatcagcaccaactctcagttcatcagggttgagaaaggacactggattgagcttctgaaatgccnctggtagctctgtaacatgggaatggaaatgtccctctctgggcctgtgtttcttngtntgtccantgaaggaacagaactagaancccattcancnacctntgagattnttacacagggnttggcttctntatgttagccagggntgctgtaagaactcaggttagtagcatacttgagtaatnagggtcaaagtgtntcaccacaaacaaaggtatcaaatcacaagccnggctggctgaggtggtgtgatagagntntgtggtaaacagcagaacttagggtgcagactgacttattgatttccaccttggcaatggcaataaagg

SEQ ID NO: 4988 - DNA, 473 bp, Mus musculus
  misc_feature (133)..(133): n is a, c, g, or t
  misc_feature (227)..(227): n is a, c, g, or t
  misc_feature (233)..(233): n is a, c, g, or t
  misc_feature (240)..(240): n is a, c, g, or t
  misc_feature (242)..(242): n is a, c, g, or t
  misc_feature (258)..(258): n is a, c, g, or t
  misc_feature (260)..(260): n is a, c, g, or t
  misc_feature (262)..(262): n is a, c, g, or t
  misc_feature (323)..(323): n is a, c, g, or t
  misc_feature (429)..(429): n is a, c, g, or t
ggactatgactacctgaatgactggggaccccgcttcaagaaactggcggacatgtacggcggtggtgacgactgaacggcaggacggacttggcttttggacaagtatgaacagtttcacctgatattcccnaaaaaaaagcatacagaagctaggctttaactctgtagtccactagcaccgtgcttgctggaggctttggcgtaggctgcgaaccagtttgggnctcccngggaatntncagtgatccaatactntntnggaaaacaccgagctcagctacacttgaattttacagtaaagaagcactgggatttatgtncctttttgtacctttttcagattggaattagttttctgtttaaggctttaatggtactgatttctgaaatgataaggaaaagacaaaatattttgtggcgggagcnagaaagttaaatgtgatacgcttcaacccacttttgttacaatg

SEQ ID NO: 4989 - DNA, 430 bp, Mus musculus
  misc_feature (352)..(352): n is a, c, g, or t
  misc_feature (354)..(355): n is a, c, g, or t
gaagcctttgtaattcaaaacatcaaaaatcagattgatttatcatttaagaaaacatataacaaatggtttgcaggagcacagctgatctctctgttagacctggtcctgtctctccctgagggcgctgagacagacttactgcagaactcagacaggattatggcttcattaaatttattgaggtatttggttatcaaagataatgaagatgacaatcaaactggattatggacagaacttggaaaaattgaaaataactttctaaagccacttcatataggacttaatatgtcaaaagcacattatgaagcagaaattaaaaacagccaacaaaataaccaagtagccncnnatgtgtaaaggtgtttgttccgtgactgtaggtggagaagaaatcccttctatgcctcctgaaatgcagcttaag

SEQ ID NO: 4990 - DNA, 367 bp, Mus musculus
  misc_feature (195)..(195): n is a, c, g, or t
tctccggccttttccagatggatgtccctggcttgcagggacttcccaaccatggaccttctcccttggggctgggtcctgccagcctctcctttgaactccctcggcacacatgctccggtctccaggttcgattcctcagactgtcctttagtgcctgtggtaatgccaatcctcacaagtgggttcgacatntaagccacagcaacgcctacgtaattcggatttgaagctccccaagcaaggatatggacagcaatgtgagcaggcagttgaacaggaagaggacattttctttgtggctttggacctggacaggaaggtcccacggaccttatgtgatgcgggaggctcacaaacttacaaa

SEQ ID NO: 4991 - DNA, 564 bp, Mus musculus
  misc_feature (298)..(315): n is a, c, g, or t
  misc_feature (356)..(356): n is a, c, g, or t
  misc_feature (359)..(359): n is a, c, g, or t
  misc_feature (365)..(365): n is a, c, g, or t
  misc_feature (489)..(489): n is a, c, g, or t
  misc_feature (505)..(505): n is a, c, g, or t
  misc_feature (515)..(515): n is a, c, g, or t
  misc_feature (526)..(526): n is a, c, g, or t
  misc_feature (539)..(539): n is a, c, g, or t
aggttccaaggccactgcaaacatttttgccacctatcttcctgaatacatgacactgtggcggggcttcctggatgaggcattcgtgactgggatgctgcagctgtgtctcttcgccatcaccgacaagaagaacagtccagcacttcaagggaccgagcccctcgtgataggcatccttgttaccgtccttggggtgtcgctaggcatgaactccggatatgcaatcaacccatcccgtgacctgcctccccggttgttcactttcattgctggctggggcaaacaagtgttcagnnnnnnnnnnnnnnnnnnagccggaaacaactggtggtgggtgccggtggtggcaccanttntgggcncctacctaggtggtattgtatacctgggtttaattcaccccagcataccacaggatcctcagagactggagaattttacagcaagagaccagaaggtaactgcatcatacaagaatgcagcttntgcaaacataagtggntctgtgcctntagagcacttntaagtagagcttntctttgaccacaaccgtactgcaat

SEQ ID NO: 4992 - DNA, 405 bp, Mus musculus
acagggtcttcttcaggagttgccaaagtgggaggagtcacagaaaagttctatgatgagatatattttgattctgattctgaggatgaggacaaaacagtgaccaagaagaagaagaagaaacaacacaggattccaacaaacgatgagctgctgtatgatcctgagaaagataacagagaccaggcctgggttgacgccaagaggagggggcatgaatcctacaagacgcagtacagggcaatgtttgtgatgaattgttctatcaacagagaagaggttctgagatacaagaatccagaaaacaggaggaaacggcggagtgctaagaagatgaggtctaatcctgaagatcccgcagagagagaagcggaggaaatctatcaccctgtcatgtgcacagag

SEQ ID NO: 4993 - DNA, 486 bp, Mus musculus
  misc_feature (293)..(293): n is a, c, g, or t
  misc_feature (328)..(328): n is a, c, g, or t
  misc_feature (416)..(416): n is a, c, g, or t
ggtgggaccaaggagatgccctcatagacccttccctcgccttcttcctccccggtccgggttccattcttttcaccagcacccatcgcccaaggggtaccaaggggggcaaggggtgtccagtccaagcccacccccgcctcgccttccgcaaaactgtgagcaaaaagcaatagaagcctcgcccccgcccccggcccgtccctttccgcaggatttgccgtctgtagcctccccattccagttcctagacctcatggctgccccctcccgtgacacctccactgcacaanctcgggcgggggcgtgacccccaacccgtcccttntgtggtttccgtgtggtcagcccttccagccgccgacccgggatggggactggcccccactggccctcccctccccatggactctttntgcttgacaatgtagcaaaccccctccctctttctctctccttgacaataaagtctggatttgttctgcc

SEQ ID NO: 4994 - DNA, 511 bp, Mus musculus
  misc_feature (267)..(267): n is a, c, g, or t
  misc_feature (292)..(293): n is a, c, g, or t
  misc_feature (295)..(296): n is a, c, g, or t
  misc_feature (299)..(299): n is a, c, g, or t
  misc_feature (301)..(301): n is a, c, g, or t
  misc_feature (308)..(308): n is a, c, g, or t
  misc_feature (315)..(315): n is a, c, g, or t
  misc_feature (324)..(324): n is a, c, g, or t
  misc_feature (328)..(329): n is a, c, g, or t
  misc_feature (331)..(331): n is a, c, g, or t
  misc_feature (333)..(333): n is a, c, g, or t
  misc_feature (341)..(341): n is a, c, g, or t
  misc_feature (364)..(364): n is a, c, g, or t
  misc_feature (372)..(372): n is a, c, g, or t
  misc_feature (390)..(390): n is a, c, g, or t
  misc_feature (414)..(414): n is a, c, g, or t
  misc_feature (429)..(429): n is a, c, g, or t
  misc_feature (446)..(446): n is a, c, g, or t
  misc_feature (479)..(479): n is a, c, g, or t
  misc_feature (481)..(481): n is a, c, g, or t
gagagtacaaactgcccgacgggaatgtcatttacatcggagaccagctgtaccaggctcctgaggtcctgttctcaccagaccagttgggcacccatggtccagggctggcacagatggcatctaacagcataaccaagtgtgatgctgacatacagaagacactctttggggagattgtcttgtcggggggaagcacgctgtttcaggggctggatgacaggctcctgaaagaactggaacagctggcttccaagggggtccccntcaaaatcacagcgccgcccgaccnntnnttntntacgtgnatcgggncctccattntcanntntntgagcagnctttaagcagatgtggatcactnctgcaganttcaaagagtttggagtntccgtggtccagaggcggtgcttntgaagggctgcacantcccagtagctgcagtntcccttgcaagggacacccatgggaagagagcntntcccatggcctttagcaccacatttaatta

SEQ ID NO: 4995 - DNA, 480 bp, Mus musculus
  misc_feature (68)..(68): n is a, c, g, or t
  misc_feature (333)..(333): n is a, c, g, or t
  misc_feature (373)..(373): n is a, c, g, or t
ggacactggattcagccgagtgaatgaaaggaccttgaaccccagagtgcctactccagccccacagnctgccagcatgagccacaggtcctaccagcctccccagcggatgcaacagacaaatgttgccctgcttggcagggagtctgtggggaacaaggagcccacagggttcactcttaacaaccccagctatgttcggagttcctatgaacaggacagagatcagcggtacctgaccacctacaaccaagggtacttcgagaatatccccaaggggctggatcgagaaggctggactcgaggtggcatccagccccagaaagcaggagnctacgccctcagtgagctgaataaccataccctcatggantccaccccaaatcccacggagaccctgaggcacctgcacccccatgtgggaagaaccctggcttcagttgaccccttctatcgagacatgcctcatagcagccgcta

SEQ ID NO: 4996 - DNA, 549 bp, Mus musculus
  misc_feature (157)..(296): n is a, c, g, or t
  misc_feature (327)..(327): n is a, c, g, or t
  misc_feature (345)..(345): n is a, c, g, or t
  misc_feature (363)..(363): n is a, c, g, or t
  misc_feature (384)..(384): n is a, c, g, or t
  misc_feature (393)..(393): n is a, c, g, or t
  misc_feature (395)..(395): n is a, c, g, or t
  misc_feature (397)..(397): n is a, c, g, or t
  misc_feature (403)..(403): n is a, c, g, or t
  misc_feature (416)..(416): n is a, c, g, or t
  misc_feature (445)..(445): n is a, c, g, or t
  misc_feature (447)..(447): n is a, c, g, or t
  misc_feature (470)..(470): n is a, c, g, or t
  misc_feature (487)..(487): n is a, c, g, or t
  misc_feature (524)..(524): n is a, c, g, or t
tcaacagcaaccacatggcctgtagctttgcagtaggagctggcttcctgtcctttctcagctgcttggtcttccttgccatagatgcctatgagaggcgcctcgtgggcacccgctttaagatagccttccagctcttggacttcattctggctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatactccaggcctacctagccttccaggacntccgagacgaggctccantcccctacaagcgctccntggaggagggtagtgtggtgntgaacaccntntntccatnatccaccagcccntccaaccctcccatcacaggccccaacantntgagttacaccagttcagccctntccccctacatgacgantccaaaggccccacgcctggctatgatgccagacagntaaacagcctgtatacataagtaaa

SEQ ID NO: 4997 - DNA, 517 bp, Mus musculus
  misc_feature (127)..(127): n is a, c, g, or t
  misc_feature (300)..(300): n is a, c, g, or t
  misc_feature (344)..(344): n is a, c, g, or t
  misc_feature (346)..(346): n is a, c, g, or t
  misc_feature (348)..(348): n is a, c, g, or t
  misc_feature (360)..(360): n is a, c, g, or t
  misc_feature (366)..(366): n is a, c, g, or t
  misc_feature (378)..(378): n is a, c, g, or t
  misc_feature (385)..(385): n is a, c, g, or t
  misc_feature (387)..(387): n is a, c, g, or t
  misc_feature (391)..(391): n is a, c, g, or t
  misc_feature (408)..(408): n is a, c, g, or t
  misc_feature (410)..(410): n is a, c, g, or t
  misc_feature (434)..(434): n is a, c, g, or t
  misc_feature (457)..(457): n is a, c, g, or t
  misc_feature (459)..(459): n is a, c, g, or t
ccctccgaagcatcttcaggtgaagtttcgggtgacgaagcaggtgaacaggtgtctagcgagacaaatgacaaagaaaatgatgctatgagtacaccacttccaagcacatctgcagccataacantaaattgccacacatgtgcttatatgaatgatgatgcaaaatgtctccgtggagaaggagtatgcaccactcaaaactcccagcagtgcatgttaaagaagatctttgaaggtggaaaactccagttcatggttcaagggtgtgagaacatgtgcccatctatgaacctcttntctcatggaacaagaatgcaaattatgtgctgtcggaatgaacntntntgcaacaaggtntagatncccgtgccctanttcttgntntganttaggcaggttcaccantntacttggctcaatttatgttcaanttcaacaactaatcacatcgggntntgcctgatcaccagataagaagctcaaaccttgtctttattgataccccattgcctat

SEQ ID NO: 4998 - DNA, 343 bp, Mus musculus
gatgcagccctggacaatactaacattggcaaagtctcaagttacatcaaagagcagagtcaggaacagtttcagatgataatcatttccctgaaagaggagttctactccaaagctgatgcactgataggcgtctacccagagcacaatgagtgcatgttcagccatgtgttgactctggacctttccaagtatccagacaccgaagaccaagaaggcagcaggagccaccggaagcccagagtaccacgagtatcaatgtctccaaagtctccccagtctcgttagaaatgagtatactcttgaacagccaccagctatagaagctttaccctgaccctgt

SEQ ID NO: 4999 - DNA, 45 bp, Mus musculus
gaggctatttgctcaactggcatctttctatgagctccagctagt

SEQ ID NO: 5000 - DNA, 486 bp, Mus musculus
  misc_feature (445)..(445): n is a, c, g, or t
ggacacagctccgactgttcgctgtcggcgcggggcggcgccgcgtcgctcgccttcaccagctgccatgagcgagcgcctccgccccagaaaaaggagaagaaatggcagtgatgatgacaaccaccctcctccccagaccaaaaggagcagtaggaaccccatcttccaggactcctgggacacagagtcttcaagcagcgacagtggtgggagcagcagcagcagcagcatcaacagcccagacagggccagtgggccagagagcagcctgagccacaccatccccggatcctgccccagcaccccccagccgatgcctgagcagtctgcactatgccaaggcccttacttccacatcaaccagaccctgaaggaggctcactttcatagcctacagcaccgaggccggccgccgacatgatgctcctccggcagtttcttnccttctgtgaagggacagcactgtgcagattggatatttca

SEQ ID NO: 5001 - DNA, 346 bp, Mus musculus
gaaagtgagtatgcggctgcaccgtggggccccagtcaacgtctcctcatctgatctcacgggccgacaagatacctctcgcatgtccacctcacagattcccggtcgggtggcttccagtggtcttcagtctgtcgtgcaccgatgagaactctcctttttgctgtgaagggcagacaatgcatggctgatctactctgttaccaatggctttactagtgacacgccccccggtctaaacctgaaatgttaacgccgggagctctccaggccactcacccagcgatgcacatggggaatcaaaacacaaactaaatggacaggctccaagagctgccatcgccag

SEQ ID NO: 5002 - DNA, 498 bp, Mus musculus
  misc_feature (369)..(369): n is a, c, g, or t
  misc_feature (371)..(371): n is a, c, g, or t
aaaactcaccaatctatatatcgcggataattccaggtggaattgctgacagacatgggggcctcaaacgaggagatcagctactttctgttaatggagtgagtgttgaaggggagcaccatgagaaagcggtagagctactgaaagcagcccaagggaaggttaaattagtcgtacggtacacaccaaaagtcttggaagaaatggagtcccgctttgagaaaatgagatcagcaaaacgcagacaacagacctaatcatttaaaaactttgtgttccttttgcttttagctaggaaagttttacttgtgacctactgatggcctccacgccagtgattgtaaaacaccagaaacttcggtgacctcntntcttgccattttataaatgcctgttttagcatcacttatggttatagagaagcatacactgtttttctcacgagaaaaagtcagagttggtgaggacagttctgtcctgctgtttttacaggccttt

SEQ ID NO: 5003 - DNA, 538 bp, Mus musculus
  misc_feature (334)..(334): n is a, c, g, or t
  misc_feature (336)..(337): n is a, c, g, or t
  misc_feature (393)..(393): n is a, c, g, or t
  misc_feature (432)..(432): n is a, c, g, or t
acggagctttaccaccagaagtcggtcctgataatggggcggggctaccattatgctacatgccttgaaggggctctgaaaatcaaggagattacttatatgcattcggaaggcatccttgctggtgagctcaagcacggccctctggccttggtggacaagttgatgcctgtcatcatgatcatcatgcgagaccacacttatgccaagtgccagaacgctcttcagcaggtggttgcacggcaggggcgtccagtcgtgatctgtgataaggaggatactgagaccattaagaatacaaaaaggacaatcaaggtgccccactcagtggacntnncttgcagggcattctcagtgtgattcccctgcagctgctggctttccacctggctntgctgagaggctacgatgttgattttccacggaatcttnccaaatctgtaacagtagagtaacagacacctgaaacttaagacagttaagcaacacgagataccttttgtatttaaatttttgatttaaactattgcctcctgaa

SEQ ID NO: 5004 - DNA, 539 bp, Mus musculus
  misc_feature (124)..(124): n is a, c, g, or t
acaatcaacttgagcacttggttcaagaatatcgtggggcccaagcccagctaagtgaggcaagggagcgctaccagcagggcaatggcggagtaactgaacggaccagactcctctctgaggnttacagaagaattagaaaaggtaaagcaagaaatggaagagaagggcagcagcatgacggacggcactcctttggtgaagattaagcagagcttaaccaagctgaagcaagaaactgttcagatggacattagaatcggtgtggtggagcacacgctacttcagtcaaaactcaaggagaagtgcaacatgaccagggacatgcatgcagctgtcaccccagagtcagcaattggcttctattaaacacgtgggcttccatgcttctgattatttcgtttttatatcaaatgattttttaatgttgcattgatttccaaacacaatttatacttcttcaagcatattcagtgggtatttttgcacatgtgttaatatcatggtgattatgatggccaaagcctgtacaatgaata

SEQ ID NO: 5005 - DNA, 510 bp, Mus musculus
  misc_feature (212)..(212): n is a, c, g, or t
  misc_feature (221)..(221): n is a, c, g, or t
  misc_feature (254)..(254): n is a, c, g, or t
  misc_feature (257)..(257): n is a, c, g, or t
  misc_feature (297)..(297): n is a, c, g, or t
  misc_feature (303)..(303): n is a, c, g, or t
  misc_feature (306)..(306): n is a, c, g, or t
  misc_feature (336)..(336): n is a, c, g, or t
  misc_feature (342)..(342): n is a, c, g, or t
  misc_feature (363)..(363): n is a, c, g, or t
  misc_feature (365)..(365): n is a, c, g, or t
  misc_feature (371)..(372): n is a, c, g, or t
  misc_feature (374)..(374): n is a, c, g, or t
  misc_feature (379)..(379): n is a, c, g, or t
  misc_feature (383)..(383): n is a, c, g, or t
  misc_feature (410)..(410): n is a, c, g, or t
  misc_feature (412)..(412): n is a, c, g, or t
  misc_feature (432)..(432): n is a, c, g, or t
  misc_feature (434)..(434): n is a, c, g, or t
  misc_feature (437)..(437): n is a, c, g, or t
  misc_feature (443)..(443): n is a, c, g, or t
gtccaactattttgaccccaccaagatcaacctgctggaggacgactgagtggggcttaagcagcgctaccctgctcactccccagagaatctacccaagggattgaaagaagaaaagagtgttactccagctaggcctgtcaatttttttggccaagggcccacacctcagtaacactgattgacctaaatatgctaaagagatgggaggnacaattatntccttaatgagagaatgtattttccttggccgnaantctgtgggctctagtcacctgtggggccttcaccttgtgntctgcntanttcctggagttctaagttccaaaacgcatntgtttnttttccccatcttttgaatantngccaanntntgggntccntccccccaccattgatgtactgggctntnttgctttatttgtatccccntnttntgcttntgccatggggctgcttgggagcctccattactaaacttcatatgtaacccaaggaaggcgtggcttt

SEQ ID NO: 5006 - DNA, 409 bp, Mus musculus
gcaaatgactgctgacctggagacatacagtgacctggcagctttaaaatcatcagctgaagaaaagaagaagaaattgcatcaagaaagaacagtattgtcaactcacagaaatgcctttaagaaaataatggagaagctgacctcagattatgatacccttaaaaggcaacttcaagacaatgagacacatgctcagcttacaaatttggagaggaagtggcagcacctggagcaaaataacttcgtaatgaaagagttcatagcaaccaagagtcaagagagtgattaccagccggtgattaaaaatgtgatgaagcagattgcagagtataataaaaccatcatggatgctctacataatgccagcagaagctgaaactgagccgactgagtctacaagcatcct

SEQ ID NO: 5007 - DNA, 507 bp, Mus musculus
acagcctgggatgttcatgctggatggaaacaacaacctggaagatgactccagcgtgagcgaagacctcgaagtggactggagcctgtttgatgggtttgccgatggcttgggagtggccgaagccatctcctacgtggatcctcagttcctcacctacatggctctggaagagcgtctggcccaggcaatggagacggccctggcacacttggagtctctcgccgttgatgtcgaagtggccaacccaccagcaagcaaggagagcattgatgcccttcctgagatcctggtcaccgaagatcatggtgcagtgggccaggaaatgtgctgtcctatctgctgcagcgaatatgtgaagggggaggtggcaactgagctaccatgccaccactatttccacaagccctgcgtgtccatctggcttcagaagtctggcacctgcccagtgtgccgctgcatgttccctcccccggctctaaaagccaaggctcgtcgtaacagtca

SEQ ID NO: 5008 - DNA, 548 bp, Mus musculus
  misc_feature (432)..(432): n is a, c, g, or t
  misc_feature (447)..(447): n is a, c, g, or t
  misc_feature (451)..(451): n is a, c, g, or t
  misc_feature (469)..(469): n is a, c, g, or t
atagcctctgatggcctgctaatggcaaatgtcaccatcccaggccctaacgaggagctggggattcgatttgccaatcgcccctttctcgtcttacgcggtcgatatgggtatgtgggctcctcctccgaccacgacctgctgaagtgcaacatggatcaacctgactgtattcagctattgccctgtcgccagggcatctatcactttcaggcacagggtggatccttctggtcaataacatcctttggcaccttccgcccttggggaaaatttgccctcaacttctgcatagaactacaggggagcagcttgctcacggtgctggcacccaatggcttctacctccgagccgaccggagtggcacactattggcagacagtgaagaaattaccaaagaatgtatctgggaattttaggtcaatgggatntcacctgccaaactntcantcctccaggaacaacctntgaactaaacagggcaggagccccagagtcacgatccacgaggaggctgtgtgctgtgcgatttttcctacctagttta

SEQ ID NO: 5009 - DNA, 551 bp, Mus musculus
  misc_feature (102)..(103): n is a, c, g, or t
  misc_feature (294)..(294): n is a, c, g, or t
  misc_feature (319)..(319): n is a, c, g, or t
  misc_feature (346)..(346): n is a, c, g, or t
  misc_feature (373)..(373): n is a, c, g, or t
  misc_feature (377)..(377): n is a, c, g, or t
  misc_feature (384)..(384): n is a, c, g, or t
  misc_feature (397)..(397): n is a, c, g, or t
  misc_feature (416)..(416): n is a, c, g, or t
  misc_feature (421)..(421): n is a, c, g, or t
  misc_feature (429)..(429): n is a, c, g, or t
  misc_feature (439)..(441): n is a, c, g, or t
  misc_feature (450)..(450): n is a, c, g, or t
  misc_feature (452)..(452): n is a, c, g, or t
  misc_feature (517)..(517): n is a, c, g, or t
  misc_feature (519)..(519): n is a, c, g, or t
ttcgacaaccggaacctgggcaaagggaccagcggtctggcggaggagatcaccttccaggacttcctgaccatcatctcctacttccggccgctgcggccnngtctcaacaaagaggaggcggagcagaaccgcaaggacaagatgcggttcctcttcaacatgtacgaccaggacggcgatgggatcattaccctgcaggagtaccgccgggtggtggagagcctgctgtcggcgcacccgcaagtggagagagacactgtgcgctccgtcgccaatgccatcgcccagggncgccttgaaggaggcggccagggcntcggaccagccgctgatggcgggccancagtatgagggcatcaccttcgagganttcntcaaganctggaagagcctncgaattggaggtgaagatngcaantcagcttncctgaatctnnnaagccacgntnttatgccagtgaccggcgggctgccacacccacactggagaagctgccccttgaatccggcagantnttgcagcagctacagggtacatgggacttgat

SEQ ID NO: 5010 - DNA, 544 bp, Mus musculus
  misc_feature (321)..(321): n is a, c, g, or t
  misc_feature (346)..(346): n is a, c, g, or t
  misc_feature (348)..(348): n is a, c, g, or t
  misc_feature (363)..(363): n is a, c, g, or t
  misc_feature (373)..(373): n is a, c, g, or t
  misc_feature (375)..(375): n is a, c, g, or t
  misc_feature (396)..(396): n is a, c, g, or t
  misc_feature (407)..(407): n is a, c, g, or t
  misc_feature (410)..(410): n is a, c, g, or t
  misc_feature (412)..(412): n is a, c, g, or t
  misc_feature (445)..(445): n is a, c, g, or t
  misc_feature (452)..(452): n is a, c, g, or t
ctgcttctgctgagttttcatgttctcatcactcctgtctcgaaggccaataaagaaacaaacagatctgttcatttcattcccacagtggaatttgccgtgaacacattcaaccaggaaagtcaggatgaatatgcctacaggatggaacatatcatgagttcctggagggagaaggtaaattttccaaccgtgtattccatgaggcttcagctgcgtagaaccatatgcaagaaatttgaggagagtctcgatatttgcccctttcaggagagccatggtctgaataataccttcacctgcctgtttactgtcggtacntatccctggataacaaaattcaagntnttcaggagtgtgtgntcatagtttntntgatgggagtcacccatggantggtcacgtanttntntgcatccgtgaaggggttacccttggcagaacntctgtgntcattttccttgttttgcagcattgtgcagtatcaagactggatatgtggataataatgaggggaaagtgtacattgctgttgtttcatcat

SEQ ID NO: 5011 - DNA, 556 bp, Mus musculus
  misc_feature (138)..(138): n is a, c, g, or t
  misc_feature (248)..(248): n is a, c, g, or t
  misc_feature (266)..(266): n is a, c, g, or t
  misc_feature (299)..(299): n is a, c, g, or t
  misc_feature (310)..(310): n is a, c, g, or t
  misc_feature (313)..(313): n is a, c, g, or t
  misc_feature (345)..(345): n is a, c, g, or t
  misc_feature (347)..(347): n is a, c, g, or t
  misc_feature (357)..(357): n is a, c, g, or t
  misc_feature (367)..(367): n is a, c, g, or t
  misc_feature (410)..(410): n is a, c, g, or t
atgcccttcgacgactcggacattgctggcctaccccggcgccagaagcgcggcgtgctctaccctgacggcctcgaactgtcggaacgatgcaaatccttgatcgccgagctgctacagttcagcccgtctgcccgnccctcggcgggccaggtggcgcgcaatggctggctgcgggccggggactccggctaggagccggggttctcgctgttcccgccgcaccaggcacagagccagggcggcgnacgcgcgaagggcgagcnttcgggaaacccgcgaagtcgccgcgcgccacntgcgcacgcgnccntgtcccttccccttcccccacggcggcggccntntgaggcctgntgttgggttntgattcctcctgcacaaactgattgctggagagcgcatgcgcntcctcgatttctggcgagaaggccccgggaggggcgcaaagagaagagagagaagcattgcgcctgcgcagaatgagctgttgcacggtgggttgccatgctacagagaaaccgtgggccagccgtgcacgctaagttccaggttg

SEQ ID NO: 5012 - DNA, 543 bp, Mus musculus
  misc_feature (318)..(318): n is a, c, g, or t
  misc_feature (329)..(329): n is a, c, g, or t
  misc_feature (331)..(331): n is a, c, g, or t
  misc_feature (374)..(374): n is a, c, g, or t
  misc_feature (404)..(405): n is a, c, g, or t
  misc_feature (413)..(413): n is a, c, g, or t
  misc_feature (473)..(473): n is a, c, g, or t
  misc_feature (498)..(498): n is a, c, g, or t
  misc_feature (513)..(513): n is a, c, g, or t
  misc_feature (515)..(515): n is a, c, g, or t
  misc_feature (517)..(517): n is a, c, g, or t
aatggtctctgtaccaggactctttgtgctgcagacccctgtgctaccccaagacactctaagctggagctgtgtggtggcagtggggctccttgcattggtttcctttgtatgtgtgagctatgcagtcaccaaggcccaccctgccctggtatgtgctgtcctgcactctgaggtcgtggtagccctcatgctgcagtattacgtgctctatgagaccgtggcaccttctgacatcatgggagcaggggttgtgttgggcagcattgccatcattactgcccagaacctcagttgtgataaggaagggcaaacggnggaatgaaatnanacttgagggggggaggggggacaggggtaaataggagagatgngaataaaaaccatgggagaacaaatgcctnncaaagaantggtgtggaggaccagtgagatagctcagcagatagaggctaatgctaccaagcctgatntatatggtagatggagagaaccgantcctacagattattntntntatacattcgctgtggcgtgcttaca

(The sequence listing continues in the following parts.)

The invention claimed is:

1. A method of identifying or not identifying an organ- or tissue-specific highly expressed gene, comprising the steps (1) to (4) below;
   (1) providing 2 or more samples of gene transcripts from each of organs or tissues including fat tissue, urinary bladder, blood, femoral bone, brain, spinal cord, hypophysis, thyroid, gallbladder, bone marrow, adrenal, skin, blood vessels, mammary gland, colon, esophagus, heart, kidney, liver, lung, pancreas, prostate, skeletal muscle, spleen, stomach, testis, thymus, ovary, placenta and uterus,
   wherein the samples of gene transcripts from each organ or tissue are isolated from different individuals,
   (2) measuring expression levels of a specified gene group for all of the samples,
   (3) acquiring, for each gene, (a) a minimum value of expression levels in said 2 or more samples from a particular organ or tissue and (b) a maximum value of expression levels in all said 2 or more samples from the other organs and tissues,
   (4) identifying the gene as a gene highly expressed specifically in the particular organ or tissue if the above-described (a)/(b) ratio is larger than 1 or not identifying the gene if said (a)/(b) ratio is not larger than 1.

2. The method of claim 1, wherein the gene is identified as a gene highly expressed specifically in a particular organ or tissue if the (a)/(b) ratio is not less than a given value between 2 and 8 or not identified if the (a)/(b) ratio is less than the given value in step (4) of claim 1.

3. A method of identifying an organ or tissue from which no specific highly expressed gene is identified by the method of claim 1, further comprising the steps shown below;
   (5) acquiring, for each gene,
      (a) a minimum value of expression levels in said 2 or more samples from an organ or tissue in which no specific highly expressed gene has been identified in step (4) of claim 1 and expression levels in said 2 or more samples from another particular organ or tissue in which a specific highly expressed gene has been identified in step (4) of claim 1, and
      (b) a maximum value of expression levels in all said 2 or more samples from organs and tissues other than each organ or tissue (a) above,
   (6) identifying the gene as a gene highly expressed specifically in each organ or tissue (a) above if the above-described (a)/(b) ratio is larger than 1,
   (7) measuring expression levels of (i) a gene highly expressed specifically in the other particular organ or tissue and (ii) the specific highly expressed gene identified in the above-described (6) in an unidentified organ or tissue,
   (8) identifying the unidentified organ or tissue as said organ or tissue from which the specific highly expressed gene is not identified, with the expression levels of the specific highly expressed genes of the above-described (i) and (ii) as indexes.

4. The method of claim 3, wherein the organ or tissue is derived from a mammal.

5. The method of claim 4, wherein the organ or tissue is derived from a human or mouse.

6. A method of identifying an organ or tissue from which no specific highly expressed gene is identified by the method of claim 2, further comprising the steps shown below;
   (5) acquiring, for each gene,
      (a) a minimum value of expression levels in said 2 or more samples from an organ or tissue in which no specific highly expressed gene has been identified in claim 2 and expression levels in said 2 or more samples from another particular organ or tissue in which a specific highly expressed gene has been identified in claim 2, and
      (b) a maximum value of expression levels in all said 2 or more samples from organs and tissues other than each organ or tissue (a) above,
   (6) extracting identifying the gene as a gene highly expressed specifically in each organ or tissue (a) above if the above-described (a)/(b) ratio is not less than the given value,
   (7) measuring expression levels of (i) a gene highly expressed specifically in the other particular organ or tissue and (ii) the specific highly expressed gene identified in the above-described (6) in an unidentified organ or tissue, and
   (8) identifying the unidentified organ or tissue as said organ or tissue from which the specific highly expressed gene is not identified, with the expression levels of the specific highly expressed genes of the above described (i) and (ii) as indexes.

7. The method of claim 6, wherein the organ or tissue is derived from a mammal.

8. The method of claim 7, wherein the organ or tissue is derived from a human or mouse.

* * * * *

UNITED STATES PATENT AND TRADEMARK OFFICE
CERTIFICATE OF CORRECTION

PATENT NO.        : 8,535,880 B2
APPLICATION NO.   : 12/447446
DATED             : September 17, 2013
INVENTOR(S)       : Saku Miyamoto, Kenji Takami and Akira Horinouchi It is certified that error appears in the above-identified patent and that said Letters Patent is hereby corrected as shown below:

In the Claims

Column 30, Line 29: Claim 6: delete "extracting"

Signed and Sealed this
Twenty-seventh Day of May, 2014

Michelle K. Lee
*Deputy Director of the United States Patent and Trademark Office*